United States Patent 7,420,044 (NUCLEIC ACID AND PROTEIN HOMOLOGS AND USES THEREOF) - sequence listing, part 3

SEQ ID NO: 7832 - DNA, 1374 bp, Homo sapiens
  misc_feature (1)...(1374): n = A,T,C or G
cagacccaccgacacagagagaggaaaagaaagagagaggcgcgcgagggagagggctttcggcggggagaacaggagcgcgagggcgaaggttagagaaagagacgacaccaagagaaccgccccacgcccgcaaccaaaaaagcgagggccgccgcgtaaagaaagccagcgcgaaggcgccggagaggagcaaagaaaccaacacaccgccagagaagaggagggccgagagaaggaaagacgaggagagaaggacgcgccacaggcggagcgcgcacagcgaaagaacagagagagagaaccgacgaaagaagacgcccggcagaggaaacaacagaggcacgagaacagaccgccgagaaacgaaaagggaacgccgcgcacccgaacacaaagagacagaaaggagcgcaggagaacagagagaagaagagagaagaagacgagcacgcggagcgaggaacagcacagggcgaacaccagacaggaggcaccgagncggagagtcaagnaccgcagcgcacaacacgacggacgagaacagcaatagaaagcgcgcgcccgagacgcaacagaaacaaacgacgaagaaagaaagaaatgatcaaccggcggcagcgcggnaacaccacgcgaccccaccgcaaaacagacagtgcagagcagaggtcacgtcacaacggacggacaccggagagcgcaacgaggacgggagacgcacccaagccacggaagcaaccgcaaaggcacgcgacccagtcagagaagaacgacagaagaccagcaggaaaagaacgcgtgaaagaggcaaccgcgcaaggcgcggaancggcagacgaacaaaagggcgaggccggagaacgacggangagcagcgcgcggcgccgccgaggcggacaccgcgcggcgtcgtggaggagacggcgaccgagcgaaaagcgcggccgaacaggaccagcgcacaggcacgcgcaagaaagaacacgcgcccggcagaaagaacacgaccagcgacaacaggacaccaagacgcacacagcgcgacgcaccggcgcagaaggcgaagcgcagagacagcaccaacgcacaatagagcacgacacacacgcgagacgacgaatgaaggcgaaaggagccacagnacacgcggcgatgaggcgccgcgccgacgccggaagcagaagagagacgcgagccacagccgcaccgaaaggcgcagcgccgcacaacagcgcaccagtagaagatgacaacaacacgcgacgnagagacagaggaggagagaatacggcaggcagcgcgcagaggaagcagaaggcgcagacaggagtatccgcgcagcgacaccacgcagaagacgtcgaaggcagg

SEQ ID NO: 7833 - DNA, 1003 bp, Homo sapiens
  misc_feature (1)...(1003): n = A,T,C or G
agactaacataatcactaaatagagacaacgagagagggaggtcttattggggacaacgcccggaatctcgcccgctacaccagtccctacacccctcttggagatgctactatatttaaaatgataggctgagggcgacacaatctaccataatttcctagtagcactacttctgaaaagtgtcgattatctgatacaaaaataacatcaccaggccgtcaaaggcgctcacaccaggatacaaacacgtcaatattatatcccctctaacaacccatactattaattcatatgacttgtaagccagggagggggagaatttccctacaccgtacataatttctgcactaacccatgtattcaacctttatttagtgggataatacaaatgatacaactatggcatgcatcgtnaagggcttgacacacatacatgacaaatacccatatacacttggcgattagctatacaggatgcagcatacctagtaagcataaagatgtaatatccactagattaagcacgtagaaaaagaattgccagactgacattataaccgcacacgaatatctaatagtgcatcatcgcagccggtatgagctataacacaagtgaagatcgctatcaaagatgattagaatgaaatgcgtgcggaacagcggagttgtgtagtaaccatcgacgccctcaatcaaactctaacagcccagaacgccagacgaacgtatgatgactactcttacacgcaataataataccttatatttgctttaattatattacggcaggcaactatcatatacgattctcaactccctgtgaagcattttccagaatagataccctaaacaacgatatctacgctatctctcgagtgctcccgataccgtaaggaccacatggctataactctccttatgggcggtatagttcactctctgttgcgcactatgtgcagcgcggagaagtattgcctgcccttgcggcacgcatctgataaa

SEQ ID NO: 7834 - DNA, 933 bp, Homo sapiens
  misc_feature (1)...(933): n = A,T,C or G
ctattgaaacatcccctactagatccaaccattcgaatcattcctgacacaaatgaatctgtagtggtcataaagacccgcgactgacaaaacgcataaactaggtgtgtaacaaaataatttctagctaacccctgtgagtttcatgtgtaacactccattactatccatcttctaagtgcgtatcttttgtaatactanatctacggacggcaaaaggcacagaaataaacaataatccaccatcacggcgacctacacatgtagaaaaagtatcggggctgctcttctgtcgcacttaccaataaatagctacaaaggtgccagtacaatacaaccgaaatctctcacagccaccactaacagtcacatcaaattatgttagtggtcacacagagtgaaaacataagccgacatagctaagaccacattccacgccaaagtataaccaaaccattcgggtgtcctaacccacaagttgttcgagtttcatttatcctgggtacagtcatttccccccaataaggaatttatccctttgtaacacttttttttgatagcttaacacaacctccaacatagtatatgggtggccaatattcctgtgtgctgcttccctgatgatgtttaatttcatctcgtttttccaacaaatccaccatatacatccagcataaatgaagttgacatgcaactttcttcctcactgccttaaacgtctactcagctttctgactttcttctacctgtttcagttttaaggcttccttcaaggattttagaaattttgcacaatttaacatctgaatgtaaagttatagaggaatgtcttggactttttcttaacacctgcatagcccaactgagttttataataaacacggatgcgaccgcttaccttcatttttatacccagcagctcgcaactcacct

SEQ ID NO: 7835 - DNA, 407 bp, Homo sapiens
ctatctcccctcctccctctgacaggtttctcctgttccatttaaccccttttctctttcgtcgttcttaccttctccgtttgcctacagacgcggcgttcatgatcacccttctagacactctttgtcctccatacgtcagatcgcctgtttgcccgcagcgataaactccgcagttcttgcgccccatccacgttttcgaaatcaagcagttttaagtattcaatgccgtacagttgtttctataatacggcgggcaacaaagaacggtgtccgactggccttctctggattcctgggttggtctcccccagtcccagaaaagctttttacgggtccatggccagtaaatagatatgcaggctttcgatatccatgaattagagtccttcgctcatgataatttt

SEQ ID NO: 7836 - DNA, 953 bp, Homo sapiens
  misc_feature (1)...(953): n = A,T,C or G
gtgtgtataagattagaaggacgaatcgaactgtgggagagaagtcgaagcacacatcgctgagttcgcagaataacaacatgccgaattacaagcggtatcttcataacgtggtcaccctacaatggatgttacaaccatggagagcgattaacaacacggagggcggtatggctgacaggcgcggaatggcgtatacgacaaacaagggtggtgacaataactagagactgtacccaatcaatcacagggaaagtgtacatggttgtacaccgacacgcgaatcgtgcaagaggttatacaatatcgcggaccaaggcgggtacaggggcctgcatgaaccagaacaacgagcgattgtatacagtcgggaagttagagacgcggaacggatagcgagcggacggtaaaaaaaatcagatgtctgatattgaacaacacgattggggaagacatcactgcgcgcatatagacagtaacggactggttgtaatatgtactatgtatgactgatatgtaagacaaattatcgatcgcggtaggtagacgcaaaatacgagaactactcgcgtgggtgataggtctaaatgtggcctctattcagcctcagccaggaccgtcaacacgattaattccaagcgcgaagttaaaatcatagaatctctggagaattggaatatatgcacttcaacgagggtaataacaggggcttacgcaccctaggccgcacgtctgaagatgacgctctcagtttccctactttaaaggttttgggactggggctgatcccctcaatagattcctggcttctcaacttacagatggcctatcatgggactttagcttgtgattgtgtgagttaattataccttacataaatccgctgaacgcagtaaagtgcanaatcttacagtactatataaccgaccgcggtagcgagacatgagggacac

SEQ ID NO: 7837 - DNA, 1262 bp, Homo sapiens
  misc_feature (1)...(1262): n = A,T,C or G
cacagtgttgagcataaggcgctatcgtcgcgcagtgtggccttatagtctacagtctcacatttctctcgagtatccacaccgagcngtctgtcgtcattctcatnctcacgtgatgtgtgtgcatgcctttgcaggtctcatatagtnttgtatctcgtccttgctgtctcgcttgtcctcactcatgtggtcatgcgccaggctgtntgcgtgtgtgtctctatgctcgctcgacgtgctgtattgtgagtcttattctatgtgcgcgctgatgtgtgttctcgtctgcactacgcgcgtatgtagttctgcgtcttcttatcctgtctggtncgtgttcctctacgatacgcgttcgccatgtactctcgtgctcttcagcatnttctctttgttgcacgtgctccttgctcgtcgatgatgttgtgtagctcgtcatggtgcgactcgtgagctacattcgttacataggacgcgactcgtacgacgggtgcagttgtcgggcacgcgtcgatcgtgcgtctcctcggtgctgttctcgtagggtgcgcatgatcgccagtgtgcgggtttctctcaatgttgcgttcttgtgcctcgtgtntctggcccggcgcgcgtctgtgtgtcgttccgtgctcgnctgttcgtctttcttcccttcctctctctctctgttggtngtggccttctgtcgctggtcgcggttcggtatgcgcccactcgcgcggtgggtggtcgctctcggttcttgctgcttgttcctgtccntgtctgcttccgcgttgcgcttttgctgggctgtgagtgttgtcggctttttgctgtttctcccccgcgcccgcntggtgcgctcgtgtccgttcctgtccgcgtctcttcttggtctctcggtgtcctgcggtggcctcggttctcgtctcttcnctcgtccttacacactcgtgtatcagagaaggaagagctctcagtctgctcttggctcggtgcggcggtgtccgatctgtgtcgtgggccgccactatagcggtacaggtgccttcacgcgggctggtggtccttttagtcctcgatcggcaatctctccgcttcgagctctgtgggaatcctgcggcgctgggacccgatggtatgcccatctgagctgtagtctggccctcgtcgtgcatgcaggctccgtgnagcctggtaaggtaagagagtcgtcgacagctaggcccccccctctttttcttcttatctgttctccccctcctctc

SEQ ID NO: 7838 - DNA, 1796 bp, Homo sapiens
  misc_feature (1)...(1796): n = A,T,C or G
gcagatggcctcatcatatgtagtcccgcctcttagcacacctcgcgtcgtctngctcacgcgacttgatttagtancacacntctgctgtagacgtcgtcgtagcatatatatacacntcaatcagtcgtcgtgacgtattanatagtngcgagaatagagcaganacgtcatgacgcgctggataacgtaacattcnananantccgcngntatgcgcatgtgacgangncncgcgcgagcgngcgtgtgacggtgtgtcacgatctcctgacntatgcgngtctgtacgtagtatgtgacgcacatgcacgcagcgacaattgtgtctatacatatacagttacacgttnaacacagtgtgtaggagatcgncctnttgnctactcanacgcgncgctcgcgctggagcgncgagcgctctccttcgatgtgcgggcgaatacgcgtcagcatgtgcacaactatcatgtcaacgtcgcgacggcatcatagacgnaacgcggcgtcgtgttacctacagcgtgtcgactcgtgcgacgtcacatcgtgacgcgcgtatctcaagtgcgtcgacnctgagactacgtcatagatactctcgctgagaactcagagatgctacctgtgtaatactcgtgagcgactgtgtctgtgcgacacgtacacaacgccgtgcgagcganggtgtccaggagcgcggtgacgagcttgtgcgctctagatcacacacactactgtcgtcgcttacacgtcgtgtatgcgctacacctaccggtgtctcctcgtgtacgtatgtcaaatcactcgacggtcgacgtctgtatccactgagagtagtcgcatgcgagagcggangccacanccaggcgtctgatgacatctggactcacgatctctgcgtgcagaggcgatgcgtaacatagcgcgacgcagtcatagcgatatcgtcagagcagataacacgagtccggtacgtgagtgctcnagtggaacactacgcgacgagcgtacggaagatnatacagtcatatgttgcgcgcaacgtcgcgcggcgcatgcgatagnagactggcagcgcagtgagctctagagatgcgggacgcaagctacgcgcgtcatacntatgtcgtgcgacgngtcatcacacttcatagtataatagtatcgacgtgccgagctgacgcagatagcgatgagagcactatctgcacatcgctcgcctgtcggcctgactattcntgtcgctggctccttcatgctctgtcagtcgttctagcacggctctcagtgtgactcgcgtccaccactaacctntatntgtctagtctcactatctacgtacctntgcatggacacgcggcatttatcctacgcaccgcgacgcagccacgatcctatctcgtgaatgagtgacggtagtcanatcgacantatanacacgatagcagatgtgtggcgagtcgccggattgacacagtcgctgtgtcagcgaccggcagatgatctacgacattgcatatcgctcatctacagcnagtggagtggttagctgtctaatacatagcgtctcacatggtgatcantgtgttgagacggctgcacgtagctgcgaatcgtcaaatccttcgatacgccgcactgcttgcgtgtgacgtattgtcgagtcgctagtagctcanccgagctcgggcagttgtagtgagaacggcgcgatcatagagntntgcacgccatgcgatatcaactacctgtgctgaggtatgggtagcacactagacgtaccgcgcagctca

SEQ ID NO: 7839 - DNA, 1894 bp, Homo sapiens
  misc_feature (1)...(1894): n = A,T,C or G
ctngtgtcgagcatccgctgggagagcacgtgctctncattactctatcaatcgctgcgtcgngtctcgcgcactcgctcgctactactctccgtgactcgatangcggagagacgcatttcattgtcatcgtgaatgcagatcgtgcgcgagctgagatgcgacacatancacgtcgatcgggtgcacgctctcactatctaganctcgatggtngtcgtgtctaacgantncnccgagcatgttcgcggactcggtcantcatgcgtcacacagtctctctgcgtgacanaggtgcgancgagacggtcgtgctctacgcgcgtcgctcgtctctctgtcgctacactcgcntctaggcgncnggcgtnatgactgttgactacatcgacgctactagtgtctctcatcgtatctagactcgaccntctgccgnccgcagcancgntgtagtcacactgtgcgacatcactcgtgactctncactactntgctgngtgcgcatcgtctntctgtgatggngctctatagcatcctatcacgtcatgtctacggganacgcncantggacgcgatacgcgacgacttatgtgagtagtcgcatgactactatgnaactacanaatcagcgtgctcttcatgctagttantatatctgtgatcacgctncgntgtgtgntntcgtctcacgccactctgcgcgtgcctcatagctgtggncatatggtctagacgcggctcgccggtgtnggcgtggcggcgtactcgagtgcagtctgacagtcnatgtgtcgtgcacagcgcgtagtangntgacggatctaccacagcatgtnggcgtgcgtcgtgctagnccaacttctgtcatcggcgctcggccgcgactcactgtacncatctatcagtngagtatcgccgntggtttagtcgatacanctcattcctcagtgtacgtgtactctcgacgntgtatgatngcgantgacagcactacatcgtaccacactctctactcgcgtgcagtgtatgatgcgcgcgatctcagtagtacgatgntnggtntgtccgactgctcgtcagtgtgcgatcttccgcctgtgcacgtntgacggggcggntcgcgcctgngataatgctcagttctatcctgggtacgagtatctcgagcatccgtctgctgtactctcatcttgccgcgtctaaganggacgtcgtagngacgccagtctgacgtgcgatcgnatgtgcggtanctacagagagtcgtagcgtgagccgctgtgtactcgcagcgatcactntctcgtcntgtgcagctctcgatgcgtcctacgancgtgcagtgtactgtctccgtacancnacatnactcatcacaggtgtgagcatattgtcgtgtcggtatcactcctactgtgtccttatngcgcttagcnagtngtcgnncgtgccgttatgcacgcgtctgacgtcgtcgtgatgcggtgagagacgctactagcgatccgtatcacctgtacgcatgaatncgcagtcntnacatgcgacgnctagcanctngcgagcgcgtcgncagtatacgtcgtcaggcgcgcgtcaccgcagtcatctgtctaacactcttactacgagatgatcggacgtgatgacgcgtgatatcgctaataaaaggacgccgtgacgcctgcgaggctgtgtcgtctagcactctgatcatcatcaatcacccttcatagtgggtgtctggtgcctctctctgnctacaacatgattcgcctctcggtgtggtggttctcgcgaccacattngacgctgcgtcattnatctcgtatagctgtngatctanttgtntgtctgtgtcatgtgactcctttaacgtcacatcagtcccaca

SEQ ID NO: 7840 - DNA, 1269 bp, Homo sapiens
  misc_feature (1)...(1269): n = A,T,C or G
aaggagagccaggcaacacgcgggcgacgaaagacacaagaaaagaagaggggaccctcctacgaatgactnacaaggcggagaagcctcgngggaggggggaaaccgggaggcaacaggggggaagaaaacaacgacgggggaggccggaggtttgaggagaggggaggagagaggcgagaacaangacaagaggagcggaagggcgagcgcgcacacgaccaccgcaaacaaacgagcagccgcaccggcagagagacgaagggggagcgacgccacgccaacaaaaaccgaaagcgcacggcgaagcgagaccacagccccganagacgacaacaacagcacagaggcgccaaccaaagacaaccagcggacgtttctctttacgacgcgaggacaagggggaacgaaacgcacaacgccaaagagaacaccaggggggaagcaggggagacgaacaagngaagagacagctagcacgagaaagatggaacgcgccgagcacaagacacgcggagggcgagcaccggacgagcaaacaatgnaacaaacaaagcgagcacacggagccagacaccccccagagagcggggggacaccacacgcgggcaccccaacagaagacagagcgaaaaccgaaacgagggacgccacacccaccacacggacccggacggagcaagcaacagcgagaacaacagcacagcagcggaccanacganagcgggggctaccaacccccccacagacaacgagacagggggcgagagacaggcgggacgcacgacgagggggaacggaccagcacgcagaccagaggagcgggcggacacgaacccgaggaagggggagcgagaagcaagcccacgagcggacggggcggcggagcacgcgagccatgcgagaagaacgacgaagcacagaacccacagtgaggagtgcgaccccgacacacagcgaggaggaccacgaactcaccaggtgtcgagacgcgcaaaggagggagaccgagcgggacacgcccgcacaacaggagcaggcggcggcctcacccacacgacacccaagacgcggcaggcggggcgagagaagcagagaaagcagggcgccncggacgggcgtccgcgcgcgcaacggccgcgaacaccagcaagcccgtcgcgctccgcgagcggagagcggcatgcgcgcggaacacaggaagcaacaagcgagagactgcggagcggaaccaaacgacaaacggagggtagcagacgcagcgcggag

SEQ ID NO: 7841 - DNA, 1270 bp, Homo sapiens
  misc_feature (1)...(1270): n = A,T,C or G
aagtttggggagcgtcttgatttatcaccatccttgttatgcttttggtggttcatcgtattgttacattggggcttggggangggattaagagaaatttacaaaaattgtaattgtgggaaatatatttggaagaatggttggggggcataggacggtgggcccgcaattacccacaacaggactatgtggaggttgtggtggaatataaaacaacacgtgtggacacacacacacacaaaaaaacgtgtgctgatgagcgtgtgcttgtaattggcgttttgtatctccgctggtatcatgttctatttgttattacgtcaaaacggtggaggtgttggggaatctgaacatacaaacgaggtngtgcgtggacaacaactaccaaacggcacttccactatgtgtaggaccaatgggaacactgaggcggggaagtgggggtgtgaacacacgtggtgctacttaatgttgacataataattgaacatacaattgtggcacaaaaactccatgacaacaccacgggatacttggggatcaacacacatcaggagacaaaggtgggcactgtggtgacgggacaaagaacacaaggcattgtgaacaccacacaactatgatacaacatctggtaaattggtagtcatgtacatttggtccactgtggtatactataccgtgtgtggtgtggcgggtngctcaccatctgacacagcgaacaaacaacggtttactacatgattattacaaataaacaacacattgngtgggaaacacaacacatgaggcgggcgatntgtaattgacacttgggactggtgtgggttggtattatgacaaaacacatatgttattgggtgntgatctatgtcgtcatactcaccgcgcgtgcaacttcatatataactgtgtgtgtgtacagataatattgtnatacgtagttattgtatgttactgttcgtgtcactgttcgtaacattgtggtgtgtggccactggatcacttgggttaacaacacacacacacgcgcgtcgataatacctccttacaacatataatgtttctcgtttatgtctggttattattgcgttaaccatgtcttactcacacagccgttcgtcatcacctacgtatccgtacatcangttcatgaccacacacngtgctacaccgctgtcgtggtataggtgatacaaacacgcaacatattggtgtgtaacgggagataacgacacaacctataccttatgtgggttataatataaag

SEQ ID NO: 7842 - DNA, 1230 bp, Homo sapiens
  misc_feature (1)...(1230): n = A,T,C or G
agaacaaggaaggcaggccgcaagcgggaaaaaaaaaagaggggcctgggggaaaaccngagncgnanncctanggagggggaaccccgacggcggggggggcggcaccaagcccagggacgagactttggagggagggagggaagaacaaacaggaccgaggacgcacggcgcggacgcaacggggagcgcgggccaacccagcacaagggggcggcgggggggacggcgacggcaacacggacggaggacaagcagggaccgacaccaacggggcggggcacaacagcggcgggggaaggggaccaaggggacacaccggagggggaggcacccaacacaagagncgggagcggcgggaacagcaaccacacacaacacancacacccaccggggcggcgggacccaggacgagcaacacaacgagaccggggcaacggaccaggaagacgggacccacanacggcgacaaggccggcgcaacaacacaggcagagnganagagggcgaggggggggggggaaacgagggaggggaacagagcaacggggaaaaaaacaacgcggggagcggacacgcaggaggggcggaccgacacggcggacacaaggggaaaccaaccgacggggggacaacacggaccaaaggggaggcgggggggggcgacacgacaacaaanggagaacaaaccgaacgcgcaaggcgggggcggggggcgggagcaggcgcccancacgcaaaggcgcccacgggggacgggaaacaagaaaacaacaggcgcgggcggaaccagaggaccgggacaaaacacaggaagggngacaaaaaacaaaaccggcgggccacaaaccggcgcaagccgcacaccaccgcggggcacagacaccaacagagagacagaaaaaaaagacgacacggccggggagacgggacaaggacaacaagaggggcgaccaccacacagggaggcggaccgcggagaacaacacnggcggggaccaaacaaggcgggcgaacacaacacagaacgacaaagggacgacacggcgagcgggggcggagacgacagaacagaaccagagagacgcaccccaccaggggcgacccnacacgagggcaaaaaacagggacacaaaagggggagaggaagcgggcgcaggcnaccgcgcaacaggcggcagggcggcagggcgacaacggcgaacggggaaaacacaaccaccgggcgc

SEQ ID NO: 7843 - DNA, 965 bp, Homo sapiens
  misc_feature (1)...(965): n = A,T,C or G
gggttgtaaataacggtcctcgtccgattatcatcaaaggataagtaatccagcttaggtagctgactcactgatggcattactacaccagcttgtctgtaagaccccagtggtgccagctggtctgaaggataccactgactgaggtgatctgagggtccccacgagaagtggactcactaaagaatgcantctctatatcgtgatgatatcacccttcttgccctgaccaatcaacaacccccattttccaatccttcaccctcaatgatccccttactcatcccaggcacgaactgctcgaggagatgggtttgaggatgtcctcctcacccccttgttggtggcctgctaaaaccaagccctgccccctgctgcaggaaaccaaagcgaagattggtccccttcggcctccaccgccggacgtcctgggcaggttcctttccgtggggggtgattcacggagcctcccgccccccctcgcctccgcctcccccgctccccctgcgtgcgagcggccgtcacgttcacttccaccgggcggtacctccagttctgtcacgacattggcggncactctctccatgccctccgtacctggcggagttaatagtgtcaaacgaggacgcctcgctgccccgcagttactgannccactcgcgccccgctagtagttagatagtgctcaggggcaccgggatgacagagtctctacaacggtccgccgttatntttnnactttgtggtcacaacccacacctgacccgatctgacaacccagtcgttgtccccagccacaacgcctcgcatctgactaaccagaacagagactatacccatctatgcaacccgcacacccgccaacgccacatgctcccacaggaaagtgcactccagttcncaggagcgcgcaccgattgccgctccgccctacctcatatctctcacgccacacatacccctcc

SEQ ID NO: 7844 - DNA, 667 bp, Homo sapiens
  misc_feature (1)...(667): n = A,T,C or G
cagctctatcagaagcaactacatatataagccatctatcgcgatcctaccagcccgcctgcgcttcctttaatctcgtcctctgtgacttcgtacatatctatggggtacctctcgctctatatgagatgataggggggtcggaatagtgaagagggttgacacgatgctcctcggtcttccacgtagtgagtaaagtgatgccacacggtcgcagngcgggctgtctggcagtgatacgcagtctcgtgttagacgttgctgcgcaacacacatccgccactcgcgacactatcagacaagcggctgccgtgcttcacgcgagcctcggtacgcagcatagtgcttcanagacaagtnagtgtaggcacgaagaggaggacgtgtgcccatcctctgatgttgatcgatatgatatgagcgttgatgtatcgatggactancgcgagatgtataggcgttgccagccgacgcgtaacgtaatacgctacgcacggctcacgacgatacagtgtacntcnacccgccncgacccgccctactatcgtgatcatcgtagccagtctcacagcgtgcgacgcgagaatagcaatagagaagagcttatatactacgtaccgtctctgataaggagatcggcgtcacacgtcgcatggtcgtcgccgcg

SEQ ID NO: 7845 - DNA, 1660 bp, Homo sapiens
  misc_feature (1)...(1660): n = A,T,C or G
atagactagctgctatctaaacgtgacgtgaatgacagacccgcaaaccacaacgtggagaacctgaccggcctgctaactcacagattggcgctctcctcttagggaggcacgacgcgcacgcagagctgataaaggagctgcagcgccacgcgcggtacgccgatctgcgcctgacctgagatacgatcgngtcactgcgttacagcgtcataaggtctttacgagtcgcgtggagatacataggagcnctcacaattcttcaacgcaatgccgagatagccggctctccgtcggctaagtatgaggaggcgtcgcgcgagtcagcgcagcacatgtacatacgcgacgtacgttgtatgagagcgacacgacatcngtagtagcagctccgcgcgacgcactatgctagcatgtcgtatgtatgtgtatcatgctgtagatagcacgctacattcgcgcactcgntctgcgctgacacnctctnatgatgtatcgagtattcagatgggtgccatgatctcgactatagcacatgatcgcgctgagagatatgacgcgaacacacgcnactgaggagagaccatcttgcgaacgtctattaacgagcagcatgnacangacgcgtgagcacaganagcagctacatgtgtacgctgctcgacggctgcgcgctanctcgccgctagagtgagacngctcgcgtgtgtatgttnatctctacagttntgatttantcactantnctggtgattctcatacacgcagtaagagacgacgtccgactcatgcgtcactgtgtgactcanctactaccataaggtagctatcnatatgctagtagacgacgacgggatgcgagagagcggcggatgtgatgctgagtgtctataactcggtagaacgagagaactgtgatgcgtagggaactgccgccgagcgctgtgacgcagcaagagagtgacagaggacctnaattggcatggtacggcagagtcgcactgtcgatcgatcacacgctatctcacgntgcacacatcaatcaccgcggacaagtcacagatagacaacaantagcgatatctggngtgaccacgcacgtccntatagtgatgcactacaggtgctaggaccacattcatcacgtcctgaactgccacacgcacaccgacacaaaccacgacacgtggtgcgtgtacgcgatcatatatggttagatgataatatgtgtagaaagctgatctcatgatgtatgtagtggtactctattgacnatcaatcgtacttatcacactcgaccacacatcagcgactgacgctgacgtgcgagtgcaggatgcgagacgaaccacgaggacgtcaacacgacgcacgcgnntacgcacaaactatataacatataantatactaatgcacatacagcagcagaaatgcgcagttacntctacacactgntgcgacaacaccttacancactacatcaatgacggtgttatcttgtacaactgatcagtctacactacgcggcgctgtgcnacgcgcgcatagataggnacatgcgacgcaccaactagagcgacatatactcgtgtagacgtgaggtgcgtcacncacatagtcatcatatagcatgacatctcgtgacataacacatatagg

SEQ ID NO: 7846 - DNA, 1667 bp, Homo sapiens
  misc_feature (1)...(1667): n = A,T,C or G
acggtgatactgtgctgttaacgatgaatagatacttgacacgagaagaacgaagaaattttcacacctcataagcttggagttaacgtgtttcacttttacagaagcnaggaggacgcggcaaccgaagacaaggcgactagcagccgagtctatcgagtagaagagggagcgcgcggtgcgcgtcctgtatgtgtcacgagtagtcacatccctctagagattcgtcatttcgcgtctagtacgtcccatcgatgcttcagccacacaaagtgccagtagactattacagacgagccgagaccaggcgccgaagctaatgcacnttacgtacctgatagatggcgacgtgagtcagatgatatacatgagactctatatctattggcgcatcgatagctgaatgtcgtatgcatgaccttactgagttgcgtntcgtatctcctctggctctctctcacaagctgttacgctctagtgagcantatggtagtcactcttagatgacgccgtatgagatacatactcatgtgcacgctctctgttgacatgcgacaactgaatattacactcattgatcataacagcgagtaaacaccgagagngacaaatagtaagagaggcggacgatgcgacacacatcagtctacagatccaacatgagttcaatagtagtgttgatcgagttacaaagcgaccaactactcaattagacgcgactactacttctcagattctacgcctctctacacgctactatttgtctatcagcatgtgatganctcgtacagcccgcgcgagtgcggcgtgtgtcgagacgacacgcattccacgctactgcctaccgtctacatgtcattagagcactgtacatatgagatctgtacaactcgtgtgaactctctctacgtcagtcnacantgcgcaggagtgcgactggcacgctacgtatgcacgtacatagtcgctctgccgcntcactaccgctatctagcgtgcnaccactaatatactgacgagtgacaccgcgtacactagagatcacgtgtctgcgatactccctncgatcgccgnacatcggcgttaacatgatctaactgtagaatcgacgtagcgtatgcttaatatcgtgtagaagatacagcagagcaggcgtatacgagaaggatatatgcgtcgagtgagtctagagacgcaatctctatcacagncacactcagagcacactcntaaccntcacagcaatctatagtagcgacgatactaagacagtatgtacgtgtatacgcgcgtcgatgggacatactataatntnatctaatgacaatgcacatactgactgaggcgtctnactcttgcgcgcgcacatancacgtcacgatgctgctatcacctcgcgctgcatgagcatgtaagnagcagccgcagtgagacacatacatctcgtatctcgancatcaatacgctgtgctntactgatagtatgactagtagcatatcacacacactcgccgcactattgcagattcagncgatcgtacgatagncagtanctactgtgtatgacgagnacttatgtgcgccgacgcgcacagncagatcgancgctcgaacatagtccgctcagnagtatagatcagcctcgagcgngncgcagatgataagct

SEQ ID NO: 7847 - DNA, 881 bp, Homo sapiens
gccgctgttaaatcttcccggcaatgccacacaaaaaggctcctgcttgaagtcaaaagcctcctttaggtccgatccctgatcacagctgagcagacacctctaaccatccatcctccgaatgaaaacgtccttataactaccctacttatgaattccggttcccttctcacacattgggctcatttctgtttcttaacaaagtcatcttatccctccatcccatataatttggccacacactctttaaaacacatcatacccccaggaataaagccctaggtttgaagtaagattgtgctttttaatctctaaaagttataaatcacatcatatttctctcttgttcaaaatcttccacaaaggttttcaccatgtttagaataaaatcccaacttgttcccatgacctgtaaggatctagataatgtggccactgcttacctctgtcatcactgcgcaccactctttacctttatatatatatatgtgccttctttctgttttttaaacatgtcaggtctgttcttgcctcccggcctttatactcttttccctcagatcatcacgttcctggattgttctattcatgaaattttgagctaaagtttcttcttgggggaaccttcctgactaccctgtctaaatcagtcctcttctcccactaccagttagttcctggcactttattgtgctgttttgtctttgtgacacttaatatcctctagaattaccttgtgcatttatttggtgactttgtttatttcccttgccttgacctcccagaatgtaagttccatgagagcagggtctctatcctcagcccttagacagtttctggtatgtagtaggtactcaataaataaaacgagatcggccagc

SEQ ID NO: 7848 - DNA, 621 bp, Homo sapiens
atccagagctcagtacctgcacagatgttcttatggcccaaggaaatccttctccacatctcttgccctattaccttgaaagaaaaagtggctgccccaaatccccaaacgccatgaacattgaaggatggtgcccctgtccatgttgcatttggatgcctctttggagtatcaggaggatttgagcagtggaagctcttaagaaagaaaatacaaattattttaagaagaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgactctgccatcccattactgggtgtatacccaaaagactataaatcatgactgcaataaagacagatcggcca

SEQ ID NO: 7849 - DNA, 861 bp, Homo sapiens
  misc_feature (1)...(861): n = A,T,C or G
cccccgccgcgacttgaggcaaagtcgaagcctttcaggcggccaaggaccgtccccccccgttaatcaattaagcttaagcccgggccagtggctacagccccaagtgggcccctcccagcctgtaaaattcaggaaaggaaaagcttctccatgtgcaaaccaggattaaccgagtccctaagcgttatatggagcaaaagcccgctcttgaggaagcactctaagtaaaatcctatataatatggtcagtgttaccacgggcatcctgttatttcattaagaaagtcaaatttttccaaaggagataccaatacgtggccagactatttcagcccagcccttacaatgggaaacaaaaagtctcacctgcttttttgcccacaggaagtacagaaagatgtgtcaggtcaanagttatntcagccatcccaaagaagtaatatttccaaacaggtttgaaaaaaatcagcatcacatagaccccaaatcccaaagcggcatccatctctctgtaaagtgctttactccaatgggcaatgtagatgtatagagaggtcttctatcctctcagttcctgcagcatctaaagagactcccgtgagactcttgtcgttaacacgaaattacaatgtttcatttgaacaactgaccaagagcagcattaaatccaaagaaattttaaaggcatctcatagaatatgaagattgtccaatattgtaagttgataacattattgcttgcttggactgggaagataatttccctaatgaacttgaactgttatttcttatctggaaaatgatggtgtcctagttgtcttgagtcatagaatagtcaataaacacagatgcggcagg

SEQ ID NO: 7850 - DNA, 1424 bp, Homo sapiens
  misc_feature (1)...(1424): n = A,T,C or G
cagttgcgcctgtttttaacctctcgtcgtattcacatcacttcgacaaccggctagcgaggatcttttattgtcatggatggtctgagaagtacggaagtccgctctttgcgcgacccgggagcgttgcgcagccgtgtagaatcattcatcagccgctatactctccgtccatgactagagctcgcacggccgatcgctccactctatacagtcattccgtaccgtgacacctagcgtcgatagtcggagcccgtctcgcgattccggttacgtcattgcggcgcccctacttgtagctcgagatagagcgcagtgttacgatcatctatctagtcaggtggctacaacgcatcgttccattacatgtactcttgcggcacgtcgccacgataccgtgcgctgtcttctctatcatcaacntccagatcacagcactgactgtcagattcacactaccctcctgcccacccctcctgccgcctcatccacactcaattaccgcgcacgagcacgcgatgtatagtgtgccacccttcttcctcctctctctggtgaactcatctacgcagtttattatcacattttacatctatacgagtctccgtgaacaactctacttaataacatacgtagtacagggataatatatactcatatgataaatatgtgatttattagttaaatttgtattctagatctatagagtggaactatcagtaacggtgccaatggtgggcgcagaaccatgctctcggcggccacgtctcgcttatgtctcacctattataacaactctcacgtatgtgaggcgtagccactaagaatcttcgatgtgtatctgaccgtatagaaggcggtagtgtattactacactgtactatcaggcagggattgactcgttcatctctctcactatcggatttgttcctctcgcctctattaggtgttacttgttattacagatatcagaggcgcggcaatgcgcacgttctagatgtggcgccggagcagcagatcntcactcttctgaaccattaacaacgagtatcaattggcagacggcggagccgcaatcgttgctctctccgcttacacacacgacacactcaactgccccttctactactctatgccttacaaataggctggtgacgatccgttatgtacatccgtcatctcgcaccgaccagtcacaacaactatactctgtcacgttatcatactccttatcaaattttacgtgaatcatggcgtaccgtcttcgtcaccgccgtcagcgccgctcatcactcattatcataagacagtcgcatatgactctatacatccttttgtatgtcaccgattgcttatgtatctgcgtgccgccggcttggtagtgctcgcgtaggtatgtatatctcctcactgctcagttgagg

SEQ ID NO: 7851 - DNA, 1369 bp, Homo sapiens
  misc_feature (1)...(1369): n = A,T,C or G
ctcatctcgttcgtctctctctcgtactgtnctctctcacaacttcncntacgtctctctcgtcgcgacatcgtatttgcggactgtctgagattattatgcacttcatctgcgctggttgctccgtctcgcgactgctcatctgtcgtctgcgcgactgcgtcgctcgcgcgcgntggattgcgtcgcgctcacgctcatcatacctgcgcgcgcacggcgatcgatacgatctctactngtgntgtgctgcttctgcgtcgcacgacgcctctcagctcacgccgctctcccactactacctcatcctncagtcctcctgtacggtcgctgcgntgctgacgctgtcgactacttctcnctctgtctcgtgtgtcacgccgcctgcgctctggtgctataaacccgcgtactangttgtgtggatgcgactccttcatcgngtctgagtcttatcttatctgattgtcggagcggcctcgcacggacctgncgactgtcatatgtgcgtgccagtttcgattgctcctcttgttgtgtcgcttcattggcacagctctatatacatgtaagtgaggagagacatcggatgctctttactctatgntgctccctagctgtgnggctcgagctgcgcctagcccgctcgctcgcgccgctcctggcgcaccctgtgcccctgcgctcgtcgtccctacatccttgcttcctcgatggtctcgtcgccgtcgtctcgtctcgctgacgctcgcgtgtcactctctattactgcttttctctcgccatcctctcaacagcatcactaccccccctttctctttctgtacgcggcttggcccgcgacccactatatacgcgcgagactagcttgtctgnttcttgtctcctgactgtgcatcgcggttctcttgcgccctgctctcgcccgacagtaggtgtgttggtggagaggaggaagaaggagcgcgcctcgacttccgctgtgtccttctccccgcgctcctcctcgcgtctcgcttcncctctccccgcctcgtgttttgttatgtgtggcgtgtccgcctatcttattattctcntttacattttctcgatactactatactctgaacgcgcgaggcgcngcctccctgagtgctatgtgtggtcgtgtcgtctctggctgcgtccgatcctacccctcttcgtttatgatgaaaanaccagagtagggcgcaacgtggggtgggccgccgagcggcggtccctctccccacaaaaaacccccccgtccgctgccccccaacaggaagcctcntnntcgtcccttngttgtggttacagtcagctcggaggtggaggtgggctagcgcgccgcccgccctctccc

SEQ ID NO: 7852 - DNA, 1743 bp, Homo sapiens
  misc_feature (1)...(1743): n = A,T,C or G
attatgattagagctagcngactctacaagtatagatctagaggtcatctagacngtctagtcagatcncnctngtgctatgtgagatatgtttattaccgangtcgnagagagtactcgcgaggncntgtcagtgagagtcgnatagtnacgatgtgcagccggcngacgtgatctcgnactagtaggcntgtagagtactaangacatagtaacggcagtcgagtganaggcgaatgcgatgtatatgtactatgatcgngcgnacgagtagtgcggncatgacttgntcgtgtacgggntcagtgntggtgantagcgcagcgacgatgctgatgcagcattgatgtgatagatgcaagtacctcacgtagcnatcgtactgactacacagtgtcnctcntntgnatgntcaagtantctgtattgccntgactagatgagtagtntcgaccgttgtcnaggcngctgagctgtcngtcgatgtcancatgagatggcnactcntnagctgcntcatgtctcctgcacnctcagttatantngatctctacgntacgtnanatgctggatagatggtgatcgttactataatctatgtaccngtctgtatnttggcgatactgcactctcctgactggtagantctctcgatctacacgatatgtatatgtnatggcgtgtatacccgagaatntntcgntgtnctcntcctctgcacnacacactatctgatatgaagtcgatgtacactcattatcgtgactntacgttaggatgctcgagtgatcgangcgccatgtcacagcactgcctcatatatgtcactagtacattgacgctntgatattaangatcgncctccactcagcacgattatcgcatcgtccagatgtatgctgacatgatttaatcagtgatgttggtatcgctgggtcgtgtttcgtnacatgtgccttgtcttctctcgatgcatcgttcatactgtgatccactcgatcgaactaatatggnctctgacgatcgcgtactgcgtatatcttatatctataatgctagtcnagtcttcacactctcgatactaactgtagtgttggtgantgcatctctatcgccgcatctagactatatacgttcccgataccgcgcattacacgctcgcatactagaatcttcgacgtcgctagcgcacctctgtctgtcacgcgtcntctaatattacatcgatcaccgatantacacgatatgcaacagcatgacgtctacgctcatcgcagatatgtgtataatcgatctgatctagatatatatctantctctgtatanaccttatatacatggatacgccgacccgagcgcgtctcacgagtaaactgatcacgcgacacccacgtnatgtgtagtattgagtgaactctgtgacgtcgatcgtctcgcgacnactcatccatctagatcgctgtgcgtcatgctacgtgccgatagacagagagcacgttctctacagactcgtcntgtgttcatatcattatngtcgcgcgtgtgngnngcatatacgcttntactctacagtccgctgctctgacgntcgcgattgtctaatcagcgacacagctcttgcacactcataggtgcgcgcgaggtatatcgcgagtacaattacgatatcgtatgtgattagatatcacgtggtgtgatgctgatatgatatgatatgtantcgctctctccacatgcgataat

SEQ ID NO: 7853 - DNA, 930 bp, Homo sapiens
  misc_feature (1)...(930): n = A,T,C or G
ataagagtctgcactatgctctgagtanacgtcttataagttaaaaagnaaaaacaaaanacaaccnnannaaggagaagaaaagaagagtcttcccgagcgggaaaaaaccaaagaggaaagaccccagcgaacgacagtcgagtcgacagtgtaatccgggacgagccgcccttggcaaacatagtcaaagacatacacacaagattatacaacactcgaaggcgcaggaattggtcgtcatatgacgcatggtaaacacgcagaccaagttctttgaggagagaaaaggggcattatgaaaacgcctagcatccaaccaccacttcattccctcaccaccacccgccacaaccgcaccaatcagacccgccgacgccaatagtgcaagcgaagggttagagaatggtgaatgaatgggacagtaataaaataaccgctctgaggtacctatcttcgaaacgtcccgcaagtgttgtaccacaaatggcaccccaaaccacatagcctcacgtgtaacgtcgtgagctacagcgtcatgtgcccacagcacgagggacgtgcctagcaccagacaacaccgccagcgacgcgcgccgccccaatcgcaccggcccaccaacatgtcgcacacaatatgatccgaaggggtgccacccgccacacacctgcttgtatagcgtcaaattaaccccgcgcccgaccaccggtcggctctgtatgaacgtagcagaaataagatcttgaaatgttttgagtcacaataacacgcccacgcaagactatattaagcatgccacaccaaacctctttcaagctgtgaaagattaacagcacctcttttattaatacaacaccatttcttacaagttaataacaacgtgcatggacgcgaaggggacacatagccttcgtcaaagaggagaggag

SEQ ID NO: 7854 - DNA, 1130 bp, Homo sapiens
  misc_feature (1)...(1130): n = A,T,C or G
agaatgacganctttagttgagttcgtctataattaaaanaanaanaaaccaaaaccaccacccacgcagacggcggcgagggtgacggctcttttccagtagcgccgtccccaacctcggaggcgatcctcgctcgtcgtcgccctccaccgattcacgtgcctgcagcttacgcatcgctctcctcatgtatgtttcattttatacagccttgcgcacagctaatatactatgtctacagacgtgttggtggcctccttatatcgtcgctttcatctagaacgccccccgttgctcgtccaacttacatatgagcgagtcgtcttataggttagctntcaaaaagatgtgtcagtgaacactatggtgaccccacgataccatcaacgacgcggttgtccgtgtgtgtgatgtagctactgtaatatccactatcgcccaatattatgcactacgttggcattattgtatatgacacaacgtgtgtcaccctctttccatgacgccgccgtcagtcacgaacccgctgccggatactgttcgcgcattcccgaatcggtgtgcgctcgcccaagtgaacaggatgacgtagtcaccgagcttaggagcttgctgaattggtgccaccgacccggtgcctactaccacatccacgtcgatgcaaaagatactagcgtaacgccactccgctcgtagtgatggctctgtgcctgcgactcatggttcctctctctcgctttctcacaccaactgatatgtgttaggtgtaagcgagattagcttgatttattgtcggtgacctatctcttcgcgatgtagtaagatggacgagcttgagggaatcagtcgccgctcagttgcaccaatccctatgcatatcactcactatcatacggccgtgccgactccttaacttcaccctcttccctccctccctcacaaactaactcctccactatccacgtcttgtaggttacttgaggagacagagtgaggaccatcccggctgcgtcgatactactgtatacatcttatgtggtagatggggacaagcacgcctaactccttgctgcgccagcgccgaatgcagcttaccgtggtccaatatacaacgcacacctcccgcatc

SEQ ID NO: 7855 - DNA, 1783 bp, Homo sapiens
  misc_feature (1)...(1783): n = A,T,C or G
cactagtatctttcgacggcctagcaggtgacacgatttacgtattacgctgcagagagcaacgcgatagacccctccactgccgagttagacctaagcgagcggggngccggctgtcttatgctggggcggcgcgcgctccccgagctgtcagcggcatcacacacagagagagaggcgggcgagaagcgcgnatcgatctgcactaacgagaatggtgaggctcacagcacgacgcaccagcgcgngactcagcacatatacgaggtcctctgcggacaattcgtgtgatcagagcaggntcgcgtctgntggatgtgtatcagtctcttgagcatcgatcgacagatcaggatgtgaccgatactagtactcatngacacagcatgtcgtgagctaattgtcgcgctaatatatatattactggtactactgcatctgataagtggcgcatacaatagtaatatctacatcagagtgctctcacttttaagtantaatatatactatagtattgattatccttcnaacgcacaacgacagcgagcgctcactcgcacgcgccgagcactctctccacaccgaacgcacgnttctacagtcgntgtgaccagctctcaccacacgngaatacatcnttcgttgcttaataggatcattatggcgtagtgcaggagacatgagcaccgaatacactcacctcgcgcgccgtgacacantctacacactcctccggatggtagtacgcgtcgcttactatattgaatgacttgctgcgttatagacatctgtattgtacgntgtctagatgaactnctcatatcnatcaccatctcaagatacggtatgtgtagcacacagcacctctcttacgtcttcatctatatgcnggcttgcacaagttgagagaacggtctcagtatacggagtccactctacggatcctcgcaatataccgtactatacttggctgtatgatatcacaattatatgaccgantatgtcacgatctagttgcnaactggagtattgtagtagtgtacgacttacacctacaccgcaagtgacaggcagagagatacgagagnagatcctcgtcagntgcgtctccgangnanaccgcacgtggtgtgtgtgtacacacgcgacgatcnacatcgtggatctacagacagtcacacgctggcgtgtcaacaacagcgtgagttcntgaagtcatcacgtatatcacacgtataccacagacacnactatctactgacgcaatcatgtacgacgcctgccgatcacgagagctgcgtcgntcgtctagctatgaacacngcaccgtcatcattagtgtcacgtcgcgacactctcatccatacatctccaactagatattgccgatcgcaccatgtaactacagtacgcatgtgcgtattcactagcttactgtctatgtatctagtnagttctatcgtcggacgtgtcgacgacacgcgtgcgcttgcatgctcatttagtgtacgttntcgtcgttatagtgngcacgacttgangatcatgatgatatgcgcgtanacacgcacgttnactgctctcttcacagcacatcctcacgagacgtgcgtagagacgactcgcantgacagacncaccgcggcagattcgcngcgcataagatgtgtatgacgacgctgttanacgtatatatgatntacatacgagcagtcgcgtgacgagcagcgatgtagtgcgttgatctatgtcgatagacncgctacaagcgcgntcagcatgg

SEQ ID NO: 7856 - DNA, 801 bp, Homo sapiens
cacccccccccctttttcctccctatcccccccccttcctcccgctctcaaccccccacaaagtcttttcaacctacctcaccccagcccacagacccggcttgcccccaccagctgtaccaagggcccacccccccgcggtcctgctccttgccccattccttaccccccttctctctcccaccccatttttttttttccccttacccctaatataggcgggcgcccctgattaccccggaaatttccccaaaaagatttctccccatcttgaaaatcccagtaaaataatttttcagtttccaacgaccattttttagttagaaggccccaatctggatgggcatccttaactaaaaatttgtctcgcttatggacctctgaatttccccacccattgcgcattttatttgctaaatttgaaaacccttgagatctcccagaaatagttggaagcatctggaaaacaagggcctttgagggagctaatgtcctccaatgaagccattacacagttttgtttgtgcaatttccattatacaggattcaccagttttataaatcccccctcatagtttcctgaacactttatttcccacattaatatttttctgatcttaattgtattgtcttctgtaacataggcttttctgcattttgaaatttgcccagttttacccagatactaaatacatatttcaaaaatgtgattcccacgaacacacccacccgattttttttattttcataaagcaaaataaacaccccaccctgttgccttttaaaaaaaaaaaaaaaaaa

SEQ ID NO: 7857 - DNA, 408 bp, Homo sapiens
  misc_feature (1)...(408): n = A,T,C or G
atacatcaacactcgacacgcacccccgccagacgcccaaaccaacacccgcgcggaacaccaaaagacgcggcgccgacgacacacaaaagaggcacacacaccgaccaacagcgcgacccacagagcggcacggaancacggcatgcaacaagaagaccgcgacgccgcggccaacgacaaaaaccgccacacaccgcaaccacacccacaacacaaaaacaccacagcaaacaaacaaacaacaccacacccaaccccccacaaacaccacaaccaacacaanccgcaacccacaaaaacaaacaacaacccaaaaaaacaaaccaacaaacaaaacaacaccaaacaaccaccccaacaccaaacccaaaacccacccccacacaacaaacaccaaaaccaagc

SEQ ID NO: 7858 - DNA, 1481 bp, Homo sapiens
  misc_feature (1)...(1481): n = A,T,C or G
cacgtatgcgtcacgctgtatacatggcgcagagaggatgagagccacgacgagaagagagccttcagatcgaatgacacaagcagaggagaggtgcgagttttcgcgcgcggacatcgacgccgccgtggcgacgtacgatacttctgcactgatgccattatgtgacagctatctgattgctgctgaatgtactatatcctgttatagtacgagatgagttcctagcgcatgtgccgtcctcgccgatgaacgtgctgtactagtatcgaactacagccgtggcatgacctgcctccgccacaacgtgatgagntgatgcacttagttgatgtgtgtgagttcgattantacagagtggattgatgtatgtgttctatcgatcgctagatccacaatactcattatatagttngttacattaatgtgacagagagtatagagtgtagactatgtagttgtgatatagagatgtcagtggcacntgcantcgttcaaccttcgtgtattgtcgacagacgctaacgcactacgatgaccgacctactatcttgtctgctactcgttatgtatcgactcagctctcgtcgtcgccattctgggcgtaggtgcggcagagaattaacattatgacctacaggattctatttatgagggctatgaggatctgctgagctgtgtgagttcatatattgatattatgatccttctcatgtcaagcggntgtgcacagctacaatgctagtaaaacggagcgccgaatccggtctgagacgatgacaatatgatcagaaagtatatgtacaaatgtgctgtaggtgcgtgactggtctgatctttgtattgatatagtatctctcttctcttctttactgcgtgcgactcgtgttttatcactcacggacctcacacagcatggagactgtgtatctgaattcagtacattgtagttgtaggccgtggagtgangcgatatgtacaatgtggatatntgagatataatagaccagttctatggtgcgtacgctattcgacacctagaagaacagtgagttgtctgtatagtacgactgtgcgttactcttgacacacacagcgcaccgtctgtggcgtgtgtgtacaagtctcagctacttagtgtcgtnacacgtcatcacgtagctcatgcagatattgtagtgttgctcgtgacttatatcatatatagatcatgtcacgatggacacaagangatacataataacgagcattctcgcgtcgcgttgcgtgtcttcgtcacttgatatacataatcttccctatatcagcgcgtccgaagtcgcgctcctcactcgcgatctanacttctgacatcnatcacacatcgatgctagattagtgacgatagtataagaagtataagtcatgacagtagtagcggccgagtcggagcgcggcacacacgcagacccgagatcagaccacgtagacatagtggatgg

SEQ ID NO: 7859 - DNA, 980 bp, Homo sapiens
  misc_feature (1)...(980): n = A,T,C or G
cttcccccccctcccctcgttttccctttctttccccccccccccttgtttttgtcccaccctttgttttctaccaatctgtactctgtcctgtctccaggttgtttcttgtgcgccgccctcaccacgcccccctactcaaccttactggccccctccagaggctgaataccgttcatgtcccccctgcccccccctcccatccatactttgtttggttgttttcccttgtcccccccgtgtgtcccgcctctttgttcccccccatttattttgtgtgtgctccccctctccccacctttgtcccatccctccctattttttgtttcgtcctcccccacccctgtttggttcccgttcccttttcctccccagtcacgtaggtgggctttacatgtgccccattccccgtgtattccccgttcccccgctgttccggtttctttctatccccgccttttttcccccatacccctccctccccccctccatacgctatccctatcggcctatccgttcccccgcagagtggcccccccccccacactcgggtcccctccccccggggggtccccccggagagcattcacttccttcttcccccacttttttttccacccccagggatgcctaaaaaaaatccctcactctaggatggaaaccctgagatctccccagccataaagcacctgggtcccccccccatttctttccncaaaatgcatttgggttaccctgtattcagccctgtgtttgaatccaagcttttcacctgacacacaaccagtcaggtgaagagcttggattcaaacccaggtttccattaaatcacaccatctacagacagaggacgcagttccctaaaataatgcttacattcccatgtgctacccaaagggaaatagccaggactctgtatgcaccaataaaacgagatgccggccgttccctctcttcccctctgctgcctaccctgctcc

SEQ ID NO: 7860 - DNA, 1623 bp, Homo sapiens
  misc_feature (1)...(1623): n = A,T,C or G
gcacatcagtttcgcgtggcatgacgtagcggtgtgtagngtgtagaccagcgagtgcgagcgaaggagagccgtacaatgccgagacgaacaatgagagacagaggaagcgcggtctatgancggggacgagcggagcagcaggtggagccgagcgcgcgagcgatcagctgtcgcgtgtnaggatggacgcagggaacgacgatgacgggcgagtatgtagggcgcgaccgcgcagcgatcgcttcagtagtagcagttcagcagattagatgagagtatcgacgcatcgctcgcgtatgtcggtcgtatcgtgcgtccggtccgaggccatgcttgcgcctgatgcagcaggctgacaaccnaccaccgaaacaccccgatacatcccaggctggaacgggacaactactaggtgcgaacaggacgagtaacgctgagtaagcgtagagcatatgaaggagacccggccgcagcggtgcgtgacagggacacgcggcggcggtagcgtcgaacgacggcggggtcgcgaacgagagcgaacactgtgcacgaggcgtgtcatacaacagccacatcttatgcagctgcgcgtcaacgtgtgcgatgcgcgcacactgcgcacagnttgacagtccatcgcagacgacacgctcgaatcgcgccagcggtcagagacttcacagtactanatgtatgtacaccagtaacaaccgntcgccgcgcggtacgctaagtgtcgcgacgcctancgctagccgtacgnccaggnctcgctgccaatgtttgagacatcgccagtgtgctactgagaacactcacatctacantaggtatcctnatgacattgcagttgattgtcgcgatcacgccgctgggaatgtcaaggtgagctcttagaggtcgtgctagatcgctgtacgttctcgcgacaagccgtgcaggagcgcaggacacatgattgcggtgccggacgnactgtcatccacnagcgcagagtgacacggggctgtngacagtatcactctatccgaatgctatcgtctgatcggtaacactccgcgcgcgaccacgacgtctcgacgacaccgcgcacgtattacgttcagccctgngtagaaagtgcatatattctctacgtgtagagatataggacagatataaagcactatgtatacactgtctcgcgatctcngcagagacaacatgacgagacgatacggntacgtcagcaacgctacgtgctcagacacggtctgtctctcgatgagcgcgctgcggcgtacgcgtgcgttacagtacagagcagcacgacgtgtcgacgntcgcctcaagctactgtacgctcatacactcacgatcgcgccgcaanantggcgagcgcagctgacatcgtcgtacntcnctgtatattactcnctctgcacgccctcgctcgtcgtgtagttcgcagtatgantcgcatataaactacacacagtatcgacgtgnactggggatgaagcagcgtagtgcacgcgacaggagtacacnacgtcatcgaatagagcgacgctcgntggtgtcgtgactccccgtcgcacgtcacacgagttgagcgcggatctcggccacatgatagat

SEQ ID NO: 7861 - DNA, 872 bp, Homo sapiens
ggggttgaaaaaaatcccaaagaaaattttcgcccccacagggggattcccaataccccccctttcaacggttcccaaggttttgatcttcggctttacaggcccaacgccacgcaaaagagagtagggccaaaatcaaattgcctcaccctttcgtggtatcaaaatacccccaaacgtctcaccttgaaccgatccctattaaaggaaagaggggccaaatcccttttcgttaagccctttaacccaacccttacaaatttaaggggagttaaaagctgcatcaaagaaaaactgggacccaaaaaatcttgtgagttctgaaggcaaaattgccttagccaaataaaagagtattataatataagagtggtccacccagagaagccccccctttaggaagaagaaagtatgactgataatatgctcacgcccctgcaagtaagctggctcacttgggataggagatgggaaaggggagatgaccaattgaagtttttagtttaacttgtccaggattacgtagctacatgaccaagatggatcaaacacctgatcttaggatgccaaggccaatggctttctttatttcaagctgacatttgggtccatttgtgtaagaccctctccagaaaaggtcccagtctatacccccgggagaagaaatgctgatttcacaaagcttccataaaaactcaagaggaatgggttccagagcttctggaagcctgaagatgtggaagactctggagggtggtgcactcaggaagggcatggaagtttcgcaccgctgtctccatgcctcatcctccacatgtctttacatctgtatcctttataatatcctttacaataaaaccgagatgcggcag

SEQ ID NO: 7862 - DNA, 1164 bp, Homo sapiens
  misc_feature (1)...(1164): n = A,T,C or G
gcgaacgcgggagagggacgaggcgacggggggaagacaaaaggaaaagggcctcgcggggggaacaaacaccggggggnncttcggcgggggggaaacccagggggaggcggcggcgcggggcgagccgcgagcggcggcgggggtcttcggggggggaagcgaggcggcgcgccggcacgacgcgagcgcggaagagcgcgcggggagacgcgcacacgacgaggacggaggacgcgagggacgcgacaccgcacacggnggccacacgnacggcgcaaccccggacacacacaaagggaggggagacggaggaggacgggacaagaagggggtgggggaagaagagagcaggacgaagcggagagaagacgcgcgccacaccagcggctcctccgcacaggggcancacgcgcgcgcgaggcgcaacaaacacagacagacgaggaaccacaaggaggaaccccacgacaccaacccggtgcgcgcggcggggcccacaaaagggacacaagggagaaagagacgggaggaacacgcgggcacggcgagggagacaaaggggcaaacacaggccacccgcggggaggcaaccacgaggggaacgcaggcggcagcggggacgcacgggggggccagcaaaaacacaaggggggcgggcggacacaaaaggggaacaacaaccggaagggcgggcgggggggcggggccaccccacccgccaaccggggcacggcaacacaccacccccaccggcggggcacgggcggacacacaaaaaagaacgggggggagaaacaaaaacccggggggggggcgaccagcaagacgcggacccggggcggggcgcccgcagggggaggaccaggacaccagggcggggagggggcacagccaagccgggcgacacacaccccggggggcggagggggacgacacgggggaacaacacagcaggagccaggaagaacaacaacccggccacccggggggcggcgggcgccaaagacaacccgcgcccgacgcaatcccagtgcccacggcgccgctacccccgcccaggcacccaagaggaggggcgagaggagggaaagacgacccgagaacagggggagcggcggcggcgggaacacaagacacagagacacacaacaagaccgggag

SEQ ID NO: 7863 - DNA, 290 bp, Homo sapiens
catcctctcggctcccctttgtcttccaccgccccgcccagcccattgcacactatatttttcccaaccatagtattacccaccgtgtattctgaccctctgacggctaacggcatctacgggtttctgttacaggcatagatttcgcccccccgtttcctcctttactccaacttctttaactcccaaacggacaatgcctgtactcctctggtgaaaaactcacagccgacggggacccaatgctccgagccgagaaagacccgaaaggccaccgtaacggggcccag

SEQ ID NO: 7864 - DNA, 1148 bp, Homo sapiens
acgtcttggcgcgtccgccctcgtgcgatacgccgggagaacgggacgtacacctgtaacatgagtacggttcatttgcgggggaagaccgcaagatactacgcccgacacgagttgcattattcgcttgtcctcggcgctatgcgaggagcatcgcatcttatgtttatcgcccactcacactcccgcgacgcccgcgcactagcgccaattacggcgtagtaggggcgcaaggcgcggcttgtagcagctccacacacgactcgcccacgcaccaagccgtctgtccatgccgccgatgtatagtatctgtaacgtttgccatctgtagagtccttcacgggtatccgtaccctttggtcgtggagcgcggtcattttcggcccactacgcggtgaccggctcaacagacgtgtgatgatagataagcgacgcataacgcttgtatggatatagagatcagttaaccaaccactggggacttattttaatagatatattaatatatataatcatatatagcagcgcatttgcctagaggcaacccgaatctctgcgtccgtggtggatacaatgcatcatgcgcgcccaactcgacttggattaactgaactgctatagtgaccggatggcgttcagctgtttcatgtcttatggtcgccgtctcgcagaaggaggcaaaagcgtccgtgactctccccgccgcacgcacccctccctctcgtaccgcctcccttccgccataccgtaccttactacacaatccatatcgatcttttaaggtcaggcattaagcgttatgaggtcacagcgagcacgatattcataacactgctataccgtaccccgtctgagctgtgtcagagcagtctatgctctcttcatcgtttcgctgttcctcctggcctttcgctgctagacgagtgccgctcagattgtcacacgacgcgtcgcgccgcgctagaaggacacaaatcgagaggaggcaaagttattgatagacttaagtcgctcattcacaacacttcagcctcactcggcacacataagagacgccacgcgccggctgctcaattatacaagcggtctatattcatagacacgcgcaactaacatatcagctaactgagaactcctcccctccgaat

SEQ ID NO: 7865 - DNA, 903 bp, Homo sapiens
cacacccaccgccccacattcaaccccttcctctctcacagacccccatcgtccgcgccgtgggtgcactttgaaaccccccccccccagagggtgagcgcacactcctcatcaccgcggagaaagggttcccgtggcgtgaaagggggcccgtcgtccccccgccctgggcaatatcggtgtacacccccctcttcggcctgtgactacactcctcatctatttatatttcccccggggatttcttctaaggcccacaaaaaaaaggggaagcccctctccccttttggttagaaatgtaacatagtttccgccccctttggaaaggggtttggaaaatttttataaaacaaagacctatcattaagcccccgcccatcccacttcttgggtggatcccccaaaaaaaaaataaattattattatttttacccaaagaccaaataccctaatatatttccaaatagcaaagccagggatccaccctaggtgcccttcattgatgtacaggacaaagaaaatgtggcatatgtccaccatggaatactatgcacccataaaaaagaatgaaataatgttctttgcagcaacatggatgcatctggagcccatcatcccaagcaatttaatgcagaaacagaaaaccaactatcacaggccctcacttataagtgggaattaagtcttaggtacccacagacgtaaacatgggaccaacagacactagagacttcaaggagggaggagggaatggggcaagacctgagaagcttcctattaggtactatgttcactatccttttgatgggatcaatacaagcccaaacttaagcaccatgctatatacccttataacaaatctgcacatgtacccctgaatctgaaataaaacacgatcggcag

SEQ ID NO: 7866 - DNA, 1323 bp, Homo sapiens
  misc_feature (1)...(1323): n = A,T,C or G
ctttagaggcacggaagagaaaggaagagaggaaagactcctcttcgtagactgaaggagangngggcgtcgagggggaggaaccnagccccgcggcgacgagcccacataagctgaacacggctggcatcttttaagtaggtgnggatgcgcagcccgtgcacgcagattgtatagatcggtctggcgctgcgagcggcggcagccccgccgacccgaccgacccacatttaccgatatgagctagagcacgcgagagcgcagcacagcatgcggacaagtacgaaaagataccagagaacgagaacggacgaggtgaggagtggctagggagctgcgacggaggcgcgagagaacaaggagcgagcgagcgagcgcatagacaacgacggagaggcgcgagtggtaagcctcaagcgtacagagaagagctgccgacnctcacggccacacgcccacaagaccactcacccgccggagagcgaccacgcgcgcgcgacgaaacaacaagtgggataagtagantagggaaccaacttaatgccgtcgcgcgtcatcgatcgatagtcatgtcaccagcntagtcacntacacgacgctgtagacgcgcgacgcacgccgccccgtgctaggataaaggacgcgccgcacagngacgatccgcgtaccgacctcgcccgccggcctgcctcgcgcgcaccacactaatacgtcgagccggctgatacgatgacacgtanccgtaagaagtacatgacacaaatatcgagacgaggggagcgtgccaggcagcgagnagaaggagactggtagagatgggtatgacactcctacgctggactcgagacggatgtgccacgacagtcgactcatgagtagcacgagcaccactcatgagtagacacgaggcacaggaanagtagtctgagacanacaagaagaacacgacgttggtacagggccaagcagacagccagcgtactgacatancgacatacgcgtcacgctaacgacacgncgaacgacgcccagcgctgaccagngcgcggcgccgaatcacgcgtctacgctgccgcaganggaacgccgcgcgactgcggagacggcgcgcgcgcggcgtccgcactatcatgggtagcacgatcgcgtggagccgcgcagcacgctgcgctcacgacacgcaatcgtgcagtgcgactggctccgcgccgccacgaggctcctcacgcgggcggtaccggagcgagacacgatccacggagatacatgagtaggagccagagcgccactaatacaagctcataccccaccgccgcacgacgg

SEQ ID NO: 7867 - DNA, 1097 bp, Homo sapiens
  misc_feature (1)...(1097): n = A,T,C or G
atgttgtgtcagttgactttttgtattgaggactacccatgcgcctacctggtgttggtcctcaatccgatctctatgctcgcttacttgggcggtcggggcgcttgtacgtcctcttctcgccaccataccgtttctctgtctggcggtttatatttcggcgtcggtcgggtcaagctttgggtgtgggtagatgtttttatcattccacttatattcgtgtgtgcgtggtgttatgactacgtcgcgtgcctccacctactctacaaacgatctcgcatccgtcgtttgctctgttaactcgtcttgctgtatctacctttgtcttttctttggactccacaccgttgtccttttgtctctactggtgctttgtcgtcacacactcagcgcngacggacccaacagtgtcgcgggcaaataccgcactggccaaacacgggccaccacgggaaacatggggatgtatcgtggtggccaggacttgtgtagaaacattgctacttaatgggacaaaaccacaggacaacccctcggtgtgccgctcttctagcggtgcactgttcgcgcgtctgtgttcaatccattggctggtacccaaactcatggacggaggggtaactctactggttacacaagcgtgcggggcccgtctggcgggtactttggtatacgctccatcattctttctaatggtaaaaaggttaatcacaaaataaagggggtgaacacaacacaaagtgggggtgttcttcaaccggggtagggctacacagtcacacaccaatgggggtggtcatatgattttatatattctatgcttcattatgtgggggatatatagatatcatggaagcatatacaatggtcgccggtaatggggtgggctcgtactatttttattcacgtcgggtgccgctctaaatcaaatcattggggggtggggtgtccgttgcgccacctggacaactacttattaatttngtactgtcttctcgggntgtacacacacgggtttgggtgtttggctcttgctccttgtacaacgtgggggcggtgtggggacttatctacaatttcaagcggtcgatggttcg

SEQ ID NO: 7868 - DNA, 259 bp, Homo sapiens
caacctccgctccgtgtgatttagttcctgaacgctgtccacacccccaaaaattctttccaccctctcggcaactcccggtcggaactccagatctttttggccaaaagcgcctatccaatacatgtgtcgacccacagacggtttgccccccccacttcgcaatctgagggccaggtcttcttttaattacaccccccaacaaatggcttgcacccccgtcggtttataaaattccaaacggagaggcgttccattt

SEQ ID NO: 7869 - DNA, 2795 bp, Homo sapiens
  misc_feature (1)...(2795): n = A,T,C or G
atcgctcatcacatcacttcatctacanactntactagcattatatgantaatgtctctgtacacatcttactacattttcagcgtcttcaatnctaatactatacactnagtacgcactcttcctacacccgcttccacacggantacaatctctcatacacatcaactctcgtatctgcacatcactcttccacagtatcctctctctggccncctatctcctctctcaattatatctctattatatcatacatctatctctatgatcgtattcctattgtattgtcacttatcctattgtcacctccctctactcactctcgtcctcctactacatcgtctatctatcctccgcgacaatctccgtctagctatatggtcacctctcaccacggctagtctatagtctctcacctctcactnccaccncgcctctatcatgatactactcgcaccatcacacctccagacccancacgatctgtcctgcaacgctgaaatcacgaccgatatagatttagatctcctatactgtacataagctacttgtctantnactattcctctgagtattatgatatactagatatagcaganatatatatancatttatantcntatacnatcgtngtagtcagctcagattcactagccccnccgaccatcntntnctactgcgcanctccgngtctcgctcgacncgtcncctacgacgcngtctctgcgcactgacntctcacgatgaccaancacacntacgttcctnactgctcnaacgacacatacncactactnctcactctacgctccactacacgatgcagctatnnctgcantnattgtcgtatctacataatncttcatnatcntnnctncacgaccagtganacattgactgaacgctacanacnagnaatagcagacttgngtttcatatntactnatanaatgannanatgngttnanacacgtagctaacgtcnatttcgatnctcatactacgcgtacnacnactcagtgcantcagtcgtcgcctgcgcanctncgtcgccatcatagcanctactantantcacgtctcactacagcagtagatatccgnacngagtcatatctntgctntcatctcnatcatctaataccaccgacacnatnctnatgcntcttcncagccgacnatatgatnagtanncagcatctacanncgangattacgtctnnctcaactcagtactgatcactacagtngtagtatcgacngatgacgctncnactcgttatccatgtcttantccagacgacgtancatantttctaccntaatnnattntagtcatcantntgcanntnanccatcanctagcatctctcatgcgtaactgcattcgnatcngactgctgtgttgnnaccacagcatcctcgtaactacngcaacgntactnactactanctacacntacgnatnaccanntccgntantgctgntcgatcatccagnacactgtagnncancagccctgncgctngcccgaacgacgntacttncagctntatcngtaagcngncgccgntgcntcccaacctgcntantcagttactgantantgantcnatcgtnccgcntaagtccagatccacgnatgatcctgaacngaccgaantactcagcntgcgccgtcatncatcatncggtannatgttaaanttnttgntctcagatcatctactgcattcagtcnancaacntgatcgatcacangngtaatgatgtacntgatgtnngactgacgttcctnccnnactactacnntctgactcngagctnagtagnctaacatnaaatntcatnctctganatgcatcgataacntcgatcgnacntgnacgataccgacncactgatcttggatncgcatcatcatcttcatctaagccgccttcnnntcgtcatntncanntantcgnnagnanngtccacnatcntncngacattgacntgctancgtccnnntncatcgtnactnctcctgccnatgcagtcaagtgccngttanctaccgaanattgcttattanntcgactgactacttacgtacatcagtcatcgtcaangtngtanttnnganaatgntacancagnnactnacgnacctnacgtcgnntcnngtanccgtagcagcnacttaactacancatcantagttcntcgatcantttatcnatnctaccagtacgtntgnactccncgctgccagtcagtctgctngtccgtccgttcatcnatgntcnctantgntcnntccgtnttcgttatacctcaaccatngntganctannancntccacctatccagtcactangcncnntcangctgtcgnacaacctnatccatnacgnatcnngtnnnntcnatgtcatncagcgacgccanctaccctacnctncncannntanctcgctgcaccngtanaccgnccanctagacntgnncngtcnactcaatccacatgcgccaacgnanncgtaagcntgcnaacnatcnnanntgactgncctgnnacngtagnnaacntntccancgaannnctanntagtccgnatccatnnttannttgntcgnntttnngtcancnnagttgncntcngacgtcattnntacctagcgntacnntcnncacctgnctnnactgagtcgcgncgtatcccttacnactcaatcgaattaacngatgccatgtnagcagntcgnatcctagcttcgtnaaccnaantacttnntgaaancncatt

SEQ ID NO: 7870 - DNA, 1294 bp, Homo sapiens
  misc_feature (1)...(1294): n = A,T,C or G
gtgtgtggtcttctttggtggtttgtgttctctcctgtcacgtggttgggccttctgtggcttgtcgtggtttctcgtgtgacttggcgaggctggcgtctagtttgggacccaacatttgagggttttagtttgacactgggtggggggtggacatggttgcggcgggcgagtgagggggaaactctactggtaactgcgtgtgtgcacggtgtctgtgctatcatgggtggtggactactcatcacaacacagcgttggtctgtggtgggttacaaactgtagtgtgggactgctgggggtctcgtggtccacggttgtacacctgtgctgggtncgcggtgttactcttgttgttgtggttcaattatacgtggntgcatgacacacttggggcgccgcgctctactccgctgcggtctcatcgtccctcttgggtatctatgtgctcgtgttgtctgggtgatgtctttatcgtgtccgaaatagtgtatataaactggtgtgtacacacacacattgtcattacactggtgtggagtgngactcattacattgtgtgcactggtgcggcgtggctggtggggatcctcacaactggcgattgtacacattcatcactgtgcgttgtggtgtcgtggcatattgcttggttgacatctctggtgtggtggcgagctacctgtgggtgtgtgtgtggtntgngtgcactcacctcaatgactacaccgtaactgcgcatctggcgactacaaggtgatcatccacacctgncgttgtacggggtggcggccccncacttaatatcagctgtgcggcgaatattntaccatcgggtcggtgtgggcgagtcaattaatcagaactacttagttggnggtggtgtgctctgctgtgttggtccttcactgttgtcttctctctctacctcagcttgtgtgtgcgtgtacacatctctctccgacacgtgacacacacatactaacttgtgtgcgtagtagtgacttagtgtggcacccgtgtgttgctatcctcttatantctatagcacgtgtggcgtgacccacacatacaagtaacacacttncgttgtgtgtgggcgtgtgcgctctgccgactcactntggaaactcacacatatccatcgcactccgtgtcatagtatcatgttgttctctacccgtcggtgtggcggggggagtgggcctcgtgtctgtacttctgtgtcaccttgtggttgtgtctgttgtgtggtaaacttgtcacattgatgcaccacgcatacacggtgtgg

SEQ ID NO: 7871 - DNA, 417 bp, Homo sapiens
  misc_feature (1)...(417): n = A,T,C or G
caactccacaccagcgcccggatanacacacttatcctacacgacgggcgcgccgtgtgtacagaacgattggcgtgaacatatcttggttcatgtctttattcttcagttgtcttattaaaacngctcaaattatcctgcgtcgctctttctgcgttaagacgccaattcacgcatcttcgctcgagagacccgccaaaagtattattagcagccggccacgggggtaagtttacccaggggaataacaaaaaaatatcttctcgcacaggaggcccctccccacataaatatgcgaaaccaaatcgagatcttctccccccaccaatttccaaacttaagccgcagggaatttttttaattaaccaccggaacaagtggcccgaacaccccttggggtaaaaaaataccgaaacg

SEQ ID NO: 7872 - DNA, 1689 bp, Homo sapiens
  misc_feature (1)...(1689): n = A,T,C or G
gagagagccggncgccacacgacacagcgcacaccaagcagcgacgtacgaagaagaagaagagagaaggagagangngccctcnnngctaccagagatngaactnangcgagnagncggnnngangngcagccttcnnacgagcgngacgcgncgagaaacccncgcacgagcgcgacagcgagncgcacggcggagcgcagcaggccagagagnacgagagagaggagacagacacgctctctcgagcacacagaccgacgancgagcagcagagacgccgcgccgcgcgcgcagcacgncaaggcagggaaggcgcagcacggaggcacagcgaagangagggcgcgacgagccgngagaccgaagacacancagcagagagagcaggccgcgcgcagggcagaacaacngncacacgagacgcgcanngnagacagagcncagagcgacacgcagagacgganangagcgcaacaangaccacgcggcggagacaccacgccgcaagccggcagcngcgagacacaccagcgccagcagcgcagcagacgaacgngacgcacccacagcacngaggggaagaaagcagaccgngngacaagcaagncgatcgctgacggagggcgcgtgcgaggagcaataggcgcgcgcaagagcgcacgcgcgagccgagacagaggcacacnacccatcatagagaggccagcgccgataggacgcgcgcggagcgcagaacaaagacaggacaacccaagcgacaccgcgcggagtgcacgcagagcgtacaccacacccaagacgccactctacgcagcgacgccagatagagagaaaagcgagcgaacaagaaggagaaggagagtgagtacgcacgcgacaccagagacacagagagcacaccgcgccacggaccgagacgcaccagcagcagaggagaaagaaagaggcagcgaggcacagaggcggacgaacggcgcaatcaacacaaacgacaaagacacagcagcagcacaagcgcgcagtcgcgagacggcgcccgaaccaccacacagaacgagatcacgagacgcaccgccgcgccagcgccgccaaacaacaccgacgcccgcacgaagacgagggacacaatacaggccgaagagacagcaacacgacacaacagaatcacaaacgataagagagcgagcgaacagacaagcgcccgagaggacccgaggacccgcagcgcgtcagaagacagcccacgtctacgacgacagacggcagaggcacagcagacatcaaacgacaaggcgcgaacagcacacgacgcgcgacgaacggacagtcagccgacgagaccgcggacatacggcaagcacacacacacanagcgtgcggcggacacacagaacaacacgcagtgcgagacatcgcgcgcgcggacgcgcacgtccgacgatacaccatactgcgcgatgccctcagcacccacgcgcacagcgagcgagtagagagacgcagacncngcacaccgcccacccaacgcaccgcgagcgacatacacacgaccacaancaccagcaacgcgaccacctctccacgccgncacacacggcgcacacnaggagacaagcaaaactcggacagccacatacgacaagcggcggaccgcagcaagagagagcggcgcaccgggcacaaaga

SEQ ID NO: 7873 - DNA, 1577 bp, Homo sapiens
  misc_feature (1)...(1577): n = A,T,C or G
ggagattatacttctgttgatctatcgtcaggtatagagagcaacctaagtgcgtgcctacngagggccaacacacgccgccgtgagtcgcgtttcgtgccgccagacgatacaattcgcgtgcgagtgatgcgcagcgagctatagttgcggctgtggagaccgctatgaggtcgtgagcgcacgacacgcagatggcgtgtcgatgatagtttacctgtgtagcgctttcacgcgactgtgcagagcgcaccagtaacatctttattcgatctacactngncgctatngcatgtgcgaccgcacggtgataatgtgctacgagttgacccgacgcagcagtgtagtcgatacacgcgcgtagagcggaccgctcgggactctgcgnaagacagcgcgcgtgcgaccagaacagcgtagagcgcagttaatgtgatatatgtagccgctcgcaacgccgactagacagttatactgcgcgagtctgcgcttatcgcggtaggacatagatnttgagactctcatcaacagtantgacgactatagatcggtcatcctagaagcgacatgacacactatagtgntganntaatgagtgctcgcgttacgctcgttgtgagatcacagtgcgccgcaagccgatcgtttatggtacatattgttgatttgtttattcatgangtttnagttacgttgaagtgataggtaacgcaagcgggntgaaaattgcggataacttaacatagaatgataataattgttgcacntgtggtgcgatgagcgcgcaccacaatactacgtggctacacgcgacttacgattctaacggcccacggtgtacagaagngtgacgagggcacagtgtatgacaagattagaatacaccagcatcaggccagngtcgccgagggcgtcgacctgtctatcgcctcaagctcaccaccgcgagcagatgagtggtaccacatcaataccattgtcgtgcgagagtnatgtgtcacacgctcacgtaacgatagactgacaagtcacagctcgctagatatagcgaatatggaatctcacacgactcggagatgagagatgcgctacgtagttgacgctacacatagacctctgtgatgccagtctctgctcttgcgtnacnttctcatatccgtgatgatcacaatgctacatatatcgtctgtaantcgatagacgttgtctatatcntcatagattatatgagtgataatgtgatgtgganatatgtgttnaacatgcagcagtgtacgaagcngcgatctagctactgagctacatagtgcacgtgctaagtcacacacaccantgtgactgtgttatcatacacaataacatngtagcgcacagactgcggacgacatgctgcacntgtgactgagtctantatnctgtcgatgatcactngngcgcgtcacatncagcactgcatatcagatgnacaggagacgacgagtgcatcaagtgcatagaanagntgcgacgacaagaggacgtcatcacctaccatgacagcgtgagatgtaccgnctgcgtcggacangtagagtgag

SEQ ID NO: 7874 - DNA, 2107 bp, Homo sapiens
  misc_feature (1)...(2107): n = A,T,C or G
acaggganatatcgcgacgacagtcancanagactcnagcggtgtagncgnctncgtatgacntcgtagcgacccggtacgcnagctcagtngagtcttctgagcgctcaggcgcancgagccgtacatagctatgatatgtctctgtnatctacggactgtgtgtcncgatagcgacggtntgcagcgtgtcgagcgtgtcgagtacanagtctnctctgccacgacnacatcaacgcgacnatcactatactctancatgactcntccnagtcgcagtcgtgntgtcacgactaaaatgacgcgtgtngcggantcncagtcanatgcgacngctgatatgtgtaatgatgacgcatnactagtcgattgacgactgacatgtgacgggatcgatatatgacngacgcngncacgaactcntactctcagatgcgancatcatcngncagtgaggatacgatacatgactggcagcagatgatgctcagactgcgcagtntgagcnaggtntngatcangnactagctatcgccagcnactacgactnactgcntggtgatggcgantgangcncgcagatcgttgngnccgtcntactactgactgactgcgtcgtgagtgcgacgggctcntncgacgcantcgtgacgatctcgntctcntcgctagggctcactctctccacatncgtagaccanctgctccgtagncnactactcnctgtctatctcgcgctcacgaattngatgcacangatncgncactggacatcgngcancgtgacgtacgaattgtcatcacactgangctgcgactatcgncacgacnctgatngtcgacancnatcgctgagcngatatgntncntacantantgatacntgatcacngatctactcatgagtgtgtcagagcgacgtcgacngaagcgcagcgcgatgcgaatcctacagtatgnaggtctgactactagcacatcatngangtacgtatgtagtgcatctgagatcatgtaccactgtagattatgtgtatacagtagaatatgcgagtatcatacctcatcacacgtcgtagacagatgtgctagtcacacgncagaacngttcgcacagagtacacacagngntgcncacagacgagtcgcgtgagtcggtcgacatgctgccatttaactatnactatatgtgacatagcgtcnatgctctattagagnatatctcaananaagntagcgagnctatngcgctggacactgtntgcgagatgttactcgcatagagcgtgcatcacntcantataactacatctcatagtgcgtanattgctgccacatagcgctctgtgttatagcgtacatgcgcgtagcagccnactcagcgcnagctatagagagcgcagaccctcatacgatacgtcataggagactgatactctgacgactatctacttctgttatagacacattgtcatgctatgtcncagcacacacgtgacataattatgctatcgagtgtactgatcgagcatacatacgagtgtcgtgtaattgtgagtagagtctggttgatgtgtcgtgctatcgtgacgagtctcacgttgtcttcacantcgngtcgcgncgancgtccatgtagatagnagcgacgtgtcacatcatcacgcatcttgtncatatcncagatggacgcgacgntatgcgtacatgcacgacgtctntatcacatgcatgtcgtgctcagctgtganctgtgtgatatagacaccnacgcncgctcgctcgcnagtgtcagcagagngatcgtgagaaaacgacactagacactacatactgactcagcaagcgtcgtgacatgttcgtgtcaacagagacatctntcagtgancgcgtancgtcatcgtgtgatccgcgaatagtctcaccagacactagcgcgtcgtangtaccatcacgtgtatctcgtacgatactnagtcgctatnattancnctgntgacagtcatactacactgatctatgatcatcncngtagcgcgcgtaggacgcatnagcaatgtcgatgatcatacatagtaaacgacntcgcgtccnctctatattagat

SEQ ID NO: 7875 - DNA, 764 bp, Homo sapiens
ttgagagcaatggcgcgatttcggctcacagcaacctccgcctcctgggttcaagctattctcctgcctcaacaacctcctgagggctgggattacaggtcctcagagccacctccatcttcctccttgcaatgaatcccactccactcacaccacgggtcccggctacactccgccatcttctctgtctgctggcaaaaatgacctcaagtatttcttccatatgtaggttttcgtccacggttccaggctcataactcccacagccctgtatagagcctttcgattatgatgttggctgcgttaggccctaggagcaggccttggggaaacagaatctctctggcctattccctgcctcctttcacccgctaaggccggacttaaactccctcaacctttctgattgtgggaccctaattcgcagagagggtcctggcccatacctctgggagaaggaatgctgtggttatgaatcttctataaaaacccaagaggcctggttcatagagcttctccatagctgaccatgtgaggctcctagagtgtggggtgccccggaggggatggagcctccacaccctgtcccactatttctgccctacacaacgcttgatctgtatcggtgcgagtatccttcataatgaaccgacagacacagacggtcggcgtctccctgtaatgaggggtaatacgatgatcctcgctccctgaactcagtgggctaatacatgagatgcggccagcgtacttgttgcactaag

SEQ ID NO: 7876 - DNA, 1381 bp, Homo sapiens
  misc_feature (1)...(1381): n = A,T,C or G
tgtgatggtgggtgagacgggtctataataacgcaggcgagccagcgtggttactggggaaacaagagaaagaagacaatttttagtgaaggaacaagacaacntggcgttgaacgaggaggcggcaccgagcgctccaaatacgcgattttagtattggtagtgagtgggacgtggtcgcgtgcgactgcccagcgcgaggcgatcgactaacacacgcggcctatcgagagaccctaggcgatataagtataccggatcaaggctggaatcggagacagaagcatagagtgcgggaagccatactcaacgcatcataaactcgcacttgccgtacagcagattagtgacaaggcgagcaaagcattgtgggatgctgacattatagcacgagtagaaacttagcgctaaccacctccgtgctcggtatcacctgcaaccagatcaaatcttgaaccagtatggccgcccgatgcacgagtaagataccccattgtactcgttgtcgggagatgtggatgaagatgatgttgttgcattgtgatacgattnacatgcctcagtggtaacgcggtggtattcgtagccaagtgcgtaaactggtgcgacttgattagtgcattagtcgcgacaactcagtggcaacagcgagcaaagcgatataacctacgtccgaagtacatactctgttcgatggcggcgacttgncgagaaatatagcagacggtgcatgtagatgagantgcaccgcgacgcatacactcatctgatcagcacatggcgctgtcaacgcgtgaccgnaatcactgaagaaggagacgtgcgcggtgagcaagcatatcacaagatcgcactgacaaccgctgcccgtgacacncggcgactgtcgctccncggcctcgcgaccncgtacagcgcgcctncgtggtagtgaccgcacctgcgtgcgtcagtagaacaatatatgaanagatatagtcacaacatactggtggtgtcatcaactggtgtctagacaagttctataccgtgctcgcgtgggagtacgcttcgagaatgntagggtgagtagatagcgaatatatggtgttatatgagagcgtcggtgcagcgcacgaatacagagatatagagaacgcgagtccgatcgacgtcgcgcggtgctacgcgcggtcgaccacagacagctancacaaatgcacgtancactttctccctcgttatgtntagcgcaacgcgcgttgtatcattcgcgcgcggcatctcgacangacacgcagcacctgngactcactggactaatgccagaaacacgngacggccacgctcgcgacnaccgcagccgagtgagagagnggacgcgacgangcagatgatgagg

SEQ ID NO: 7877 - DNA, 1408 bp, Homo sapiens
  misc_feature (1)...(1408): n = A,T,C or G
gtgaataataaagatcatcacgactacatcgtagcgcgtaggttctgacctactcataagatanatgcttatcagccancagtataatancctgttaccatgtcgctagttcggtgcatgctatcattatntagatanggcacgctgtacatcgaattgcaacaggtatattatacagtatcaccaggntaagtatacaatacaagatcaaatgagttactaacaacgctgaggattaatggtagtgcttgttgcgtaaatacagtacagtagatgtgtagacgagagagtggtgggtgtggtgtgtaactaaatagtcgtagtaccgtgtctctaatctaggatatgctttatgcatgacgagccatttagccttatgatatcgccaagacgctaacaacactatcgctcctcgcgttcgtacgaatgtctaatgatgcgagacattagatatgagatggaactcaacgtctattatacatcagcactagaaattagctgccaagattagcacttagtagctctgcggtatagcaacaagcgagtaccacgcatacgaagataatgcgtagatgtcagtcagaaacaactacatctatgaggctgataaatacattacgcagagacagtattagtccgtgtactaataatcatgatctattagactactgaaccacatgacaaacatacacaaataactagcttcactactatcgatatcgttaaatcaaacgaacttctgattgtcataactatctcgtgaattacatctacactacaactcctgaccactccctcccagtggtgccatatgagattgacaccaatgtacgaaacaagagagtgagaaatacaacaaatatgtagcaactcgtgtctacatcgaacactcgccatcacgaccatacgaaaaacgacgacccgcgcactacagggaatcactgatcgtctgctacctgttgggcaacacaacacactaggtgcgtgctgatcctctttgtcaacgtctagaatatctccaatgattgactacgcacgtgtggatagatccatctacacacatatagatcaatcatatagtaagtgatatatatgtagcatgaccaagcgcaatgataataatgaaatatagtgtccgctatatctattctaaataatatatgtaactacgccccgccacctgcattaccgagcattgagaggcaggcgtcacgcacgactaacgagagtgagcgtagtgtatcgagtgaatcgccgcgaactacgcagttgttacatctcgtaactacactgttctacaccacatagtacaaacaatcctcttactcntgccgtatgagcacacacagcatgtatacgacacacacctgctcatcagctgcgtgcgagaacaagccatcacaatcat

SEQ ID NO: 7878 - DNA, 915 bp, Homo sapiens
  misc_feature (1)...(915): n = A,T,C or G
atattgttgttctcgtcggtttcaccctatacttgccgggccataaccgcagaataaagtgtatctccgcaacaaacagagggggtggacaataccatacgcaatctgttttaatttgcacgacggaatattgcgccttctgcgccatcgccatctctaaacgaagttttgtaatgtgttttcactcccgccccagagagaacccccagaaagtcctaggcatccttttttggtcatcaagctgcgagactggaactctcgttacctgttgtgtaattgggcaaatccagtccctggactcctcaaggcacaaggcaggaaaataccctcgtgaatatttcaacgaagcagcaaaaggactccgatgcaagtattatgctgcaaaaattttattatttcatntgtaagcatccaactctacttttggcaattgctttgtaagcccgttatgttgtaccctttccttcctttcatctgctcatctgttggcttgggctaacttcatctttttttcaacctgagtgctccagttctttctgcaggtcacagagcgattggcacttcccctttcatgacttcttggtccccagagcagatccacctttttatgcttctatgcagaaatcacactgtatttctgaaacatcatttttttattgtgtgcatctcttctctgggtgccttggaggaagggacatattgtttctgtggaatgtctgattccatgtgtgcacctcaaatagcactctatacagtgggacagactggagtgcaaatgcctttcatagcatttattattgatggagcttaataattaagtggtcagccacggcctttattatctcatcttaaaactaaaggtacagagccaaataaccaattttcataggaattaaataaaaattgatcggccag

SEQ ID NO: 7879 - DNA, 1914 bp, Homo sapiens
  misc_feature (1)...(1914): n = A,T,C or G
actagtccgcctcatctatcccaggttcacacttctgtttgttatcgtgcgatcatccacttctcatccactcctttttcctgctcctctatctctcgtagtatntatctcatttctatcgctantctatgtactcccgcagcaatacgccaccgtttcctcaccacatatcgtctcttacacgcacctcgtctcttctcaccacactatatccacatcactacaactcaatctggtctacagactgcgngtgttgatanatagcacaatcatccttcgatgccctatctatctcttccacctcctcatctgctcctcccgcactctctgcctcgactacgtcactcctactncttatcaacctctcacacaacctccgattcaccattgcactattcctgtcctcgactctcgctctcattcctgctatcgtaatctcttctccacgtcacgtgttgctctcactacatcagtcactctcgtcttctctctctactacactgctgcgctctcatctcattcattaccctactctcgtctgcacctacatattattatacgctcacgtgatcgctctgcttnagtgtntgtatctatcanctcgcgcgctctgctcatctctgacttatcacaatcgatagcgccagatcagcagacgactgcctacacgcccactaccgatcgctatcatgactcantactatgactgatatacaactgntgactcccatactacatcactnctgtcctgcgtcgctgctctgatgtgcanangtcgactagatattatattactntgattgattatnatnatatnntntattattgantatgacctcngatncagcacgtcntcgtgcgatgcactntcacacatacntacataccatctanatactttgatctacgtgnactctcactctcaccccnctactatcgnctnactacatactcaacggcgttcgcgacatattcatcactcgtatagtaggctgtgtcgcacttctagtgatatctctagactactatcgctgattgtgtagtctcagttcgtanctacngttgctctcgcttcgcnatccatatctatcgcatcgtaaangtctcacctcctatcattagaatctntatgcagnagatntgntggctgtgcgctgactcgtgagntctgagtctcgagtgcttattcgtcanactatggctgcgtgatcatctcgantgctcgatactaatcatcacatatatatatctacatancgtcatctgagttctgtgtntgtttttacatacacacatntagtgcgctagtgtctcncctatcactcaatncatcatattcatgcacangcgagcgctacgcntgctgcattnactcgtgtataatctatanatacatacgtcgtncntatctctgcgtcgcttnactctgcatataccggctctgcatctgncnatcacagaccacgtgtcttacancgcgngtcgctctcgatctatctctatnacactganagttagctgcaggacaccnactcatactacantcgacaattactgcgcgncgtcncncgtctngtatctgctctctcatgcccgtctctcgctctcacccnctcgcancgcacntcattcatatgtgtcctactcacacctctccacacacacattgtactagtctnatcgngcgatgacatntncncagctactccgtctccacacatctctgcgcaatcatnacgncgaggtcntgatactttcgcactttccacacctcacacgcacctaggcctcacgtcgataactctccnccgcgcncacacatcagctnnaantattcgacacacaccacctggcgatcnacgctcganaactaccttgnacatatctccgcgatcacctccgctgctatcacag

SEQ ID NO: 7880 - DNA, 1532 bp, Homo sapiens
  misc_feature (1)...(1532): n = A,T,C or G
atgatttttaattacacttcatcaacttctcctgaccatcgagacgctctcctgtcgactgttcgtagtggtgacaagactgctcactgtggtatcttcatagcgtcctaatgtgagtgcgtcagagtagctgcgcgtgtatcactacactacttacgacagacatcgttggctacgtgtctacttaactcacttacttaatcaatcatatgttctcgaaatgggatgattggacatatatcagattatttttactagtatattgttgctggaggagatgacacatccacacatcaccacattatgacatcaatcatgcgctatctaatgcttgtgtatatagtgaaatattagctctgcgtatgtctgagagagtgtgatagcaacatagaaataagaacttgtttataagaagtagantccgtgtggatatgaggcgagtagcgtggaataacaangcatgagcagcgtgggccacaaatacacggtcggcgctaacataatcagcgcatgtagtgnaatatattggctgccgtcgtatcttagagtggcatcggtccatctcgaatgatagccaatataagagtcatggatatatagttgtacatagaatacactctcacatcaaatatgatattcgtgttgcatatccgaatcgagcacaagtggaaaggaagacaactcctcgatccacagcgcctatcgcacactatccaacgcatactcgctgtaggacggcagaccaaatacgtcatatcacacaaacactctgcgacacatacgacctcagaccgaatcacttgtggctcggttgtgtgatgttgtcactgcgtccaacacaccctgtgtggtgtagtcagtataatacaatagtatnagaaggcagaatatgtcgtcacatcatcgatccaatctctcatcactgttccgagacatagacacatacagcgactccgttcactactctgtggacagaagaactcgctcgactgatactagtgttcttgancatatctagcactcggaggcgggtggagcacacactgtgtgctagctatacgntcgagcacgcgtagtcgcagatactgtgctagatctataggtcgtgctagcatctgcgtngagtactcagacgactgcgtgtgctntctgatagagacgccgtgtacatacagcatagagagatcgntacatcagagtgtgatgcantcgagtaggagaacagatagcatgtctgagacgaagagagcacacaatacgacacgcggncgcgtccgtagccagactctgctgatacgctgtatagtgtctatgaatatacagtgtccnactccncagtatccgagacggtagctctttgaatatangttcctctatcatgtaacatagcgattatacaactcatctagtactacgctgacatctcacacgtctctacatacgtagtttattnctatggtgatctcacaatagacagcgtgacacacancatactacatcactcgtgtctgggctcaagcaacacacgatct

SEQ ID NO: 7881 - DNA, 1592 bp, Homo sapiens
  misc_feature (1)...(1592): n = A,T,C or G
agcagcacacacacaggacnacagcgcaccaacgtgaggattagacgagggtgacgagacagagnagcagtgccttcgcggcagggaggaaacaaaagnanaacgaagaaccaccctctaagagacgcgacagagcgaccaacncgacgcacgccgtcgaagagacgcacgcgcgngctaaggacgacgcgcgcgagctagcgcaaacaaagacgcgacgcaagccggtggaccgccacagaagacagaggcagagacacgctaccgcgaatccgaagaggcgcgacgcggagagacacgcagccgccagcaacagcacgcgnaccaggccgcagccgagnccacgcggcgcgagagcgcgcgtgacagggtgacgacagccggcgcaacagcagaaacacgacncgagatgagcgaacacacagagacaccagagcagacaagaagagtagaggagtagacacgaacagacacacacaccgcncgcacccacancacgacgaccgcgagcacgacgcagctacgcagcgacagacgccacacgagccacgcgacgctgtaatgactcaccgcacacgccgncgagcaaccagactaccgatgacnaccgatcagtccgaacgcgagaacccgagatagcggagcccagtacgcgcgtggaagaaaacagataggaggaacagctaacgagaaggcgagaatacgagaaaggagcggatcatgggcgacagagacccaancggacgcacccaagagcaggagaggcgctaccgagacagagtgacgcgagaaggcgcgcagagggtgtgggtggcgcanagcgagagnatcggacggagagaaagacgacgaaagagagcacacctcaccgacgaaacacaagccacactcgaaacatagcagataggaggagcacacacgcggcgagggaagtgnacgaggcgagcgacgcgcggagcgccccagcacgatacatcgagagagcgtatacactgagacgacagccgccactgagcactgtacggtgagccagaacgacaacacaccgacacgcgagacgatactgtcgcagcctaggccgaagaccgatcgcggagaacgatagcagacgaccaataacaccgagtgaagacgggagtgaagacgcgtcgaccaagatgtagacaaccactctactcacattcaaccacgcgcgcggtgagaacagaccgagcacgcacagacgnaggcagagagagagacacatcgagagaccgagcatgancgagccggaccggagagaggatgtagcgcgacatagattcacaaccgacgacaagagcggagacagcgcacatcatatcatagaacacgaatgcagagccgcgtgcgnggcgtnacagcacacgctaaccacgacgatntagatagcacgcctcaaccaggttcctnggcttgacgacacagaccgagatgntgcgaccgacacacatggcgtcgcgccgaggcgcagagncgagaggcacagcactcagcacgcacagaacgcgcgcccacacggaccacgaccgcgcgaccaaatcagagaacgcgcccgcggcgacgaggagaag

SEQ ID NO: 7882 - DNA, 2079 bp, Homo sapiens
  misc_feature (1)...(2079): n = A,T,C or G
gtgatatggcatacggcagtcccggctaagcgcgcatcagtcactgctgtagcaccatatctacatcccctggctgggagtacgcgncacgcgttcggcagctccancgcgcntcacggccgagtacgggtaacgcnatggctatgatcgtcacgcgacactgatgatcataagctatgatacacccggccacgcagggcagacagttgacgagtggagagtgctaactaagaccacgccgcactgcttctactgtacctacgactgntctaatangtaganacagaggagtggtagctgagacantcaagaagtattagagtatgttgatagtagatcgtcgacgagcagtggagtcgtggcgcactctccncacacgcatgatatatcgcagtacgtgtggctctctcgtaganatctacagtagtacagtctcgtatccatgacgtaggactgacatgctgatctagtatgtgctatnactactgctgccgcaggagcnatcagcgcactggcgatctgatcntggtctcgcacgaacatgggtagtgacactgtgtgagtctgttactaagtaaggagtacactnacgcacgcatatcgtcacagtctcttccgatacacgttctgaagagaactgacaagtctgtggagcgagcagttagtagtgagatgagtagcgtatctnctacgtncggtagagcgatgaagntatctganactacgtagtaatacaatantcttgacgatcactataccactctgcagcgagctacagatatatatctagagtatagcgtggcagtatncggtactgtggccgtgtatgtgttcgatcgcatagcatctactctgagtatgcactggtcacagtagtacgtgtagtnttatcnatctggctatanagtgcatctcgatactgactcgagtgagataggtagacactcctgctcntctcgcttantntaacgctacgagtntatcagtctcacgatatagcgtacaaantatatgatcgagnagatgagtcagcctcgtgacagantatatctatacaagagtgacattgcatcatgtgtgagtggctatagtacgtgtgtgagcggatatgntangtaggtagtgtgcagatgagatatgtacgtatatagtgactgttngaggantagagatatagagtttagtagtatnagtcattctgatatagngtcagtaacagtcatgacgatcagtgatgaatcatagaatactcatncgtgactggctactcacagtcatantgtacagacgctagcactagcagacactacnctgatcgantctcgnntgacgatgtgacgcacatcacgacaacnacactntgacgagctctgtggnacagagnacctgactagatgactgcactancaactacgtcanacnacgacgctgatgcatatgacncgtcgctacttctngacnagaggtgctcgagctcatancatacgatcgacggctctcgctgacgagagctactcagacgtctantacatcagagcatgagcganntaatantcgttgtatctnataaccatcagcatcantnagcatctcncatatncatcaantatagcaagtcgatnacgatctctcacgttcaaagttagcaatagcctagtcgtacgtaagacgctannatcagcagtagntgacgatgaaatgtancgntatgactgactancgtcngttatagtagacgctgagccactctgcatcctcntgatcagtcagcacatagcacgatgctatntcagtangtcgcntgttgtcgatgctacaagtganaganacgantcgacantactatgaacgtcgtnnagaccagatnagagtcgtgtctcgacgtntaagctcagtgtagcntagcacagcatcgtaattaatcacgnncactctaatcatgaatgnagtgntgtatccgttgatngnctgcgtaacctacgctcgatatagtgagnngagtagctnagccanaccatntcntactgcaanacgaggactgaggtgntgtgacnatcgtagtcagangacgacagtacg

SEQ ID NO: 7883 - DNA, 864 bp, Homo sapiens
catcaaattaacaccgctcatagtaacttggcgaggcagtaacgcacaccagggttcatctcggccaccaagccaggcacacccacaaaccacgcatactctgggagcctcatggtatccatgattcccccaattttatgatctaataacagctctatttttaaggagcccctatcacttacaaacactctaccgatagagattcactcctctcactcctttcccttctttaaaacaggcgatttcaattatagccccaaggtgagttcatcgtgcgatttaggctcccgcaagtattcctttcagtatcatccaatctcgagcccaaccctccctagtagctggagcaacagcacccgcccccacattcggctaattttttgtattttcagtagagaggaggtttcaccgcgttagccagaatggtctttatctcctgcccttgtgatccacccgcgtcagcctcccagaagtgctgggattacaggagtgagccaccgcgcccggccatgagtttcttaatttaatatttgtttctttaagggatcaggctggcagcaatgtcatggagatatcgatgtgcttcactgagaggaaaatagttgtgcttctttggggaaggggcttaattcataaggtagttcactaaactcaatgcagatcctcaaaccatatgactttgtaaatttgtctaaggatcaaatcatttgttccaatttagtgtttctgactttctgagaataatatttccaagaacacccaggagaatgcaaagtatgaataatcccatatctgtctctccttttttaaattaaaaaaaaaagataataaaagacaaattaaaataaaaccggtatcggcaag

SEQ ID NO: 7884 - DNA, 1942 bp, Homo sapiens
  misc_feature (1)...(1942): n = A,T,C or G
aaataagcgtagaacatggagcatgtancnaagcagacacgagagccaactggtgtnngcaaagctcatcgagtccnctcagcctcgcncnagnctgngcgtactgtgtcactcactagtctctganctacactggcgtctgtntcactccngtanctantccgactctgctncnnncatcttatacctcncctgaccactgcatgacacacctgtcggctgntcncactcgtgtagcgtggcnntcncctgtcatgtgagctgcgtcngacgatcnatcgtctcagctacgcattnacatatcctgctntctnntatgatgctgctgttatgtcagtgtacgtcgcggtcgatgcgcgttagctagtctcgcagcgctctgacgacatcgcaccgcgtcctcccttctgcacgcgcgttcantnntacagcagtgtnacgcgcgatatcgcagtggcntacgagtcgcgtcagccgcagcagtttagagtcgtcacancgcagcccagtatacgtcnatcgtcgctccgcagccatatcgtcgtagtccgcgatttagccacggatctcgcgtcctctcccacagcccacttcactgcgaccatcgcgtgctcgctcncacgncgcgcgcgncgcagaacgtcnctgactcgtacggcgcgnncacctcatcgnccactcccgtctccacgtatgcgtccgctatcgcgcgcgctacgctacgcgtntctatacagcttattntncacgntcttacatgatgtnncctagaagaacgcngcacagtcgncgaagagactgcggtcacagacgagttgctnatcatagttngctttntatcgcgcgacgtctcgctctcatgctcagtgcatctatcacgtagacgctnctcgacgcatgtaccgtcttggatnnnatggctgctgtgttctctatgtagcnattagtgctngtcntgtccaatcgagtggtgntctcgtcactcacttatacgttatattatactacacgattccatctcgcgttgacgctgcgatatcatgctacgcatcatagcttcgtgccactatcaggtggatncanacgcgacatggagcgtgtgngtcgcatnacatcgntatcagcagtagancgtnacagctggactctacactgcttactcttcccgctttatatcatgcagcatctgcgcgcgcgtcatcgatgcgtncntccgactctgcatcgcatcatatgagtgcgcgcgtgagtcantcgaatgcatgtacgnnntacncacncnagcgcgatctctactactcacattagcatcactctccgctncanatccnncgtaagtgacgaacgtgtcgacanagagttagctatgttccccgctagtcgtgtgtgcgtgctctgtgtgtgcggctcatcancatctttncnagctagtgtgcgtgacgctcgacgtgatctatgtatgagtcgtctgtncacatactactctaccgcattcgcacgttncnantgtagtcgctgctgtcccgcgcacgtgtgctgtcgcncgcctctgcgtgtcgacncgtcagtcatatgagtacacatcgacgtncatactgtctatcgtcagcntctcactaccgtatcgntctactntcgttcttntatagattgtgtnctctcctcgcacacgtgctctcntctacatgtctatcaactggtattgattccactctgtgtctatcgtagtctcatagntcggcctccatccactctctgacaggccgtgcgacgttcgcgtcagactcctcgcaactgaccgactgtcatgtcncncctatcgcgctgcgccntcactgtcctctctctgtgcctttcagtgagnctnctatgtctcagactgttgncgcgtatcgtatactagcgctgctcgactgtgcaatatatattgtcatatctcaat

SEQ ID NO: 7885 - DNA, 934 bp, Homo sapiens
acataagtgtatgacgcacaaaagaagaaggggaggggcttgtctgcgacgactctcttaatcctccaccgctacacatcatttcagtggctctcttacaagagctggaatcattgacctttagagatggacagaatccaagagatacgaaggccaacttgtgtctaaagaagagaaacctgaaggctaggaattcccagagatgcctgtcatcacacagctggttaggagaaatgtcataataaaaatgtgagctgctgaaaaaaaaaattcttctatagggaaaaacaacgacaaacgaaacagacaaacaagaaccctgagtcccactcaccatgtttcaccaagtgggtccgccaccaattaccttcggtgcaggtgactccattatttttatttaagtttttgtttttaattagtgtggcgtattgttcctaactggattaactattcctcgagggtccattaccattttcgtacaacattccagagatattattgactgatacaatcttgtccccctcttcgcctatcaatcgcctcaagatcggtggtatatggcccgcaacttcgggggcataagggagtgggcttcctctccgtgggaggcccttttaatttattatggtcctcgtgatttaaatgttcgcaagtttctccaaaacaataacaacaaaactggcgtttgcatgagaaaaaaaccccgagtgagcataatgtatagatccacttaacgcggaaaacgttatcataagaaattatttcgtactcaacaaggcgacgcaggcctccacatacacactgcaatatatgcatagaagacgaaataaaaggcagaagaaaaaggggacaaacaacggggtggtggggcaaacagggcaccacctacaattaaaaagtggataggtgctttccccttatttaaagtattatg

SEQ ID NO: 7886 - DNA, 812 bp, Homo sapiens
cggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaatttccagacaaagagatcttttattggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaaccccaacccaagcttcaggagtgcaacttggatccttgtccagccaggtcagtcaaattttgctaattcattcgtcataaacctaactcaggtccaaatatggtatttaaattaaaatgaaacgttttattaaaaattaaatggaattaaacttccaagaaaaaaaatataatactttatttgtagcttatacaggttctgaagtttatatttctgtaataatttatttgctgcgtcggcgggtcttattatagtggaggggatctcatatccctctactaacagcagctcacgccggtgctagagtagcggggggagcgggtatctcgcccattcagccgtcattcactacgccataatgaagggtgcagcatggc

SEQ ID NO: 7887 - DNA, 838 bp, Homo sapiens
tctctttccaggtgatatgtacaaaagtaatacaaacagcactcagtggaaggtctttgtagatacttctcacaatcaatctggactaaagtcccatgcctaagttcttaccgaggaaggagacaaagccagcccagatcttcagtagaagcagacggtgtgaagaaagctttttcctgccttctcctccattcgtaatagcagctcctccagactgtcttccatgtcgtcggactgctgcaggcactggcaaatctcacagatgaggaaagctcccaggatggcaccttccaaggtatctttgatgtccatgttgatcacgtgcacaggctgaaaggtctgctgttctctggaacacagatcttccaccagtggggaatagacacgctcctgacaggtaaagatgaactcgaaagagttcaggtgcattccttgaaatctgtcttggagccaggttggattctgtcattggcttccaaagatctataagattgcattgtcgggacgaccatactctatcctttcccgagagaggtcattttacatttgcttaagatagtgctaacaaaatcgcaatctaaatgataattgcggtttctaattcggaaagctacaatgggaatgtaattagcctaataacggtttctttaataccttgtttaccgaggatgccctaggccctcactggttgctgggattggagatatgtccacacatactgtctgacgttgaagtattcagtgttggcgacattggatcacagtgatcggggcgactaggtcgactaggcctgaacgaagtgatcactaatattacaagtttgtgaagagcatttcgg

SEQ ID NO: 7888 - DNA, 2532 bp, Homo sapiens
  misc_feature (1)...(2532): n = A,T,C or G
ancatgtagnananagcaggagaacagtntnaactataatcntgtgcgcgtgtgtagagagcatcgtagagtnatctcatctgatntgtncagcnacnattacgatgatcgctgcagacngactacgattagacagcatgtacacgacagattgacgtataatacagtatagagantagcagccgagcgtacacaacacgaagacagcacacgactataatcangatgcagcactcnagcatcagcaccctacncgcntgtatcgcnaganacgancgatccgcagtcctgtacgtgagagcgcagncaagccgacgcacantcgtagtacggatagtagacntanatgagatatatcgtatagatcgatgcggcgtatgtatcatcatacgtaacgtgaatgacagcatctnganaanacganacgatcaaacgtgcatcatntagtcaactntaccactgtctcagtcactgactcagcctgcgacnacgacacgncgacagcgcacatttgatcatacagactgantagtctgtcgcncgaagcgagatcganngacgcgcgagagagtacnaagagtcagacgctcatgaccatagtaccgatcatangacgcaagnatgatcgagctatgatgtcgcttactagtgctgctcgtagcacgagcactagtgacatcacatagcagatcatccgatgcgtcgcgtagcgggacgatgacactatcatacgcgagacgagagacgttactnagancaaagtctnacgangtaccaaatgtgagatgngcnatgtcactcgacntacgtgngatcgtagcgacgtatgctgtgtctctntagatgnatgatgtangattagnaantgatgtngatgagnagcatgatgtcgtangangtgctgattgcagatagataggacagngcgaacnagnagnacatagcancacaccagtcaacgncacgatngatcatcagcgntngtcgactgantnatntntcatcatcngcngtagcaagnagncnctngcagagcnntactcgctaagacgaaggctcacatancacaacgctacntacgtcagagtcagatgcacntgcgannaggtcctcgttgntacatctcgantgaacngcacctngtngangnngaacgatangactgantgnacnganntgntntntgtcngangngcgacgacnngnagncgnatatncangcgtcagtggtnganagtaccancatcacgtacgcagcnacactgcancactncgcatcggncgncgnagctgtgactgaagnatnagngnagtacctgattaagcagnaantcagnacatcgacatncatgcagtntacngtcgtnntnangaaagcagctatntagtaggtncatacctatcgtacgtcgcaatcaatgacgacactgcaaatnagcaantactactantacancngctgnnntcgtcatcgantatcggtgatgcagnantactgntagatgaatcagtcctacatnactgcgatcgnatcganatngangcagagagcatgatagtgatactacagaactanctcnaactaancaatacancagcangcgtcgtnncntnngcagatncnaaatcntctcgtnaagagtacngagtacatcagatcatcgacaacgatgtncgnaggacagngaagtactanatgncnacatcgntgaangagtcagcaacngtacagtcagatgagtnatngtgacgangcagnttgagngacgtagcntnncgnacgacgactgntgntggtcgtatnagtcgangaancatgagctactangtcatacgangtaccttcatagntgtananatcgacaaacncgtagtactangctagntanctgcagcagtcgagacgtagcatgcacntacagtantcatcaacaacagtgangagancgatcactnctctgtctactgtactgtacataggacatcaaacgcaggacacgacgcacacgtcganccgtgatctnganactangcaagtgctantcacatgnacacangaatgatgacgatggatactatngcactcgaatcacagatcgacngacatccanctntgatagactgctcagtatgcntgcttgaatcatanttccgtggacngngtcatcagctcgncgatgctaaatntcgnnncncnctccatcctgtctcttcggcgnnctgctgggtgtcgttcgctcttcgctgtncngctgttcgnggcgnttctgtcgcnnctnccgtctgtntggcccgcgngtncgctgtnggtcgtngtgtgcttgtgcgtgctcgctcgctctntntagaaaacgacntntctgntgcgctcncgtcgtgatnggattctctctnctgcgacngacctgaagcnnaatctgacatactctctgtctgcacnctgaccnacgcggagtcgngccatgatgctaatcaagcangacacagtntacagacgcgaccgtacgagcacgatagtgctcacctcaggta

SEQ ID NO: 7889 - DNA, 1492 bp, Homo sapiens
  misc_feature (1)...(1492): n = A,T,C or G
tgtccttctgctatgtgttgtggtctgtcccttggtgtacgcttgtgtagtgtcggttgtggntggatatgtgtgctcctctgtcancttgctctcgtctcctctctcgnttnctctctctcttctctcttcctccgtgccgctgtggccttngttgtctcttcgcctcgtgatcgcgcacgtgatnggcgccgtcctgggtgccgctggtggcgtctgtgtgcggtagcggtcgcctgcctgcgcgcgtgtgtctcgcgccgtcgcgcgcgtggctcgagtacgcggtgcgtgttatgttgtttcgtgtatggcgccgtcgtcatggggcttgctgtcgtcgcgtgtgtgcggaccctctctggctccccgtcgggtcgccgcgctcgtgtgcgcatntcgtggtctcgtctctttgttgtggcgctgtnggcgtctgtctcgctgtggtcgtctccgctcggctgcgcgtgcgtgtcgctcggctcttgctgtgtggctctgttgttgttctcgcgtgtgctcgttgtcgtcgctcgtgggtgctctcttctctgtgtcgcgtgctcgggttctctgatgtgtgcggtgcttgtttctgtcgtgggctcctgcctctcgctgggctgcgcgcttcgcttgctgtggtcttctccgcttgttgcgtgtcgtggacggcccatcgtcgcgtgtcgcggttgtgggggtggtctctggagcgcgcacgggtcttcgctttggtgngggcggtggggtgccggcgtgtgcgtncggcgtgtttntcgtctgtcgtcggcctgttgctttnttgggtggtgtcctgtgtggtggcgggcggtttctcgggtctcttcggtgnttgcgttgcgggccgcgctgcctgtcttctctgtggcgctgtgtgccggccgcgtccgctgggctggcgcgtgtcgcctcgcgcttcggtcgtgcgtctttcctcgtcgtttgtgtctgnttgtgtcttctttctgtcttcgtcggcgtctgtcgcgtttgcccttgtcccgtctcttttcttgtggtgcgggctgtgtgcgccggtgcgtggctcgtcctgcgtcgcgttcgcgtgcgtgtcgtngttgngtccgcttttgtggtggtgttggtcgcttctcgcgcgcgcctggtctcgtgtgtcntttcggtgccggctcggtcgctgctcgcgcggctccttgcgttcctcgttgttccgcttncgcgcgcctgttgctctttctctcgtccggtcctttgcgcctgttggcttgtctcgtctccttgcttcctctcctctgtgcgttgctgccgcgccgggntgcgcgtgggcgtggttgttntggccgctctcgcttaaaggggtttggctctgttcttgtgtttgtcccgctcttctcagcggtctctttgttctctcgctctttttcgtctcgcgctgtcgcttgcgcgtttctgcggctgcggcttgtcggttggtgtggtctgt

SEQ ID NO: 7890 - DNA, 1224 bp, Homo sapiens
  misc_feature (1)...(1224): n = A,T,C or G
tgtgtccttactgcgtgtcccttctgtgtgagcgcgggggcgtggcattggtgtgttgttctggtcgtgtgcgattggttcttcagtagtcgtgtactcttgtgctgtcgttgctcgcccgtcgccctgctccgcgccggcgtcggtcctgttcagtttggggctgcggtcgtgctgtatttgctgttcttcttgtcgtctgctctaggtaccgtcttctgcgcggctcccgccgcgtatacgttgtcttctggtatgcgctctcgatgcatcttgttctgcgcgtggctggcgtaggatgcggatgtggtcgctgccgccgtgccgggctgcaatctgctgactcgtattcgtgtttggctggagtgggtgtctcttcgttcgtgcgtgtcgacttcgggtgtgtctcttctgaggggtgctgggtgtgcgtcgtcggtgagttgtgcggcgggtgtctggtctaggtggggcgtctctgttctttgacttttttcttgtgtgtcgccgtgcgtgccgcgagggttgggatgttgggttggggcgggtccgccacgcggcgctcgctcgtgtgcggtggtgttggcggcctgaggcctgtttctatggctggtgcatctggcgtacaggcgggtgggcctgtgtggacgctctttcgtgtgtgtggtggtgttggtggcagtcttcttctgtctgctgcgcgtggttgtttgtgcctgatggttcgcgggggtgagtgctgtctttgctgtccttgtggtctggtctgcctgtttgtgctggttgctggtgtggtggctgtgtggccgtgactcttcttgtgctcgtcgtggtgtctttctgtttgatctccgcgctgcgcttgctatccctattactgtgctcggttttctttggtggctctcatggttgtggtncgctgttgcgcacctctgttgtctcgcattgatcgttcccgctcgtgttcggctgcctgtgggccgtgttgtgcgggggtgacggctgcgtgctgcggcttgtgtgcgattgtgtgttggattgtacacttcatcgctgctcctctggggggtgtgactaacttcgtgcgcgtggtcgcttccgtctcagtctcgtttttcgtgttgggcggggcgcttctgtaactgcgggcggtctgtgttcttttgggaggtctctttcttgttgtagccttcgtcctttcttccttttctttcgtgtcccttc

SEQ ID NO: 7891 - DNA, 1110 bp, Homo sapiens
  misc_feature (1)...(1110): n = A,T,C or G
cttctctctccttgcgtcttccctcgtctttctgcgcttcccggcgtgtgtccttcttcgcttgccctcgtgccgtccgggtcgtcttcttctgtttccccgtcttgggtctttgttccttccctcgctcggcctttgctcccttcgctctcttctttcgccgcgctgtccgtcttccgcgcgactctgggcttccggcgttcttggtccgcgctctttctcgtgcgcggccctctgcgttcctgctgcgtctgtcccttttgacctccttgtccctgcctcttccgggctggtctctcttccctctgctctccccctcctccttctttatcttcgttggttcgcgctcttggtcgtccccgcctgtcctgttatcgtctgtgcctggtccctccctttgcggtcgtgctcgctcttgctcgttgttcttcctggtcgtcgccctgccgtgttcctctcgttggctgcccttcgctgtgatgttcgttctgtctgtcgtggtctctgcggcgggcgccctcgtcggggcgtttcttttgtggcgcgtcgccgctcgctcccttcgtggcttttctcctgggggctgcctctctggccgcccgctggggggcgtctccggtctccgcttctctcggcggcgcttcttgcccttctcggccgtgctctctgcggtctgccgtggcctgtcgccctggcgcgctcttttctgtgctatgcggggcctccgcctctctgtcgcctcagcacgtattccggctcttctctgcctcttttccttctgttcctgggcgctgttcgtcgccgcgtgtccgttgccctttctcccccccgtgcgcccggccgcccgccccgcggtgtgcggtgctgttgcgcccttctcggcgctccgcccccttcctgctggggttctttgtgtcgctgcgtcccgctgtcgcgcgttcttcgcgtgctctgtctcggngtctctgtgtcttcttcctccgcccgtntntgttgtgggtttgtccccccttngaagcgcntggcgggnnnggttntccctcccacggttttttctcctttctttcttgtgcggtcgctctggcgtcctcttgtgctctcgttggcccc

SEQ ID NO: 7892 - DNA, 952 bp, Homo sapiens
  misc_feature (1)...(952): n = A,T,C or G
cttataaatattaacggcgagactaccgggtggtacgtggcggactctgcgcccgtgcctacgtgagtacgcgtgagttgacgaccaattacagcacatcaaaatctgctgatacgataggacgcatacgacaatacagactgtctcataactgagataagattgtaccacgttacataaaataacgcaaacgcgacttcgtaaaggcggtggggatatacgattgggggcgttctgcgcactgcgaacaggcagacgagatgagagcgtgcgcctgaggacgaataccatgactacggcgggcggggcgggactcgcctaacgtagtctaggatggacaaagcgcatgatgcctgataactgttgaatagtccactatcaactctgtccgacgactttaaatttatcatggtgcagaagcgcgacaaacactcatcaaaattctatcatatacgggatcgccggactgtcgatctttgattcgccatataatgaggcgagatagcgagagaaagaagagacgaactaccacagatgcagcaagtcgcatctgggacggacatgggaacggttaaggagtgagcggggagaggtcaatagttgaatggagggggatgggatttatagcaaatacacagggtgagcgctcacacaacggacgaatggggacaatttttttttacgcggcgcaacagggaagaagtatccccccctctgagatgggtgtatcaggaggtgtgcgcgaataacgagagggctcgggtccttgacagctgcgagacgctagaacaaaccaagatcaatcatacaacatggaaaaaacatagaagcggaatttacgagggggagggaaagttaattctcccccgcatcctgggtcagggagntatttccgtctgtggatcagatacgagaccatgatttattgattgtaataaaccaggatgggcca

SEQ ID NO: 7893 - DNA, 1175 bp, Homo sapiens
  misc_feature (1)...(1175): n = A,T,C or G
gttctggggcggtctccggcccccctgggtctccgtctgccgtgccgctcgtgtgtcgtctctctttgcctgtgcttcggtgtttctcgtgcgttctgcgcgcgcctctcgttgtggtggtgttgctcctgctcgctgttcggccgcttcgcgctatctcgtccgccgctcggctcgtggttctntcgctgtgttctcgtcctccccgggtcgtccggcccggcccgctcgccgctttgtgtgttgtcggcctctgtgggtgcctgtggctgccttttggtgccgctgggggtgtgtcctgtctttgtgctctctcagtcttgggcgtcggccgtgcgtgggcgtcgtgccgttgtgttgcgtccgcgtccggcctgcgtggcgccgtcgtcgctgcgtttggttgtcgcgtgcgtgcttttcggctcgccttcgtctgcgttgcgctctcttgtgctgtgggcctggtcctcgtggcggcgccgtgttcgttgctttcgcgctgctccttcgtccggctcgctggtgctttcgcgggtgctttaggtggttgtgtttgcttgggggcgtgggcctgcgtggtttggtgccttgcggcggggtgcggttctcggggggggcgtgtgggtgcggcgcgctgcggtccccgctgtcggcgcgcgggtgcgctggtgtccttcgcgggctccgcgcgcgctgcctcgggcccgccggcccgccgctgtgtcgtgggccgtgcgccggctcctggctcgttttcgtgcctctctggcaacgatggttttgtttttgttcttcgtgtggttctcccctcccggtccgcggctcccctctttctcgtgctttccgctccctcccgtctcgtgtctgctgtcgcttgctttcgtttgtgtgtgttgtccggtgtggcgtgttggtgtcgtggcttngctgtgtttcgcgggtctccgctcgcgccctctcccgttcgctcttctccccgtgcggcctggcgctctagctcgtcctctggcgctcgctcctgcggggttctttgcgggctcgtcgggttttttccccccgtcgtcagggcttttgtcgtcctctggtttctcctcgtgggacgcttttttcttcgctttgtttcgctgcgtggtggcgggcgtgtctgtctgtgtttcgtgtgtggtgtctgg

SEQ ID NO: 7894 - DNA, 728 bp, Homo sapiens
  misc_feature (1)...(728): n = A,T,C or G
gggggaagggtgttgcccacaccggtggggcaaaacgcgggaggcccttttttttatacacccgggggaaagaacaacctttttgtggcgtctacaaagaaaaacacagagatgggcgaaaaactctctccccaaaaggctttgggggggttttctctttttttttaaaaaaaaaattttggtggggggaaaacccccccccccctgtgtaaaaaggaggcgccccctgggggggggggggagagaaaaaaacgtttttaaaagggtttggggggcgcccccttttaataattaaagaaagggttttgtggggggataatgggggggggggggggttttgggggggttttttttaaaaatttttgggaaaaaaaaaaaaaaaaatttttgtttttgtggggggggaaaaaaaaaaattaaaaaatttttgggggaaaaaaaannnttagggaaatttttttaaaaaaaaaagggggttttggaaaaaaaaaaaggggtgnaaaggggggggaaaaaaaaaannnnnnngggggggttttttttttttggggaaaaaaaaaaaaaaggcccccctttttttaaaaccccccttggaaaaaaaaaaaaaggggaaattttttacacaaaaatttgggggaaaaaccttttttttttgggggggtttttaaaaaagggttttgggccttgngaaaaaaaaaaaaaaaaaatttttatacaacccccaaact

SEQ ID NO: 7895 - DNA, 1037 bp, Homo sapiens
  misc_feature (1)...(1037): n = A,T,C or G
tcttcgggccgtgacttctctcgcgttccttctcggtaccgcttggtcttttttgttgctcggggtgtggcgtcgcggtgctcgtgtggtccgccgcgcgtgtctcgccgtttctttctttcgtcggcctgtctgttcccgctccggtttgcttgctggttggtctttgcccgttggcggcgcgcgcgggccggcgtggcgnggctgtgggtgtctgccgtgcggcggcttgttgcttgtgcgcgggtcgcccctccttgcgtggcgggtgcggttggttgttctgggggttccctttgctggcgcgctgtggtcgtcgctcgtgctttgtcgctggcgtggcgctggtgttgctggttgctcggttcgcgtggccgttggncgtttcgtccgggcgttgggcccttgtcctcgtctgggcccggggcctcctcgccgtgccctcctgtcggcgtcctgttgctgtcgtgcttcgtcctggtgcgttgttggtcgggtgttctggtggtgcgtttcctttggtgcgggttggctggctgcgttcgtgtctgtcggtccgggctgcttttctggccgtctctgtgcttggcttcgggtttgcgtcggccggggtgccgtgctcggggtgngtctgcgttgctctgttgttccgccccgtctcttttgctcggtgtcggggcttgctttcgtttgtggtcgcggttttcttgtgttgttcgcgctgttgtggtgtttcttgctgcttctcttgttttgtcccgtgcttgctccgtgcgttttgtcgtttgccctgtcccttcctccttgctctcgtccttcgctttctttgcgtcgggtcgtttcggcttggtctcttccgtggtcggtgcgcgggtttttttgtgccgctttgtcgcgggtgttttgcgtgcgtttgggttttttcgccccctttggagcnntttgtgtgccttggtttcccccccgcgacggcctttctttcttcttgttttgctcttctctgtctgtggtttctgtctggctcccgcttgtctgcc

SEQ ID NO: 7896 - DNA, 1040 bp, Homo sapiens
  misc_feature (1)...(1040): n = A,T,C or G
caaaaacaccatttatttgacacatatctttctagaactgcttttttatcgactacctcatcatctcccttactcccctccttatattactttcctgaacactccatccctgcactcttaagctactgctagtcctatgccgatcatgtagatctcgccacgctcatctacttccataatacggccgtactcgcgcttccgcggctgcaatattcctcccctaaattatgacggaactcgagtcgtgtgcgactcctttctaacacaccgtggtgcggagtaaaggaatattagacaacccacatgtttgattctaaagaaaacagatgacatcgcagccctctaccatttgtcaactgtgttatctatgtgagagcgcagtgtccttcggtaattttgctcggtggcttgagtagccgcaacactaccgaattctgcggtttatcttataggccgcgggactggtgtcctcacgcagtagaccttgatccatacagtacgtggntgtggtcacctaaacgtatcgtctgatgccgaacatgttagggtgaggtggggtgtgtggcgataaccgctcaaacatagcgtgaaacgggcggcagaggcgggaaggcgataggaaaccagcagtgtatggagaagaggaagaaggcggtatttgaaggacactagcccgggcactatntgtgagtagattatatcaccgttgtcgtgaacgaacatgaggtagtgattgttattgtgtaagtaggtagtactgttttccctcgtaggcgtggctgacgcggtctagtggagtgttaatggagatgcgtgatcaaantgaatagtagaaatattgagaaaggtataaacatgcaccggcacttacttttttttactgatagtcgaggttaatgtattttcgcaggcgagtgataaggataagaacatgtgaaaaaaatgatgcgggtatctttgatcgctacattccctttttatgcctcctagaagaaaataatcaaatgaactactatatattacaattaatatatttttat

SEQ ID NO: 7897 - DNA, 838 bp, Homo sapiens
cctagcggcactgactctcttaatctaccaccgctttacaagtgacccattgtttttacagactgcattacatatgaccctaacaaccactgcaatatagaaattcgcatctccattctccagatcaggataccgaagctcagaaaaattaaatgatttgcccaggatcacatagctagtaagcagcccaaggagatcccggcacaaactcatcctttatcatcatggagaagcttccacagcacatacctattgctgctaggctggtttttaaaaaaaatctctgtgaataagggaatagaacaccagggctatggagatgcgtggcaatcatttcatcaaagatgtaaacagctgaagagagaagagaaaaggagaagagaagagaagagaagagaagagaaaagaaaaaagaatagaaaagaaaagaaaagaaaaggaaacgaattctttgtccataaaagtataaatagactttgcctgggagagatgcaaattattttacctccggaaaaagattactccaaatactatatttggctgccttctaggatatgaaccagttcttaactaattagcaagtcatgtcagaatcacttaattgccttcatacagatatatgttcaacagcttctccttggagcctgattaacccctttgttttgctattaatgatgaagcccgggcggcgcctgcacttagagagggtaatacatgaccctgggtccttactcgctgccttgggcaatctaccgagctaactatttaattatctcaagggtgggaaacggtatcaaagagatgcggaatacccgtcgaaataacatcgtaccaatgg

SEQ ID NO: 7898 - DNA, 649 bp, Homo sapiens
  misc_feature (1)...(649): n = A,T,C or G
aattgcaaatttcactaaagaagaggaacagttgactctcaaggaaatacaagtttgaactgcatggggtccactacaccactgactttcttctgcctctgcctcccntgagacagcaagacccctcatcactctctgcctactcaacctgaagatgacgaggatgaggacctttatatcatgatccacttctactcaataaataagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccgtataaaccccaaacgctaagctccagaagcagaccagcaagccagccgaccagcagatggacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccaccattcaataaaaccagatcggcag

SEQ ID NO: 7899 - DNA, 868 bp, Homo sapiens
cccctgggccccccgcccggcgacccacaaggttgccaaccaccctctgccacccgcaaaaagacacatcaagcattttgaacatacccgaaaaatttttactgtcacaaagaaacccccatccaagatacaccccgttgcaaacacccggccccccaaaggccatggcaccagatccccctatcccctacatttcgggggcctccccccagaggcccagggttggcaatcactttgccccctggataaaattagaacactttttccagtaagggcaaaggtcccttggtaattaaaaaggaatgtttgccccggggttgttcaataagccttcagaaagttttaatacaccaggggaaaattcccctttttgttagaaataaaagggttcaccccaatgattttataccaaggtttgccaggttgaaaacgttcccttttttgaaaagatttcacaaggttaagtggcccaattttactaggttattttttatggtacaaattttaatcctgaacaacttcccattctttatggaatgaaatttttttggaaattattgatttattttaagaagaactgttgacaaagattcaccagaaatacctgaacctttggcaaaatacagtccacacaactggagcactactaaaataattccaggacagaagtttattcaacagaacaagtctcttaggtgctgtcattgataagtaaactgactgcttcttcctttcctaaatatgcagtggcataattaagagtattttatcacttctgttctttccctaattatataaaaattaaaatgaccgcgcgcgggggcggacccccgcgggcgcgcgttatacgctacgacgagatggtagt

SEQ ID NO: 7900 - DNA, 160 bp, Homo sapiens
ctcgtgtatccgcttcccggctctgaaccggatcactagtcagctgatgtgaattgctccagccggggtaatccttcggattcttaccatgcaagtaattcataggcagcattactccattgccacaggactagcacccatcgcttggggaacataattg

SEQ ID NO: 7901 - DNA, 211 bp, Homo sapiens
attctgatttaatcacttagcttctgtggcataatcaagacaagttggatgaattgtctcctaactggattataatgaaagaagctctaactggtcttaacgtagtttcgatgtttggagtctttcacaaagagaaacaaaagcatgataagaatgtgctaagctaattcgaaagggaagcaagggtgtcacaataaacatggatcggccg

SEQ ID NO: 7902 - DNA, 1147 bp, Homo sapiens
  misc_feature (1)...(1147): n = A,T,C or G
cgaagcaaatcacaacacccccccctacccgctaacaaaaacctccccacggatacccagtcccgccgaatctcctgcgacgggttacgtggcgctgaaacactacgacattattccgctcggccggccgtgcggtcagatgcctaggcgtccgcagcacatacccgcccagatggactggagtagcacncgcacccggcgctacggaccgcgcctatcccgatcccctaacggagtcagcgagctcgtcgcaggagaaggcttctcccaaaatttccgaggccggcgcgacggccaagcgagtgtgtgctgccaaagcgccgccaccgccaggagcgtagcatacacgacgctcgcttaggagtacccactaacaacgtctgtgctacgctaagatggtatcgtcctattaaatgacaaacgattgcgcagatctgtctcatcactctaccgctctaggctgaagacagcaaagaaccagcaaccgacagctgacagcgtgggaatcgacacgccacatcataccctagtacgtcaagtggttatactcgtctgcgcgagacttctgtgtgatattgtgagctttagtcgtccagccaaagagggagaaggagagtcgcgcaccccgaacacaaagacccgcacacaccagcccaccgcacaacagtcaacctctcagacgtctagcgagcgcgcgcagcctctcgacgatntgcacgcgacaaccacttggcgagtggcggcaccgcgcgcgaggagagcgcaggaaacagagccaggcggcaagcacgaggatgntnacgatcggtatactgacgcccntatgccgcagacctcaagcaagancagagnagcgacnagagacgagacgctgcaggagttgtgctcacacagatagagagtcgagggagtgcctactataattacactgaactatatccttcgaatacacacgaggcgcagccaccgcactagcagcgcgtcgctatgcactacagatccatgaacgacgcgagcgacccacgatgtcggtaccatcgccacccgttctcacgtcaccccacgacgcacccaccacgttatatcacgctaggagagacggaatccgcgtcgacgagacagaacgtgagactagcgcatatccacg

SEQ ID NO: 7903 - DNA, 828 bp, Homo sapiens
ctctcttaataatccaccgctacagttcaatagaagcttgcctccatctgatgacctaggaatctaggctctttccatgttttaatactgccatctcaacatgtggctttcaaggtcattttgactgaggaaggaagatgtggagaagactcagtggctcctaactgctttgacgcagtggttctcaatcttggctgtatactgcaatcacctaggggagttttaaaataatgatgccaagattacacttccagggtgtctgatttaattggactggggaaggatctcaggatcaggattttttaaagttatgccagatttcacagaaggcatatttgaacattgatgactagacgactcacctgctgtggggagacatggatcttgagttgaatccaatgacaggatttggggtctacttgctttaaatgacattcagtgcgaataatatgaattatccatatgtgagactaagccgtggttgagactaatatttcactaatgaatgtggcgggggagaccaagctaacgtgtgttttgcgtctctttttcgcggtgaattcaggacctcgctcatattatctccccgtatttggccgagttttaattaaatctttccccccccggatttcgccatgtcactctagtgttgaaacgcgtcggacgttaaacatttacagctacgatggcttcggtcgttaatggtagtaggtgagtccgatggattgggcgtttatcacgcagatatttagctagttatgttattgtagcagctccgacgggtagtatatatcttttttttatcaaattgggtatttagtataatat

SEQ ID NO: 7904 - DNA, 824 bp, Homo sapiens
  misc_feature (1)...(824): n = A,T,C or G
tcatatcaaatgaccttactgcactaaactctgagccttgtgttaaaagatatccgcaccccctatctcccatccaacatgtctctcacagctaaactntcaccataacacaaaaacatttttattacctattagcgacagatgtcacatcgtccataagtatcttagttcccaacagttaacttacactaccgattctagtgttgtaatgttacaccacatccacacacctctcagttttttgtcccattgcaccaaacattatctatagttatatcatggctcatacccccaggcttgttttagcaagtgatgtgatattccaccacaaattaaatcagggcttgtgtacaccaaacgacacatgttatatttttcctgcaggatatttaataaggaaatttcacacacaaatccatattttcagcttatcttggaagagcagatctgacacaatgggctcatagcacctgaatggcaaaagctagtgaggttgacccttgatatactccatgctttctccagtgtacctcaatacgtagaactttctgatgtttcccccacctggcgtgctttacacacttatggtatttttctatgcctccaggtattaatttgaatatgtaacccttggatatgggtcatataagataaagtgaagggaatgagaacaaatttaagtgattggatgaggccatctgatactcccaattttagagaaaaaatattttacttcatcttttggactctaaagaatctaattctatgtcactcaagtattaatttgaatatgcagcccttggatatgggttgtcaagacaaag

SEQ ID NO: 7905 - DNA, 1152 bp, Homo sapiens
  misc_feature (1)...(1152): n = A,T,C or G
cgtcgcgactcgtctcatgcagtccgtatcttggtcgcacacgtatgtaaagcactgtcatcctctccctcctctcncgcgcttcactctctattatcgtgttagttgtgtgcatgtcaggctcgtcctcgctgcgtggagggcgttcgggcgtgctttgntctctgtgctgcaggtactcgttcgtcgctctctctgtcagtcttgtgtaagtcatagcctcagctcaacgcatactcggagcactctcctagcctcgagtacaagatcgtctcctgcnatatatatggcaggcgctcagctcagacctgtcgctgatgatggagtcacgtacgcgtgcatttacgcgcgtcgtgacgcgtgctgtcgcttctcgcgtctcgcgatgccgtgtgattactcgctgcgcgggactcatgcgagtgtcatggtatcctggtaacttatgcgcgcaacctaaacaccgaccacctagcatcgcccgctgctccgcgtgcgtccccggggcgggggcgggcgatctgtggtgtcgtttattgtttgttgtgtgagtgtggaggttcggccacctcctccgcccttgtcgtaggcgcgccgtcgatgtgtggtgctgtgtgcggtggggtggtggcggtgtccgacgggggagagcggtggggggtgcgtccgggcttgtggggggtggttaaaaaaaggtggggtggcttttttcttttctcgcgaggtgtttgggcgtgctcttctttttgcttgtctgtgttgtctgtagttgaggtggctgttcgtcgcgtccttttactccttcctatcacttgtcttctcgccgtggggtgtgttacttgcgggcgggttttcatgtgttgagtctcccggcgccgcttttttccgcgctcgcgtcgcggcctctctgtttgtcctgtgacagtttatatatatttctttgtcccttagtccggatggctctccagttgtcgcaccccgccgccgcccggcggagaagggggggggagggcctgcggtcgccccggccctcccgcgcctcactccgagaaaaaggtccctgtcggtgcccccagaagaagttttaaacacctcccagacaaggttgacacagaaattatagttagggcgcgcgccccgcccccgcccccc

SEQ ID NO: 7906 - DNA, 1212 bp, Homo sapiens
  misc_feature (1)...(1212): n = A,T,C or G
gcgggtacgctccgacccgctcccccagcaccgcggtggtcgctgaagtaaagcccctcccttgtagtcgtcctcatcgaccaagcttgcggtgtttaattcaactcattgacccgtatcccgatctcaccccgcgtcactattaaacacaaccttaaacggatctgttgcatctgccgaagccgtcgaccgaaggagacgcccacgacagtaatgagcctcacacgagctactagctatgcaacttataccattgctgtccgaccaacatcgcaccctgtcgcgcgacggataggtcgctcctgcattaccttaactaccgttgagatcagggaatgcgacgatcacaaatgctatgatgcagtcagccacgcgcgaaactatgaccagctagagagagtctctgcggctagtaaatcatacatgaatgacagatgattatctgtgtaatagattaatcgatatcgaagcgactccaggngcatatctatccctccacaatccgccacggctatacgagatgatcgaccgccaagtntctgaaagcatcttgtactgatgttgcacgcggaattataaactcactagtcgcggcacgttctcgtgtgactcgcgtgcccgaccggaagacgcgcgcggtgacgcgtggcatgatgaccgagccaggcacgaccacagggcgccacgtcagtctacgcttgtggaggcagagaattgtcaatgatatgggagggtgcgacgcacgttagcacgcccgcgtgagacgcgtcgtgcgccagccagcagacccacagcgccatctactacacaaatatatgagccgagctgttgtgagacgctgacgtatagacagtccgtgtgcctctatcatcgtcggacaagtggagctgtcgacgctgcctagcggctcccgagcacagctcgcgtcgcctcgtggacatatcagaggccgcatctgtcccagcttctctccctcgcgcggccatggcacctctaccagtcgtctactttcctgcttttagtagtagattatatcatgacataggtgtccgcgagacagcgtatgtgctttcgccagcgctctcctctctcacgaacacacacacgacatgcacacgcgnaacgcccacccgcgtccacgcctggctatcttccttccacacataggcggtcgaactattaattgtccacgagtctaaaccgcctnctgac

SEQ ID NO: 7907 - DNA, 725 bp, Homo sapiens
aaaaatgatttttgtttattttttttgaaaaatgtaatgaaataaccttaatgttttaggaggggtgctttctttgctggagtatttaaagatcccgctcaattatttcccctccccaaaacttcaaacttggggttcgctccccagtcgcttttttttttttttggctcttccctttcccttttctttttgctggttttcttttggctctccccccccaccctttttattcttgtggtccattaacctctaaaagaaacaatccttcttctcccccttctcttttctacttgtcgaggcccttatttctttatactcctttcctcctcttctctcatatccctcaccttttgatcttgcccctctctccctcacgtaccgttccttccatcctgtcttttttcctcttccctttgccttactacttttttttgccctttgcagggggttaaccaatcatctcttcctcccactatctcccacacgtatttgcgcatctccgttcttcttctctgcgctagcctctataatctcctaccgatcaaccgtttccaatgtcccccgcttcctcttcaacccccgtctccctccgtatctccccgttccttcatctcttattaatacattcaacttatcttatccctttctcgggcttacccgttcttctcccaccctatcgtccacccgccctcccattcaactcttgctttcctccccacccaccc

SEQ ID NO: 7908 - DNA, 1401 bp, Homo sapiens
  misc_feature (1)...(1401): n = A,T,C or G
tcctaataatctacttcgcagatgattagtattaacaacaagcatgcgtacaggtgttcctaagcctagagtgcgagagagcacagacgaagnggngtacgtttttctgcggttgaactcgtaacatacgtacgctgctcgaccaatagcgagcgcgcgcgcgaccntactgtaagacaagactagctctaatacgacggaactgagagctgaagtgaagtagtatacgcgatagacagtcggcacggtgtcagataactgtcactcagcataattctcggtcgcggcgcgggataatatatatcaacattatcattcgcccatacaactagccagaagcagcttacaggagagcgggataggcaacgacgacggacgacacggttagctcgaggggtcagcgtgcacgagagcttcaggagtccgattcgcacggacacctggtgcgagggcgtgggttggctgagcgtctatcagcacgcactgacaaccgtctaccgcaattattagaactccgtgacacccagctgtcacttcgagagagccacgacctatcatccactggtccggttgatttttcgtgtagtaataatgtatctagctagcatnacgcgagtgtaggaatgagtacacaacgagtctcgactgcggcgggtccgtgcgacaccactagcatcagcacccgcgggcgagtgtggagcggttgccgagtgatacactacaggcgcgaatgcgacgagtatggtacgtctcggcagagagagagtagtacgcgagagggtgaggtagcagttgacgcacaacgccagcacacgcgatcaagggacgcacgcgcttcgatgtgatcgcatgcctgacagtgtcagtcccgcgcagcgcgtcacaactatntcgatctctcatagtctcacgtcacctttctacacgctatattctcgcgtaacaacgagcgcatgatctgacacgacctcgcacgaactgaactattactacagtaggttntatgcacacaggccgcgagnagtgtacgcaggacctntgtcgtgtgggcgacacaacatccgatgcgttctttaacatgacaaagcgtctaggagcgtcagtgagtactacggtggtagagtacttgatgactgacgtatgctncgacacgaccacgcgcntcgtcgcaccagcataccgcgtctacacacatcacagcacacatgggcgaggactggaatgacagttgctgagcgcacagccggcgagacagggatgttagaatcgatgatataggcgctccacgacacactagcattataatagtaattgatacataaatctatagcatttantaagtgaggcntgtgagagtantcgtgaccatcgcgacacaaccgcgcggaggcgactagtant

SEQ ID NO: 7909 - DNA, 1654 bp, Homo sapiens
  misc_feature (1)...(1654): n = A,T,C or G
gcgcctggaacatacgacagagaacatcgcctcgtctcgtggtcgctgctctgtcttacaattgagtgctgttgtaaggctactatacaataatattgtagctcacctcggacgtctgctgatagatgacactggtaggtgaccgaacgtctgctgcgccatacgtgggtaagtggggcgtggtatcatgacatctatatgaagtatgatagaacttgttatagtctcacaataagtgtcagttagtaacgtacgacctnatgcctgcactaatctctgctggtggtgggaggtgatcagtgattgtaaagcgcgagttgtgctacgtcgcctaccttntctgactacgtagaagttgcgcgccaagaatgcaataagtacgnagcagcgtcatgggtctcgctgcatctgctgagacacaaaaagagcgagtaaatagcggagaatagaatcgtatataaatagcataacttgctaccgagatgtacacatctatactctatcctaacatcgtgatactgaatgcagcgctcgactgagaacnccttgcgcgtgggctgtccatataattacaagtgagacntcgaatatgtcgagacctatgagtatgtgcgtgagaacaacggaagtatcaggcgctgtgatagggtatgcgcagaatagagtcgcttggcacgccatgggcgtatgtcttgcaagtcatagcgctgtttctgctgatgcaatagattagagactcatgtcgtgtgtattaatgcatntcgtagtatgcataaacagtatgatcatcactcatattataacgatacaatgcctgtctgacacacacatgatactcagagtcgcagtatggagacacagcaagtacacactgccgttacttagactcgatgctcaacagcgcgctgatncatctacaagtctgtatgntacactacatgagaggctgtgtattagttgcagtatggctgtgtcgtgctncgattactatcagatgaatcacaactcgtcatacacagcgtgcgacgtacgcgcgtngtcattcatatgatacaacgtctactctatattacacnccacagcctgncgcgtctngctcgttgttgcaataatagcgcgtgntncggaactctnncacatccataatgatgtctgtgttgctattatactcacattgtgatacagtcacctcttcacacacgcgacagacgcacacngagagacagacacgagtgtgcaggcatacacttcagcgtcgatctagtagattncaaacagacttcatatctacactaatcggacacatttcagcacgcgcacaaagtctatgttattagttagtaccatgaatcaataggtctagatatgtataatactgttcatatccctgtcgatgcactgctcatgncggagagagatatgatcatgaacagagagagtaggttgagaacgactggcacacgagacaggcaattgcgagctagttacaaacagtaacgaaatgcgttcttgcgacgcacaatacacgaatgatgctgataatcaatcgcgagaacgacgagagcgtaatgtgcagtatncnctncngcgcacacaccgcagtactctaagtctgcagcacaagagagcggtggaagtacacaataangccggg

SEQ ID NO: 7910 - DNA, 1245 bp, Homo sapiens
  misc_feature (1)...(1245): n = A,T,C or G
agactccggatatgagttttcccaggtagctggttaagatcgtcgccacgggatcctttaagatggcgcctggcccgagcgcagtaatttatttttcgcaactattatccgccgccgccgcgttagatattccgaatccctccctattatatttccgcatggggttcccgaatgcgcgattaaaagccagcgatgtacgcgtagagtaaacgctgagaatgagcatgtgaagcgtgcggatgcaatatgccttcatagactacgagtaacatcatccgatagagcgcgcgagtagataacggcgtcatcatgataagacgtctgttgattatcccgcccgccgcgcgaagtggttgagaatggacgcaccatttatcaaagagtaagtcgaggggtgcgacaggacagcgcaagattgtattgtagcacatccgagaggatggcggggatgcgctttgatattccgcgcgggaagcgtagcaagaaggaggcgggaacgattctttttttttaaaagaaagacccctatggggggagccacgaagacacaacaccccccgtcaccccttatgtgaggggggggggatatgaggagagtcccgctagggctctatatttattttagaccagagaagcgcgccaccgcgcacccatagagaggagaaaaaacaccccctccaaccctctggcgtagaatgtgtggaaagagcggcgagcacaatgtgcgacagacggaaacgtttgtaaggacccgcggcgcanatcgtccacgtagatttaagcaacaatatgnctgctcatatcttataccagcggcggcgcgatgcagacaacccgccgctgtgtcgtagagtgcgccaccccggatatttatgtctgggcgcgagtagtatgtatgcgaggcggcagaaccccacccgccggcacatgtcnaacgatgagattcacaacacgacgatgttcgacggtagcgcgccacgcctgcacagagaacgacatcgattgttgcgcgcatcggcgctcagcaggcgagtcgtgtcgacgtgagcagatagatacacatacagcggcctgcaccactatgacacgatatccgcgccgtagcgtagcgcgccgtgatttttacacgccgcgctntaaagtaagagctgacaacaggtacttagtagtagtcacacctaagtatggcgtgagggtacgatgagcgcgcgtcagtaaccatgagagagtagtccgtgagtctag

SEQ ID NO: 7911 - DNA, 1013 bp, Homo sapiens
  misc_feature (1)...(1013): n = A,T,C or G
gctccgtttagcgttgttccactcccactgtatcctcctcatgcctcgcatcgtgcactcctcgcatacttcggggcacccggcacgctgcgacacggttcggtcattctgcgttcccgcgtgtgttgcgctgccctcttctcactatctctcccctctttcccccgtcccgtatacttgctctggcgcctcatcgctcctgtcgtgctgtgtggattctgtctcactgctaattactgtgcttgctttaatgcttcggtgtgatttatatctactggtgaactatgtcgtgtggtgtacaaatcgctgtcgtgctgctaggttgccgccatcctcatgcggtccgcgacacgaactgtgtcgttcctaataaggtgccgtcgtcgtgccgggttctcattgtatatggtgccggtgtgggtgcatggcacaccggccaccccacgtgcggtggccaccatcgcccacgggatatgaccacggggggaccaacccacaatggaccttggccgggctcatacggacaaacgcgagggacgggtgcgaacaaagggtgggggggggagaaaccggacggggggcatgcaaggtcctggcgcatatgtgggactaacggacacaacctacccaatgccatgcctaggtgtgtgggtggtctcaccactggtgtgtggggggtgcagcgacacaccggccaggacgcaggggcaactggacacgggacgaacaaactgggggacgggccactggaaggtgacgacacgcggaccccggtggacaattgggggaaccaagatcaaaactattgttctccataacagactccngaccatgtggtgacgggggggggggggggcaacaaagtggtgtggggggggccctgggcaccttggcacgacaaaccggcatcccagatagtggactcgtacggggacacctaccaccgtggtggggggtgatccctggtgtgcggggacacacaccacacggggatggggtgagcgggtaacaag

SEQ ID NO: 7912 - DNA, 1158 bp, Homo sapiens
  misc_feature (1)...(1158): n = A,T,C or G
cgaggtactgactactcatatttactacatagtcctgatcatgtataaggggagtgtaactacgctactcccataccgctatcacacagagtactcgagaatcgttgtacagttgtccacgctataatctacacgtcacatatgttaggccgcccgtccttaccgtcctacctcaatcactctagaccaagagtgtcatatagatagtgtatggtgcacagcttgatggtggtctatctacatatatagtatgatttatatagagtatatttagtctttcttgctttctaataactctacatatacctcattacacaacatcgtatgtgctctctcntctccgaggcgactataacacatgttgataataccgatcgatggatttatccgcgctattcccaatctcttctacactctcaataactagtctcgcacttgttacttatctgacgtctgcgtggttctatctacctcagattatgtcttgagatcttcgtgcttctcgtctctcatttcgcccgagtcataactggggacatcactgtgcctactgacacatacacgctcttgtactggggtgcgcagagcttgtattagtagtaaataaactggcttagatctttcatcatgcatattagtgttacatactggatgaagtcacttcattccagtctgaaaggccgtcggtagcttgtcgccgacacacggtgaggttggatgcttggcacccactacttccgcagttgctaggtccaacgtagatgcgcgaaaagtaattctatcatttagtctttgtgtgcgttctgtctacatcgtctagtgttgttgcgtgcttgtgtggtgcacgagnggcacagtcaactagtatgtctactactgaattaaatgtgatttgtgttacttgtgggtcaacctttgtgcactcccgggtggagtacacagctcggcgcacttcataacaggagcgtgtatgcataaccgctgggctcactgtttattatcggcttgcttgtttgntgcgtggtactctctgatatctgaaatatacaatattaatgtaatatgagtgtgattactttaacacatcatccacatctttgtcgctggcggcgctggtttcgtgncgtcttcttcagggacatcttaccgactaggccc

SEQ ID NO: 7913 - DNA, 1774 bp, Homo sapiens
  misc_feature (1)...(1774): n = A,T,C or G
agctcacttnagcnttcgatgagtgctcgttaataagtgctgctgttatatagaatatcngcgtncacgtcagctgacagatagacgtagcgtgagacgcagaagaggcgtccgtacagccagaccacgcagcaagcgagcacgcgtatcataacgtggatcagtgagcagcgtagcgatatctgccacagccgactcacacgatcgcgcatcacacaacagcacgtgatattatcctggattgaatctggacgtcgatagtagtctaagagtagcgcaccatatcatattgataagagtagcagaactaaacatgtctcgtatgcggcgatagaggtatagatggtggtggggtgcggttgtcaagagtatctaggctaggcaagggcggacccacccataaaatacatatactagattgtcgatgaatacgacgtcagctcagtgcagcgnctgcggatagtgtccagaatcagtgtacctatgctcatcgcacacgacagctcgcgtactcataacctctcgcgacaccaaacgtacatcgtacgtgcgccacatactatgtcctcacaaacgcatcgctatcgtcgcacaagcgcaacgtaaaagcanaacagaatgggatcagacacgaataagtactcgttcctaatatagatgtaagaagacagagaagactccacggaccaatatgtagcatcgacgctcggctgtgatcgtgacgcacgacaggtggcactagctgacatactgtatngtctcatacactgctatctatgtagccaagctatacacgcgcacgctcgtacacgacaatagatagtatgtntcgagacgtgtcgaagggtctctgagaattacgcatgagactgattatangcaacatgtagctcgctctctgtcgctgtctcatgatcgagntccacgctcgatatcggcgaccntcgtctacctctccgctgtaganctctgtagcatacctcgatactcactgtacacactcacatacgccaactcgacacagcagatgatgantagantcagagacgagtatactgccnggcagtcggcagtactcaacagtgcgtcatgacagatacataggctatacgtgcgtccgccgtgatgcacagtctagtcagacactngtatgtatcaagcacatatgcttatactactgangcctagcnacacaacatacacgtgagcacgcgcntaggacgacgcatagagacgtgtagagtggtgacgntgtcttnatgatatatacgtgatgtacacagcctctcgtgcatcgtcanacttgtctcgacagctcgttgtgtatctgactgctgccatntaactacacagagacnctgttactctacggagccacatgtgaacaatgcttcgcgacacatatcacacgatcgagtaagttgggntagagtgtggatatgttagttantatatctgcattatgactaatgtcgcatatctgcgctatcgcagtctcatggcgtctntcatgcgctatgcacgaccgatcgaagcacgttgtatcatcatcaatatacacgacacgaacantngacgagatccagatgtatgtgcgcgactcacgacagtcgacgtgatcctagtcctgtaggatctgtctcgtagagaaatctatatcatctgtacagatatatagtntgnatatgtgncacgcgatcgacaaccgtgtcgtcggcgtctcagtgtcctttgtatgcttggtgtngtgcgattcatgtacacagtacgatag

SEQ ID NO: 7914 - DNA, 791 bp, Homo sapiens
gctgctggagtttgctggaagtccactccagaccctgtttgcctgggtttctccagcagaggcagcagaacagcaaagactgctgcctcctcattcctctggaagcttcgtctcagaggggcacacctgagatgccagctggagctctccttcatgaggcttatagacataaggaatttgcatttcctcagatgagactttggactgtggacttttgagttaatgccagaatgagatgttcattttattcacagatgataataataaaaaagggaatttttgaattatcatacactataaatgttcttgagaaattacatttgactgtcaattttttttgcctttctgtgatagtggattttagatatgagaggtatagctgaaaaagactggtttcaaatatactcactttgacactggatgaagcctgaagcctaatctcaaagaaactttaaacctggctattgtaaaaattggggagttgaggccacggacatttaaaagaaatcagtcaggtgattttgcccatagacacgattaacaccatgctttgcagttgagattactaatattattttgtggggaagggtcacaataacgcgattcttttatggctggtagtaggggggaaccattggctctgaataaaaacactgtggaggattttgttaatctagctgcgcttcggctttttagcagggatattgcactttccaggagtgtaggcaatctcccctaatggcgatttatatattggtgggatacccctttgtacgcatagatgattgtat

SEQ ID NO: 7915 - DNA, 932 bp, Homo sapiens
  misc_feature (1)...(932): n = A,T,C or G
ccccccccatctttccgatacncgtgttgtgtaagtaaagacacggtccgaattgtcgtgtacggacgtacaccacaaagggagacgtgaactactaactcaacagctctacagtaacaggacactcgctcagttcaaaggatacaagagcgccgcctaatcacacaaagcaaccccatacactccgtccctccgttctcttcagagatcaatacttcaacacgcataccttcgctccatctaaacccgcccccagtctcttccaagaggcctattagataaccagtattcgctaccctcctgttcgataagccattttaaaaatctcaggggttctcctaaaaggacgagttcaacaaaacccccctttcccacctgctgcaaagcctcaaccccaatacacgaaaacagctattaaaccttggctttttaaaaaatttggagattacaggccaaggaccattccaaaacagataagccaaggtactatttccccattggacccactttacccacaagcttccaggttacaataacgcctattattattttaggaaggtccagaataaccgatatagttctatctttttatatatgtttacccatgtgatctgcataggaacactttgaggtattttctaatatccccttaaactaattttatagagagggaaatggcaattccaagaggtaaagtaacttgccctaggctaatttagtatgtggtgaagccagtattcaaacacaagcagtgcacaaaattattttaagaaatgaaagaaagaaagaaaggaaataaggaaagaaacaaggaaaagaaagaaagagaaagaaaagaaagaagaaagaaagaaagaaagaaagaaagaaagaaataaagagtgatgcggcaagctttcctccttcgtttttttctgtccgcgtattactta

SEQ ID NO: 7916 - DNA, 1121 bp, Homo sapiens
  misc_feature (1)...(1121): n = A,T,C or G
cggtgtggtgtgtgtggtgcgcggtgtcgtgtgtgtctggtgtgtgccacgtggtaggggtggtcgggcggggggggggggcggcgggccagtggcggtgttgtcgggtcgggcacttgacggtgctcggtccgttgcgttgttcagccggttgagggggatccggtcggtagtaggggcgcgtgatgtagcatggtccggtatgcgggcgaggctcgtggctcgtgcccatcgcgctctgcggtgtgcgctatctcgcngtgattggtgtgcgagccgcagctcgcgggcgcgggcggctgctgttgctggcgtgtanccgagtcgctctgtcgtgtccggcacgtcgacccaccgctccntcgtgctgtcgccctgcgctcacgctgacgcgaccgcacgacgtgtnacactgcgtatgttaggttctcttgctcagcctatcagtgccgtcgagctgcgcatcgttcggtcgtgtgcgcgcgcgcggtgtgagagagcggacgctngccgcacacggcgacggcacgggccgcgggctggccgctctcatcgtgcgtgccgtgctatgtgatttacgcgactggtgtgcgcgtgttgcggcgttgcgccggggggcgcatctgttcatatctacttctgagtcggcaggccccgtcggagtgtgtcgggggggtagtgttgtctctctccggtcgtcggcttttgtctggttggttgaggtagtcgtgagggttttgcgttatgtaccgctcttgtatgcctcgtgtttcatatgacgactcagttgctgacttctgcaagtccgtgctcctcgaaccagctcaccatatcccctgaccctgtgcgtcatctgtggtagttagcgtggtcgggagggcccgtagttctgcagcggctacgcatgtgtcgcgggcgattattgttaacgctaatgtgaagaggagaaagaaagggaaataaggaaagatagaaggaaaagaaagagagagagagaaaagaaagaagaaagagggaaaggaagaaagaaagaaagttttgaaccaaagattcggccacatttccttagcctattgcacccccctactccccccccccccccccncccnctttctcctctc

SEQ ID NO: 7917 - DNA, 1069 bp, Homo sapiens
  misc_feature (1)...(1069): n = A,T,C or G
atcgttgttcgnttctcttgtttcctttttggaggtcccctcggactccccttctcttttggagtgggcgcctcgcttctcctcgccctcgnnggctccctcttctcgtgtgctcccgcgtctctgtgtcttgtgtggggtgtgtggttagctcctccgttggtctgtgcgtctgttgtggctggcgcgcggggctcgcctgctcgccctgtccgtcgccgcttgtccgcctggtccgtcgtgcctcgtcggtcatgttggccgccgtttcggtccctcccgcctcttctcnnacccgtcctctccctctgccttttggtcacctcttgcgctgtgttctgtcttgtgtggtcctcgtccggatgcgccgttccgccgtccttcctcgntctctctcgttgcttgctccttcccctccctctacccgtgcgctctcggctctcctcgccttcctcctcttgngcctgtctcctggttgtcccctggtttgtggtgctgttccgggtctgcctcctcggggggcgggtccctctcttttgctgctttttcgtggtcgggtggcccgttcgcctgggctgcgttttcgccgcgcttgcgcggcgggtggncctcggccctccttcccctctgtcgcggcccgtctggctgcctccgggccccttcccttttcgnccccctggcccttcctcctccgtnccccctttcctcgtttgcttcttgncccctcctccctccctnnccccctcttncccgctnnntttttcttttctccttgcctttcnctgtgttctgctttcgttttggcccgtctggggccgcccgggttctgtctncctctgttctgtgtgtccgttgcctgcggggggnggcgcggttgtgtttgtgtgcggcgctctcgcctcggctttcgggccttggctctcgcccgggccgccgcctttcggtggtttgtgtggctgtcttggttcccgcccccgaaggcgtttttgtgtctccgttgcaggtttttttttttggttgtcctccctcggcggcctcgcgccggacgngtatttgtacttcgcggcac

SEQ ID NO: 7918 - DNA, 1078 bp, Homo sapiens
  misc_feature (1)...(1078): n = A,T,C or G
ctatgattacataggctcctctcatctctaacttgcaggttttgtggagacattttctagtctaaactccacctatgatgactgacgtacgtcagggaagtacacaatgtatgcgacaccgatctgttattttgcgtacctcctactactaattacatactatcgtagtagcaatgtacatctcgtgtccacatgcgtcttggagataggagctccccccatcccgatctaccgatggcccatacaattataccaccaccgcatcataacttgctctcagcacacgaattcatgaatcatgagtcaaaaaactagcagttattcctgatataaacatgtgattcaatactcatacggatgcaatgtcaatcttaagctgcgtctgaactctcgcatataaacgttgtttttctgtcttagttcagtcatatcaaaaagcgaaatattcttgaatactatctatgtcactcagatatttagtcctctctctctcgatgtctcccatccacttcgtgctatgactgtctgtggttcgctagcttcttgctaacacaagtcatcttttttctgcttacaatataccataaatcaaatcggagcagagtggatgcaacactggctatgccgttatcgcgtcttcacgaccacggttatattatcaattccactggtccaagagctgctccatattacacacactcacacatcaccttactgcttgtatactaatcgaacatctatcaatcaatatcgtgctcattaccggcaattgtttgccatttctcctaaattgaatgaaaccaacattcaacgatagcaacgacgataagaaaacagtacttttcatactgcatattcattacttattgtgtagactatcgaactaacatctcatgaccgctaatgccatcaaacnagtgcctccccgtgccgctatacctatcgccatgcacgcaccgcgttactcctcaacatatctatacatcaccgattccgcattatacatcgaatctgggcacccaccctcccccgtcctcacttatgggtgcccccctcatgagagcgtcgtacaagctaa

SEQ ID NO: 7919 - DNA, 804 bp, Homo sapiens
cacggcctggatcctggttctctgtgtgaattcaggagttgaaacagggctgtctacccatgaagataaagagaatagctccactgtttcttgagggatgttcatttaggataaaatatgcaacagagctggaaaacccagaaggctgagtttgacaggccaggttggaagaatttctggaagacaggaaacagatggcgtccagcccccagactgtgaggctctcatgcagtcatggtgatgatgtgcaagtatggtttgacagagctgggaagcaaatattatcttaaataaatctactcttcggaagcttttcaggtaaagaaatcctacaaataaaaagtgaagatggacaacccaaaagaaaaacttttcaggataaagcatctgaaacaaatgtgtttaaaagaggatatccaaatcatcaataagcatatgaagaggtgtttaacttcagttgataatcggggaaattcaaattaaaagtccagatgagacactacttcataccactagaatgggttaatagaaaacaaatgtaagaatatctagcagttggtgagaaatggtgatcattctggatctgctcccatactggtgagagggaattgtatatgggtatacactactaaggaaagcctatgtggcttgttgtctagtagccggcagaaattctgtaaattggcccctatagtttctgtcccttgagggagatgcccattgagttattttttcctttagatcgcggtcaggcctagttggtatttgtataaataatatgattcctctggggtggttagagtg

SEQ ID NO: 7920 - DNA, 892 bp, Homo sapiens
ttgattgccccaaaatttggtcccgaagacaagcccaaggatctttctcttttgagtgtgccacccaggtgggccgtaaaaagaaaagattcacttctgtcttaagttacgcaaagtgaagggattttttgaaaggtataaaagtcctaaatcagtgacctttgggttcatcagaagaaccaaaagggaacaatcctggtggggttgaacgaatcaggttaaccttgcaaagagagttgggttctccttaaggccagatatttaaagggtaaggtgtaaaggcttaaggaaaggtcttcaggggattagagtggtcttggcccaccagccagcaagaaaaataaagactcaaggtctaaacccccaagaaactcaattcctttaaagccgtgaaaatgctcagaagagggttgtttcttggtcatgcctctagatgggacccagcagcctataccttgatttcagcctgtgaagactcgagcagaggacccaactaaaatgtgccagactccttacccatgaaaactgcgaaataacaaacttgtgtggttttaggccactaagttttttagtgatacacagcaatagaaaactgatggtcttataaagctgtatgcatgcatatccttttactcaacaattccatttctaggattaaaagtagaaggccatatatgtgtttgccaaaatacgtagaccttaatatccacaaaagctatatttataatagctaaaacctgaaaacaaagcaagtgagtgagaaaaggacttagggatactggtaatattttatttcttgatttgggtgctggttacacatgtgtgctcagtttgtgaaaattccctaagctgtgtctttcctaaattaactttaataaaatttatcgcaaag

SEQ ID NO: 7921 - DNA, 1110 bp, Homo sapiens
  misc_feature (1)...(1110): n = A,T,C or G
cgttgatggttaaggcgacgggtgtagcttcactgcgagacgtcagtgtcgcgtcgcactatcgttaaataaaccaccggctacaggagtgtatgcctccactatcctcacaaaaatgacatgtaggcggggagcctctacttcctcagtgccactgtgtgcgtgattgtaagcgacgcataacgacacgacagtacagtcgcctagattcgatcaacataattgaagcaatgtcgagcgtaacagaccacacacccgaacatgagtacttcccaaacaagataccctcaccgcgctagttactaacagctgcagccttgtggtcctcgaacgcacaaacaaaatcccgttgactactggatcgcctctactgtatacgtgagtaaacctgccatgtcgacaacgcaatgcactactgtctgcgtatgagctcccctatcgtgggacataaacgcccaggccactgatacgcatggcctccctctgaccgcaaacgtaagaagagaacggtgagagagctcacatagatgcagagccgaactcgccgccgccgttccccaaagcgcgccttatgtcgggcggtgcgggtgccgctgaaacgacgcggagcgcgcagttggtagtcaaccctcacgcggctgagtgtaacgagtggacgaccacgcggacagtggagtggagtcaaaggttgcattagaaccacacagtggacacgacatggggaggggaccgagggaaacaagcgaagcgtcgtgggcggacccgccttatcgacgcatcgcgctgagacggcggcanagctgctaaatacggtgacgtaacgaaatctcggtggtgcagccgagaaatgtgctacgggcacaggcaaggagttctgctggggaacatccgggagggataaacaaccacccttcgccagacagaaaaagtaacgctactaactcgacgacgcgctacccgtctaacccacacagggactctgggaacgttggaacacatatgaataaagaacgatgataacgagtggtgatcccattgcacaaacacaacatagtgtgttgagacacagtgtgagggtatacacacaaacgagggggacaggacacaaat

SEQ ID NO: 7922 - DNA, 594 bp, Homo sapiens
  misc_feature (1)...(594): n = A,T,C or G
aaaaacatnagaatgtatgagatctagaatttaatttatagttagagaaaagggtttcatgtgaactttgctctatttgatcccctggtcttttctcttctagattagtataatgatattgcaacttttgaaatgaggtgatgccataactgacttatattgaattgggttggctgtggtagagatagtagtttaagggataaagtgctgttgttatgattgtagagttttgttgtctactttaataacgttttatttttcgttaattctggaactagaccggaggggtatcgatgatggtgttttgtgtgatttatttgcaaggtaataatccgctattcggtttttttttctcgggttttatttagtctatttttttttctttagcccccgtgcatttacattattatcatctattttcgtcgatcgtcgttgctgtatgtcggatctcttcttttttcctgattattttattattgtttatatttcctgttgcccttttctcgcattttttttgcactatgattagtaataactggtgtgattgatttgtagtgtttagtgtgttctgtgtgaccgaatggggtagttgtt

SEQ ID NO: 7923 - DNA, 512 bp, Homo sapiens
  misc_feature (1)...(512): n = A,T,C or G
acaattgaatgtctgagagctganatttcacttttagtgagaaacagggcttaatntgaactcagccctatctgatcacatgactctgctctgctagatagaagaaggatattgtaccagaagagtgagtgaaacctaaccttacttagagtgaatggtttctccaaaaaagagaaccagtaaaagggagaaaggatttgtagaagaagaagacaattgtggcctacttaagaatgtttatatgttttttaacttttaaaacaaacactcagatcattaactttgccgttgtttctaaatactgaagaataatcatcaaatagtagtcggatctccaggtaaaagcgatgtcattatggacatgtggtttttcagaggctattaatttttgtttcagtgaaaaaccacatttatacagtaaatcatttttcccatttaaattctgttcactataatataaatattgtgtaagaccctgttatgagagagcttaataaacatagatgcggcag

SEQ ID NO: 7924 - DNA, 916 bp, Homo sapiens
  misc_feature (1)...(916): n = A,T,C or G
gctgggtccgaccaannaaaacancgcccccggttttggagacaaacccgataattccctggaatgctttgggaatcagcactgtttacaatccaacgatcttggtgccgggtttaaccccagaaacctaacagtgcccaaccgccagggtttggaggcatattttctatgcttcacgcggaggatccctattaaagaaaccccagtgcggggtgcttactcggggctcgcaaaaccacaaaatagggagaccccttttttttggggggagaaaaaaccatacgccgcgacacccaaaataagctcaaaaggtttggaaaaaaacaaaaaccccccaacctgatcaaccgcgaaataagcttgtcggtcgtttttttccaccattataggaataaacaaaatgccaacaaaaaaaataggcggtttccacaacacatgagggtctacccactaccccggcatcactcagggtgggaataacatcccccctctctccaccaacaccttccacaaaacatctcaatatcctggtgtactcgttcggaaagaaacgttcaaatttcccccgcatattcagcgggggatattatcttcacttcatccagaaattaatactcggatgatactcgccttccccgccatcccaaccagaacccgaaagcaagtgacgatgtcttcacatctgggatataacccccccatatgcgcaaacgcaatagctcttcccggccgtaacaatctctttctggtgggacaaagccaattccgcctacctccctgtacgttcttattctaaactattcttctaagcatctacgccgcttagatgagggatggtaagattataatttattaccctacttttcccgttttactagacaatataccacacctatcctgtatgttgtacctattt

SEQ ID NO: 7925 - DNA, 1554 bp, Homo sapiens
  misc_feature (1)...(1554): n = A,T,C or G
cacctatcatctatcgnnntacatcgtctcatctacatctctgactctcgtatgtncgtgctctcagctcctgngngacatcttcagtatacgttaacacanagatactagaatacactacatgacacactactctnactcataatagaannnnagcatcgctactatcactgtggagactctccctgtctaagngtatctcgtnnnaactctagannngagctgatgagctgaggagtaananacatctgtctcttcatctcacaggcgctcnaatatgtatgctatntantcgacatgcgacgcgncgnagccacgcgatcangtcacatcgatgagaactagagtgagngtgaggntgaacatagtagtaatctaggggatggatctgcactgtgagatgtgaggagattgnngcgacatcatataccacatctccgnnnacatacaacaactaaatattatacctcatgtgngntcgaacagtnaatctaggncaattaattatgatcagtcatactgatacgcttgctcgatacatcacctcgttcattatactatganaccaacactcagtncacgntaagcacacaatacactgtataactanaacacatatagcacactatagtcaataatncatgatagtcagctactaatcatttgtnncataagctgtattatagtgtgagagacgcatgctcgctatagnactctgaactgtcggttcgttgttgtttcgtgtgngngngntgtgtgagatagatcaatgatgtgagtcgagatgcagtcaatacggngaggngtggagagtacgngagtatagagngacctagagtacacatacacatgaaagaactagtgagacatngtggngctttcagcacatatgtgtantgagattatgtagaatgctatgtgttcgtgaagactattaacatnnnnctcatctcacacagactctntaactatgtganagatcacagaggtcctctctgnncaactacaataaactatgtaatatacacttnnaactcatattacaatattcttcnnctctaccgttnnnnatacaatgaacgacgtgcgtcactttgctattagttagcatcttntgttgtntgtngnnngcatccacgctctgcgtgtcgtcacttnnncctagcttcagctttactcattgcgacacncagctactgatgggtattcatagatgtgtcngtatnttactgtctgcgctggtggcggctgtgcgtcgtgactctacatgctcactaaatgtcgtgtcacatacgtgtaacgctagtctcccgatgaatgcagagggggacacgaggcagatgatcagacaacaatgtgtcgaggccggcccgtgcgctctggagctttcttcggtgggctgatgacgtggctcgtccttttagtgctggaacgcgtcgcgccccgcattgggcgcgagcagtgtccaccggcgctgccgcgccgtgncgctcgtatgaggggttgtgtgtctttgtgaattccgtgaaaacacaggaccacagaagcagacag

SEQ ID NO: 7926 - DNA, 934 bp, Homo sapiens
  misc_feature (1)...(934): n = A,T,C or G
gaataacggattaaccaagaatgaagggatgggtggaagtctaataaaggtgaaagtggttactagaacgaggcagaatttgggcagttgttccggtaaatgggagggaggaaaaaagcgagggggtccataaggaaaacaatgaataaaagaatttcagtatggggaggagtaatggtaataaaggaaaaaagagaaataatattttgtatattataaaaaaacataactcgactgctaccctgtataaaacccacagatctttaaaaacatacatccctatcaaaatcaactataaaaaaaataataataaaaaaaaaaagaaataaaactaagagaaaaacaggttggccatggcgcaacagcggaggagtgacaaaagtgacagatagggagagttagaaggtacaaaaagacgacgagtcgggccatgcgcatatggaacaagaacatacatattatatcaatagggattatataatcgtaaaatgcaatagaagaaattaaaacacatattaatatatgcacaaaatatataaaaaatcatcncacaatatacaaaaaatactaaaatgccagataattannatttagtagcacattgaaaattataattaactataattcttattaggaaatacgcttaatgatgctacggtggaaaggtcctgtgaaaagacagcttagtgtacgcgtgagtagtgacactttgggcgggaacncatatngagacggaataaagtgggacagggagcacgtaaggtggagtgtgagcngagagtcaacgccgcacttccgtaaaaaacacacgaggtcgtggtcgcgcgtggtgggaaggggtgtgcagagtcggggnggtggaaaannnacataactgcaaanacataagaggatatcaaaactcttntctntgttgggaagcgcagggctctca

SEQ ID NO: 7927 - DNA, 1574 bp, Homo sapiens
  misc_feature (1)...(1574): n = A,T,C or G
ccagcgatgntcangtcgaacagtagggtctaggttgcgtcgtcgncaatctaggttatctctatgtcactgtatatctgacatgcagtatcgtcagcgtcatagtcgtactgattcgtgtacgagtgctactcactacgccgaccatncacgtactccggagaacaatgcactggtanggatcgagtgattgatctgcggtagcgaatacgcgagcgagcagacgaagatctgccctgactgcgccggctggcactcgagcgtcagtagtctcgttcnctcagtcgtcgcgtatgcggcctgagacggacggtcgcagtacttgcactcgacgtcagctacactattgtgctaattgtacacgttcgccgcgtcgtgacacacgttnggacgatgcgcatcacctagaaagtcantctgtaagctactgncgtcgaacaatggatgcgctgtcgtgtgtgtctcgctcgagctagcganacatagcaaccgaggactagtcgtatgacgtcgactattacagacagccagctgcgtaggacgagcgcatgttgtcgctnctgatntccatctcttcacatattaggtatcgtgtcgcagcgatcgatggcaatctgactgccggcgctagcgagtactggctagcatatgctcacgtacatgcactatagcgcgcatgtgcgtgcagctgacgccntagataccgacgccgtgataggtgcagtgcgtatcgttggtcagtctgccgccgatggtcgtgattaatttctagattgcgcgatgctggatgctgccatggcgatcgcgcgtgtcgctaaggcaacgacacgttctctgtcgctcgcgagtatgtctcactatttgactatatacactcatatacctctctgtactgttggagataggcttgtttgtagcgcgatcgtcttctgatcatgtactctcgccnacatcgacccggtagatgatactagcatacttcgctctacgtactgctgacgcgatagggtagcggtggatgtgagccgccgcggtctctactagtctcagtgtctcgtctatgtgatatcacgtcgtttattgcagnttagtatcagtgacttcacgccactcattgtcatggcgcgagcaactcccgacgcgcggacgcgatacttcgacggcactcgttcgccgtgacaatacgcttgtctgcgagctgcgaccatatgttacgcgcagcctcttgccgttcgatctggggtggctgagtgccgtctgttgtgagtgacgccgcagggcagatccagttgagatgtacggagtcacttaggtggcatttatggtgcactaccgagcagtctcgctgctgaactctgcacgtataccgttcatgagtatagacgctactccgctacacactcacctcgctagctctgtctcgccgttgtcgtgcgantctctcaagcggctcacgacctcgctactgtgtgattatactgtacttagtcactccctgtcactacattatgaggtgaaccgatcttgcttgacgagtgagcgatatgtgagaagaggacgatgccctacccccg

SEQ ID NO: 7928 - DNA, 1350 bp, Homo sapiens
  misc_feature (1)...(1350): n = A,T,C or G
atctgttggtagggagacgaagacaactaatgcgggttccctgcctgcaaacacaccattcaaactacacgcctatgggacctgagcggttactattaaacattattaagaatataatgtgtagtacatcacgcgcacatacatattatgagcgtattcagcaatgatccacccaaatcccgtttatctcataagcaccttgtataggacatactagtgntttaatttattgcccataccgcatgcaactcgtaacgtcatgacaacggaattgtgcttcacttaattatgttatatcgtcatactatatgattatatctactcgactgcaagctgattcactcatataacaatatgaataataggtatacatgtncgaggagtagtagcacagcggtgatactagatattagtccgtcccgcccaagatagacgtatatagtgagtagtacgattaganatctagtaacggtaaccgtcggcgtatatgacgatatttcatagttcgngcactctgtctagtacaactgctctttgcgcgcgaagattatgagatattaatgcatgatgatgattgttatcagataagtcgatgatgattagttacactaatactatttatacaactctatatttgtaccagtatcagangaaacttataagcgtacagtgttgacggatttatatctataagntaatgctgtggaggatgacacacgtattantgtacgatattaatagtatgacgtggtacagatagactcatatattaagatgagagagaatgatatgaagtctagttgtntccngtagccnaacagacgctcgcacaaatagtattacatatatatatttggcgnaccaaatcggcagtgtatatctcanccgtcgcgacgatcatatatgacatcacacgcctangataatatagatantatagcgagaagtataatgtatatctaattacatatatacgcacacccacagacgcgtagatgacacgatgcatattgtaacacactatagctnagtgagatatagtcgacgtctcgccatcaactgagatctatgttatgtatatgccgcgacagcgacacgctatcgtatatcatcacctatcgatagagtactagtntaatntatctacgatgccatagatcaaacatcgatngttatcatcgcactttcantatatcgctcgcgacgtagtatattcatcgagccgagtgtnagtngtaanatacatatanagcatcgtagccgtcaatgaggtagacgtgagtagtacttatatatataattttctataccgcatgcacgatacatatataagtatagcgataagagagt

SEQ ID NO: 7929 - DNA, 1061 bp, Homo sapiens
  misc_feature (1)...(1061): n = A,T,C or G
attctcttcgcatccatcatacccctctttgtagtgcgtcttctgtgggttcacttgtcttaaggggatgggtggcccgaacctctccgcctcagnnactttttcatctggtattctcttggggctgtgatcttgtgggtgggggcgggttgcacttttgtgtgcgtcggntgtgccgtcanaataggtatttgggaaaatctttcttaaattcttggccgtatcatgggcatctattcatctccgcgacaggattagttctatcttattnntcacttctcttttcttgnncttctttcatcttctttttctngnattatttatcctttacctgtgtctttccattcgctttagtatttaatctcttaatcttttctgtngtacatctttgtatgaaacttcacaactcaggatcttttatttctgttcttcttcatcttctaatcctnnccttataattaataatctttgagcggggtgcgtttttgctttggttatgctataacacgtttatgttcggaggagatgtatggaggaggagagtgaggttgngacgtcgagctccatgtaacgtcggttgcgnngactgttaatctctactactttacataccataattggacatacggnnactttttctgtctatcttcattcctctatctttcatgnatatctatatttattctaaaatactctatcttttttccttttctcctttnactttatcatctatatttttaataaactcactcctataactccttttgngtgtgtttggtcttttgtgtttctaattnatatttagatattgtgttattaagttgttatgagggtgccttgtttgtttatctttcctttctgtctctttggcgggcggctgccgttacctagattatgtgcaagtaaacgggaggcccttgcgttggtggtgngtnggtggtgggggttgcttgtgttacgtnggtttcctttgctgtgcgtccgacttgccccgttctcctcttgtnnccgttctgttggctgctccctcttcttcttataaacaatagagtaaggagtcg

SEQ ID NO: 7930 - DNA, 1085 bp, Homo sapiens
  misc_feature (1)...(1085): n = A,T,C or G
cgctccgggtgtgctgctcgttcccctgttcctgctctccgcgcgtcgtgtcgcttttcctgttgggctttcgtcttgccgcgttgtggtttccgcgcttcccccctcggttggtgcgtttctccctccgccgctcgtctcttcccctccctcgcggctctgtatcgcttgctgtggcgctcgtctgctttgttcctggcgtcttcgtgtccttgtatctggtcttcctctgcgctgtgcggcgcgtgtggttcttgcggggtgctgtctctcgttccggtggtctcgcgcttccgcttttgctcgtttctgggggcgcctgtcctctgcggttgtcgtccttgttgcttctcgctcgctggccttgcctcgctcttctccttctgtcgtgctgggccgtgtgggttctctcgcctttggctctgcctcgtcgtcttcctgtctcgtctggtctcccgcctcccgcgcaccctttgcggcgtctcttcgcttttgtcttttctgcgtgtgcgccggttcgttggtgtttttgccggtgctcccctcggtggggggcgctgccgccttgttgcttttctcggggctgtcctcggcccggttgggggccgcggtcgtgcgccgcgttggcgtgccggctgtgcgttttctttagcttgggctgtgctcggtgtttgccggtcggtcttcgcggttcgtttctcgtccccgcggtcttccccctctctcccttcgaagaaacgtcgcgcctcctgctctcgcctgcgcgcgcgtcgctctcgcttcgtgtgtctctccgtccgtcgtccgttccctcttgtgcttttccttcctgcccctccgtcctctcccggtggtcgtccggtggcttgtccgcctctctgctcctcgtttcttgggccgtccgggcgctgcctccgggtttgttcctccttcccgcctccgcctcgcttcgtcgttcttcccccgcctttgcggcccttgttttcnccccccttgaggcgtcgccggctggttntcgccccgagggtctcgttttgtttgttgtcgcgctcgtccggcctcttgcggcctctcctggtgggccc

SEQ ID NO: 7931 - DNA, 1702 bp, Homo sapiens
  misc_feature (1)...(1702): n = A,T,C or G
cgtgacacnggacgtgcgacacactacaaactgacgncgctcgatcgtatgacgcgtganctacacgacgcacagcgcgccttgcgcgtcgtcatcgacaatgacgcgggcagcagcgggtcgcgcgtcgtgacgagtcgngcagcgtgctactctatacactgtcatancagngcgcngtgcgggcagtcacgaggtngaataatactcagatagtgcactgcgctgcgagcgatacncgatatnagcaggctagtgcgatgcganattantactgacangatcattatctcgcttcanangngngngncgatcngcgntgacgcangaccgngtcgngagcatcgacnaacactgtcggantgtcggagtcgacgngacgaccgcgngggtcgactgagcganagcgacacagcactgcgnggtgngcatgncatgtgacacggatgntgcagtagcncagtgcaccgagcatgcgtcgcagtacntattagtatcgtatgtcgagtgcgatagctacgatgncgatngnacagcantagncgacancacganacacatcccattatacnttactattgcacggtctgtnntcaatgcantcgctgagntactctaatacatcgacgcncgcgcgctcactacgacgactnggcgatggcanatccatnctgcgataggacnatngtggtgtgaagacgcgtcgaccaacgaacgcaacgngtnagattcgagacgaaatgatggtgtgccacnatcagtgatgtgttgtgctatacagctgntcgcctgtctggtatcgacgcaacgtacncacatcgctcgagnancgcgagacggtgcacgtcgagcgacacatactcgatctagtcgtcaantcagtggcgcatcatcgtgagcgacanagcagcagctaacgnagatgngccacatctatagagtgattgtagccgtgcaagtgagancgaccgtaggcacanatacctgtgtcgccaatgtgtggccgatgcgtgagcgacaattcacggaatttacgtcaagnttcgcattatctggattatctgtagtattcacgtgttgctgcgtcagtgtattatatttatatatgccgcgcgngctggacgcgaacagtcggcgatcggcgatagagcgcaacattcacactcttcagtcatatattnctatcgcgcggcgccttgtcgcngacagatttttatacgagtctgttgngctcctgcatatatagacagccgcncgacgatcgcacgacatagctctctttatctgcgntttgaggctctgcctatntggtgtatctcagacgttagagcagtaacattttgacatcgtgactcgagctcgtagntgcttagcgtctgtagtagagtattatagtacgctagcgttgtagcctcacntgagggaacctgttctctctagcatgtgagactcctgagcgcctctcgctaaggacgcctgatcgcgtctgcgtagagatagaggtcgtgattgcgctngagcctatacttagntgagatgtgcgatatgtctatgcatagtantgcggggcacgnacctggcgattgaagatatgnagcgctatccgatctgccgcgactacttnatctcagcactggctagttcaaccgcgcattctactggatgatcacacagtcgtgcgatacctcatcgcagcactcga

SEQ ID NO: 7932 - DNA, 916 bp, Homo sapiens
  misc_feature (1)...(916): n = A,T,C or G
ctagtccgactttctaacttttagtggcaaaatatgtgggacgacatctggacaaatccggtcttatttatgttcatcatttaaatattatagatgtcattccattacaaacaataactaaaaataaatacattaaaacatatgcatgaagtagtgcacagataaaattatagggtttttcacaaacaaaaattatttgatgtatgtgtatctgtgtgtatgagagtattccctcaatacatgagtgaattatggaacaataacctaacacaataatcagaaagtcacttagagttagtccttagaatggaatatatttctttataatatgctcttgccattctcaagctgaactgcttgccttctgttaggatgtactcccatccttcctaacctgatcataatttccactctccctgaacacaaaacaatctaaagagaagagaggacaggacacatactgtaagcgtctactgtacacactgcaaatggttatagtaaattaaggcttttactctgctgagtacgcttatgtatctatcgccattacggtacatagattcagattaactcaatgtgatgttaacttctgtttggaaacctatcttaggtacaaggggtcttggatatggctctacataatgttgtcatcgaaacataatatgccgagaacatcgtactttaaaacacatgggtctttgagtgtttatacccgctgcgatgcggattttagcccaaaatcgacactccgactattatgtatatgcttattctcccnccagtttatcgcattatacctgtattgcgcttgtccactcacctattataagtaaacatagctcatatagataacagcaaatataccagcgatataataaaccatttttgttattactacgtcatatatcattctacg

SEQ ID NO: 7933 - DNA, 822 bp, Homo sapiens
accaactggatttttgagtttgtcttcatacgaagtgtcatttgacctttccctatgagaagtctggagcaaggttttattcctgaaaagaagagccagagagagggatttgtgtgcaagccatttgtcaaaggagtgttccatggagaaatctgtgagtgcaagaagccaattagagaagagaaaagatccgcaaacacatggattcagatgaggtctatccttgggctgctcccttgagaagcaccaacatgtaaatcacaccatggaatttgctcagctttgaggcaacagaaccatgcttctgtacctcacattgaacaattattatctaacagccactgtagagagtgttgaaaattggctacattgagctgcaccaaaaacagttggtatgctatttcttcaaaagaaaaattggatgagcctgattggcttaatatgttttatccagagatgattatcatcattgaattaggaagcacaccaaaaatgaccaatatcatcgtttttcctgggtggagcacacaaaaccccattcttttaaagtatttgctttctggaaaaaggatgtctttatatggaaaacttaaagtagtgacattttttaggggccctttgactattaactttgctcccaagcattaatttgtcaaaacatcttcttaaattttggttttgtgcttccgtaagggaagctcttgtcagtgtgggtttaaaagaaaatgaacccctgaacttacacttggaacttgtgagtatttcattataccctggaggtcgtgcacccgacccctttctaatagtcgattaggactacag

SEQ ID NO: 7934 - DNA, 1047 bp, Homo sapiens
ttactcgttatctccctttttgccaatattcggtcacaccaggccgaaaaccccacacagtatttcttcaataattttttaattttttatgtttttttttctatatactctacccttcgcttttcttaagattcttatctttcgaagagaacagggctggatttaaaattagtgtggctaccactacaccaacaatatttgttgccgataccactagtagttgcaaccctttgcacctcctccaggtggagtatacatacaaattgatctatataacaaatatattggctcatctccgcaaataacgtctaataatacccggacaactctctataactcctacaacaatataccgaccaccaagtggcgatcccggaccctaacatgggtggggccttatattaatacttcattccatgccccgcgttttcatggctaacttcgaaatatgcgttccaatttccaaacgtccgacacttcaacggagtggcccttttctcaaatacattggtgctagttgccaaacaaggagacgaaacgattatgacttatttttgtcacctcctgcatcgatatacgctaatcttattttcatttctggggtcccttacgataaatacctgttgactccccattttttctacagatactaactatagtaccttaaatacattagatagcctccaatcgttatctgtgcggttttactcccctacgtaaacgaaattattatgattgaactacgtttcacatatatcttttttcataccttctgggtcacgcacacagacagcaatacatatgaaaatcctccgcaccctcactgtttccactagcctccgtacatctctttataatttgtccctcaccttcgcccttatccgtatgttaattttctacctcccaatattgccgcgtctctttatatatcacatgctcccccccccttaaatgttatattttacacgcggctatgtgacatgagatagatttgagtagcgtcctgttattattattgtcttcgctccgataagaactacgacgcgt

SEQ ID NO: 7935 - DNA, 794 bp, Homo sapiens
ttccggagtatatgagcaggacgtgcagaaaccgagaccctgaccagatggaaactgctgactgatgtcacatggacctcagacaaaaggaaactgaagcctgaatgaactgctgttctttgttctaaatttcttcctgagggacctggaaagacagtcatgactgcaggccatgagtcttgataacctgaccactctgacccaatacataatggctgtgacctgactctgccttagcaccccaagattggtgatgggtgtccttatgttaactaatgggggggtaaagccgaaccttagcgtgtgtgttgggtgaccccatgttgttagacgaagtgttgctggcgtggggcagtggtagtgggggatggctcgattgccctaagcctgtgggcgggggtgagaaatattgcacgttttggagcaaagccgttgcggaggtgcaaaatgaaagcgtgatgaggccctgacggtcggcttgtgtgggtgtgccctcgtgggtgagagcccttgtcgaggggggcgttgggaggccggtggggacaggatcgtggaggcaggtggcaggggcccgaaggagtacgtcgcggctgcggggaaagagggggcagttgagggttggcgggggacgtgggacagatgcagggggacatgggggggagtcgcgcagccgagctgttccggactatagggtagtggcggtggggctgactgttagtggatgaggaggggggagagttaacactgctccgggaggatcagcgagcgagtggccgggaggctgcgccgccggg

SEQ ID NO: 7936 - DNA, 883 bp, Homo sapiens
  misc_feature (1)...(883): n = A,T,C or G
ggcggggaggggtaacaaaattggggcgccaaaatccttagtttactttcaaccctcccccaaaccctggcgaggagttatttttaatactttttccaaaaattatgccttttcagaatgtcgtgtagtggaatcacccagcatatagccttttgaaatgccttattcatttagtaataggcatttaggattcctgcaagtctttttgccggctttgatagctcatttctttttagtgctgaatgctcttgtgcatgatgcatcatatttttttatccatttacccaccgaagagcatcttgatgactcccagggttttaacaattatgaataaactacaagttaacatttgtgtgcaggttttgtgaggatgtacatcttcaactcacttgggtaaataccaaggattgtgattgctggtttgtacagtaagagtatgtttagttttgtaagaaaatatcaaactgcctttcaaagcagttgtactatttcgcattcccattagcaattaatgaaagcttccatcgttccacatccttgatagcatttgatactatcagtgttttgcattttagcccttcaaatatgtatgtagtgatatattattgtcttaatttgcaatttcctagtgacatatgatgttgngaccatttcatatgtttatttgacatttatatagatttgttagtgagatgtctgttctaatcttttgctcattttttactcaactgttcaccttcttgagttttaagagttcttttcatactttggattacagtcctttatcagatatgcctttttcaaacataatctctcagcaaaaaattttagtttcaatnnnctcgctggcctcgttaacctcagcggtggagctcatcgggct

SEQ ID NO: 7937 - DNA, 904 bp, Homo sapiens
tcttgagagactgaccccccgccctacagcgagacacaactctcttctttctcttcctcctcatcctactcatcatgaagatgacaaggatgaagaccttcatgatggtccacttcacttaatgaatagtaaatagtaaattttctcttcctcatgatgtttgaaataatattttcttttctctagcttattttattgtaacaatacagtatactatacacacacaaaatattttttaatcaactgtttatgttattggtaaggcttatggttaacagtgggctcttaatagctacactgtggtggagtcaaaagttatatacagggtctcgactgtctgggggtttggtgcccctaatctctgtatcgtcaccggacacccacaccgttattcctgctagacatgtgtcaaccccctatcctgtcaccgcgacctgctattgctacaaatagttcctagcaaccgaccgataactctatgtctaactcctacgaacccccatttagtgcacatatacgggaaacctccctgtctaactgaattcaacgtacttgtcataacactgacaatcaacaaccctccgacattccctacctcacccgccgccctctcccaccaactcccccctaccccgcacactcgcccccacctacaacccccataccctatctccacctcacccgtcaccccacttcatccacaccttccctcctactactatcctcctccatatcacgcaccaccacccaacacactacccctaccccacctcctccgccccccgccatccatggactcctctccactctcacaacaacacccctcccctataactacatccacacctctccctaccacaccctctattctttaccttaccatcccctcgtttagatactctgt

SEQ ID NO: 7938 - DNA, 1132 bp, Homo sapiens
  misc_feature (1)...(1132): n = A,T,C or G
gactccactcacacactcatcacacaatgaagactatatgagtgtctgaagtacaagaaagcaaacttcggtactacaccagnatgaaggatttataaacgtcgtccctcaaagccatgctttatgtcgaagaagtcttcctgtcgtactacaagatctaaagattctgttctacagaacactcttggtattgaattcgacacctcgattagcgctgcatttaaactacagaattctgcatcattgcgtactccttcagcctccgtcataatctcagaatatctctcacctcgcggacacaccccccacaacccacttatgataatcatacactctatcctaacttccgcctgacgataaactgtagcatgtaagctatagttagttgaatgcatcgacataggacgctccgctccctcaccctatcaatcaaatatttacaacactgcagcacggaagctgctcatcaattacacaagacgccgtcaccactcgactcccatactgcaatccctgaatatcatgattcccagtacattctacgaattgcttttcaagaacgctctcttctcattctaagaccagtcccacatcttccacacaataactcgtccactccctaccgctcgatcttatggctatcattcttacgcaccaatcacgctctctatcccccaccgcctcgcaatccgatttgcgtttacatgcgaagcgcgcgtgatgagacacacgactagcaccacgacccgtcactcgcaataaatccgcgctgcagctgccacactgacgtgatgatagctccgaacgctgttatgcactgtgccgcatgtcatacgtactcgactacggatagatcagagagacagtacactctcaggtcccgatgcgctgtggtcacataagtacaatcacacacatgcagaaatagataacctaaaactgacacccgcagaaccatcaagcgcantcagtgatcgcacctagtcaccagcgagtgaatcgacctaccgcagtctccagcggcatagccatatccgcgccgcgtacaatcatctaagtaatctactacccatatancatatatagatagctacactagagtgtgcagagtagacagaccgttgatgaatgg

SEQ ID NO: 7939 - DNA, 893 bp, Homo sapiens
  misc_feature (1)...(893): n = A,T,C or G
ccgctcagttgtgcacggcccttcttttttttgtggtccagccgtccaggcttctttctccttcctttagattggcccccgtccctctttaatgtccagggttggtgatcgcccagggtcctttgtcgagaagcatgtgccaagggtaagggcagtccctccgttttcctcgtcttgctccatgggtgtgcccgaacctctttcaagtcctcatggtttctgcgaaggcctcctctgccacctcccagcagggtgctgcaactcctgcaaatacaggccagtggtcatcatgagcacacaccaacaggcgagtttttgaagctctttgtcctgcncgggtatcgctgcccctctcgcctgggggtggctcccctccccatcgccatctcatagacaggggcttgtcctccagggacagtgcttggagagccaggtctagcctgctgggctctggagcaggcatgtcgcctgcctggctctagagcaggcatgtcgcccgccccactgcccccgacagtggtatggggaatgggactgcagtgtgggtgccacagggttgccgggcttgctgcatgcctcctgggacaagttgcccagcctgtccgctcctcaggttcctcacctaaaagacggaggcgtcaagagaaatgcccgaggacaactgctgggaaatgtcatgctgctgccctaccccccggaccccgggggtcctcagcggcctccccaggtggcatcagggcctccccactgcagacagctggcactccacagcacctgctgtggttagggtttctcaccaggctgcacacgcggagtgtcagaaggctgtggaaaagcaaattnancccntngcccgatggcctcgatagcctcagcggtgaagcaaaaagccg

SEQ ID NO: 7940 - DNA, 872 bp, Homo sapiens
  misc_feature (1)...(872): n = A,T,C or G
ggggtcgcggccattaaaggctatccctttgaacataggtcaaggaggttgcaacctctttnaaagcacccaatacgcccttacctgagtatcttgcaagattcgggcttcccgtggtcccaaaatttactaatatggtaggatttggggttactgagcccatcaccattcagtctatattatcaaccctttccccaagctagtaaaaactctttctacccacaaccaaaggagggactgaggcccataatataatcaccaatagaaataggatttattatgtcttgcattatcccatgcaatactcttaacctcccttgaatgagagttcaaaattgtagggtcatgactagaacgattataccttgcccactttccaggattgcctgatcctctggatacaattctgtctactagttatgaccctaaactagtcagagagtcaacttcttcacagtggccccttctggtacctaaaatatccccacattgttaaccctaacttctaatcataaaaaaaaatagactctgactggaagaacaaagtgcttctgtaaaaatcattatggtgctgtccatagaggccaggcatgtaacagggtaaggaataaatattggagctatttttttctgtacagttcactattactcctcagagactcttcaactgctttatcagagttgttcaactccagagaatctgcccttcccaaaacagataactggcacagctgccatgttaaatgattcctacactactacatagtctgtgccctcttaagcaccattttatttatggaacccatcctttgcttgtttctcacaaataaaccgttggcctcgttggcctcagcggtggagctctgcgcgcg

SEQ ID NO: 7941 - DNA, 895 bp, Homo sapiens
cgggcgaagaggaggggcgccaagtttttttaggtaagatatatcatcccaacaccataggggcccaaggcaaaaagacgtgccggggagacaatgtcctgaccggatcgttaagaagcgcctttctgcttgggtgtagcaatgtcaaaataaaggccatcaaaccttttccaggaagcaattctcaacaactcaagaaagtgctcccatagaaaaagactcaagtattgttcaactgccttattaaagggatggaatctatgccgggccatctaattataataatgttatttttttgggataagttctcgatccggtcgccaggctggagtgtagtagtgcattctcggcttactgcaccctccacatcctgggttcaagcaattctcctgtctcagcctcctgagttgctgggactacaggcacatgccaccacacctggctaatttttgtatttttagtagagacgggtttcatcctattgatcaggctgatcttgagctcctgacctcaggtgatccacctgcctccgcctcccaaagtgctgggattacaggagtgagccactgcacccagcctccattttattcttaattcctcaccacatgggtctaactgtgggggcagctaccatggccagcgagtgtgaaagaagaggagtgaggatgagggaagtcaatcagtctccccctttagacttccagatcaattcccataaacacttggatcacaaagtctttttgtcttcctaagaacatttggtatttcactatattaatgtttgacagaatcttcttttggaaaattactattatccaatgttatttataaatatatatgcatgcaacctaaataaaggcgtggcctcgtgacctcagcgtggaactctatggcg

SEQ ID NO: 7942 - DNA, 1751 bp, Homo sapiens
  misc_feature (1)...(1751): n = A,T,C or G
ttgaggatcatgtaagcnntagtagnntgtggaaggnaganaannannatgtgtagaagagaggacacagaggtgganagcatgcgnatatacgcgtanacacgatggacacggactcnatcctatatagtnnaacgancaaaacancaacacacaaccaacacacacgatnanatctntcaaaccacactacacaaaagtagnctcaacnctcgccgaatctcaagaatcacaagcattaattagaaatatagacatgatagcagagcagtgagagnagtagtagggtaganacgatgtgctagcacanagaagagagaccgtgnagantggacganaattagagcataagagattgaggcgtgcggtggaggtggtagtcatcactcacgacatgcntgtcacaggtatatgcgcngatgaatgtcatactatcgtcacgtacaaccgagtcagatgtgatcgcagcacgtggtcanagtgtgacgcnggtgtgcgcactagtcatacgtagtcagatacgcggtntattgctgtggcattcgcctcgtcatgaccanatcgcgtatcgtcgctactggcgtgacctccncatacacataacttcatctgatgatgcgagtcgacacacgagagatctaggntcnanatcgatacgcattcgacgtgctaacagctctactcacagacgctgagctactgttgacgatcgncgacntcgctgtacaccgcgcgtagtcatctcaatggtcagagtaaatgcntcgtgcagagtgncgacgatcacccacnccactatgacacnacgacangnccacgtatatccgatatatctgactagattntgactgtgagctgaccncgatcgaatgaagatgaactagngangtaacganaanacagtgcgcgcnatgacagatgacatgtatatcagatnatagcgccgtctctctactgagataatgataagagcgactctacacctgctcttctgcntgttagttctacacgtgacactcgttcatccatgacccgtcattaccgacttaccacacatacgaacactcaatgtctgtacgcttaggttgtgcgattgttatacgtcggttgtcgtcgaanatcgcacgcaccgcaggacatgtccgcgtgatagttcgaggtcgctccgcgtgcatatagtacgtatcatagacacgcattatgcgcgacagactccgacgagcgganaccgtgtgacaagtggatcatgattgctactntgacctacttaacttttgatcacaaagcaacacaatactcgataancaantcatgcgcacntatgctagacgcgcgcaggtatcgatagtagtctgctcactcagaanatcgacctattactcggtcgtattgcgtgcgcagtgtgaatatgcgcgtacgagcgatcgtcgttgggatcggagtgcgacatagagcacgcgacacagcncacgcgagagaagtatgtaatactcggaggtgataagagtatgaaccgcgttgaacgtcgccttatccacgcgaggntcgatatagcatctatagancaacgtatgctacgatagcgtgacttgcagctctatgtctgangatagntagatgttcacntacntatagtatctcactctnatcttccgtcactacacactctttagtacagatatcatggttgagttctgattatgtgnagcgcgcgagtgaagactgatcagtatgcatggtctcgagagtag

SEQ ID NO: 7943 - DNA, 1595 bp, Homo sapiens
  misc_feature (1)...(1595): n = A,T,C or G
ccagtgtccaccagatgatattcgctacaagacgacaagcactatatacctcgcccatagccccggaagttngttttccctgcgcgtggaacccgcgccccggatttatatagcgtggaggacgagacgcccattaacgcgctcagagatagataaccggcgctatacacccgacgcgcctgccccgcggacagtatatatgagtcccaaaatgatcgcatcactacacgtcgccaacaactctccgtgcgcgttataagcagtggctgctttctgctngcgccgcatcgcgaagagtttatgtcgtcacgacccaagctccgacataacaccgtcgcacgtaacgagatatattatcgcgcacccacacgtacatatnctcgacacagttgcagttagtagtccaatcactataaataatcagcgtacgacacagctgcataatcacactagagctactccgcatacctgacactgcgggcagtatagagcatcgaattacgangcgagtcatacacatacatgagatatcgtagtaaacggagtgacgcatacgtagtaatatgatcgcancgtaccacgatgcgcgcgagccagtgatttcgactgagcacctctacgacgcagtaccgacaggaggagtacagctacagtgtggacgatgaggcgagcgacataagcatcatgaagacgacaagtctgagcctgttaagcgtctttattacatntagatgctcacgcacgtgacggctaatcggcgagtgccgacagcgtcgcgatgtggatagtgttgacgtacacacaacatagaagtgcgaagntcatagtgganggcaaatgtgacgcacgtgaaatagcccatacgacggtactgtgtgccacgcaccgcccaaccatcgcgcgttggctcgagcattacgagttggcttcgagtatcgtagtgtgacgacacatacccacaaacaaccacgtatggncacctgagtaatgcgcactacacagacgtagatataaaagacgtggtgacgctgtcaacatgagtgtagcacccggaggaaaccatagtatcagcagaggtgantgcgtgatcacttgttcagatcgaagcgccagcccagtgataggagtgtatacgacaccacatcaacgtcacatcgcgcagacgcgtggcgcacacgcgtgagaacgggtcacacgctgtttgtgaactcatgtgnatgatggagtacnacgccncggatatcaagagcgacaatcacgccatcatctgggttattcgatgacagtagcgcgcgcagtgtagacagatgtagtgccagccggtgcgtgacatctggcagcccgtggcgagagcgctccagtgcgccagagcagactgtatcgagcacccatatcaaaaaccgtcatacatgcaatcacacaacgagttgcagatgtctatgacgcacgatctcgtgctactcagccncggagcgtcgagccgttatattgtacgccccacnacacgccaacaccgcattgtgtcatacgactcgcaatatgatatagcgcggcacactatcgccacctccgatgatagtaaagtccgcacatcg

SEQ ID NO: 7944 - DNA, 1626 bp, Homo sapiens
  misc_feature (1)...(1626): n = A,T,C or G
acaccgaattaccgcgcggaatnnannnntgnnnnnnnnnnacgnaagnggtttttttttttttgtacccaccatggaacaacatttatcttttgtctccctgtccccctcntcgggaatactcttgacgcacatcttactccaaaaaaataccataatatttcatacacaccaccagcgcgtgtgggagngtgtatcgtcatatatatttatacactagaataagaccactctctccaantaatacaccgcatatcatttatacacacaaacacaaacaacnctgcatactctatcatatagatacatntattatcaagcacacaacaatagctctttatatttatataactactctattatatatattaaatacaccaagccatcgcgacctatatntattcgttacgtatttnttantatatacatattatcacatacacacatcncattataatgtgtattcantcactactctcttctgtacanctgagcgcgcggtgcgtcgtcttatctattatagatactactgtgtttttncaantcatatacacatacagcgcgtctacatnatctcctntatactagacacacactcttatacactactatgaaccataacatacttcatgatacttatcgcctcactcgatcacgcgcncagcacgtatgtactcacaanantcatcactctctctataatcattataattatctctatgacatatactgcaactctnctcactctctctattatcacgctatcgatatacacaatatactctccactcatacgcgacgatccgtcgcactcatcatagtagctctcttcttacattactccactactttctacatntatatcgtcctatctcgatntatatcgatactctgcgtccnatcncacacaccctctcgctacaatatatatactnctcaccgcttattaacatcatctacacactctgaatcatatataatcactattattatatattctctcacttatacacaatcactactccactccataatattataccgacataattctcttcatacacatatcatacatgcgcatattgcatcttacaactcatccgcactttatcacacagtatacacataatacttcacatactcccgctttcttctctataacaaatcatcctcctaccttctcttctatacacgcataccttctacaatatactaaccattatttacaaatctctaagtcacgcacatactcacacatacacacaccacactacgcactagatgagattacatatgcactatactgactctanctatctgttctactcataactaatatatcctaccacactcatgctctcacgcganctnctaccgcaaccctcgcccatctcactagtctcagtcaatgaaaataatatatacatatatccgtatcaattcaaatgagctgctcttcttgatagatatatactcatcactcaaactatatattcgctatcacaatacacatatatttcatatatatacatttaaactactattctatctaatccccactgatttatgatactctcttacctcattctcgtctaccctctcatacatctgacacagaatccactc

SEQ ID NO: 7945 - DNA, 156 bp, Homo sapiens
aagcaaagaactctttagatagtggagtcacactggaaaaagcacagacccttgagtgtactgcttggaggagagctaccctggagcatttgctccagattttgcatgagcaaaaaataaacttttgctgccttaagtaaaaaaaaaaaaaaaaaa

SEQ ID NO: 7946 - DNA, 1327 bp, Homo sapiens
  misc_feature (1)...(1327): n = A,T,C or G
cgttacgtgtattgatagtggtccttctctgcggcttggattggagtgcttgatcgaatatgataaccacacccctctatgacgcccancccctctctctcttacctcttctctcgctcccgtcggttactctcacgtgcattttttacatgtaattcagcgcaacgatagtggaacaacgatggtccaggagcagaggttgaggacttgaaacttggggggtaaaaatcgggggtcgggtggtgggtaaagggtcacaaacaacaacatgggcggggcattggccagatcccacatctggtagtggaactatcacttggtgcgcgggggtgagacaattggtcaaattgtcattagtcttggcgcgtgcgcgggtcgatatcgtggggatgttaagggggtgacggacccaccattatatgctgggtgtattaccacaatgttctatgagtacggatggcctgtcgctcaccattctcctctctacgtntacttcatgtgggtcttctccatgtgtgtgtgttgtacctctgacacactnctctccatngttctctacaccacctacctcgtggtggntggtgtgttgtgtctgagtctgtgtatctcttctgcctcgtcttgattctcnantncagacttcatgtgcgtngttgntctacctattatctctctatggtgcatatctcntcatgtgtactgtgagtgacactcatgtcttctgggtctgtnatctcggacactatgtgcaacncgatngccttacctcacacgtctcatgtgtcttgtgtgtngtgtgtatctactgctcactctctcnctctatcatcgtgtagtcactctcttgtatcngatctggagctggctgtgttcgcgtgtcactgcctctctcnctgtcgcatctcactccttcacgtgtgtacgcncgcttgtgtggtctgtgtggactctntatgctgantgtactgttttgcacgttctggcctcgcacgcgtntagctcgtgtgtctctctanatggtgtcttctttgtgttgtgtgttctgttgccggcctgtgcggtggcttctctctgtcgtgtccgtntgcggagctctgtctgactgtaacatgctatctctcccggacgtctgcgctgtatatactgtcgctattgtgtgtgaggtatctgctcctcatatctgaggtgtcggtggantatgngatatgaatctgacttaagctctcactcttacacatgcacggggggtgtgcgtgctacatcaactgctgactctcacccagtctgcgctcagggtctacaccacccgcttggagactgtgcggtg

SEQ ID NO: 7947 - DNA, 852 bp, Homo sapiens
tgggttttttccacacaaaaacgttttttttttttggaaacggtgtcaagggtggaatatttcatattccgggggtctggtttttttttcctagggattgggggggggtttttctggggggggaagattgtaaaaagggcgggaaaaacgggggggttttttttttgggggtttaaagggggggaaattccccctcgagggttgggtgtaggtaactttgcgcacggttttaaaggccccaaaagtttttttgggcgcctgggggaatatacaggggggggatcccgaggatttttttggccaaagagccctcccgaaaaatttttttttgtccaaattttttttccccccccttttaaggccggttttttgttttcaagttattgataaagtccccggggaaaagaaaacccagggggggggggtatcgcgccccctttggggggccggggggaaaaaaagggtttaagggggggtttttcccccggggcccatattttttttaaatatgggcggggaaaaaaggccccccccccccccaggggtggggggggtggggtttcccggccggggaaatggggtttttcccctttgggggaaagggtttgggtttttttttttttccccccccccccccagggggggtttgttaaaagggtttttttggggcctttaaaaaaccctttggggcccatagggaatggggggaaaaaatttttttttttcccctgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaaaaaaaaaaaaaa

SEQ ID NO: 7948 - DNA, 1450 bp, Homo sapiens
  misc_feature (1)...(1450): n = A,T,C or G
tacaatcatactgttgtttatgttattatacattnttggtatgtattactgacgtgcctattctgcggatcactctcaatgctctgatccccattctctcgatagcaacaaactacaatatggatctgtctacacacatctgctgcactcatgcaccgcgacgcgttgacctcattcacngcttcttatctattatatcgtctactacatgctaaacatatcgtcgtacacatcgctcccttcactctgtcgggtatttgagtggcgatactgataaatcaccctcggtgcacaattcatcgtttgtacttgtgtatcggctgacatgttggacacataacacccactacatggccgtcgtgcgactgtgggcaatgaaacactatcacgcantcgtattgtgaatcctatcncatcatatcgtgtcgtcaactgtcgcgcagagaaacaccttgtcgancctggtgggccnacacngctgattacgccggcgatcaggagcgtagggaganacaaaggaggacgctgatagactgcgggcggctcggcactactctcacatctgtcgtngtacgatacactacatctgtgctgctgtcgacacgctgctgtacaccctgtgctaaacactcgaatatcaatgacttgccgtgggcgtggtggaacataatacaaggtaccaaagtaaacgcccaacacgatatggtgtggtgggtctcgtgggttggttggatacattcgcactaatatttccgtctacgattactggtggtggagggagtatcgatancgcagttaatggcccatcatcatctgtgctattgtgcaaacggtggatgtggggccacactggtccctgtccacacgcgtaccctctgccaccacatagggtgtggaaggangataatcaccacgcctagacgcctagtctcncaaatatggtgggacactggtagtgagtgttgtggtgactcgacgaanaccgacacattgaatanataacatgggagtgtgggtcgggtgagcatacgtgtaacacaagcaagacaggatgacactgacgcangacgaagtgccctggcatacagaactcacacggtcgagtgatacaacagcgaggagaacaacgataggagactaacgtgcttcnctgactcacatcacctcgttctatatgtctttcaatactatcgccgtggatgtcagtcaactgtcatctgtgctgccaacacgtactgttatcaccaattgtattgaagtgagatgtgctaggacgacacantacatacatgtgtgtgtgcttctatatcatgcacatnatctgggcttctctactctgccgtggagatacaacggatcgatgtggcgcagacacaagaatatcatctcacattctgtcagtgcagccacatcaacacactgtacacagaatgagtaantagatgttgat

SEQ ID NO: 7949 - DNA, 558 bp, Homo sapiens
gcctatctggccgtttaaacagatgtgtataagagacaggttttaggttttctatgtctcattaatatttgctcctctgttcctcctttactttttccttttgtatttagtggaaatttttgacaatgtcattttaattcctttgattacttttctctatctatatatttttatatatgtcaaatatattgtatttctatatgttacagttccaacagtaaaattgtatacatattgctttattgcaattgttttttaaatcagttaggagaagaaacatgaatttatactatcttttacagtcattttcacttttgtagtagtttctctagggctaataatttatatcttaatagcacttttacttcagatttatagtcatttatttcaggcaagatctagaaattttactactataactatacaagtccattctatcccccgtttgttctcttattgttacacctatgcccaacatgttatataattactgttttaaaagatttcatgccaacctgggcaacatagcaagacctcatctctacaaaaaaaaaaaaa

SEQ ID NO: 7950 - DNA, 831 bp, Homo sapiens
gggtctatggcccggttatttaaagggggggcctccccgggggggtggggagaaacactttttcattaaccctttgggaaagagcggggttttccgtgcccccccccttcttggaataatgggtgaaacccccggaatttttggtggttttttccaaaagggaaaactttttgttttcttttggaacggggtgtcaaaggggggcctttttcctattccccggcctcccgttttttttttcccaaggggattcgggaagaggtttttccggcggggcaaaatttttataagggcgggtaaaacctggggtttttttttttttcgggttttttaaaggccggaatttcccccttaaggggttgggtttagggccctttggccaccgttttaaaaccccccaaaattttttttcgaggcccttggggaaaatccccgggggggaaacccgggttttttttggcccaaaaggcccccccccaaaattttttttttgccacctttttttttcccccctttttaaagccggttttttttttttaccggttttggaaaaggtcccggggggaaaaaaaacccggggggggggaaaaagcccccctttagggggggggggccctgcaaaaaaccgggcaaaaaaaaaaaacccccctttttttttttgggggggctttgcaaattttcccccaggggaaaaaaattgggggttttttccccttgggttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 7951 - DNA, 1387 bp, Homo sapiens
  misc_feature (1)...(1387): n = A,T,C or G
catatacatgaagaggaaagaggatgtaaataataaaaggaactatatcataaccaatcgctactcacacgcttctttcctaccccagaacttattttcactaacatggcgcacgtggagactcaggcatgtacncacacatctaaacatagtgaactctacaaccagtgtgaatgtactattacatcgtcctgctgactgaatctctctcaatcagtcgtaatcacctcgagacactgacacatacacgtactgacntatngcaagcagttctatgatcagcacataccctctagtccactatagagagctgcagtaatacataattgtgtgtttagagggagagctaataataggacacacagagatactacgaaggagtgatngcatgagcacagcatcggcatcgtattatcactcatgtcatgttcacntcagactgtgtctnatatcgcacgtgtgtgagcatcgctgatgtntatcagtctactgtgcgctacttgcgaantagcgacgacgntatgcgatntgcgatgtcatactcgcgacaaatngtgantgatactcgtgcacgtgtgaggttcgaattatactgcgaacagatatantcatatgatgctactctgcacacatgttggaacgtattagngtaccgctttagatcacgactgcgacacgtctgcattanggagtgatacgcacgatagaggagagtgtagcatacncatcggttcgtatgtgagagacgcatatggagaccgtgaaggcacagatattgatacacaggataaacatcgcgcgttgtatacgtggcgacatacaatgtattgcatctagttgagtgcgcagagtgcatagtgacatgatactgagccaattctggagntgaactgctggtgcagtatcgaaaggatcattatatataaataaagagcgcgcaacaaagcgcccaagtatggggcactgagaagatgagggtggtacacctagacagacatacgagaggtacagacgcgcataataacctcgcgtagaatataccgccaggtcatcatgcgcatgaggatgtcgtgacctgcgaggacacaatgcagttgtacagaccgagnagaaagcagagtacggtaagttggcgacaaggtcggatgttgacgagacgctgagaatgatagatgatgacgaacgatatacttcagtgacccaacgtgcggcgaagtgaattgaggaaggaagacaagagacatctagacaagnctggactaatacattgacggatgtgtacatatgataggcgacagaatagacangcgagtatagctgtacaggtaacactagtacgtgcaaggataagatagaatcaaagacatgaacgtagtgagtgtgagag

SEQ ID NO: 7952 - DNA, 1191 bp, Homo sapiens
  misc_feature (1)...(1191): n = A,T,C or G
gtgggaggtgggtgggagaagaggggggagcacagggggcggcggagttagggcgatggtatgaatgccttacggcggggaccnaggaggcacgcgcgttcancaggggaacgaacncggacagaagacagaaagagcaaaaagcgagaggaggaaagccttcagagagcggagggacgnaacaacccgcggacgaacgcaaagaagaagcaanagcgagcgccggacgcgcgggcggggcacacacacgtaaccacaccaccaccgccgccacgccgacgccgcaccgcccccggcgcgaggaggcggggcgacggccaggagcacgcccgcgacacgccgccgcccagagcctcacgaccgcaaggggaagggggcggtacgcaggagaggccggaaanagcgcccacgcaccccagagccgcgaggtggacttttttgttcttggtatttccagattattgagtttacgttagttgttcgattgtgggctgtgtgttgttcttggggtggtctccccctccacaccgccctttgttgacgccggccgttcggtttgtgggtcntccgttaccgcctcgcacgtggagtctcgccctcgccctcgctttgaccgtactcctcactagtttctgtttttgtattactttcattcttttgtcatattcatatgactttgttgttttttgattttcatcgttgtattattgttgttagtgtcatgattgaggtgtttgtatgtgttgtggtagatgatttagtggttagttgtagttaactattgttggtgttgttatgatagtgttttatgtgtgcnattattatgttagatggtctaacttggcttctagttgctgatactgctggtctcactgccgtctctcgatgtgtctatggctggtggctcttcgcatgcagtgtctcgnttnacgcgagtcggatncagnagtgttntcttcgncgcgtctgttatgcgtgtcctactctctatgttantgttgtgtgtcaccatccagtatgtgtatgcgtgatgtaactcaccgatcaatgtgtgatcacgcaagtgcgtcgtcgtatgttatgnntctgtgatcgtacctcgcatcgatgtgngcnctttcattgtccngcgcgtatatgttcctccgtaggccgtcacggacttggcgcttgtatgggtgtggtcttgct

SEQ ID NO: 7953 - DNA, 816 bp, Homo sapiens
  misc_feature (1)...(816): n = A,T,C or G
aaagttaaagtatttgggtgtactatgttatatatgctttaaaatatgccaaattaggtaagaagtataggtatctagaatagaattctattttcatgaagtggggtaaactaatttgatctggtcatctaattgagtatatgtgggaacccatataaaaccacttttaaaacctcaaaaatccagtgaaaaagaattaatttattaaaatgctttactacaaaatactcactcaatgcaaaagaaagaaatggaggaacagagaaacatanacngatatgaaacaccaaaagcaaaaacttaagtgacatacataaatccaagcatattaataacaacattaaatgtgagtggatagaacagagattttcagactggatttaaaaacaacaactatgattcaactatgtgttatctatacgatacacattatatagatccaaagacacaaatagattgaaagtaatagggtggaaaaatatatatcattcaaatagcaaccaaaagaaagctgagtggcagggcacagaggctcacacctgtaatcccagcactttgggaggctgacgcggggggatcacttgaggccaggagcttgagaccagcctggacaacatggcaaaacctcatatacactaaaaatacaaaaattagctgggtgtgttggcatgtgcctgtgatcccagctagttgggagcctgaggcaagagaatcacttgagccttggggagcggaggttgcagcgagccaagattgtgtcactgcactccagcctgggcagcaaagtgagactgtctcaaaaaaaaaaaaaaaaaa

SEQ ID NO: 7954 - DNA, 819 bp, Homo sapiens
gggaactttttctaccccttggggaagggggggttttccttcaccccctcttttgaaattttgtgaaaacccccggatttttttggttttctccccccgcaataaatcttttttttgtttctaaccggggttccaggggggggattttttctattccccggccccttttttttttccacgggatttgggggggctttctccggggcgcggatgttataaagggcggggaaaccgggggggttttttttcggggtcttaaaaggcgggttattcccgcgccgggtttgtttagggccctggcccacggtaaaacccccccaatttttttttgcgccccttggaaattccccggggggattccccggttttttttccccataaggcccccccccaaaatttttttttggccccctttttttttccccccctttttgggccccttttttttttttccccgtttttccaaaagttcccgggggcaaaaaaaccccgggggggggtaaaacccccccctttggggggccggggcggggggttttttttcccccccgggggcccccccggggttttcccccccccttgggggccccgcgggggttttttttttccccttaaccccaaagggggggggggtcccccccatttttttttaaaaagggggggcccccggggttaaaaaaaaaaaaaaaaaaaaaaaaaaaaaaaaaaaaaaaaaaaaaaaatttaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 7955 - DNA, 2210 bp, Homo sapiens
  misc_feature (1)...(2210): n = A,T,C or G
acatnccagatcatcgacgcagcgtcnngnngncgactactntcatctagtcgtcgagatcgtnaccacttatcgtagtcgtngacgcgnactgactgcatcganctgctcgtagnagcagctgacgacgaccagtcggacctagntgtantngganngnagtagctgctagtaggacgagctactganagatcaactgcanctatcangacactcctgccaacncgnnnaccgacntnattcgcatngatctacgngnntagacacnacgactaggagtcatnggnganaccagctattgcgatgacactacatcgtcgnggtacgagtgctgtgcggcntgcagtgcagtgnaatactcaatacntagnactagctgcgctgcntatctntgncntctgtgcgtacntatcctactaatcatngtcatactgactcacgaccaactgctgcgcggnngcgtaatgcaganatcnatnaccatntacatcaactacgatctcgtcggcncagtcacgtagctacngatnggcagcgacgctagtanacgtcgtgcaaggctgaggcgcagcananacgantanatgaggacgacgananatgaagtcacacgatgacgnnnnnacanatcantactcaagtacatanacctctcatcntagnngcnacgatcntcancacacanacntancgcagcatcanacaactaacagacntnnntactaatacgtacactgnntnactgnangtgacnatncaacatgacacacgtacngcatagtatcaaccatcctaacgccgccacctacagtctnnncagtactatctnatntactactcgtcacacnatntcnattcctantannacagncctactacnatagcagnncaacanatnatnactacgattcatgacatcatcatctacacactacgnnnntatccacgctacagcttacatcgattnatgtncacgtacactagnaacnacatccatctcaccaactactcatacngnacatacatagttcancacagancgctanganacaaacatacatctgaccgtgtgatnatcgntnagactgcatatntgatggattgtcgcgtttcggtgtgtgantaganctcnaggctcgactgtcgactgtagctatcngcagtgcatggcgtgcacangngacctcggtacacncgaacgacatagntgatcacgcactatggngtgcgaagcacgacgnctcacatcacatgancgagagatcagcgacgcgtgatgnagngngacagacgacgatactanaacagaatgacaaacnagtaccacngngctctnatatgtgtgcatagtntcatatcactctacntnngnacttctatncaatctatcaactacgtgacacgtagtctctcgcgctcctatctatactcttactagatntantatacatttnctgaactactatctnatatactccttcaatatngnntactnactactcanttataattntatcttatnnctatcatctcatcntcnnnnnatnctatatcnnncactctctccncaccacctcacantncctcntngcngntnacatctgcnncgtcccatcntcnnctnnnncacgnctatcagctcaatcanagnggatcatgtacngnagcacagttccacacgaagcagtaatcagtctatcactcaaacncgcaacactgtggtgancagaatacagctaggtcgacgaagaactaggtgcgcctcagcacggngcgncnngcggnngatgcagagggaggatgacgtgagagaaggtcngatatgatctcgcgcagaaggttgtagtgtgancgagactctggtgcgacttgncgtgtanacagtcgtgtncnccttgcgtctccgacatcctgtacagcgcgcgctctggtgcacgtctccgtcgcgccagctcgnntagcgcatggacgagagaggaccgagccgacattgcatcggctagcaggaataatagaacacgatatatangaacacaagaattagacgatgtagtgctantgtgctgagcagactgttgatctgtatgttataatgtgactacatgtctnnnnnatntcaacacatacatacactcatgacgacccgtcagcgntcnncnnnnnccccgtgttntanaccnttcttntatagcatcagggtccttgtgttt

SEQ ID NO: 7956 - DNA, 1126 bp, Homo sapiens
  misc_feature (1)...(1126): n = A,T,C or G
agcatcggaggtcgaggagatgagaaatatgatcgaggggcagtggaatgggatcttaatttagctggaatacattgatntatataatactataattcccccggtcacaacataagattggagctgcaaaagaacaatcgatgaatcggctatacggatgctgtggaccttgaccagttgaattgtatgtaatcgaacctgatggtataactatttgctacaacgagggtaccacaggagggttggatggattctttgtaactatggtttatccagatatgcagtggagggaggtgttgaggtattcttgcacacaatgtcgtgtggtaaatgacttaaacacataaaactcatgtctattaataaataattgctatttatcggtgtgatgatcatcgtttaacacatggatcacctgtctggcgtcagtattttttcgaggaatggcgtcagtgtatcgactgtgcaaggcacacacaccaaatagcgatacaaaatagggcgaccttgaaggtgcgtccgacagcattcaactgatacaggagctgtttgtgtgtgtgaagataagcaatacaaaaatagataacgaaaagatgggtggtgggtggctggatgcgtaaggaataaggatgtgagattaggggggtggggatggaagagaaggttgttaacaacttttagagtgggaaagtacaggggtctaattggagtgaaaataaacacggtacgaaggtggtgggtgggatcgtgtgtagtacggaaacgaaagaggtagaagtgggatatagtgttagggagatggacgagagaaaaacagggggcgtcgtgtggaggcactgggggatgagtagaggagggatgaaaatgaaagaacggagtaggatgggcgtaaggtgggggagagtgtgagggggaagaacacagagacgagaaggagagggggatggggaggggggaacgaggtcgcgcgtaaggaaatatgtgggagagtaggcgagacaggaacaggcgggtgtggggaaagccgggcaaatgtaagggtgaggacggtacggaagtgagtggggaggaaaaagatggtaaaatggagtcgtgaagtgacaaagagtttaagtaatatgtgtgg

SEQ ID NO: 7957 - DNA, 820 bp, Homo sapiens
  misc_feature (1)...(820): n = A,T,C or G
aagccaaagccgcggccgcgtgttttttcgccccggggttacgcggggggagtcctccccgcggggcgcaattgtgaaagaggcgcggaataagaggggggggtttttttcttcgggggtttaaaagaggcgggatattccttctcaccgggggtgggtgttatggggccttttgccacagggtgacangcgcccccaaagaggtttttcggggccccctgggggaaaaaacccggggggggcacccgcattttttttggcccaaggggcccccccccgaaatttttgtggggggactctggttttccccccctatatagaagcggggttttttttaaaggttttgggaaggggccccgggggggaaaaaaacccggggggggggaaagggccccctttagggggggggggggggccccccaaaaagccccgggggcgggggaaacccccgaaaaagggcccttttgggggggccccccaaaggggtttttttcccaatttttgaaacctgggggggagggggcccaagtttccccccttaaaaagcccccgggggggggccccccccccccttttttttttttcccccccccccccggtttttttccccgaaaaaaaaaaaaattcccccccccccccctgggggtttgtttttgaacccccgaaacccaaaaaaaaaccccccccggggtttttttccccccggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 7958 - DNA, 778 bp, Homo sapiens
cgggtctctcgaggcgttcaagacgcttgttgtgctttgagcggtgtgctccacggggttactctcgcttttttccgccgcgccctttttttttcccggggggttgcgggggtcgccttcttggggcgggcaaagttaacaaggggcgaaagacggggggttgttttttccggggttttaaggcgcgggtatccccccgcccgggtggggtgtgggggctcgggccacctccgtgaaggggcctccagggtgtgtttttgaaccccgggggagataccacgggggggatacaccggtttttttgggcccaaaggaccccccgcccgacgttttttgggccaatgtgcgttttcccccccttattgagcccctttttttttgtcccccgtttagtgtaggtgcccgggggaggaaaaaaccccgggggggggtaatgaccccccctaggggggggggggcccccttttttttctggggaatttgggggggcccccaaaaacttttgttttgggggggtttttctcaaatttggggggtttagaatttaagggggatttttttaagggggtgggtttttttttttaaaaaaaataaaacccccccccccgggggaaaaaaacccccccttaaaaaaaatttttttttttggggccaaaatatttttgggggggggttccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7959 - DNA, 1355 bp, Homo sapiens
  misc_feature (1)...(1355): n = A,T,C or G
aatatcttatactagtagtaagantgtacatacatcacacagctagagcatntgataantagattcttaattaagtgaagcgatnttctcgttcatctatattaacttatcaacnctcgcgtnacnctactgtcntctcatataatatactattcgtgcgcanaacttatgtctatgctgtgacactcnctactagcggctctcgtctttgcgnacgtttgtgcatcgttggcgatgtagagtgtgtcagtnggtcatcacatttgcgactcactatcacttagcgcgtngcattcgctgtagttatacactgcggtgttgatgtcggcgtggcngaacatgcatacttaagctgcgtcggtaactatcctatcggtgcggatggctgtgtgcgtctgactagtgctgacatcaacaccctacacatgtcgtgcgggtgggacttggggacctatacacagtcacccgagcgtttctttttatctaatacagaacaaccgtggtggccaactcgcgcgtgcatgacaacatcaggaattacactgttgagtgtcaaatataacactgagtggcaatcgtatagtgatgatattactcctgcggcggatgatgcaggctcgcggtgcgcaactacaaataattcgggggtaatgactataattggattgctcgaacggactgtactccangagtcattaacaaatttgatcattgactgggctgggtggtgtggacactaaccactgttacaataaantccccacgcaacaagtgtggttgtggtggggtgctactcatcataatacagattatcaaaatattataactggggtgggtggcgtgaatagagtgcacttgaactcaacagggcgatgtggcggaacactgggctgtcgcgcnacatgtgcatcgtggaacacaggaaccactgaaatactctgggtgtgttgcggtgtacaccaacccacctgggatattaccatttggtcggtgaatggagtgagggttggaagcagcgcaaatgaacagcataacaccacacgcgatagggagcgtgagcgcgtgcactgttgtagagtcacatgaatgcaggcgcgcacacgaaaatttgggttaaaaactgggaaaaatgtgtggtaatatgttatggcggaaatccaactcatgaataatatgtatgggtgagagtatactggtacacgtgtctgggctgcgtaaatacgcggctgcacgctgtacgaacataattngggtgtgagataattagagaatgcttttgctctactgtattaattggggtgtgcatatcaaagtcacaatccactggcaagtgatacaatcaccgcaattgggcg

SEQ ID NO: 7960 - DNA, 1152 bp, Homo sapiens
  misc_feature (1)...(1152): n = A,T,C or G
aacatcacgtgggttatactttagctccagactntcctacccatcgggactaagatcatatgtggagaatcatacaaccaatacatcactacggtggaacctccttttcgtcattctgtcgggccgcgagccacaagtggtgtgcggggcganaattaccaccgcctgggggcccataggttcgactcaccgtaggtaatactcttgcattgacgtgactggtgtgagccgggtaacgtatgggtaggtatcttactcgctanctcccattatccttnacctatacctatacctatgccatnccctcttacttcatctaccatccaatataattgttattgaaatcattaaaaactataaatataaaactattgatatatactctactaaatatggctctttctcttctaattttccttcttcttaaattcaagaaattgagagaagtaataaggtacctacctgcggttgcgtggcaccgtcccatgccgatcgtcggagtcacgcgatataaacgacatatttaaggggcttagcgcgtgtcgttttcaatacgaatttaataaattattaggaataatagttctagtaatatatattatctttgacttactatgttgtattggccgtgaagagaccagcccacacccatctaacactctttacctctcaccttatcaatncctctatatncttaactccaccatcagtacttaccactatcattacacctcgattatcacatntctatcacgagccactatcataganagttctgtgtgtacgctgtgctctaactcactttagacttagtgtgtagcgcctttactgtctntagantgtagccctctgatgagaggagatcgtggctttatatgtggtggtggtggnagatgtgggtggggacganagacatcatgcggctncatacacaacactcgtaggcctcacatacccactcccgtcggacggaaagctgtgtcccacgtctacgcctgtcaatgccaaagaaccctcccgangcgcgaggagactcgagntcaaagagactgctatgaagcatnntctcactgntnnnctcttcgcatcaacnctactcctgaccgtctctctntccttttggtggtgttggtgagatcattgtccggtgta

SEQ ID NO: 7961 - DNA, 1044 bp, Homo sapiens
  misc_feature (1)...(1044): n = A,T,C or G
caagaaagagaagaaaaagaaaaagaaaaaaagcggcgggtggttttgttgataccccccacnncctcncgggnaaaacacaaacngcngcaggncacaagagcgcaccgcanacattccgagagngcgcgcaaggccaggcaaagacacgcagcacgccaaaagaacgcgcgaaaggcgacgcgacagccggcggacggcgccgncagcgcgaagcgccggcccaaacacggcgaagccgagaggaaggcaagcacaagcagaagggagacgacagaacgaaacgcgcccgacagaatatgtttttcgaggaggaacgcnaccacacgacgcacaaaagcgcgaggcacggcagaaaacacgcagcgaggagagaagagacaaacagcgccaccggcagcccacaaaccaccaaggggggagaaacaaacagcgcgcacaacccgccacacaaacgaacacgagcgcgacagcgacgaaacgagcggccgaacgcgaagaaacaaggcgcaccacaccaagacaacgagaggaccgcccccggcgcaacanaaaccgacagccgcaggcgccagagaaagggacagagacgacgaacagaacccgagcggggcacggaggggcacgcggaaagagagagccacaagaagccaggaggaaaagagaagaggggaaacacaggacaggggcgaggacacaaaaaggggacgggagagaaaagaagaggaagcgggggagcgcggaacccggcgccgaaacacnacggagaaaccacccagcgaggaaggaagacgcaaagacgggacagccaagaagagagagagggaggggagcagggagaagcggccaacacgcacaaacggcagggcgacggcggcgggggacacgccaccagaaaacaccgcgaagaaaagaaacagccgaccgaacaagcccgagcggacaaacagacacaaagaggaaacaacgcccgcaagccgcaaggagagacaacagagccgggagagaggaaggagagagcaccgcagcgaacgcgacagcgac

SEQ ID NO: 7962 - DNA, 148 bp, Homo sapiens
gacggttaacgtcggctcgtgtggtgtgtggaggtcgatgggctttgatgcggtagtttgtcacggttgggttgcctgacttcgttggcaatttgactgtggtggactgccgcattgaagcttatcgatttccaaaaaaaaaaaaaaa

SEQ ID NO: 7963 - DNA, 830 bp, Homo sapiens
attataaaatacggtcgtagaaaacaaataaaacaggcgaggagagataaaattattgtaatacaaaatacataatgatttaaatgagtatcaaataacataataaataagagcatcaattagctcggatgaaataaaactaaagatccaccaatataaatagaaaataatatataacatacgataacaaaaaatatataaaaacaaccagggggtggatataatgaccggtgaaaaaaaaataaaaaaattaggattagggagatttaaaaaaatgaaaaaagacacaagaaaacacctcaactaaaaccattttaaattagtatagtaagatcaccgcgcgagttttataaacaaaaaaacccacactgctggactaatacagagacaacttacaaattgtatacattattcgaaactaatttacgggtcaaaaagatcaagcataacatataggtaacaatctaatccatggcccaagaaatgcaacttacttataggtttatcagtggtgtcattcggaactttaataaacacaatttgggcataccagcaagaacagtcggtatctatgtaatggacacataccagtaaccacacacaaaaaaaatcctgtgatttttaaacaaaaataatttctgcttttgaaactatccctgcctcaaaatatcctttttaagtaaattatgattaggtaccatgaacccagaagtattaaaaacaaaacaaaaaaccgccactctcccaagcatctaatctgatgtactcttattatggtttgaatggtactaataaatactttaactaattacgtaaaaaaaaaaaaaaaa

SEQ ID NO: 7964 - DNA, 107 bp, Homo sapiens
acaataaagaaaacgtccttggcacgctactgcagaagcttgaacagaaacttctctgcatacaataaagatagtagcatcagaaatccgaaaaaaaaaaaaaaaaa

SEQ ID NO: 7965 - DNA, 156 bp, Homo sapiens
aattatttataacagtcgtaaatctttataaaatctttcagaaggagatataaggttcaaattgaacataaagaacgcggtatacaagggtgcaacactaaaacaatatatcgggtccacgttgtttcgtttccataacgaaaatacggtttcagt

SEQ ID NO: 7966 - DNA, 1017 bp, Homo sapiens
  misc_feature (1)...(1017): n = A,T,C or G
ggcactgtcgtntttttagttgagttcgtctataatnnnnnnaannnaananaacanganccacctcttattacacagagacacccgctctcttcgggggtgggncttctctcctgatctgtcatggatcccgccatcatctgctcacacacagtggtgatcccgcgttgtctgtgcctacagcgaacatgggggtcaaaatgggggtgaggttctcgtattgcggctcaaccacaaaacagtgtggggaaaggacatcaataaaataacggagtgttttatttacaacgttcggaacgaggtggccaccactgtctaatgggtgctcatccccattggtgacgctgtggcgtaatgtggcagatccggcggggggacaaaatggggggtagcacccggcgcgcgtgttgggacactaacacacatgtcaaggccacggggggggaccttcactctcatggggaaccacacactgggggtgggggagtggggggccaaaggacacaacgcgacactacgggggggcgggggcaccgggggtcaaccacaaactttttggtgtacagtcaatgtgttgacgtgctctggcatgggcccctgacacaaagggggtggggggaacaaaacacaaacacaccaaaacaacgaggggaaaggctgggggtctgcgaatgaaactgaaatggacaaaaacaaagggaatggtgggccggtancccaggtattcggacacagtatcagtggcgcatcaagagaaagtggtaacccaacgggcacaacatgggacaaacagggacgggggaccacacaacccacacacaaccgacgggggactgcacaagggccaaccacgaggggcctgaccaaaccgcatcttgcgggggttggcccaacaaccgcgcggtgnacaaacgcaccaaccggcaccgcacgccggggacacactggggggggtgaacacaaacagaacaaacgcgggggcgaactgaccacacaaaccaccgggacaggtggggg

SEQ ID NO: 7967 - DNA, 1143 bp, Homo sapiens
  misc_feature (1)...(1143): n = A,T,C or G
tatctttgtatactgagtcgtattagttttngggnanaaaaanagngnaaggccnagaagcacaaatacgcccnattttctgaatcccagcacatccttgtgcttatctagcaacctccgaataccatgacgctaccagggaccgtcttcatcgcgccagatctcggaagaaacacctgcgggcggacccctacgaagagctctttccttggacaccttacaagatcaccaacacggggcgggcggagtgggctcacaacacagagaaangaacatctccccttactactacgcatcgacacgcgcggggcggcacaacggaccacacaccgnggaccaacancgganaggncgggcacgtcaggggggtcacaacagcgccgcggacgctgcgagggtgcggaaactcaacataatggccgaatataccaacaccgggacgcgtgaacagtggaacaccaacacagaaaccacagcgacacggggacaccaggctgacagcgacaacgaaccaaaacccaatgggtacaccaccacacatggggggggtggtgggggagacggaaacaacagaccangcaaagacaacacatgcggggggcggagcgggacaatgcngaaaggaacacgacatgggcgggncgggcgacaacaggggtggagagggggacngggggacgggatcacaggacacacatggcagcacaaagtggggaccgaaacaaacacacttcacatactctcacgcacctacgcgctggcgcaacacagaaagagtaccggggcnaaggaacacctgacacggcacaaacacaaataaaaagggcggcggcccgcgccgaacacgggacacaaacaacagaaacaacagtgccgaaagaagaaaacacgtggacaataaatgcgggacacaccggagacccaangggacttactgcactcacacgcgcacaccacaaatacatggaggagagacatataacatcggggacgggcggggggacaaggaggggcgcggcgcgggggaacacaaagcggggggggaaccacgaacaacggcaacgaagacaggaacaacagggcggggcgacaaaaaaggacaaagggagggggaaaggacaaacacacacggaaacgtggggg

SEQ ID NO: 7968 - DNA, 620 bp, Homo sapiens
catcaaaatttacaacctcatcgcactcttcggtcacaaccagtgtgtacgtatgaatcgaaaatgcagatttacgggccttatacttaccaaatgtcatgatcggctcgcttcggcattactctaatacctgcctaatttcacactacctccaccaatctccttccgcaacacgctctgtcgattagtgactgcgcgcgaaatttcagcacgtgataactttcaaacacactcaacacgtgtccgagatacgacggcgatcggccgacaccatcctcgtactatcaattttatgctgatatgcgcgctaaacattcatcacacctccagcctcgtcttcgcctcagacatatcgactgcagtctgatttacccgtgtcagcgagctcgcaacggttgaaatattgaagatagataaaatacggtatcacaatagacggcacaaaaatgtcttactctcacgcgggtcttcccgcccctgggtcttcacgccttttaatgtaaccggatcggtccaaccagagccgaatcgtaacaaatttggcggtctccaattgcggtcgctaggtgctcccagaatctgggggtcttctaggtgacaccaaccgcatgaggtgctca

SEQ ID NO: 7969 - DNA, 308 bp, Homo sapiens
gcctatctggccgtttaaacagatgtgtataagagacaggcagcccatatttagcttttacaaacagagctgcaatggatagatgcatgcatcagcatgtactaaatacacattgaacgtatttgggctccagccgtgctcagacacttcagacccccctgtcttgctggccatgcctgtagtccacagttactcaggaggctgaggtgggaggattgcttgaaccaaggagttcaaggctgcagtgagctataatcatgccactgcactcctctccagcctggacaacagagctagaccctgtctca

SEQ ID NO: 7970 - DNA, 336 bp, Homo sapiens
agaagaacatgtttgctttcccttccaccatgattatgtggaccctgagaccagggaggttgcgtggcatcattacatcagaaggggagtggtctgaatccactcctccccttccagggcaggaagtcaacagagaagggctctgtggtaacgttgacaatcacaaatcagtggcataaacatctccttaagacatgcagaggcagctgggcgtggtggcccacgcctgtaatcccaccatgtgggaggccaacgtgggaggatcacttgaggttaggagtttgagaccagcctgggccacatagtgagaccctgtctctacaaaaaaaaaaaaaa

SEQ ID NO: 7971 - DNA, 861 bp, Homo sapiens
agtacacatggtattatagattttcaccctatgtttatatatatatgcatattttcgtccagttatcgcctactcaaggaagaaatagtcgtcgaaagtaagagagacctgtggtggggggaggaatagatgcaggtggggaccaccgataagtccaagtaaggtgccaaataaggccatggacaaacacaaatgaaggagaaacaagaaaaacaatggaccataaaggcctcccttatgttggtacgttagtcaaacgagaacattcctcgaccattatatgagtcggtaggtttaatggcatcaagctcaaggcaagtcgtcccggtcactattcaagtccaaggacttaggttaatgtactctttatagggtgtcagtcagcacagatcctccatgataagattatcagatggaatgtcagcattttgtgtctgtcttatggagcgtttactagagaattcacggctccttatagttactgatgggtatgcatttggatgaattttctgccatgacaacagaaactctggtaggttgatgacagtaatggctatgattggccacacctgtcttggaccctggagctgcattgtcaacaatcctgggctagcttgctggagaatgagagccaggagattcagtacctccttttccacccaccattgccctagctgacagccactcaaccgccagacatgcaaggccatcctagaccagccagccgccgactgatttgccagctgactgcagaccttagcccaggctaagtccttcaagactgaaagaaccacccaggctatccacacactcatgagctaaataaatgattgctgttttaagacaaaaaaaaaaaaaaaa

SEQ ID NO: 7972 - DNA, 828 bp, Homo sapiens
ttaccaagtggtcaaatattgtatcgtccggtttattaataaatgatgttaccagtcctcaaagtaaagtaaagaccggatgaatagctaggggggaaaccagatatttattgtcaagaaggcctccaggaagaaggatcaaaacaattaaataattcgacccataacgaggcaaaggttaaatactgatgctcaagataaagtctcggtacaatgaagtccatggcttgagtgattagactctttatagggggtaggagcctggctctgtcacccaaggtgtggtggcatgatctcagctcattgcaaccttccacctcatgagttcaagcgatcctcccacttcagcctcctgagtagctgggactacaggtgcgcaccaccacacccagctaatttttgtattttagtagagacagggtttcaccacgttggccaggctggtctcgaactccttacctcaagtgatctgcctgcctcggcctcccaaagtactggcattacaggtgtgagtcactgcacccggcctcatatgttgaaattctaatccctgaggtgatagtattaggaggtggagcctttgggaggatgattaggtcatgagggaagatccctcatgaatgagattagtgctgttgtgaagaagactcaagagagatactttgctccttctaccatgtgaagacacagtgagaagggactgtttatgaaccggagagtaagccctcgccagacactgaatcttctggtaccttaatcttggacttaccagcctccagaactgtgagcaataaatttccagtgtttaagccaaaaaaaaaaaaaaaa

SEQ ID NO: 7973 - DNA, 843 bp, Homo sapiens
atgaatctcggtatatgtaatgtacgcacgttcttatctattcgcactaacctaaacactgtatttacaggcttgtatggtattacgtgcgccggcatagtgcaagaagtcttgagcggttaatatggagtttgcgtacgtcgaactaattcatactaataaccaattacggggccccctgtagaaagatgtgtgttggtattaatgattttgttgtaagcggagagatgctgggcaggtttaaacttgggactgtgagggaagaacaatagttggtggtaacaggcgggaagtggtttccataggggggggcgaggatagagcttagtgtacaataacctccgatagggtataaaatccgaccacctcatcctcctgtgtagttgttctacaggtgtgtccctccacttccagctcatttttgtattttagtagagacagtggttcaccacgttggtcagggtggttttgtaatccttacctcaagtgatttgcctgcctcggcctcccaaagtgttggcattacaggtgtgagtcaatgcacccggcctcatatgttgaaattctaatccctgaggtgatagtattaggaggtggagcctttgggaggatgattaggtcatgagggaagatccctcatgaatgagattagtgctgttgtgaagaagactcaagagagatactttgctccttctaccatgtgaagacacagtgagaagggactgtttatgaaccggagagtaagccctcaccagacactgaatcttctggtaccttaatcttggacttaccagcctccagaactgtgagcaataaatttccagtgtttaaaaaaaaaaaaaa

SEQ ID NO: 7974 - DNA, 379 bp, Homo sapiens
gcctatctggccgtttaaacagatgtgtataagagacaggcccagattcaaggggtggagacacagactccatcccttgatgggaagagtggcaaagtcaccttgtaagaatgtacacaaggaggcatgaaagagtgtgtccattctgcaacatcctaccacaagctctcagtaacagcctggccaacatagtgaaaccccatctctactaaaaatacaaaacttagcccaatgtggtagtgggcacctgtaatcttaactacctgggaggctgaggcaggagaattgctggaaccaggaggttgtagtgagctgagatggcaccactttactccagcctgggcaacagagcaagactccatctcaaaaaaaaaaaaaa

SEQ ID NO: 7975 - DNA, 1033 bp, Homo sapiens
  misc_feature (1)...(1033): n = A,T,C or G
gaggaagagannagagaggagaggggagggacggggaagaggaaggggaganagagagagaacggtctcgacaggcccccccccgccaccggtttctcaccttacaccccgtttataattctcctcacgtccacaaacacattntcttatacagccacaatcaacccccaacaaaacccattacacgcgtagccaactaccaaccttcacttcctccctgatcgcgcgcaccacgcagtcaccgctcggaacgcgcacaagtccaagagcatgcccgccgaatgtcagtcgcgcatgcaaaacgcacacgcgccacagaacgcatagaaaccgaaacacaaacacaaccgccgcaaataaacggaaccacccgcgacgtctcacgagaatcataggtactatcgacacattacatcactataaatctaagctgcccacgcggccaccgcgagacccatatcaacacctgaacgcgcgcctgcctccacggcctataatgtccacgtgttaaggttcttggacgcacacagttcgtcccccatgtattatgtttatcagacttcgctgtccctacgtaacaatatgtagtgtccgctaaattagcacgcttggttgaaggagacataagttatgagaagtatagagcgtacgataaaatggaatgatgatagacagagtaacgggaatatgtaaggacgacggataagaagcaaattaattggacgcaatagagtagncgtcgtgacttgcagcgtgcagttgatantagcaatgaatgacacagaattctacgcgcccttagcacaacacagatttaacattctcagatccaatactattacatcgcgtggaacgggcttctccactcacgctgactactctatgtgtcttaacgtcccgtgaatgtcaacatccgagagccacacgacatattcaaatatagcacataagagaacaggaaagcccaagagagttacgctctgtcgccgtcgtggactcaggactaccgtacgtgttcttccgttgagcgcag

SEQ ID NO: 7976 - DNA, 673 bp, Homo sapiens
attctatataaattaaataactaactggagcatcatagaatctataattggattatattataacttcacaagtaggatttattgagtaatataaaaaataaataaaaagatctaaaggaagaggggagatgagtgaaaatagaacaaaagatggctaattgctagtatcaatgaaaagatgtagatgttaaagcaaactaataatatatgcatgtgtcttgtttagcctatacaggtataggtatttagttcaatggtttcacggaaaaaagatttaagagcaaaaagaaaaacttaatggggaatttagagaagtttaagacaaaggggcgtcataatttgttgtattagtaaaaacgtgtaagagagatcgagaggagttcacgatggataagagataatcaggtcttacgtttgtatgagtcggggttaaatactcctcgcagttgttgttttggagcacggaaggactacgttggtaaaagagatcgtgaaatgagtcgccagtcaaggtaacatccgcaaaaaagttgttcggaggagttgtgtttgtggtcgaagtaccgaaaggtctaaccggaaaactctacgcaagaaaaatcagagagatcctcataaaggccaagaagggcggaaagatctccgtgtaattctagagtcggggcggccggcc

SEQ ID NO: 7977 - DNA, 1462 bp, Homo sapiens
  misc_feature (1)...(1462): n = A,T,C or G
cgacgccccagcgccgagcgacgcgcatagacacacgacacagagacacggagagagnagacggaggcgcccttcangnanagaacgnngaccaagngnaacggncaagcaccgncttttnagangcgggaaggnacaaaacacagnangccagncagccngcacgagcaacacgcagcgaccgacgagcgcgacccacgccagccgcagccccgcggcagcgcgcgcacggcccagagggcgcggccaccgcaacgcgagcacgagcaggaccggcccagcgcagncggcacggcgaacgggccggnccacgcgccgccgccaccacacacagccgcgagccgcgacgcgccggaggcgccaacaaggccaggagaacacaacggggacgaggagacacgcccgccgacgcgaaaacacagacgagaggacgcttctgttcgtcgacacacaaacgacgacgaaaganctaacgggccggnacggcggcgagagaagcgacgggcgcgacgagcgcgcgaggaccagngtaagcgcgcggcggagtacgcgggagagcgcgcgacgcacaccccagacgcacggagaggacccgagatgcgcgacgcgggcgacgacggcggcggcgcacgggcgcgagaccgagacgagcgcctacccccgcccaaggagacagagagccccgcgcacgcgccgcccggaggagaagaagcgccgccaagacagagaagcgcgcaacacacgcgaggccgcgcgcagacagcggagacaaaggcgacgcagaaacacgaggggcggcggcgagccggcacggcncacgcagggacatcaaacagagcgcaccgcacggagcgaacaacgaagagacgcaacaacgagccgcacgagaagacgacgcgcccgcacgcgacaccacgcgcgacggagaaccgcggagcacgacagcggcgaaggcgaggccgcgagacaaagcgcgaccaagcaggagcgcggacgagaggtacgacgcaaagaacagcgcgcaacacaacgcgcagcggcgggccgaggaggcggcggaccacgagagcgtggcgacgagaggtagcgagagcggggacacagcagagagagggaggggaacgcgggaaacacgaggcgccccggaggaaccacacacgaacagagcgcgcgcgcagcagagcgacgaaagcgcgagacggagcgncgacacgacagccgagcgccgaccggcgacagagacgccaagagcgagacgacgcgccgcggcggaggctcgcaccatcaggacacagcggccgcaggnaanataatggcagtacgaggacgacagcgcgcgcggcgcgcgcggacaggagagtcncgattgcagcgcacgcgaagngagagctggacgagagcgcagagcagncncacacgaggacaccacgnagagcagccgcggacagcgagcgagcacgcg

SEQ ID NO: 7978 - DNA, 430 bp, Homo sapiens
cgctccgcccccgccccctccccacttttcccctcccgtttttttccgccccattactttccttttgtcttttcccccccctctcactattcccctctcaaataggcagcccctccctttaccgcccccctttctccaaaactgttccacccccccccccccccttccctttttccccaaaaatatcccaattttagccgtctcttcagaacgttggccatgtcccacccattccctttttccacccccccctttctctttcccatcggaatcgggcatggaccttttttccgggcgcaggaatggtaatagagccggcgccaaaccggtccctttttttttttctggtccttaaccacccccgctatatcctcctccacggtttggttatacgtccccccagccaatcgactccaatcctcctcaatgt

SEQ ID NO: 7979 - DNA, 341 bp, Homo sapiens
gagaaggggggaggaagggaaagggggaaaagaaggaagggaagactggaggaaagatggccaaggcgggttctctactgaggacccggcaacccctggcctggtgatctgagcctagcactgcgagcctgcccctgtggcttcctgaggcacaggcaccagctgggaagagctcccttttgaaaggtctgacctcggcgcggtggagccctggcctatgctgctgtggatttgagcagcatgctctgtttgctttggggctgaccctggggggaagctgctttctggatgggctctccaaaagacgggggtgggtgctgtttaaataagtaaggctgaaa

SEQ ID NO: 7980 - DNA, 913 bp, Homo sapiens
  misc_feature (1)...(913): n = A,T,C or G
agaacagatgagaggggaaaggggtgatggggttaggaggaagcagaggaggtaggaaagaaacaaaacaaaaagggagaaatgagcatgatgatgacgtgaatgacgagcggggaaaaatgtcttgatgaacagatgggacaggtattgtcagcgaggagcggggcccaaaaaggggggacaataggtgttggcctggacggtaaaactataccacgcggttgcgtggaaacaaggggtattcataatcatcactggtgcatcgtgcgatcgggcaaggggggacacaaagcggagggggggaaacgggggggggcggtacggtggaataagaacgggaaaagaaatggcgcggaaaggtggagagggaaaagcaaaagaacagggtgggtggggacaaaccgggggaaaaaaatgtgtaacaaatgttgtgatgtggggggaaaatgcaaaacgggaaaaacggggcgggtgtgggaaaggcgtcaaaacaaaaaatgctatggtgaacaggggggagggaaaatggcgtgataaacaacgaaggcgaccaatgggaataaccaagaatggagtgggtgggtgcaccacgggaaaacacgaggggggggaaccacaaacaaacagacaaaatcgggggtggacaccaaattggtggaagatgtgtgtcatgtggttcggcatgacacgaacaccgcggggaaaggagggaaagtgtgggaatgggaaaaaaaaaaaanggttatagagtttttctatacttattataacaggggacacccactgtgcaaggtggtggcgcaaggtgaaaataacggaagagaataaaatcaaggtggaaaagggcgggacactgcaaagggtgaactatgggtgaacgggggggtgaaacaggggaagggggggggggcac

SEQ ID NO: 7981 - DNA, 761 bp, Homo sapiens
  misc_feature (1)...(761): n = A,T,C or G
agtcttgcttcgtctgattactttggatgatgggttttggggactgcaaacgcctaggtagataccagtggatgcccactgggctggatggacggtccatcggtcttgatatagcctatgactgtggaaaggtgtcagggtgagtgggaagataaactgggngacctgatggtgtggtgggaggggtaaaagctatataatacacaggggggggcatggaaaccaccacctgagggacaaccccgggtgcttgggggggaaccggaccatgtttatctattgtggtggggggaaagggggtcgggtgggcaacacagggtgaacaagggggtacggggcaggctacagaaatgctagggggggccgcacgcatggccaaccaaggggggggggggctacaagacagatcaaaaagagggggtggacactaaggcacactggggtgaaagcagggggaggactgcacgacaagacacaggggggggaccacaatgaccaccacaggggacgtggggggtgacggaagaaggcaaccacggggggggggagttacaggccgcccccagagggggcacgacacgggcaaccgggtccacgtgcaccaggcgggggaccactacatattcgtatggacttaaaagcaattggcgggggggaaaagtgtgtggggggggacaaaaggggggtgcacgcccacgcacagacactcctcaggggggtgcaatccacaccaaacagggcaggcccaacaaggacggggg

SEQ ID NO: 7982 - DNA, 1006 bp, Homo sapiens
  misc_feature (1)...(1006): n = A,T,C or G
actccgcgcgctggcgccgctccgcgggtcagaaaggagcgctaatgttnanaaccaanannctttaccgccaaacaaaaanaaaggnaccaacgctcgtngccccgtttttgcgcacaccgtgatttctgtctcggcaggcttaacagatgcggaccacgggccgtaaaggccgggcgctgcgactttaccccccgcgcccagatcggtgaggctggcattattagtgccccagccgacctgtgcctgtgtttggttccacgacacacaagcagttcttttttttctgttcattcccgccgccgtgtatcccgttgttcatcgctgcggcgtgctgtcctacactccttgtgtccgcccccccccgcgccctttgggttttacattgtgttcgcttcttgtgaggcacgggacctttcccccgcttactcgggcgttccggacgctcccgcagtgcaccaccaccccggtgtggggtgcgaccgcggaaggccgtgctgacgcggcgtggtgggcggggggaggcatttaatgtgcaaatgtagtgctggttcgggggttgctgtggctggatgtatagggacagggcaccaataaggaatggtggtggggtggcacttatgctatctgtcgacagaatagtggtgggaatgggtgggtggtgcgcgtctggatggattggtatgcttccgcggtgttccctgagcgattgcccgggtgccggcaccgggctcctgtctcgagggtgtcagcgaggcctcgccgtgcgggagcggtgttgctgcacgccttcggctggaggacttcgtggtggttgggggagggctgcgtagtatgcatgtgctgaacagctgcgcgtgttggctgtgggagttcgggtgcacaatctgacgtcgcgtgcagactggccgcgcggcttagtgtttcccaatctgttttgttattaggatataatggaggtattgtgactggtgagcttggattgcgtggtactcatgcggttgtg

SEQ ID NO: 7983 - DNA, 235 bp, Homo sapiens
actgcacccggcctgctataccattttatataagatacttgagtatccatggattttggtatctgagaggggccctggaaccagtcccccacaaataccaaaggatggctctttgcagaatggcgaatgtttgctaactgttgaagcttgatggtagggtcatgggtattcattatactgtcggcttctacttttgtttacatttgaaaatgcccataaaaaaaaaaaaaaaaaa

SEQ ID NO: 7984 - DNA, 295 bp, Homo sapiens
  misc_feature (1)...(295): n = A,T,C or G
caagcgaatgtggagggatgttctacacaactctgccaattcagaatcgacatggccgcggtgcaccctctaacccgtatctcggtgccgagttgctcctccgtattcgaagggctccttcttagacccgtccgttctttggttggtactctacgagatataccgttggggtggttctcctctacatanatactcataaaaatacaactaatcatntctgaatcttaatctctttttcaatctcnncaccatcccancctcacaccccaacncaaccggcatacaaaaaaccact

SEQ ID NO: 7985 - DNA, 1523 bp, Homo sapiens
  misc_feature (1)...(1523): n = A,T,C or G
atggctctcgatatctaatgacgatacggcgtgcgagccggtgaataccacactatgcgcgtgatgcagagcctcgtggcactcagactatgttactcaacgtaccaccctacgtgtgcttgcngatacagcgatcagagtcatcgagaacacgaagagcgtactctctaggcgaagcgnggcacgacgtgactggcagtgcgtaacaaacgatagtggatctgcttgaaggttggttagtcttaccagctacatacacacagcacgtaggagtagagtcccgcgtctgtctccactcatgcacataggcgtccacttcataccctgctaatgngcacataaaacgtaagacacgagtctcaaattagacagccgacgagacctgagcacgacctctcagccatttgntgccacctctccggcgtgatcttgtgtataagactactctaccatataccgaagataacgctattangtactactgcgcgcacatcaattcagcgacatatgctcaaggtagtatgatgatactgcgtgatggcacctctccgcgcgctctagtccacctgctaccgcgacagccaaatacgcggacgacgaagaaagtgaagcgtgtacatatagttatgatcaggcgaacacagcgctcgcgcactacatcgtacatatctatgtctatgagcaactgcgtcacgaatgcccaccagactggtcggcaaccaccagactacctgcccgcggaggactacagtaggagtgccgcggcacatacaaaatcgacatagcggtccgccgtgatacagatttagtgattgataatgtctcgacgctgaatcgtcgccacacacaagccttgcactcatcacagcgcgcgtatatatatcaaatgtacatacaaaactcgagtaagggatagaggcggagatctacatactaatatataaccagtagcctctacctactaagtattcgcataatcaagcatagtctcgaacgactgcggcgtgtacgaatgacacacactcctgctctctcgagtgctctgcaatacgacatagctcactgtgtcggcgtctactatggagtaattagagatagtcatacggcctcncgccgacgctgccatctaccattagagccatatctncgttaataactattgcgctaagactctagagcgcaccgggcgccatntcgatcgagcgtacacgctgcagtntaaacgtcgcgcgatacacgataagacaccacgtgacgacagcgtcatctgacggtgagatgctaactggatatgtcgcgacgacaatcattgaaatccctatngggatgcattatggtattatggagtagaggacgtattaaggctcctgtagttacaacacgccttctacttgatcgttacgcataactcgcgagatgcacttaaatactggccgctactctagtaataaggtgaacactagcactacacaacgcacatacacatattggtcgtcgttatcaccgcatctttctggacacta

SEQ ID NO: 7986 - DNA, 694 bp, Homo sapiens
attgacttcagtaggcggcaattcaatccaacaaataagggtctattactgaacatcaactatagagaaactatacttggtggaaggggaagaatgaatatatcaaaagtcacgtgctgggaaaaggcacaaccaacgacggagataaacgggtaaactgagaatgatccttggatgaataaatggggtaccggcggttccgttaaagaagagggaagggataatactcgctcactggggcgcaacgcacgggcgatggggtaaaggaaagggaaataaaaaacgtggggggaaaaatacgggtgggcacaaaaacaggggaaaacccaggtggggatgatgtgggggaggggggggggggggggaagataaggaaacaggggaacgaacgaaaaaaaaaacaaggaaagggggaacaaaagggggacagaaaaaaaaaggaaacaaaaggagggagggaggacggacggagaacgggggggaaaacgaaaaacaggaaacgggggcggggaaaacaaaaaaaacggaaaaagaataaaaacgggggggaaaaaaaaacacaagggaaaaaaaagaaacgggggggacaaaacggggggaaaacacgaaaggggaggaacaaaaacaagtgggggggggggaaaaggggaaagaacgggaaacaggacgaagggacggtggaaaaaaaaaaaaa

SEQ ID NO: 7987 - DNA, 1029 bp, Homo sapiens
  misc_feature (1)...(1029): n = A,T,C or G
cccccgccttccactcacttatcgcaggcgcttgagtggctggtggtgttggcatggggctcgcggacggcaactgatattggtgactatcctatgggagggtttagcaacgtgactagacgggggggggggaacaatgggggagtgggggatgcccagcagtatgtggaggaactagatgagggcggggggagggtggtaagcgtgatcggactatgtaatcaattcctcgtaatccacatatactcttgnatctctccttccttcattttgtaaactctattctccttcattatatttcactctaatctcacaaaattatgtttaataaccaacacacttacgctccatccacacatacactcttaattccttcatttaaaactacacccaccactattagaatgaatctaaataacatacaatgcaagagtaacgtgcagtggcgtcgaggctgcgcgggcgcgtgaaagagccgggttgccgcggcgtgtccacaagagccgggtgacaggggcgttaatactctaacgcaccgaagggagactgaacacgaccgaacacctgtcgttgtcgttgtcggcgtgccgctaccccctcggcttgaactaatctgnacctacatttattaatnaccactctnctatcactccacgcaaatatattgtctcttaatacaatttatttacagcgtgagctcgagacgcgcgacgctaaattatanaaccctgtgacctaccctcccgtctcccccaccngggcgggacaccgcgaggtgatcacccggcagaacgaggtggaaggggttggttggacacttgaggaggtctcacacaatcgtggggggaggagagggcgggacgcgggtgtgggcgtggtggcgtgggcgcggggcaaaaatgggggggtgtatgggtatatcgaagagaaaattaaaggtatgagacgatataggtaataacatacgacgtncacaaaccccacacagggctaaaataacaantgaggaggtgggtcgtgctacatact

SEQ ID NO: 7988 - DNA, 291 bp, Homo sapiens
  misc_feature (1)...(291): n = A,T,C or G
ctttcttttgcaaaattacgggagaaaccacccaaaataggtggggttttttaaagaaggaaatttttccttttccgcggaatgtcaccaaaatagaggaaattatgaatctcaccgggttaaacaaaaagacaccgccgcctagttgcggaatttgttaaaagcatgtacgggaagccgcttaacctggatagcctctaggcccatataggatatcaatacctcgccctcaagggggaccggtcccccattccccctataatagtggtaatacgggggctcacgncccgg

SEQ ID NO: 7989 - DNA, 315 bp, Homo sapiens
  misc_feature (1)...(315): n = A,T,C or G
cttcttttaaagcgtgatcttttatttttcgcgtgataaaaaaccccatccatttagattttttaacactcccgttccactttcttgatgaccctggcccctaggatatctacacctccctctgaggggcccggcgccaatctcccccaagggttcttaagcggccccccggccgcgggtaccggctaccatcgtccgctatctatccggccctccccgccaaagtcgccgctcaaccctcttacgcgggctcacgaggcggtgnntntgntnnntnnnnnnnnttcgtttgtaaacgacggccagtgagcgcgc

SEQ ID NO: 7990 - DNA, 263 bp, Homo sapiens
tctttgtgtgactgcggatccagaactttaatgcaaaaccgaaacaaaatgatgaccttctaccattaaaaggattaaccaaagactattttcaaagctgttattctttgtgccttgatgacaaaagaaacaggaaaaaaaagtttaacttgttgtctgttacggaacgaatgcaggtgtataaattatgcttaaaattatcaagccaagcacatgaaaaaaataaaaaaaaggcttttttggcctcgctggcctcagcggga

SEQ ID NO: 7991 - DNA, 180 bp, Homo sapiens
cggtatggggtataaacagtgcacctatatggcccctttacagtccaccgggcaggactacaaaggcagaggcatagcaacatacctattcgtcaataactctttacgcaaatagaccgagttttatccgtgcaccccccattcctggcggatgtttgtaaaaaatcggccaaaagtggg

SEQ ID NO: 7992 - DNA, 1365 bp, Homo sapiens
  misc_feature (1)...(1365): n = A,T,C or G
gaggcggcgcgtagtgcgccgtgttcgncacgcgcactgtacctnccctnttctctcgctcgctctatatcgctcacatcctcacgcgtttcgcatgactctccgccacgcacgtacactcatctcgaactctgcatatgtcagtgtcgcgactcgcgcgtgccagcgccgcgctctagtccgtccgaagagaacgcctattgaaactactattctgatataagcacgcctgtcatcatctacgtctgtcattgctatgtgtaacgccaccgtcggcgcagattccgagggcgcgcgtgacgacgagtcgagtcgccagccgctcgtttacaacatttcgtcgctggacacacagacggccgcatcgcgcgccggagatgagcggactccacgcncccgcgcgacccgcgtattctattcgatatgccccgcgtgttgacgtttctcagcgccgtcgagacctcactggtcttggtgccgtgcacgtccgtcccaggcagtacgtgataatccggacaccgatgcgatcgtgcgcatcatgacgagtatagataaggcgatgatattgacgcgccagagtaagataaggtcgnanatacacgtaacgtgagtgcactagcacggatagtacgcagcacactacgtgtcctgatcagaacagctcacgcgccgcgctgatcggacgatagcgtctccgcgctcggtttagtcgccgtatcgtgcagatatgttactctccgcccggctatgtagctaacgtgagncgagcgttatgactgtcaagtctgncgacagtgatatgtcgctgacagagtagaatcttacaatgtacgagcagagtgcgataagtaaagcgtctcttgtgctgagcgagtacgactgcgtcgctgcaatgcatcgtcctagtcaacggccaccctgcaacgcacgccccactcgccgtggccagtgactgttccgggcatgtcacatagatatcgtgtgcgttnctgcgaccacgcgtttgaacgtacggagtactagcgcgtacgagcctctagctcaacgcgctgtttgtgtcattaagacacgttaactacgcgacccactcttaggtctgatagtgcttcgcttagttccactacagtgcctatcgctatgtgtagcacgcacgactatttgttccgacacaaatgattntatatagctaatactccaccgctaacacgtcgtggnactcgctcatcnactgatcggtccgccgtaccatataaccgacgcggacgatcgtcgcgttagtggcgtagtaatcagccactgaagttctaagacttcactccgtcacgtacgccagcgctgttgtcggacgcaccagagcgccgcgcg

SEQ ID NO: 7993 - DNA, 1122 bp, Homo sapiens
  misc_feature (1)...(1122): n = A,T,C or G
aggggaggaggggaaannaaaagtggnngcggcgggcgccgaccggaacggcggcgaagagagcacacggaagaagcccagaagagggaaacaaaaaacaggcgcgcctncggngcccngcgaaccancccgccgacccacgccccaacaagcagagaaaacacaaagcctcccccacgcaacgcgccgcacaccgcccgcgcgacggaagggcagagcaaccagcgcagccnccccgggagaacacgacgcgccgagcgagagagggcgagnncggcggggggcggaggcaaagcccgcaccgccccagaaaaacgccggcgagccgccgccgccgcgcacccagccggcccccgccccccgcgccgggccggcccgacggccggcacgaggagcgagaggccgaacgagcaaanacggacagcgcccgcgagcccgccccacaancacgccccgcccccacccaaacagcacacaanaagaagacgggagcagggggggaagaacacccgacgaacgcgcacgcacgaggacgagcgccgcgggagcgcagggccaccacacgagcaacacaccagcgcacacaacgcagaacgagcgggagcagagggcgagcacacaggcacccaacacacgagagcccgccccgagccgccaacgcgacggcgagccgaaccaaacgcaaaacacgaaagcgcgcacagccgccccgaagacaggccgcgacggccgagaacgggccgagccgcccgccaacgcgccacgancagaagagcccgcgaaggcgcccgcgagaacacaagacgaccgggcgccacaagccgcacagcccacccagacgcgagcggacacagggcaaacgagcccgcacgagccaggaacaccgcacaggaccgccggcacacgccacgacggagcagcgacgaaggggacagccggagcgcggcagcgagcgggcgaggaaggacagcaagaaccgacacagggagcagacacaggcagaacacgcagcacgccgcaccaaccggaccgaagcacgcaagaaagagaagagacccggaacaacgcccaacagccgcggagcatcagcctgagaagaagagagagaaacagcggagcgga

SEQ ID NO: 7994 - DNA, 1628 bp, Homo sapiens
  misc_feature (1)...(1628): n = A,T,C or G
cccgcccccgcagccaccgccaggggcgacgggnnannnnnaanccaccncgcggagcggcgccggcgncccacacccgctgggagagagaggcgcgganggagacacaacggcgcgcgcctacgagagganagnaagaganagggnggagaagagaggagcctcagagaggaggcgggggagccggcgccnacgcnccggnagccagccgcgccccgcaccgcacccgccgcgagaggtctagcggcgggnggcgcgcggggcgcggcgggcggcgggcgggcggggnaccgccccccgccgccggcgccgcgnngcgccgcgccgccccgccgcgcgcgcgcccgcgcgcgccgccgccgcccgcgcgccgcccgggcgccgagcgccgccgcgcccgcggcccgcgngccccgccccgcgcgggggagccgcgccggcgcgcggccccccgcgccgccnacccnnccgcccgcgccgcgcgcccgcgccccgcaaccgcgcgngcgccccccgcccgcacccacacccccgcccgccggcccgcgccgcccgcgcgcggggcgccccggaccggcgcgcgccgccgccgcggccgggcggcccccggggcgccgacggccgcccgccgcgggncagagccgccgcgcgcgccgccgaccgacgacgcgggngngcgcggcncacgcgagccgcgnncnannnaccgggcgacggcggcgcgngcgnggcggcgcggagaggaggngcgaggaggagcagcaaggagccgccgccgcgccggccgcgagggcgacccggnccggcccccccgccggcgcgnacgacgacgccgcgccgcggcgcncgcgcgcgccgcggccgccgcggcgccccggcgccaaccccncgcacgcggccggcggcggcaccacggcgcggcgcggacgcgcgcgcgcgctccggcntggaggccgccgccagcgcgtcgccgcgccgccgcgcccggcgcgcgccgcgcgcccaccgcaccggcggagcggcccgcgcgcggccgcacatcagcaggcgcgcgccgggcgccgcagcgcgcgcgccgccgcgcggctcgtcgcancgcgcgacgcgcgcgactgccgccgcgcgcggtgaccgggcgaggcgagcgctcgcgccagcgccgcgcgcacacagcgagccngcgtgancgtaccgcgcgcgcgcgcgggcgcgcgccgcgcngcgcncgagcgcgcncacggagagagaggcgcgcggcgcgcgcgcgcagagcggnancgcangacgcgccgccgcgcgcgccgcgcgcgcgccgcgactgcgncgtgtcaccgngtcngcgcgccgcgatcatgcgcgcgcgcagcgncggcagcgcgcgcgcacggcgcgcacgaccgcgcgcgagccgcgccgccacggcgcggtcgccgacgcgcgacggcgcgcgtcncagcgcgcggcggccgcgtcagcgcgactcgcgcacgcgcgcagngcgcgcgggccgcggcgcaacgcgagacgcgccgcgcgcccgtcgcgccgcgccgcggcgcgcgcgcgcgcgcgcggcctggccacgcgaaccacgcggtcggcgcgagcgcgcacgccgccggcagacg

SEQ ID NO: 7995 - DNA, 943 bp, Homo sapiens
  misc_feature (1)...(943): n = A,T,C or G
tttttttggtaactccgganccaagattttagagggcagcacgacacacaaatggcgaacgcacagagcatggaagcaatctcacaggagtgagcacgaaacctctgcaacctgagacacaacattacaacaaaaatgaagacaaaaccaaaaaccagaaaaagggacgcgacaggactcagcagccgaaacacccatgccaatatacccacgagagaggaaacccagtgggcccccacacccacacgcttttttctgtggggccggcgccctgaacggaaggataacacacaaaggccggacacagacacaccacagaagaagggcgccacacaggaaagcacacgaggccaacacaccagcacaagaaccaggcacccgacaaaacgacccagtcgccgaacgaaccacccaaggcagcgcacacgccaggacggacgcacaaaaacactaggcaatgaacgccaaaaagccggccgaagcgcccacagcgccaacgacaccggcaggacgaagaacacacaaagcaccacccgaggcagacgacgagaacgcccgcggcaaacaggcacggccccacgcagacggacgacgaaccccacccgacggcccccccaccaagacacgccatacagaccgaccggcgcgagacgggagcgcgaagaaaggaccggcggcggcaacacaacggcaggtgacgcgaggacaggggaacacaaagaacacaaggcggaaaacaaacgggcagtgaaaagcaaaacgaaaacagacgaaccacacatgcgcagaagaaaacaacaaaaaagacggcacaacgcgaagaaacgggacaagacaacgcgggggaaaaaagcgcagggcaagcaagcgaaacaagagcgagcagggcagagacacccacacaaagaacgcacaacaaacacaccgcgagagagcgagaagg

SEQ ID NO: 7996 - DNA, 1294 bp, Homo sapiens
  misc_feature (1)...(1294): n = A,T,C or G
gtagtcaaagtagagcacgtgttatcgaagccgcgaatatgtccggagctgtgcctcaccatattttgcctaatagtctgcgagcagatccaacgnatcatgtaattccacacgcgtatctgttcgctcgctcgcagatacagcgtgccgcgcacaaccgttccactatgacattgagtaggagcttgtcgctagaaaatagcatagaaacagtactgtgaacgtgagagggagctaatcgttttgccgcggactgtcgtggtagccgtacagggcattgcccgaatatcagagtctccttaaccattaccgtttaatatcgcggcgccccactatttatattatctagatcagatatggcaagatagtgacacacatctgggcacgagatagtatgattgtcacagccccgcgctcgatatcatccattgtatcccagctatcaccactgcgattaaagagcgcgacggctctagtaancttactatgtcagttagcgtacagatagatttgtagtgtcagcgtcagttcaggaccgttgcaacagctggcgattcacncatctagtaccgatactgtacaagaataatgatgatgtatggtatagtctgttacgttgagcgaggatagtgatggagacgcacagaatgttcgcgcgcgtcaggcaataattctcacgcccttgaccgtttgtttctagcgagacgccgcccgaatttatcgatcactcagattaaataacatccgttacgggttttgttgatggaactataaaggagagcgcacgtatgcagcacgtctgcgtcacactgtcatagcatggcgctactgaaacgcacgagagagcgatatgcctacgactgcccataattcacgtgtgtactagcgctagcgctgtataggtatgcacaggatttgtcccgctcattataattagaaaagaacatgtcacacatgtatctacatccgccgacaatcagtgtagtagtcgaaacataccaccggntactcccctacattataacactacccaacactctccaaacaaatcgaaaattatacaatacaggcgagatgtagtgaatgccgcacatctctgaatttttcacaccgctaatattcgatgtgagagtaacgtatacatattcacttntatcatagagctagcgagagtgtagagcgcaggagggagatgaccatgcagtatgataattaatgcagataccacaatgacgctatcgaccatctgccgccttcactcccgcagatgcatcaaaagatgatgtagccgccg

SEQ ID NO: 7997 - DNA, 519 bp, Homo sapiens
cagctttgattggggccactcacatttctgcagttgtctctgagattgttatcatccatatctctgcatttttcttgctaatgagaccttcattaaaattattttgtaagtatttaattattaagcagttcatgcctttccgtatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcttgtctctggttcatatttgatgagaatgtggcacctagtctttttgagaccagtggggtagttaggcccacaccctgtggatgtcagagcaaaaatatggagggaatctgggtcctgataccatcatcaaaccattgagctaattccgttttgtaagataataaattccttactgtttaagaaa

SEQ ID NO: 7998 - DNA, 159 bp, Homo sapiens
  misc_feature (1)...(159): n = A,T,C or G
tcttangncatcggaccaggttcttaaggccaatncacgctcncgcagggcactgatatgcaggatgcaggtgaagaggaccnagaaatcttaatcagaataaaagcagntnnntccaaatctgaagaataaaattgagttaatggaaaaaaaaaaaaa

SEQ ID NO: 7999 - DNA, 779 bp, Homo sapiens
gcgaaactccatcgctacacgcgctagaatctcgtggatcagaagcaacccacaacttactttcagtcccaataagagtaaccacctctctacaaacagtgactgacgaggcagacatatcctaaaatttggaaaaaataaatccatcgaggagctcactacctatcaacgctataatcttcccatccagagcgtaggctatgactgcgccagcaattatcaatgcatatacctccatacatcaagaacgcacatggcgatacttttcctgaactaccatagcatggatcgatggaaaaaatcaaattaagtatcgtccctgttcaccacgaatagtcctttaataaattttcacaacttctggcatatcacacgccttagttaaaacagtaaacctttcataatatacagcctttaggaggaagtaaatatgttccagcagagtatttgtaatcaagccataagaagtatctggcgacacacaaatactcattttatgaaaagtatcatcgtttttaatttagcgatttggagtgaagtagagaaaatgaacaagattaggtgtaaccaattgaattaaggtaacccgagttcactcttcctttttttccccacaaacctgtgtgggaataaaagtcattgtgtgtgggtgtatatgcacagtccttcatgggtatcctcggggaattggtttcaggacttctgaggataccaaaatctgcagatgttcccatctctcaaataaaatggcagtatttgcatacaaaaaaaaaaaaaaa

SEQ ID NO: 8000 - DNA, 899 bp, Homo sapiens
  misc_feature (1)...(899): n = A,T,C or G
agaccccctttttcttaccgaacaaaaggggtgagggagttacccacaacggattaggaggttttccagaacctgagcctctcctcaagctttttccctctggtcgctacaattgtttaagcaaaacaaagtttaccnctaggtgcgagaagcagcccccgggagccaatttaagtttgggagaccaccccccgccaaacttaacacaattggaaaggctccacgaaaaagaccagccccccaaataacagggaagactctgcaaatgcttggtttcccagtgatgatcaacactttaagggccaatggaattcaccctcacagggaaaggggacccgctgaagtagcctggggtggagggggcatgctcgagaaaccctacctaacttctatttccctctaactcatagagccatgggccctactaatcttgccctctgcatctcattacttaacctccccctcccatgcttttcccaaactccccttcatctcaacctactggggctctccacaccccagaaaccatcctatattatcccacccaactccctcctaaaacttgattcaaactgagtagagtcttcatgactacaggcagaatctaatgggtaatgggggaagggagagaaaggaggaggaacctgggtctctttcaccctccccaacgccgaagtctgtctgtcctatagggggccagctagggcaaggtgccaaagcctcatctatttgggatcacttcaggcccaggctttggagctgcagaatctctaataactttagccactacttttatgagcatctgaccttatatttcccattcaatgaataaatctttgaacccaaaagaaaaaaaaaaaatggcctcgttggactcagcggtggagctttgcggccag

SEQ ID NO: 8001 - DNA, 1495 bp, Homo sapiens
  misc_feature (1)...(1495): n = A,T,C or G
agtggacagagcgtacagtaaggcactttcgaggtaaccaaccgaagggggnggggagagggcgttantgtggagttaccntacgctgccagnactctcttactaggaggncatgaacacagcgctatatgtgcacactatcactattagcgcactaaggacatcgcactcgacgcatatctatgtatgcgnacgcgaagcgactgtatctaatctgtctgcgtctctcacgtccgcggctgcggcaanagagtaactgtctntccaccnacanctcacngtcactactcctcntctgcagtgngtgactgacgagtacatctgcatagaatatgcgcatcancacgctgcgcgccacgctgccgctccgcacgtcagcgattgacgcatgagccacccgcgcagcgggcgtcgccgtatncgcccactctgcgacacacagacgcgtatnagcagcgctctcanacagtgcgcacgcgcagactatattgctctgttcttccttcccgtctcacgcgcggatncttcgttagtctcgagagttgtcatcgtacacgtacgacatactgcactcacgtcgacgtcctccaccgcggagcgagcatgctattctggtcctaccgtgatcgcnatgctccgacctacgacacgttatgtgagtttatgagacggcagttcgtcgtgtctcactaatcccctctaggcgatctaatggtcttnctctagcccntatgaccgctctagtcttacctgtgtatactcngttcgcgnctctccacctccggcgcgccctaaagaagtgtagtggtggccgtgtgcctcaccccaatacataacacctccactcagctgtactactgccgctantctcactcgctcccgctgcctcaccacgcatactatccgcgctctcggtcacgcggcgggtacctcggcgggccgtccttgtggtactcttttcactagtgctgccgcccgcgcgaggatacatatagagcgaaagacggacncctcagatatcgcatacgcgcgcccatacagagcagtacacattgtaaagaatattgcantagcacggcagcgcgcacacgagcaccagcctagagatacacgcatccttactacacaatagtancactagacgtctacacacttcttcggtgcgcgccgtaggtgcttctctgcgcgtagttctatagcttacggctacaccccacatgaccagagctacaccagtatccggcacgcctagaatcatcntctgcanactatactctctgccatcttctcctgcnatatantcgaaacgacacgcgactgcgaanctacgacgtgtacgcacccgcgtagctgttgatacgaggagcgatcgcggtcatagactctagaganatctgattcactggccgacagcgccgccgcgacctatatgagatccnataccatgaggaacattatcnagccgatttatacgcgtcctatatgacccactnca

SEQ ID NO: 8002 - DNA, 1249 bp, Homo sapiens
  misc_feature (1)...(1249): n = A,T,C or G
cgaataaaaaggggcggacagngacagagncggcacagaggcggcgcgcgccgcggaggtgcaagcgagaaataggaagaatcttacgcgcgaagcaccggtgggtcgcccagcgtggcacacgcctagcacgcggtgtcgccgtgagtgtcgagcaggcagaggtgctgttgtagcaggcagacgatcggcgtgcgctgccaccctttcctgctggaaaggctgatatatcccagaacggcagcacacccgcgcagaactgcgccagcagcgaagacaggtcactcgcggaggagccgcgtacttgtaacaacaacactagcacaagcacactggtcgtacaagagaaaactgcgatagggaggggagatgataacgtagtaaagagaggacggaacgcaatacaaccacgttcggtcacgtcgccggccacagctaggctcggtatagagaataattcacagatgaaacgaggatgccattcatacaacatctcattcctactaacagcccacgccccgccacgatcaaacctattttatctacgatatctatcacccgactcctctaaatgagcattctagagaataggatgtgtgctcgtcagtgagagagtatccatgtgacgacacacgtaagtaaaggagagaacgcggaccagcctgtcatactccactcagactcaccgaccgcgcaccctcgcacacggcaggagtaacagatnactctgcactgtcaatggcgataactacctcaccgtatacaaatatgtatataatgatcactaacacacaacacgatattacaatattgagcacatatccatacattccacgactaaatgtgctgatcaaagtattgactgacacacgccggagagagcaaacaagctgggcgtggtgatccgtgtatcactgcgtgtcaatgactggtaagcatcaacgcttccctacagatggaagcatcatagaaccgacacgacgaaagcgaatgtctgtgacgaaccagccgtgcgcgctgaacgacacacgcagcggcgttcgacggcgccggatgtgtagactagagaggatgccatatacaacgacgcgcacacgctccaagcactcgcggcgtacgcgaaactctgatcaataaccacatngtaagacaacagactacaaagtagaaggtagagatggaaggacgcgaggaacgtagggtacacgtaagagagtcgaagcaacacgcgacgagtaggagaaaggag

SEQ ID NO: 8003 - DNA, 803 bp, Homo sapiens
  misc_feature (1)...(803): n = A,T,C or G
attccattccccccattttctttttcgtcgttcctccccccccgtcattctcgtcttgttttgttttttttttcgtcccggttgtttttcctttgttttccccttaggttttcaccccccccccatttgttttgtcgttcggcctccgcccaccccattgtcgtttcctttgttttcctttcccccttttttccccattgttccccgtcatcctcccatgtttttttttcctttccccccttttttggtttttccccgttgtacggattgtgtcgtcnatgtgttgcccttttccgtgttttgttcttcccctgtccttgttgcaaccccacctttgttttcgttgtatatgtttttccacagtgcatccatggatttcgctctcaaaagtttggttttttagtgacattaatccctctaattcatacaaatgagcgtcatatgatgcgcccccatcattgcacagatgtatcttaggatcactgtttccccttaagtctgtgtttcctacctccactcgcgttttttattcttgactcccttttggcctcagtttcttccgcttggtattgcacactcacagatgtttacagctttgttccagccaccctaaatattgtcatctagcgctgtgtcattcaaagtgtaggccatggaccagtattggcccagtatcttctgttaccaagctgtgacaagcgaagaagtaaggcacactgagtataactgcgtagagactttgagcattttatatctgtcaaatctaataaagtgtagctcattacacaaaaaaaaaaaaaaaa

SEQ ID NO: 8004 - DNA, 1278 bp, Homo sapiens
  misc_feature (1)...(1278): n = A,T,C or G
aaggattatagatncacaaagaagcancgttaatatcagaaaanacagacacaaacgacggagttcgttttaaggaangaatngnngcnnccaggacgccctcgaagagngngcgctacaccgnganagagggtaaggngaggnggggatggaanagaagagngccaagagtacgctacgagcaggagccgagatcgaagagagacggcggaccagcccancgcacgcggcgaccgagacgcgaagagcgcgcgagcggatggcgagccgcgacgaaagacccgcacgcggcgggatagcagcaaaccacgcacgcggccgangccgcgggcgagaaggagcgcccagcgaaaagagaggacgacggccggaagagaggagaaggacggagtagcggcggcaggcccaggggaacgaagaatgtcttttacgcccacagacgggtgagaagaagagcgacagntgacaagagantaaggaagaccacaggcggagggcgcacatgagacgncatgaaagaggaaaagacaacgcagcggcncagagccaggcaaagaaaaaaaagcgggacaagggcagcaacacacacttcccaccacgagcgaaagcgagacgacgacacgagagcagccatccgcgcgacacagaagagacacggcggcgcgcacgcaccccaagcgccttaagagagagctgacgcagagaagcgcgccncccgaagaagcagaagacacacacacgagagtgacggcagatggaaggtagaaggagacacacgagacatcagggagatataagagacgagaagacaggagcgcgaacagaggacgggcagacacgacgctgaaaagaaccgaagagcgcgcacaaaagggaanagagaggcgagtgggaagagccaggaggtgaggacggcggcgtagagagcggaaaaggagcacgaaagaacatacacagagacgcgacgagtcanggcaaggaagacgcagacgaggagggccnaaaggcacaggacgatagagcggccgggaagggccacacaacggagattgaggagcaaagcgaccccaccaagctcacaaaggaaacagccacgaaacgagaggcgcagagaagcacaggagccacccaacacgccgcgacccccccgaaaaaggaacccccccgcaagagcagtgagagaaagggagaaagtgaagaacccgcggcaaggcagccacaagcagagaacgaaatagagagtgaacgaaagagcagggaagggcgagaccgcagacg

SEQ ID NO: 8005 - DNA, 1082 bp, Homo sapiens
  misc_feature (1)...(1082): n = A,T,C or G
acaacccttgcctcacaancggacgacaacaacaaaaaggaaaggggtttttctctgtgtnagtaaagttcgtctttcttttacgacaaangcaaaaacaaacaaaaaacggcaaccacacggggcaacgagcaacttttgggcgggggcccccacggcagaccgagcccgccgccaaacgcaacacgacgcgcaaaagggggggtcacagggccgacggatgcgtacaaatcaacaagtccgcgtcaaatatgtggttggtgcgttgggtgtgtgtgggtgtatataaccaactatatctctgtatgcattggcgcaaccccattcacatgatacttttttttttcaaaacgtggcgaaaaccactgacctccacatttttatcattcgtctcttaatgaagtcgggcgagtgggtggccgaaaatcggcgggtggttcgtgcgcgctggaatcctccacaactggtgatatacccatatcggagggtggaatggagggaccactgtgcaaacgcagaaatcgtcacatggtagtgggtggtgggtacataacaggggtgataatcagaaccggtcaacaatattatagttacgggagccacttaacatacatagacaactttatatttttgttggcttatccacttatggacctgaagggggtggtgaaatgaaggggtggtaaggaacagtgatcaggcacaccggtcgaataagtgtgggattaaaacataagggtggtggactacatacttagtggactagtgtgtggggttgtatgtgatacgcatcgtgataatcgtgtggtggggtatcatgttttactgtttcttataaactgtcgcagtgactgacacgaacaagggggtaaacggggtattggggtctatttaaatatacactactcaaatatatctatgtcacaaatcttttctggctgtgtttcaagcttgttttgcgttgcgcaaaaaaggtggttgatatattaacattgacgttgtgtgacgtaataatcggctggtccgatataatatctcctctcctcgagtgcacgatctgatatatcactactcagatgtcg

SEQ ID NO: 8006 - DNA, 1441 bp, Homo sapiens
  misc_feature (1)...(1441): n = A,T,C or G
ccacaatccgcacgcactgccaatttatgttggtctcgttcgccgatttttcgcctggtccgcccttctcttttgcgtgtcttgtggacatcccgctgctctgtncacagtantcacaccccaatcanccggccgccggacggggtgcgaggttgtggtttgtacaaacacgcgaaagcgccgcaccccttaatctgctatcactaacaataccacaattgacagacagcgtggaagacgcagattttgccacatcgcacgggaccatactggcatgcactatccatctcncacgccgacatgantatatcgttgggtcccgtccgcgcacatcgcagtcatgagggaccacgttaagtaatatgtgttcgcattccaccgtgccactctcgtatcactttcgaggtcgatcgtagacgcagataaccggcgtgtcatctcatatgattatgcgatgctttcagccgcgtgtcgtcgtaggagtacactgatgcacgaaactcacgtgtacgtatcggagcgtngcgcgcggatgtggcgtggacgaccaacgtgctgcggtcgccgtgtcgacgctcacgctcagagcagtgtcgcgggtgcgacgctacntgaggctcgacgttgtcttcatcgcgctcgtctccgcagactcatccggtctcgctcacactcgctactcccgatctctactatcaataggtaaactatcgcttgcgctagcnttagtgngtctntagcatactgagtgcttaggcagccgcgagaaaatggagtcgtgtgaggcgtgtacgagcaatatcctgcgagctcgtatagatctccatgatgatacgtggcgagcgtacgcgatgagacgagcacctgttcgcttcatctccgctccggccacttcttattactatcttctgcgttcttgaatactggaatgtacngcagatacgtaatgtccgtaacgacgtctgtccccatatacactttcgtgtatgtgtgtcaacatacgcgagtctggattagcgccgttcacatcatttgtacccggcggggagncagtagacagggtgattattgtatacttgattcgcgtcatttgagctgaatcatctctctcctgcctatgtggccgtgtaagtgacacacacactagcctcgcgcactgtcagtccgcgctgtgtcgagtgatgactgtgtatactgngatatctccgccgtcggcgcaacacgtgcgccgcgttgggcgcgtcgcctgctgcagtgcnctctgcncaagtggatctttatncgctcacaacgtatcatttttcttcccgctccacctgcgcgccggcgttcgcgccactactagtgtcgcgcagtcgagtggcgagacgacngcgtcgacagcatgaatagacacggtgactgggagtgtggtcgcatganagtatgatatgtgacgtag

SEQ ID NO: 8007 - DNA, 1467 bp, Homo sapiens
  misc_feature (1)...(1467): n = A,T,C or G
gagaacagaggagggaaggaccagngtagagagaggagantcaacnaggcagacaagtttccgttttaaagttnaactnnggncccgccngngngcctgngnanaagnnnngngtatcnngngggcnngngngnggnnnnngangngnnggggggnaggggngngggngngttttttngnngngnnngggcggggggagagtcgtcgtttttgttctncggnggcggctgggttgggtgtgtggaggggcgtggtgttgggcgcgcgccggtgtggcgtcgcggcggcaccgcgggccgggcggccgccgcggnacggcacctncggncacgtcggtggtgcgagctcagcgagacgagtgaagagacgcacgagcatgggcgagagacgaagagcgncaggcacgcgncgcgggcgagagaaaaatttgtccattattggcggcgcgcgtnnnnagaaagaggcgccggcgaancagaggcggganggacgcgcgncgcgcgcggcgccggccgcggcgcggagccgacgagnacgagggacncngccggggcgnncgcgcgcggcggcngcgagggagacgacgcggcggcnacacggcgcgagcagggcagacgcggngccngcacgaccacgcgcgcgccgagcncagcgaagggacccagacgcgagacaaggcgagcacgcgcgcgagngcacggangagaggagcgcggagaggaaggncgagcggcgcgacgagccgcgcncggacagcgcagncgaggcgcgcgcgagcgagacgcgcccgcagagaggaggagcagcgcgccgcgccgangcaagccggcggcgaggganagggcggcgcgcacgcnccaccgggcggcggganaggngcgacggcnaaagcaccganagagacagcaggagagcagaagacgnacaggagacgcgccaagcggcagccgaggagcgggcagagggcggnaagacggagaacgcagaaggacgagcccagacgagagcccaacgcgcgcgcacgacgcgaagagaccggacgagccggaggcgagncagncacgcgaggcgcaggcgggcgcgcgcagggagagagggnangcgcacgaggaggaagagcgnnccgccgcggcgaggcgccgnagccgcgcgacgcggcagaggancgccgacggcgagaaacgacgccgggagcgcaccccgcgcgccacgggcgaacgcgagaagccggccgcgnggcgacgcgaccacaccgcgncggcgcggagcgcgccggaccgcgacgccggacgcggcgcggcgagacgggcggcgagccggcggaccagcacggcccacagcacggcgcggccgcncncgggagagaggnacggcacgcgcgagcgacgcgcgcgggcgccgcgacgacgagagnacgcgcgcgagcggngggcgggcagcncggaggacggccgagcagccgagcga

SEQ ID NO: 8008 - DNA, 743 bp, Homo sapiens
ctcttctttggctcaagggcgacttcttgtcgggccctctctaggggtggcgagcagtggggtttatgaggcggggaggaaaaagtgggagtcacatttgttattgggcattttttataatcggtgtataaacgtcgcccggaaggtgggggttaaaggggcgcgtgggcggagatcggcccgaggagcctcctacgcgaggtggttttgtgaggtcccctgggaaggtgtttatgcgcggggcgagttggggggggctctaggggggcgaccccgccgcgcctttctgtgggcgcgttaggggggcttctttcaagagttggtctccagcggcgaagaaaccgagtttcccctcgtttgcggggctcggccgctttgtcggggggggcggtggggggtgcgtgttggggagccagcctctgtccctgggggggggggtggggggcgctttcgggtgccccccctcccgatccccgaggaggccctttaaaagcaaaaagacactggatacagttgttattaaaaagggggcccaatttgtctggcgatggttcaaaagcgagcccaaattttctgtttcccccgcccctttttagccgttttgggggccccaccgccggtttgccattttgccattgtttttttccccccttggggatgggttgggggtgtttttttgttaagtttgggcgcccaatttgtgtactttttttttcctatttgttttccttttttttttatat

SEQ ID NO: 8009 - DNA, 2064 bp, Homo sapiens
  misc_feature (1)...(2064): n = A,T,C or G
cgcgtgagtatgtcgtatagacgcgtgtgcggtgtcagttcagtcagattacgtctctcttcgcatcgctatctacggtacacaangncgcgatccctagagacagacagacgctagagtngaacgcnggttactcgacgcagctgtancgagtntacatctctncntactcctgangagagatcgtacagcagcgcaatcggangnatgtaagctcactantagaacgacgcgtcacttgcgnagccgtngngaacaattacagtngagcgtcacgcgctgcagaactngcgagagagatgtcgcgnaagcgagagtgtacgcgcacacgacactgctgcgcacacacgcgcgagcgacgcgctactccaacgcgngtacgacgtcagggcagagtactgcangcagggtcggcgctcactacacgattactagtacacctcaacgtcacagcacancatatcngtcgagcacatatactgtacgcgtgntgacgtgtgtgacacntnacaactcgntctgagtcgtcatatgtcgtgcgtcgactagncagatagtaatcatangantaggacagcancnatcactacatcatcgatctccganagcacgantgnatcggcatgcacgctacagcacagcaccgatagnncacgtagcttcactcangtagagacagacgagatcagaccatatatacgatagtacgttatctgcngtatcgtaccgtgtcntgtcgtntagctctgtaatacagtctatctngatcgtgattgctcgctacatgcactcgttnacaccagtacgctctagtgagtagtgcagtgacgtcgtgctcgagcncgacgctctcgagtatcacttagtatactantatagactagcttacatgacgctgtcgtctgagttgactatatatgacgtggctgtgagtgtacaattgatgagtgagtcatagatcttaaagctcgcctatcacggatacngncactctacgcgtntctacancacttgtatantatacatgtactgtgctatcgtacattattcgaccgttctgtggatacatcatagactgcgtctcggcgtagacgtcgtgtatgacttcgncgatcgtgggcgatcggcggacgtaatgagatgantganacatagagactagcagagacttacatagtagagactaccaaggcagtagtgtgatggtacagagatcgtgtcgagctggtaacgcgtgctcgtagcagtctgacatgtcgcntgcgncagtagacnagcacgactcggtcaacgcgtacgacgtgctgttgacatgtcgngtnggcagagacgcangctagatgcgncacgcgagacatgacagtngcanagcacgantcgagatcggaatngtctactctatctcacatcagcgacttactacatntagatcgctcatactcatcagcgcgcgacgacgcgcanatatgcgaggtgtattangtgacgatcagctctacgttactngtcgtcgnacacatacacgatacgcgatgtgtctgncgangctgctcgctctctgnctgtgactngttcacgtcgcagtaggcgaggactcacagacgcgctgtcacggatcgatntgtcagagtacatgnttgtcggcgcntccgctgtgcagtatatcacatatagggntgatntagcgatgaggngtctgtcgtgtgatgatgattacggttgctgacatgtagacctngcatagctnatcgatgagtggctggtgcatcactcgtnagcgtcagtgnatgtctatatagtntgtgtcagtcgtcatgactcagatgatacgcgacactagtctgtgcacaggctagataacagtgctacacataanttctacagcgatgacngtagctgngaatagtcagcgcggctagtgcgccagacactcgacagacgatatcgatagtctacagcgctcaatctcagaaacgttnacagacanctcactatctacgtacagcatagcgcacatcnaataactnctcacgancagctgcatcgatatagacgcactataca

SEQ ID NO: 8010 - DNA, 1221 bp, Homo sapiens
  misc_feature (1)...(1221): n = A,T,C or G
cgtgactctgtcgaggagggtctcgcggatacgatatgggagtctactgtatgcnaggcgttgcttaagtgccagtgtcgatgtcgcctgagtancctctacctctctntctcncaanagnctactacctagtgtatagttagcgcttacgtaagttgcacatanacagacaacattgaaggaaccggtcttngcaagagaaggagtgcgatacataacaatgaacgacgatcacatgtgtcgtaagagaagcgcatgcgtttgaaactagtaccacttgctacagagcttcacctgaggcgaaatacncgtctgactacaacaatctgggatcgagctagcatcatcttgacgcactagttcatcactggaccgtcttctgcaacacctatagctatggttgtcacgactatgatcatggtgaatcacgctaatacgagcaaaaccgccctacacgatcgacacgttcgatactcgatactctcaagtcagccactgtccatatattaagatctccaactctatagaagaggacgaactagtgtctgagtcccccctgtcacccgacagcctcttgatcgatctaccttcagaccggcgtcatactcatctttcgacgcccagtacgagcacgacgctcgccacgagatattctatattatgcttactcttctctgcacacactgttacacccgcgccccgcgcccactacgcctcccgcgtccccttcagtcttattagtgtnttcatcgagttccctgtgctcggtatcgcgtcactacgtcacaccctcccggtcgcggccccgccgccaccaatcagagtcatgtggcccgagtgttgcgttggcgcacactatggagccaacggtgtatactcacagaattgaggccgaggagaggaccataatatagagggctagcaaatccgctagcgagcctggcaaccagcatatcgccctccacctgtacctttgcgtgcctcgcgtcggccatgagaacccgtgtgggccgcacgcagcgatggtcctgggtgttgcgcgagtggtccgcgccagctggttgtgcggtgtgcctccgccgtgcgtcaacccggactcagacaaccgcgcccccactgtccactcctcgccctgacaccaaccgccctctgtcacaacttaggtcctcacatatagtctctacaatatcgcacactagcatggtgggagttatgttgctg

SEQ ID NO: 8011 - DNA, 681 bp, Homo sapiens
tattctcctgatgatggtgtagtatcgtagactttctgcaggtcgccagcagcacccgtaggtgttttcgtacgcccgtggtgaaaacagcaggggtggccatgggttattttttcgcgtaagggcgttttctcgatgatttttgtatagacatctgtgttgagcctgaagcgctccggctttttatttcttcgtgtcaattgtttagatctggtagatacactgcgcgtggtgggcagaaataggctccctaatgcgtgtctcgagaagggttctcgtaggaccccctttcgtcgcacccccccagggggtgtgtatcttcttgatcaagacgccccttttttttggaaagggttctataaaaatacacccttttttttaaacccctctttttgagaatcccttttttaaagccctcctgcgaattttttgggcgtaaatgggggggggcccccctggggggagtgatcgtcgcgctttttaaaaaggttggggggtgaaatgatgtttttttttttccccgaaatgttttgccaaatattttttctgataattatcataaaggtaaatataattttttcttaaaaaggggggatttttttatggggtttaaggaggttttgttgatcccccccaaggtggttgccgtctttgttgcccccgaattacccccctaagggg

SEQ ID NO: 8012 - DNA, 1096 bp, Homo sapiens
  misc_feature (1)...(1096): n = A,T,C or G
ggcctctcaccgcagtttatatacacaccaccacaaagaggcctttcaggagggacaggcattngacagnagccttaccccggtttcaaaccgcacacaggcaagtcggcgtgacagtcaatagaagaaacattttagaacaatcttcgaatcgaacgcatggatctaaaacagacagatcagacacttctctcaaacaagcgcatgcttctacaatactaccgatctttcacacagcctctcctacgcaagatatcctccgacgacaccaactcggatcgactactacattccacgcatgatgatccacggagcgctgttgtaaaatgtcgcctcgctttcactatgcgccgcaagaccccatacccccggtgagtaacatagtcgtggctaccatgatctgcgtgaacggttatcctccccccacccgatcaagggagcctctcgatcgccgccccggcacgtggtgcgaggggccgatctcgatctgaccttaccacccttccctcgtcctcgacctcctccctccgcgcatgtcccctcttggtccccggtcccgccggcgccacgcgtgctctgttcggcctcgtccctcgcttacccccaggttgactccttccacctccctccgccccgtctctcccatgtgagttccccgagcgagcgacgctcgtgtccccgtactcgtctctctcacgcgtctcgtcgtgagtcccgccaagcgacgcgctgcgttttctttagatgacgacggtcaaccagtcgaccgctcactgttctccgcgacttcgttctcaccctctcaccgcccccgttctcctctcccacacggccacccgccgccgcgaccgtccccctcccgccctctcccgctcctattcctactgcgcatctcctctctctgcagccccgtctgcccgcgctgacccgccccaacacgcctctgctacgccaccctcctcctagaccgcgctagttctcttgccgtgccccgacacttactcccgaatcgcgttggtcccccgctaccccctccgtctgctccccccgtctgtgctgctgtgtcgctctcctccccgtgttccatattctaatt

SEQ ID NO: 8013 - DNA, 476 bp, Homo sapiens
  misc_feature (1)...(476): n = A,T,C or G
ccacatacagaaatgttttttacttattttgtaaaattgttacgacaatgttttacttgacaaatatcaacagaacaatggtggttaatttttcctgaaaatcaactttcattcccacttgggggaaaaaaatctgttccttccttaaacatcctcatttcagtcaatagcatgacccagttgtttgaaccataaggctaagagtcctgaattgttctcttttccccaaaccatttatctacagtagccacaaatagctataaaatataagtttaaaaaaaccctaacactcaccaatacctctaattcatcagtaaatctcattgattatgcctcaaaatatattccaaacctattcatttctccctaagcctgcatgccactttacaccaagccactnatttttttcccacacatgtantttttttaaattatacgagtgacatgtgctcattgtaaaaaaaaaaaaaaaaaaa

SEQ ID NO: 8014 - DNA, 1209 bp, Homo sapiens
  misc_feature (1)...(1209): n = A,T,C or G
gtggtattttgagntgttgttgntgaagtaatggggtattgtagcgtttagagagggagagantgagggntttttagatgggtgggagtggagagcggggagagagggaggatttctttatatatgatgtaatgcgtaaacataagatcacgatacaggacagagatgggtgcccgggtgtggggcgggtatggtcacgttggacgacagatgattacgatacgaagagacggtgccgtggatatattcaccctatttacgacccgtgctgtagtggtagtttgcgggaatgggagtatggtgagggtgctgccgctctttctttcccgagccgttacgaaggccctcaccaaatcatcatacaacacaacatacacacaatgaactgacacccgggtcttcgtggtcttttatcgagcagcgctcagaggacgcccggtgcacccggcgcgaccccggttacctctccgccctccccccgcgcccccccctccacccccagtgtagcccggcgaggctccggtagtaggggggggcaaactacgagaacccatcacccctacccgcaacaccagtccctccatctccccacgaccccgccgccaagcggaaccgcccccgtagatccgatgcctccgctcccgccgcgctgtccccccccgcactccatcccaacatcccgccccgcgacaattccataccccccaaccgtaattcattcaacgcgcatagcccgccccccccgaatcacccccaaccccatccccccccttacctactccccccccccccccccgcaccaagttcccccgtcccaccaatacaccaccaccgctattccgatagaaacctccccctgctgccgattggaaagtactcgcgttcacgccagtactaccgcccgtaccccgtccgatccgcatatcgctaccgtagttggcgtttccgcccagtttacccttccatcgcgcgactatccccntgcgacccagacatataaccataccgcacccgtatatcccacagacccaaattaaccgacgtagactcacccccgattatatttcctcacagccacccactngccccaccgtcacccgacaactattcactatgtctgtatacagcacgcaccaatactcatcccatatacgcaatcacactctaccccgctatctagacactcgagaatatcttccaccgatatgt

SEQ ID NO: 8015 - DNA, 826 bp, Homo sapiens
agtagctgtcaccccgtagttatttcgcatttttgttcccccgcctataggtgatcgtcgtgaaacgctagaacggtaactagccaggtaactgtacgccttctgtgtgtcccggattttacacaccccgccgccactaatgttggcctggcaaaagccaaacaccccattttcaaagtccttcaatagtccttgtcccccactttggcccacagtgatctcccaactcagtgcatttttagccgtaacaggctcctccattactgttttaatccccatttccagtttcaatcagtataagagtaacgtctatgagttaatagcctatgcacccgttcccggtaacacacaaaaaccatgtattccactccagatggtttcgacccagtccatccatggccctgggtttcagaaggccttgatttttagtccaacaaatccctcagaactatgaaatacagccataaattatgcattttcccatgtgcagagatgtattttaggatcattgcctcttacaaagtatttgttccctatttaaacttgttaatttattcttgactccctcctggcttcagtttcctgtgctcggtatcgcagactcacagatgtccacagttctgctccagcaaccctaaaaactgtcatctagtgcactgctattcaaagtgtaggccatggaccagtattggtccagaatcctctgttaccaagctgtgacaagcgaagaagtaaggaaactgagaataactgtgtagagactttgagcattttatatttgtcaaatctaataaagtgagcttataatacaaaaaaaaaaaaaaaa

SEQ ID NO: 8016 - DNA, 1326 bp, Homo sapiens
  misc_feature (1)...(1326): n = A,T,C or G
tatgtattaatttatatnatgtattcccatatctctgtataatcgtggccggctggaacactgntcnacgtatagctacggactatagacatgctctattntcgtccatctacttgtcactcgaagcctggcatcgtcttagtacnatcgcactccgtacagtaacagagcagtgccttatcagagtaagttgctctcctcgttgctagcgcatnggtggntccgttggtatgcgcgcagcagttgtcccgccgcagtcatgtacgttcaacgcatctcgtatacctttctgtctgcgacattatatagttactacaatagatgtagatccactcctacagtatgctggtgtactcgctcacatcctgagttgtatccactatcgctgtccggtagacgcatgtgnggaatttatcttctttcatctccgcgcccgtaataatagctccagcatttaatttaagntgaaacatacgcccacacgacgtgcaccatcttagtcgtcncttatgacactcattcttttccttgcagacgcttacactcgctcgtgggtagtctagtagtctgcactttcgacctccatatagcgccccgtctactcctttctccgttacatctcgtcttatgntcttcatagtcncctgtatagcactctctcgttgtccagacgtctcagtactctttatattgtatttatttcttacgtgacccgaccattagttgaattgtactctcgcccgtaacatccccgtatttatgttagcgaacgcagccactctgcgcctanttataatgcatttgtatagtcccttatcctcctagcccgcgaccgcgnccagtataaatatattatctcttcatgactccacgtcaccgtgtgtncatggtgtgtcattatatcggccactattcgtagtccaacgacgcgcccgtctaccgtgccatatttatcaactagttgttctaacatgtgtgctctgcgccgtctcagganaatgagatagacgactcattagtctgatgtctctcacctacccatgatcttaccactacccctatattatgctcctctccgtttgttatcaattcgtactcccccctacttcgtctctcccatgtacgccgcctatttatctgtggtatatatcgcataggtatccactcgaacgacgttggtcgcatatattaatacttactcactccccggcgcatattgtctctatcaccgcataatatatcctgacgttctactctccgccagcccagcactataacaaacgacttatcctngtattttcncatatactttctatccttccggcc

SEQ ID NO: 8017 - DNA, 1147 bp, Homo sapiens
  misc_feature (1)...(1147): n = A,T,C or G
taaaaagagaaaaaaaaaaaaagaaagcaaacgcgacagcagagcgaggagagaggatcaagaaancttctccgaaaccaaaaaaagaaacgttcgcaagggggaccaccagataggctccacgacgacgccaagnagagtgattcaactaaggcagcaaaccgcggcaggagcgcgcaccgcaatcccaacataaaccactaggtacgctgtaaccgcctccatgtgtgaatactctaggtgagagggaagatagggaaagtggaggggacacgggagcgggagagacagccacgtgcccgtgcgatttcccggagcccaaaacatgtccccctcccccccacccccgcccaatacacgaaaacgacagcaccgaccacaaagcagacgcgcagcacggacatacgacgactaacacacaccctcacctgcacgatatttaacgtggccctgacggcgcgtgcgacgcgacattatcaatatgtcgcacatgtcctcgccgccgtatgcggcgccgacccgctctttggtgaaaaaacagctgatagacacacaccaaccacgcccaccccctccccaccatacaatcaccgctcatcccctgccaccctatgttcgagtgcacggccgaacacgcctgagggccccggtatcgccgcgatacgacgatcgtgtagactttattgtattccggattctatgattaacttttagatcaaatacacaataagcgccataatgatgaaaagagtcctatctgcgagtgaataattatatatcaactctttatgttatgntatacagtcgacgactaaggagagagtggtgattacaccacacgagcgtcgtgctggcgcgcggtcgccacgcccgaatgcttcgtcctctcgctgcgtgcgcgttccactcggccacccatccacgtcgtcgtcacgccctcgattccacacgcggcgtgcgcgcaactcgtagcacttctcgcactatgccgtagccgcgtatcacccgcgctgcgcgcgcggcgacntgcgcgacgctcgatcaccgcgccgttaactcggcgcggcggcacgcgcgagacgctctactctcgcgcgcacactcgtgcaccatgtttcctcacggcccgactcaaggttaacgtcat

SEQ ID NO: 8018 - DNA, 471 bp, Homo sapiens
agccatgtctgccactccagatggtttcgacacagtgaatccatggacctcgctttgagaaggactgatttttagtgacaaaaatccctcaaaactataaaataaagccataaatgatgcattttcaaatgtgcagagatgtattttaggatcattgcctcttacaaagtatttgttccctatttaaacttgttaatttattcttgactccctcctggcttcagtttcctgtgctcggtatcgcagactcacagatgtccacagttctgctccagcaaccctaaaaactgtcatctagtgcactgctattcaaagtgtaggccatggaccagtattggtccagaatcctctgttaccaagctgtgacaagcgaagaggtaaggaaactgagaataactgtgtagagactttgagcattttatatttgtcaaatctaataaagtgagcttataatacaaaaaaaaaaaaaaa

SEQ ID NO: 8019 - DNA, 238 bp, Homo sapiens
agggcgccacttgaacatggtaaccagttttgtgcccccgcccaggaattgagtaagcattagcctgtagtttagactccgtatgagttcatccccaagccgaccaatcagcagtcttgatgcagtggcgcccaacccaccgatggcactccttaaaaactttgagtccctgagttttgagggaaatgcatctgagtaagaataaactccagtctaccgcaaaaaaaaaaaaaaaaaa

SEQ ID NO: 8020 - DNA, 823 bp, Homo sapiens
  misc_feature (1)...(823): n = A,T,C or G
ttttcataaattcacatttccttttacaaacaacacacacaaattttaggggaactgnggcaatgattctgagggcttaacaagaggacagcatcaagaagaatcagcaaatttcttccttacagtatatttaattcaaggatcagattttttaaaattaccttaacaagtgatgaaattattttcacctgtaataggacaaaccaatttcatgtgttgcactgaggacctgccaccttatgtggtgtttttgccaaaaatgcatgacctgtatttaaccctgaagaaacatcatacaaatgtaaagtgaaggacattctactaaataattgaccagtactcttcaaaaatatcgaaatttacgaagacagagatcggttaaggaatcattccacattaaataacacaaaagagacataatatctacatgttatacataatccatgattggatcctaaaccaagaatttttaccctgaacaggacattattgaaacaatttacataattataacgttcattatagattaggttgttctatttcaccaccatctgctttcctgatcttatgctgtatctatgaaaaaaatttcttggatcctaagatatgcactttgaacatctttagaaaacgagtcttattaaatcatcctttgaaagttttccccatttccactaaattattatcgctattctatttccaaacctctgtgttctcttatttttcccctattacctattaatcctcactgtaataacaaattaatttaattcctttgccccagtaatcgcatacatttgttattccattccaaaatgataat

SEQ ID NO: 8021 - DNA, 918 bp, Homo sapiens
  misc_feature (1)...(918): n = A,T,C or G
tcccccccctttctcacacacccaaaagaaaaaggggggngnnttttcagccccacacacccatttctacattcattttccaactactacacctcataattccctataacctctctttcttatccgtaacgcggtataaaaaaccacaacaccatancctcttcacccaccactacatatcatatttctttcttcttcctcccccttttatcaacctatatcaactctctactactaaaacttacctcaaccctcaaaacacctcttcactttctacataagggagcgacctactccttcacccttctacaaaaaaaataacttaacttatccnccttctccttacncaacataacaatctctccatttcttaatcttaaaactcctattctccttactcttcttacaaacttcctttatattatcccaactaaccataccaccctcacaatctttccatccttatcatctctaaaacactccatcccataaccaatcctccttacctcttatctaccctcccaacattctaactcttttcctcttaaactctcttccctcccccctctatnttttaccctcacccctctaccacccttaaaactaactcaatcctccttctttctccccaatataattttctattatagcacccctcctctctcctcctcaataccacctccaaactccctctctctcacctcttctactaatctcccaacacaacctcttccctcttcacctcctcccaatataatcatccaaaaccttacctcttatattccattctatccctcaaacccctaacattaacccacaccaaacctctctttcttccctcccactcctacccaacctttaatttcatacacctctcccttccccccaactttccctccccccctctacttcctttag

SEQ ID NO: 8022 - DNA, 1694 bp, Homo sapiens
  misc_feature (1)...(1694): n = A,T,C or G
gccgtacaccgcgccccctactcgattagtttttcttcttgccccgatattacttcgctttcgcgacgccggagattttgctcgttgtttctattgtaacgcacccgtgtttcgtattactggaagtccgcttatcattcgtcgcgcccgcgctcgcggcgtgagaggagcgtgttgtgctaatctacgcgttacatcncgtgtctatttcttttactaatgtatatagacgtaagctagtggtccctcgcgtgtgcgcaggtggatagtgtcgtcccatccccctcaccgacgatctcatgctcagattatccgtacaagcgtcggatgacgaattcaagtacatctcttcttctgctccgcgcgtctcagactttcgacacataatatccttagattgtattgctattctacacgtggtggctacgnatgtgntgncgtaaagatagtgaggatatcataaccgaagcgtaggggtatatgtgtatatcgcgcaccgattccgcaccgcgtactaatatgttctacagcgtctgcagagatanacgttgtggtctggtggtctgtgtgtatactgtattgtggataccacgctcgtcntgaccgcgacgtntgttcagcggcgatccgcgacttatgcctgcgacctctgcagtgattgcgccacataaatcgcggtatcgcagagcgaagttgatacacatatatattctgcctgttgtacacatcgctggcgacattattctctctctgtnatacgtnacgctagtatacagctcttcgtacactcgttctcgcgcgatgagcatctactcatacatccatgtctcagcagcgagtatcatcatacgcgatgctcgtctacgcgtganctgtcatgattatatgcgcctcacaaacacgnatatcgcatcgacatctcngagagnagcgctcgacgngatgatcacagtgatctgtcnctctnagatgacgtgtagatatcgtaccantctcaccctcgttagtctgttacgtctatcacnatccagtcatgtctgcgtgacgccgagcgtcgtatagacnagnagntgtgcgcgctgctacacgcgtatncnagcgtctatctaacgcagcatactatgatgctgcgtatgttttcagtgacggatgactcggtcgtgcagcatactgggatatgncacncacgaatctgttcgtactctcgtgtctcgcgntgagtgacgctgtgaacagacgagcatgtatatattagacttgtataattgctcggcgactatagncgagacatagtcacggctatcgacgcgtcgagtcgcgccgcnctctgtgcgctacanatcggccgtgactntatgtccgttgntactcatatgccatccgtcctcntcgcgaatagtcgntgatcatatcacnaatcttaccgcgcncacgatgcacgtcctatcgtcacgtgctatattcacgtgtattagtaatcntgcctcagcgatgtccatcacactcgtgattccngcgcgagagcgactactgtatagntatgtaatgatcatctagtcgtgtgtcgcgtgtcagtcacccgcgtatgtatanagcaggcgcgcggaagttctcatnagcgcgcgcgnccgtctaacgatgataatagtnaagacgtctcgcgctcggcatctcttatcctatatnacatgtcg

SEQ ID NO: 8023 - DNA, 2024 bp, Homo sapiens
  misc_feature (1)...(2024): n = A,T,C or G
agaggggaaaangataanagggaanagnggaggagagannangagagaagagnnnnnnagaggtgtgggnnnnanagatgaggnnnnnnnngatgtatagggnnnnangngagnnnnnnnnnnaanatagtnnnnnnnngaaaaatggnaggnanagnnnnnagaaagagagnnnaaataaagngnnnnnnnangacatagagnnnnnnaatagatgagttgnnnaagatatgtnanatannatganaactaagtagagnaatatgttngaaggaatatgtganangatataatgttnnnnagatattaatataaatgatgtanatatgaaagagataagaagattaaatgatagatnaagactacagagatnnantctnatnatctnattccatgatagtgaccgcacacgcgtanacacttcgctnctgccacactcggtgnnacgacgagagagagactctatatatctnccancgcttcacgacactagacantcttctnnacagacacgangtagactacatgtcntcacactcaagctnncnacaacagacatctacgtntacatcntttgcttactaatntcncaacgtatctgattcaatgctnnttnacactcccttccnactctctcttaacacctctctctctctctgtntnctcctctncatgctcactatctctacaacgcgatcaccactcacgcatctgtatntnactaacagtcnatattactcgtcngnctagcatcagtgntngctattatatcatagtaatcatnatcaatgactntcatatcgacacctgcnttcttttcactgctacctcctaccctcactcnncncnttgttatgntatcgtnntnnnttgtgtgaggactcctatatctacatcatgtcacantaacatactatctnnaacggcgagagagctntnatcgcgtcatatgtactagacttnnnacaatgccgtacgcncacaataacgacgtctacatctatgtgttcntcncagactgtcttntctgtatatatatctcagtcatcatatcagtgtnnnnntaatacatactcgctncnctctgtgtggtgagatgtcatgactncnacagcacactctgactcgtgcacgtccgcnaccccnacncacagcctgcactcctgtgtcgcnncactcacacaggtcncngnctacactgcacgtcnccacnactactcacntccataccnatcanntncncncgatccctgcatctattctagnatctatcgtattacatactatcatanacatttctatgcntatctgtctatcantgtgttctctgtctacacactctcatgatccancttcttatatatctatantacatccatcatcancnacatntgtaatatgatttcagtagattcatataatatagcaccnaccgntctatctagcgtctctgtcccatctgcttncgagttatcgtnntctcacacacatatatacgtagtgnattccnncngcttagctngntctcactacantagtcatataacgcgactgatncgtagtcnctcncnatccaatacactanatgatgttagtcacaatagttatcatntatactcagtcgctcntntccactagcgtatcgtttcgantcgcngtcatcccatgtanncnnncctcagactgatganagtnnnnnnatacctgactacatagtactgtantctatgccntcntncagtttcgtntcatctgtttcatatagctnnnnnaatanatntactactatncncntcanaccgtactngtctgcgncgcactacacatagagtagtntnnnacntcaacgatactagtacgacgtatacgtctcgttatnnccttcatcatagtatgtcnnnnttctcatacgacatgtgacgttncntnagatgaatatgtcttccagagtgagtactcgcttctgtcagcgactcnnnctactactcatgatcnnatagagacgatgactatcatatatatgt

SEQ ID NO: 8024 - DNA, 818 bp, Homo sapiens
ctcaatttggcttccaagttactattctttacaaagaaatggttattgttctaatcaattacctgccggaaaccctgcacggtgatgttgaaccataggcttctcattaggtagccagagagtcccagagaagttacccatgttttccttacttagaggtgcaggaagactgacaagtcagttcccaaatatccctttctgctctaggaagtttgacccccattctcttgcttcaagtgtttactgaatctgagccttcattctctttttaaatctagagtacaagagaaataccactgctctggagacatactgtgatgtgtcgagttagttctgagtttcccaggaggcagagaaagcctctgtttagggcaccctgcaaaccaggaacaccaaaaagatgttcgaaaggtttttatgtttattaattatatatatattttaagtcattgtttttcctttctgtcctgtgaacaatgacatattttgtaaaagcatcagatgagtcatctttgggaaaaaaataagatctttattagacttctttcttttactttacatcttggtattattattttgtaatttcgaattaaacatgtgaaaagaatgggcacagcctaagatttttagtgccactctttctgtcttagttcaacttgctttatatttaaagtgcaattctaaatgataaattctttattttaaacaaacttgaatggaaccagtattttaactggtcttgaatagatttagtttttagaaggcactgaatttaagacatcaataaaaaatgtgattcagaaaaaaaaaaaaaaaaa

SEQ ID NO: 8025 - DNA, 1317 bp, Homo sapiens
  misc_feature (1)...(1317): n = A,T,C or G
aaagcgatttaagaacaaaatcaacaatttagggcgtaaatgacctctgatgcttactactgctgaactaccatcactaggcncagcagatgagtcatcgattcatcatgctacacctagccggcgctatggacacactctggagtggcatcgagagacgactccgtagccctagtagcttgactcgactacgcaatagaacgagattaatcactcgaaatagccatcgccggaacagagacgcccgggccagacggtatgnatttgcnctacactccgtagcagcacgctgnatcgaacagcttcggagtccgtcaggagaacagtagctatgacgattagcgcagatgtattagagctgtaatatggaataaagaacgaaacgagagcactctggtatatcaaacaaacacccgtgggcgaattggagagccgatgacaaaatctcttctacaggtagtcaccaaagacggaagtgatccgacgagtgtcacaggaatatggcgcctaggcgtcgtgtcgcggccgtccaaaaactatactggaatttaaacctatctgctgcacgcgaagcgtaaacacagtgtactgcagaatgtacaccagatactaacatggtgtggttgtcaatagacgaccggtcctagataatttaccaacgctcaagattggtgtgcagagttatggcgtgtaatagactaattatgtgcaagatataaatacgtgcggtggtgagcgcaaactcacgcaagagtacagtagtgcggagggaggtgtgtaagaatgacggtgtgagtaagtagataatgaccacagagacaaggcgagacgaaaggtggcgtgagtacaaacacaggatcgtgactgtaacaaatctaggtgacaggatggcgttggatcgttggtagtcctctcgtaaagtgaaacaactcgaagtttcgttgctgaggcagtgtgtgaccacgtgcaagagaatattggcataagaggtggtcagagtcganatattgagtgaaagatagcaggcagaagcaggtngtagaaaaagtggaaagcacgaaacaaataaaacaatataatagtagaagtgtggaagcatagtaaacagacaatcagtggccaggcgcgccggagtatacggagagaaggttgacagagtggaacagaacatacgggccgcggacagataccagacaatatgcaccagcacaacgagaccnagagaacacgnaccacgatacagagcaataatcagatngcagacgacgacggccagagatgagaacacgaagaaaccaacaacaacagcgagatccc

SEQ ID NO: 8026 - DNA, 1189 bp, Homo sapiens
  misc_feature (1)...(1189): n = A,T,C or G
agggacaagcccaaaagagaccgcctaatagagtgagaagagggcgggggggccggctggttagggngaatngncgggcgnggggcctcnggnggggggagaaccnagnagggagggaggaagaggagagagcgaaggcgcagaaacgaaccnagagagaggagacacccagggagcgcgcgggccaacgaagacgacgcagcccgccaggaganaagacgcaagagagaaaaagaccagcgccgaccggcagaaacaagccgcgcgcgaggaagcccgagcagagacgagccagcaccgcacgagaaagcagcaccaccccagaggaaacgaagaagaacggaaggcagacaacacccgaacgaaggagnacagcccccctcttccccacgaccagggcggcacgaggagcgaggagaggaagaggacgacgaggaaggggagcgcgaagagcaggagaaagaaggcacgaaaaaagacgccacaaccgcgcaaaggaagaaagacacaggggacagagggaggaaggcgacaccccgcccggagacaggcgccgcgcgaagcacagcgacgagaaccaccaagcgaagccccgaggcgcctcccccggcccggccccaacaacaagaaaccacgagcccgcacgcccagaacggagaggccaccgcgcccgaaccacagcacggagaccagcaaccccccgcccgcaccggtgggcgggacagccaggccagaggaagccgcagggcgggacgcggcgaagagagccgagagcgcgcgcacgcgacgggggggggccggagcacggcgcgagaggccggcggagcgcatcagggacgcgagacccgagcgaagagcccccccaggccaggcaccagagccccacgcgcgaaaagcgccggaggcaagagcagacaagacgcaggacaaaacgaccccgcagagaacccacggcacganacagagaggaggaccgccccgacggcgccagcgcgcagcgcgccgagggcgcaacgccagcgcaggcgaggcgacggcacgacacggcgggcgccgcgcagacagaacgcgccccgcgaggtcaacgagcgtcaacgcccaaacacagatagcgagaccgcacacgcgcgcagaccggcgagcccccgcgcaggccaaaggaggcccaccgcgacccccacgccccccg

SEQ ID NO: 8027 - DNA, 1636 bp, Homo sapiens
  misc_feature (1)...(1636): n = A,T,C or G
attataaaataanaaagaanaagaannaananaaactnnaaaaagcnanaggcgccacaggagagtgagacgcgagagagaaatgcganatacggacaaataagaangntgtgtnanacacactcanacancntgntnanaanagcgaacngaccncanacacagcacgttctggcacgacagacctcaanctacaacactnaagagtaagaaacggcatanaacacacgcgcaagcgcgccganagaangtagataatgatgtatgctcgcgcctgcgcanacacgagacgcgcgcccgacngcgtacgcggccgcccccacgactgctgtgactcgctcataggcactgactatactgcagcgacccngacgctcaggtcgcacacgacacacgacangatagtgangnaagagagctgaagcatgtatgacgcgacacagagntacaaggcatacggagtgagnganagatacgggaaggagatgaaggagagcgaggnganatcgagacaagtgagaagatagccactacgatgcagacgggagtggcagcgcgcggtagacgccgcgcggccgcgccaccacccacgtcgccaccgccgcacgcgcacgcggcgcaccgcgcgctagaagccacacacgcacacacaancataanaatagagtaaatttaatccagataatgttacttcggtcgtggaatttcgtntacgtagantattatagctaccggacgcgacggtcgtacatcggtcgagtgcgatttgcatatgagttaattatagttatatagcagatgccgcggtttctgcatggtactgctaggagggagcggaagagagaaagagtatgtaatatcaantacgatatcatctatagttgaatttatatcgtctagttgtctttatccctcgtctatccctcactctctctgctctcgctcgtcggtacgcgatactcggagtaaggcgtgcattgtagctgcatgtaattaatgctaacagcgcccagcggtatcgttactcaagcaacacatangtcacgtaattcgtctatgtgatatgatagccgagagtacagccgcgtaatgtcgatacctcgcgactcgcgcatacgaaanacagattataatacgatatattcacgagtgtcntattgatgtgtcatatactaccgtatctgatntaacgattccatatgtccgagtgagagctctctngaactagcgtgngagtgagattaggtctggtgacagttgtcagcgtctcgctcgtgagagtggncaagcgctctggtacgtgtagacggtcacacgtgcgcgctcccagtagtcgtcaangtgaggcgcgtagaancgcgtgacgtgagcgagataatgtgctgcatcgtttgactgtatcatctctgtgtgcgatctttangattctcggagagacgcgttgtgatgagncgngacaagcatgttcntcatcggcttcatagtantactagctagcgagtcgcctgtgtgagatatatgctaataggtacgatatgtcatatattatagatctatgtagtctgtcntcgtagactttggtagttggtgagcttgtatgccatgagtgcgctatacagcgcactacacctacaag

SEQ ID NO: 8028 - DNA, 730 bp, Homo sapiens
atgccaaaagagccttcttcaaaaatgttctagttgccatatacaagaaatagttaaccaaatgaaggagcatactattgttcatagattgaaagattcagtattttttaaatgaagctccccctaagctgatctagggattttataagatcccgatcaaaacctcaataaggtgtgtatatgcatatgtgttgacaagctaattacaaaatgtatatggtaatgcaactgttcaaggatagccaaagacaatcttaaagaagaaaaagtgggaggactttctcaatcagctatcagcacttacttagctgtattagcacatatagtattggtttaagaacagccaaacagatgaaatatatagaacagtgacacagaaacagactcatgtatatagtcacttgatttaaaacaaagatgacattgcaaagcagtgaaaaaattatagcctcttgaataaatggtggtgagaaaattacatattcatatgaaaggaaacccgaatatctattctacaccatacattaatattaatttcaggcggattataaatgtaaacctgaaaggcaaaacaataaagcttccaaaagaaaacactagaagatgctttatgaccctggggtacaaaaagatttcttaaataaaatgcaaagacgataaagccttaagaatttctgttcatcaaagataccattaagagagtgaaaggaaaagccaaaaaaaaaaaaaa

SEQ ID NO: 8029 - DNA, 1366 bp, Homo sapiens
  misc_feature (1)...(1366): n = A,T,C or G
aaaattatataagaaaagaagaggaananaaanannaaatgtanaaaaacaaaggnaaanacacacanngaaatcacaaaanattattcataccacctttatnaaannntaaaaccanacccnaacacaccacacttctctcacatatactctactcatctacnacacccatcatacantccacttgncacgcgcgacacatcagcgtacagcgtatagcgtcttcacgactcgacctgccacggtctcgactcactcccacncaatagtgatgctagtgagctaatatttattggcgtatgtgagaatgagtagatatcgngatgtgtgatcagttgtagtagctgatgtgaaggctagcggaatatgaattgtagtgatataattaggtgcgcacgaacgtcgtacncacgtacctactctatgcgactcctacacactcagatatctatacactatccataacaactactaattacatcagaaatctattcttctatataattattnatatnatacgatccntcatacaacgtcagatatattacgaagtgtagcaccgcattagtcagagcgacaaggtgttgagatgcaagcgatgatgtagaattattagatggagagcaggcggtagggaggtagtgtcacatagagtgcgagcagagatgacacaggagcgaggggcaagattcatagacaacatcataatatgtggaacagaggaacgaacaatgtgagtgatatttataatgaatgtagattcactaatattttgttactgtcgtatagtactctgtgcgtccaagagagccaagaacgtggtaagttagtcactccgtctcgcctgtgtgacctgttgggtatacacgctactgacccgcgcatcgatcattctagtctgatgcttcactccatatcgttgttttctctcgtctcttatgtgtaggtcaacggctagggatcagtgccggagatgcttgagagcgtactctcaaatcgagtgtntgcgtcatagacaagttagcntatgaggttccggcgccgagaacatgccacgtcgcctatgctctccccgcagtacatgtactgcgcanccgcgatatattcagantggagtcagttgcgttcatcatgcggtctatgagtaggcgtgcattagagtaataggtcgccagggtgacagctccaaatggattgngcgagtcacttctgcgggtatagtggaaggtgtataagagtcgtgtcgatgacctcgatgtgagtacgctctctgacgtaccgttgcttgtcagnaacacatataatgtccactacagttgtcgacgatatgtgaagagcatatatttgtactggttagtcttgagat

SEQ ID NO: 8030 - DNA, 1186 bp, Homo sapiens
  misc_feature (1)...(1186): n = A,T,C or G
aatgcgttggtacgaatagggacagatcattatatatgtgttgtatgaattataggtataatgtgcagtgaagagtggtgtgcgagagtacggaatagggcacgaggggtgagtatggggggaggatgtgaagaggggtatgtggtgtcgcgttaagggcaggttgtgtcgtgggttacatgggtggaggatgctagatggagtggtggggatcgggtggaggacaagagagagagtacgagtgaagtcggaaggtagtgaatggtaagagggaggggtggaggagaganggtgcggaagcaggggagagnaagcggttccggagatggatagtaggtgtagctggtattgtgtaggaaagacatgatgagggcgcagggaggatgtcgtggggtaggggggcgtatgggggagacgtggggaggaggaatagtgtgatgaggagatagaagagagagagaaggtggtgaaggaagtggaggagaagagaagaagtaggtggggtgatgattctggtggntgggtgatattggtttatgggtgtagggaggagggtcgggaggtatgtgagggcgctggggggtggtgcgtgtggggtgttgagggtgggtggatgggnggttggtgtggagaggcgacgatggggggagatgggggagtggggaggggggctgatttaactctatcggtgtgtgaagtataaacaatggtggatcgggtggcgggggggatggcgggagggggaggggaggagggagtaaggggggggagtatggttgggggtggggagtttgaggggggggatgggatggatggaagggcggggcgaggggancncgagtaggatgttgggggttagattaatctaggatcctggtgtgtaggaagaatatcaaagaatagccctatgaaagagngagcgaaagagaacaattngcacataagagttttatgtgcttccatgtagttcattaaagtgcttggtaggatatggatgataggtnaagttcgtctggtagacgcaagcacgtaagatacgccgcctgtcacattatataaaatatttcacttctttattttnccccaaaaaatatctacttcttatctatattctccttctacctcaataaaattttnnatttaatttttctacnatancnctaattatactaccaccgcatcgccc

SEQ ID NO: 8031 - DNA, 984 bp, Homo sapiens
  misc_feature (1)...(984): n = A,T,C or G
cttaaaaagaaaaaaaaagaaacctaaaagcgaaactccgcgcagcaggggagggaaaaaagggccgcggntttagcgagcgggagggggcgaggggggagggggcgggaagggggcgagacccccgccggtccgccggcagccgccgacggccgccacgacccccgcccgcccacaccaaagcacacccccccgcaccacaacaaacacacagcgaaacgaggaagcggggaccacaccgcgccaaggacgagaaagacccaaaacaaccacgcgagcgaagcgccacgaccccaggaccaccgcggcaccggggggcggggggggggccaaggggncgcagaggagacggggggcggagaggcggggagcggacggcaccgaccgccgcgacgagggcggggcacgagcaccggcgagaggcacaacaggcctcgacccaacaaagcagaacgcacaaaaaacgaccaccaacaaagaaccagacgacaaggaggcgcggcgcgcgggagcgcagcggccggacgccgaggcggggggaggccccaccgccaacgacaacaccccacccgcaccccgacgaaccgaacccagccgacacccgcccccgaagaagcgacgcacagagagaacacacaggagaacgagaccaggcagcagggacacccggcgagaagcacacgcagacgaaccccgagcgcgcaggcccgccacccagcacaccggaacgcgcggacgccgcgcaagacaagaacacgcagacccgcaaggagcccacccacagaggacgaagagacccgcgcgaccccaccacggtccgcgagcaacagagagacccgcccacgatgtagaaagagacagcccacgcacacgcccaccgggccgacggagccaccacgaacacgcgcaggcacacggcaagagacaacggatagacagcgcacgcagcgcacggacaagaaaaagaaaaggagaaaacagcga

SEQ ID NO: 8032 - DNA, 943 bp, Homo sapiens
taattattattagtcgaatttgttaaacagacagggttgcctttctggcaacaatgccggtgaactcccgtcccccgcctttgggtacaaaccaaggtggtttatccagtgatttatctgggactagaggccaaccgcaactaaagggatgacgccgcctgcgcttcttgcacaacaacaccttactcaacattggtggagcgctttttattaaccactgttacagtctgttgagcttcaaacaaaggtagaactacgtttcggtgggggcgaaccatctacgcgccaagaggtcttaaagaatcccaaaaaggccccgactccggggagctagtttgtttttaggaaataacaatggctctccgatgggtacaaacccaaaattttgccctgcaacctttaatgctctccatgctttttatttattcgggcgacggcagagctaaatagacgggggggggattgtattttagtcaaaatccaaaccgattataaatttggggcacaagtatctttctgcgaagctggtgtaggggaatacaacattaaatctatgaaaaccaccccgttgttcaagtgcgaaacaacctcttttagtattttggtgagcgggctataccatccaccttgttcaaagaaaaaagatatttagcaaataggcaccagattgagccgttgcacaggataaatgcgtctgtaaaaaatcaatcgagtgaagtgctactcgtgtagtgctatattattatatcgaatcctctctgttggaggcacacgggattgaataatgacgccctcaccctcattacaacacagtgctgatcatctcatttaaccgcgtatgaatcatttaccattattcatgtctcatcaaaaatatgtttagtaaatagtcggtaagaagttgaatgtgaagtgggtgttaactcacgctgacagctcaacc

SEQ ID NO: 8033 - DNA, 846 bp, Homo sapiens
ccacccaaaacctacaccctatatcctctacacaatctttcacccacacccacttaccggcgtcccaactacgcccactggtgtgcccgaactcacattacctctcccccccttcccttatcttttcccgcaattattccccccaagatttattctcccctctcgtgcatcccttcccaaatcaataacatttttcctcttctcaacgcggctgctctggcacgggcaaattctcctcacgaattatatgcgcggaacctcttttcatatgtccacagatccccgatcagtcacccccctacgcttctctcacacacttatcgaggaacacggctaagatatatagtctcgcaataacccattcactgagtccatcttgacatcgcataagtataagaccataatcatgacctctcgcgggctgacgccgcacacagtgcacattctattgttcaatacaatgtccctcacaccctgacaacatttcgaattgtggggccaagattttatcaccccgccatccagcttcgtttccatttttctaacgccaccctagctcgcgtcaaccaggcagcagaaatcggggattgcagcatgcctaagcaaagggtgtgtttccgtccttttttagaaaacgaagcaaaacataaccttgaactccatcctcagtaaacttgtcccatgaataaatcaattttattcattgtatttatttattgtaaataaataaaacagtaaacagcgctatctcagttttttgttaatcgagtatttttaaacaggaaagcccgatatatatcaaattttaaataaaaatgtgttgacactcaaaaaaaaaaaaaaaaa

SEQ ID NO: 8034 - DNA, 776 bp, Homo sapiens
ttccccctaaaagacgaatttatttgccaagtaagcaaaatgccggaaaaacaaacccaggttagttaaggacttctatggggaagaatcccttcttttcgatggagcattcaatttctcctttttcgggctgcaaagtgaaaaacccaaatgtcttcaagacaagtaagatatggcataaagaaagaacccaaaacgttcccattttcctagtaaagtccaacctgaggggagcattttaattttgataaaccatgtcctgccattaacttaagtaaaaaccaattttcagtgaagcagaatagagatggcagccaataatattcattcaataaatcaaagaatgcttactgtgtcctgacaccatggtgggggcaacaaaaatggaaagtgttttctatccacttgtctatgttaattctaaaaatatgtggtagttgattactgaaaataagcatcaatgaaaatgttaaatattcaaacattaccatgtcattaactgcaaatacaagatctgatactgtttttgacaaataagagaccagcctgcaaacagcattgttaggaagtattgtaatttaatggaaaaagttttgagctaaaaagagaagtacttgactgattaatcctgacctcaacaagtctttaatttttttgggcctccaatgttccctttttggaaatcagaaatattcagatagtaatactgactagtgatagctttaaggaatccataatacagaaaatactgatttaaatttacattaacccaatac

SEQ ID NO: 8035 - DNA, 1732 bp, Homo sapiens
  misc_feature (1)...(1732): n = A,T,C or G
caacatacgtcgtattatctcgcgcggcgctgtgtacatgtcattactaccgacccgtcccntganactcgctggcgtcngtntcgtgagcgctcacaatgatatctcgcgcttagaggtgtgcgtcgangctgcgtgcatcggcgctggctatantcacgtacacncaatatctcggcgacagatctacgtcatagatttnagataccgcgatagtcacgtctatgngtagactgctacgctcgcgcacgcatgatgagacgacantcccggactgcgtgtccgtgaacactcacacatcgtnacactgcgcgagtgactgcggtacgntantgcacacatgcgctcatctagcgcgctcagtcagcangcgccctcgcaatcgcgtcatgtgtanactcagacacagatccgcgatgctggtnctgactacaccaagttcangcgtactcgcgcccngcatctctctgtcacgtnccgctgtctcgtacttnctttgatcgtctctacatagtgcgtatgtgcngccgncatgtcgcngactctcatatcacagcacacgagcgacgcgcgcatcatctctataatagtgatcgtgactcacgacacactcatataacctgtgtatcatgagttcacacgacgacgtatacgtagtccgctgtctataagtcnactgcacacagtgtctagatagagtgcatcgagtgcccctctgtgttgaggtcgcagagcactactctcgatcgaccccagcgtagcagcntgnacgatgtgtcatgaatcgtcgtcatatactagttgtccgcgatagagtgatgcgagtgatcagattgggctcccacgcattgatgatcatgttgcgacctataatcaacatatgtgtctggtgcggtgtgagactgttgtactatacaggcggcacagccacgtacgtngcacgatccngtgcgnggagcgtcagagtcgtgctaatcgtgngcggatagccaatgtgcaanacancatgatccgtctcagtcgccgcgctgtaatagcgtcgnggncacacatggtatgtctgtcatgcacgcgncgagactcaccgtccggcgtgtctagatcacacgctcgatcacacgtcgcgtgcgcgcgatgggcgatcacggtagacgcctgactcgcctgatgtatcgtaatcatcgatcgacgtctacgcngctctcctacacacttactctcatgngcgcatgatatatcaatcggtgtcngctcgcatccaagtgagtacacgcttcgtgttgtgcntcgttctcggctattcngcgctatgtcgactgatcatattactatgtacacagcacagtcacggggatcgtctgtctctactaattaatctggaattacatatcagagttcgcgtcgtatacttattcgatatatcctgatgcgccacncagcacatgccgattgaacagctcgttgcctgattgaaaatagcggagtgcgaatagcatgtctgtgtctggatgcgcgcggcgtcggagcgtgacgatatatcgggtgacatgacgtggaataatcgtacctcacaatatcgtcgcgcggctcgccgccgaccgtaattggctagattatggagtaatactatatgtgcggcgacacactcagtcatttcatttctagcgtgttatcattcttctacgtggcgcggcacgtcgccggcataatgtaaataacgaaatggcgggcg

SEQ ID NO: 8036 - DNA, 1689 bp, Homo sapiens
  misc_feature (1)...(1689): n = A,T,C or G
aacgacaaganagaggaggagnagangnggaganaggagggngngagngccacacagnacaccgcaaccgccacnnacacacacccaccacgccggancgcacnacgaccgagacaagaacacacctttaanacaaagagagaagaagaagaagagaggaaaaagagagaagacgcttacnagnaaaagaggnngangcgaagaganggggagacaacgacgacgccggacgcggcgggaggaaagtgaaagggcagaccnacgcagccagagtcanagacaggaagaggagagagagcaagangcgcangagcaaagcgaggccgagaacacgaacgccagcagacacnagacggcaaancgcgacgagagaaccgcccacgcggaacacggaccgcaggngcgcaggcaggacagcgcgagcagagggcaggagcagagagaggcacggagcagagcggcaagcgaggacgcggaagcgagcgcgagcccgccccgcgcagcaccgagcgcgcgcccgccaccacgactcagcgcgcccaacgcacaccacggccccacacccgccaccgcctcaccagtcgcactctccgaacccgcacaacaaccatgacgganaagagacgncacgagcgacagancaggagatacagcatcacagacanacacgatgacgcgcagagcgcgacagcaaatcgatgagagaaagagcagganagcggcaaggagtcgaagacgagcagnacagacgagtcccgaacgagcagcacggggaggagagagatacgggaggaacgaangaagagacggcgaggaggagaagagcgcggcgtgagggagcggcggagagagacaccagaggcgcgcaggcactcgacagagcgacacacacgcgccagacgcccgtgcgcagcagaccgagnacgatacgcggcggtcagcgcggatatatcacgaggcagacgcccgccgcacgcggccgcacccgcaaacaagcggcacacgaggaagaccgacgcntgaggctgcagaggcggacgaggcagagagaagaaggggcacacaacgcagcacgccacgcaccacaacaggagaagaaggagcacacagacagagaccgagaacacacgcgagcncgagagcgcagaggagacggagacgagccgacagcgagagaatacgagggcagagagaacacaggcagaggcgcggcgcagagatgagcagccattnatacaaggcgaagcgcaagagcgcncgcgacgagcacagacgaacgcacagcgagcgngaacgacgcncnagagaacacgcaaggcgcnacgagnacgaggtatcagcagagacgcacgaggacgccgagagacggagcagagacgagagnaggcacgcagggananacgcacgcaacatgngagnacacgaggagcacaaaagacgacacgngtcgagcacgcgcacacgaggcgcgcgcnacgagcgatagatgagacgcagacatgcgcgacggagagcgcacaggtggcgcaangagtcagncaacgcacgagcaggagcgtagcacgcncgcgagagagacagcnagcagacaccctcgcaacagacgacgcaggcagccagacgcaccgccgcagacaggcagcgcacgagcgcaccgcagcgcgcacacagagaancagagagagacat

SEQ ID NO: 8037 - DNA, 169 bp, Homo sapiens
tttcagggatttcgtgttcatcctgttatttatccaaaaaaagggattccgggcgtcttgactttctagtgtcaatatgtttcttacttccaaatggaataaatctcgctcttctatgtttttaacgccttccgattaattttaaaaattttattttcttgggatgtca

SEQ ID NO: 8038 - DNA, 356 bp, Homo sapiens
  misc_feature (1)...(356): n = A,T,C or G
cggtggccgccccctcctcgttctccgctgtgntcatacagacccgctcccctagtaacctcgcccctcggtacaaaaaataacagtacgaatacagctatcccttttttttaattcccaccatttgacgagtacctcttccgctcacgcatctatccccctctatcaagtacccacctgtcttattgcctctagttagctctatagcatttccccatgcaccttttgaaatttatacatataaactaatagctcagtatatgaccccgggttctttgtagaccccaaaacgaaattcgtgtcggacacatattttgttctccacgtccggagagggtctattaacagaagtcttg

SEQ ID NO: 8039 - DNA, 1190 bp, Homo sapiens
  misc_feature (1)...(1190): n = A,T,C or G
gggggggtaggggacacacataacacagaggagggaggaaggggggaagncctccatagggcggacctgagaggagcgcacgnaggcctgaattagggggtgcatcctcgcactctggggnggctgcacaagaggggacaacaacggcgaggaacgttgtggaagaccatgggtggattggacccggacgtgggtcgctacaaacacaattgcacacacaatacacataaatcacatgtgaagtcgagacaacactagcctcgtgtgcctcacaccgtacttgcgacttgctgtacccgactgccacgttggtgtataagtcatacataattgtgtgacgcttttaatacccctctcctctgtgttggattatatcttaacaaatatgcgaaatctgttgttgtttgttgggtctcatcctaccccaccttcaccaaccatgtaatttttactgtcngcattgtattttcttacttgcacaatactcaatacctaacttactgtggtgtgtaccaacccagattgtgtataacttctctgttcctaagttctctacttctcacgcgtttcgtgtgcctcgttttcatacttcgtcgaccccaactcggaaataacatgacgtgtgttagtgccatctcctcctacacattgctctgcttcccagattggccctcttttcttattataactccgtctcatatgattacttctcattagcattagtggattgttgttgaacaatatgttgcaataacacttgcgttctatctacattgttaatatgcgtaataatcgtgttgtataaatatttgttgtttgttaggctaagaaataggagttgccttgggtataatttgagtaccatggcctcttttttggtgttaaaacattttacgtgtggtgcgctgtacatctgttaatatattgttatctggtctcagccgtataatacaaacgtggagtgtgtgataaacacgatgagttgaacgtaaatgtatggattggtaaactgggttgatactatcctacttctcatcctccgacgtctcgcactcacatctcgttttgtgcacaatcaatctaatagtgctcgagtgttcgttctccacaacaaagtgtgtttggctgaccgacacccagattttcacccaaacccgtttcttgtgtactctataccatgtaaacaacaa

SEQ ID NO: 8040 - DNA, 234 bp, Homo sapiens
  misc_feature (1)...(234): n = A,T,C or G
aaaanatacgtcgagtgctacacgtaacaagagatgtttaaataaatatgaaagagctctttcaatatggaaaacattgtatcaggaaagaaagcattgtgtcatagtttaatttgcaactattttttccttaactatatagaaaatgaacatatcttataataaaaggcatctcagatttaatgaaaaaaaaaaaanggtggcctcgaanactcagcggggggctcaaaaana

SEQ ID NO: 8041 - DNA, 404 bp, Homo sapiens
taggaagggtggcattgcacaacattgatgtcttggaaaaaatgcttgtaatggttgaatttagggttgtttttattagatgtgaccccatattactctgctatctaaaagatagttctaataacaaacttagtgtcttgatttgtgttgcgcgcgttattttttcgatattgtttatttagggttttctttttttgctctgtgatgtgttagatgcccagatgtttgcttatacaaatacttatatcttctttatcgtcttcaactttttttctttataacattattattttttctaaatcaggacgggatagtcgaccatacatgtataattttagtcttattttgatgagttacaattatacaccacctctcctgtctccactactcagactaaggaacgg

SEQ ID NO: 8042 - DNA, 605 bp, Homo sapiens
agccctgtctgtattaaccctggctggggctgctgtggattcatcaatggtgcttcgacgaagctggtaactagtattctcgagcaaactatcggagggacaaaaaaccctacacctgatgttggcattcatagaaggctcgattgctcatgggaccctcatcgcaccatagaagagtgatcatggcaactatagctctggtacttctgggtgctgctccatatttccctctgtggttatcactagtcccactccgatgggatgctgccgcccaggcccgtggaccttccctctcctctcgctttattgatgtccttattttgagctgtgctgtggtttggccctgtgttgttcttagtgtctcggtccgctctgttctccctcccccccgcccccctttgccttcttttcctgttcgttctggtgcttctcccttctttcggcccccccccagtcgcgccgcgtggtctgtcgggttctccgtcgctctgcctggtcgtcgtccgtccttcctccctccccctcccggctccttcgcctctcccctcctctttttgcctcgtgtgcggcgctcccgttgtcttatcaaaataataaacaaatat

SEQ ID NO: 8043 - DNA, 428 bp, Homo sapiens
  misc_feature (1)...(428): n = A,T,C or G
cgngcctgtcagntgnccgnannangggttcctggtgngtngggcccgatcctgggtagagtngggctctcttgagtcaggcngatctggccagnngncngnngtnncangcagcttanggtngcggaggctacaaggnnggtagcaagggggncccatantgagtgggcttgntcacaaaaaaanggttgctgcgngtgnttccntngngcgagggnttntgcttcgagccagacaatnncaaggctacgatngatgagtttgggccacccacatcacagtggngcagtcaatggtcatgcntgnttngtggtgtttgtgtgtgntccggcctcatttgncacccttcttannngccgtaagcntgttagcgtacagcntggggngccaggtggcctcgttanatcaccgtgggtgttcgnanaaag

SEQ ID NO: 8044 - DNA, 121 bp, Homo sapiens
  misc_feature (1)...(121): n = A,T,C or G
agnntcggcnagntnggaccgggccngtcatnnntcnnnagagaggnatcnaggtgagcagngnccgctccgtgnnanagtggagntntctnaatcnnntccgatctggccagngnncgnt

SEQ ID NO: 8045 - DNA, 835 bp, Homo sapiens
  misc_feature (1)...(835): n = A,T,C or G
cnggcnncccngtcngcngannttagggnggngtttntttngctnngaatgcccgggnangnttcnnangccggggtcctgggttntcnanncatatncggnggtgggggggnntaancngtcatngggngnntcngctcttcncanaattagaggantgganggtgcntttaaggcncgtatttantcctgnctttncatnccatgggcaaagnatttttcaaancggttcncataagtgagccatanctgctgcccaaatccttgccattggggctgtcattaagtacatttttctgtctggttaaatttccttngtcaacatgtttaaaagtgaaaccaaagcttgtgaaagaaagaccttcttgtgcttctaaggtcacagatttgtcagataggtggtcaataaaggctatctctgtcactagcttgcccctttggcaccaatataactaaaaatttgatgaagtcaaatgatttcagtagtagtaagacactaccagtgttaatgtttaatgcttacgatatctaaacagaaccttggtgatctttgtattagatgataaagtaataaagttatggttataaatattatcaaaaanaaaagtgtttcagaccttaacaaatcatctttattaatcaagatggcaggccctttttccccaacatctcccccacaatattcatatttatgtgatttttagaaatgttttcacatttattatataaatatatttgtaaatgctgctctttcctgccaataaaaatgattataaacctacagaaaaaaaaaaaagggatggcctcgnngactcagcggggggctnaaaanaag

SEQ ID NO: 8046 - DNA, 525 bp, Homo sapiens
ccattcatcctcactaccccatcgtgcctgatgggccccgcgcccacccgagtccgcgtctcttgcgggcgcttttgttcccgtgttcccgcggccgggacgctggccttgcgggcgcgggcaggccgctcgggagtgtgccggggtgcgcggtgtgtgcgccccgggcctgtctccgtcccccggcccccccccccgcggcggggcggccggtgtggcgggtgggtgcgtccagaggtgggttgtgtggtggagtggtttggctgttgttggccttccgtcgtgcgccccctccacctcgccgtgggcgtccgggtgcgggccgggtccggagcggcgccgtgaggagcgggccgctgggagctgcgtccgcggcgggtccgtggcacccgcgcaacgcgctgttccccgcgtctgtatcgaggttgtccgccgcgcgcgtctatcgttctccgcgtcggctctcgcgtccgccgccgcgcgggcgcccccgcgcgcgacggataatgaagattagggcaaaaa

SEQ ID NO: 8047 - DNA, 235 bp, Homo sapiens
  misc_feature (1)...(235): n = A,T,C or G
cagatttgcctgttctggacagtccatttacatggagtntacaaaattcagcagtcttttgtgagaggcttctttcacttggcatgttttaaggttcatctacactgtggcatttaccagtacctcatttcttcttattgccaaataatattctattgagtggatagtccacattttatttatccattcatcagttcatgaaagttcaacctgctgctaaaaaaaaaaaaaaaaa

SEQ ID NO: 8048 - DNA, 1104 bp, Homo sapiens
  misc_feature (1)...(1104): n = A,T,C or G
ctcttcagttcagcttgataattacagcttacttatgtggcgcggcttttaatctcttctactattaccatgcatgtttataatatagacaggatacttcctgaacccaacaatgggtgatactggatgcgtgggagcgacctgcacaggggtgctatttactcgcagctcacgacaaactatatagtacatcgtggcgtcatgcggccggcgttggcgtctgttctcgcggcgcgtctataagttgtatgtttaagtgtcgaacgacatgagaactcaatgtggtgccgattcgcagatatacctatacggatctttttgaccacatcgcgcgtaactgaggggcgtacaggtttgacttttattacttgtttgtacatgtcgacgtttcgttcttggcgtgtagacttgtcttggcgcaactcctctttatagtgatacctttcgtgtgcccttactctggacgcatatcttctacatttcacatctccgacagtgtgtggtctcatagacattcgttgttgtacacacactcaagatgtgtgggggttgtgtaaccccatcgactctgcagcaccccataaggcacatgggctgagtgcccaccacatatagatatagttaagagtggtgggcgttaatgtacgtgtgtggtatagtgatatcaacanacggcccatcgcaacagactgggtgcggggtggaagaatatacctataacgataaatctatattttgtgatttgattgggtggtttcacatgggatatctgttnggcataattacaataatatgcgtatttctgtttatccctgtactaccaactggactgcgtgcgtccaaagttatactgtgatgatgcttggtgacgctgtggacatataagtcagcgaaaccatcttcttcgtttgctgtatcgtgtgtttaaaagctttctacttcagattccgtccccttgttttagtttgagccggattgctcttacatccggcgcgttaatagagaatcacgtatcttagtcacccgcgttgcctgtcttggggggttatgatcactataattcacgccagttctatctttctcattgaagcatcgaagcaagac

SEQ ID NO: 8049 - DNA, 1094 bp, Homo sapiens
  misc_feature (1)...(1094): n = A,T,C or G
gcaatccacccaccgttttattctcgtcgcgtatgtccctctcccctccccattgtctttttgtaattcctcgactgtctccaagccacgcgccccatccccccgcggcgggggattcattgtaaacaatcaccagacacgcccatttagctacagaaccgccgcgtccgcccggtggtacgagtacttaacgcctcaacgtaccttctttgatcttctacgcgcgtcgggttcttacatccgcgccgccgacgtccatatgcgcagataagttggtgataacggctaccatgagtacgggcaggcgttgacgcgtacaaaagtgtatcttattcctctccagcccgcgaccctcttgttcgtcaagtcactgtattagagtagcttgatttttcatactcactcgcgcgtatatgatcgcgacaaacgcggcctcgtcttccccccttgtctaacgaccatcgccatctccactttccccgcgcgagctgttatgaggtcgtagtgtccttgcctctgtcttcttgagagtatctttcaccaccgtcgttcgcctccccgtaactctaccgctattcgagttgcgtcttagtcaagcgcgcgacttgcgtcggcctgggctccgcctactatctagtattccgacaactccctttttgtctgctgacaaggtcccgatcccgtcattcgcccatctgcccttctccacccgcacgctatatnttccgtacgtgcataatgccccacgccccgccatactcaccctatctggtactcgtcatgcgcaacttcagacgcgcgcatttccgtcgctctgacgcggtgccacaattcgcgcgacgctgcgtatcctcacttacgctgctgacacgcgcgcgtgcgcaatctgctagaacgaatttatggtcagctactccgtacaccagccttcacctctatacttccgttgtcttctccttcacacgcatcgttggtagcgtggtatatgattgacgccaacgtcacgccgcccgaacatgattgtctctcgcgggcgctcgttactccgcgcggtntctccactgaatcgccgcgcctggagtgtgaagtggcct

SEQ ID NO: 8050 - DNA, 1138 bp, Homo sapiens
  misc_feature (1)...(1138): n = A,T,C or G
atagaagagacacgaaaggagcccntttaatatagggaaaagagaggagagggttccttatagttaactnggcgccccggggccttcagnagggngnaaacaangactcggggnncggnagaggaggggggagcacagagactcttaccgagagagaggcaaagttgcttttgtcacccgacggaaacaaatcttactccacagagccgaggccgcgcatgaggcacgaccagccgcgcgttcctaacgagccgcaagcggcnaggcaagaagattcttgagagcgaggcgacggcacaccgagagcggcaggacatgagggaagcaggcagnaaaaaaataccctcccgctaaagggaggataaggaacacaggnacagacacagccactaccacacgaagagagcaccagagagccgggaaaggaccgcggagaacaccccttctctcccagagattgcacaaaacgcaaggggaaaaaggcgccagcagggctaagcacacgccgcgcatgcgcaccggagacccgagaggaccaagagcgcccgagacgcgcggaccaaacgaagagatgcgggccaggcggccccgtggatagaggcgccgcccggagcccgccgtactgatcacagcacacccgaccgccgagatataacgaggggacaggggtgcgacggccgcacggggagcagagagcagatagagccgggccggcgccggcaccgtaagagagccgaggacagccgagagaggacccgcgcgcccagagaagcacagcggcggaagagggaagagagggaggggagggccacagaaggagaggggcataggagaggatataggacagcggatcaggacaggcccccaaggagcccaccgcaatatgtacgacgatacacccccggagagcgagaggcaggtgcgcccccgaagtgaagaaccgacaggacaggtaggcgccggcgcgagagcgacacgaacagggcgacggcgagcacgcacccgcgacgcaacgcacagccagggcgcaggcagaagatagaatccgcaagaaggacacactcacgaggagagccgcgacggtacgcgaagagaataagagagacagaccagtcagaagagcagagacagccagcaa

SEQ ID NO: 8051 - DNA, 1392 bp, Homo sapiens
  misc_feature (1)...(1392): n = A,T,C or G
ccggtaacaacggaggccgcgacaaggagttacgcgtgaatgtagcatagtgtcgacacctttcgttatgctctgacattcntcatctctatcttncattctctatctccgtancancgcnncctgatatactttcctgatcacgcncacagcacgagcagagcagagacgcgtagcagacgcagttcatgtatcgaccacatacctcagtgtcgatttacatngttacatccgcgctccgcagtcaccacatcgatcatcgagaacctccgcancatgtcatatgcgtcggtcatgtcggnctanaganatatgcagtcgcggcacccagattctcgtcaactgtactgatgtattgttacagttggcattgtgtgcactactgctactctgctacgatgttttagtacattacgcagcgcattgtcantgtatatatgttatatgtcgtgtgtactgattgtncatcctcgcggcgctctatatgatgttgatgtctggtagttccgactatatgcggtactagctcatagcgctcgcgtcgatgtgaatcacgcgatgtctgtctnccagtgcgaccacctcacaacactattacagcgtaattgacatcgacgtgttcggtcattacagtggtgatcccctgcgtttcacataatcaccatatatctcacatgagcagtgctcacacaacacacgtctgcttatagtcctcctcatcagacggtgatgtatagtgtggatgacaattccacagcacgacgtaggctagccgtaagttaacgcatatggaggtgatattatgacgcgtgtnatagtcagtgagtggctgtaagtgatgtaccatctagagggtgctccatatagtgactctggccatacatacccctccgctcgcgagacgtatcgagtagacgacncacgnactgcatgacgacaagtgctcatcatatattgtagtgaagagatgcgtggcggngtgaagtgcgatgtgcgtgaacgtatacataactcggcgcgagcagcgtctgagagtattaactacaatgatgtcattgcactgtagtgtgccttgtgtagataatcggaactaactcgagtgtgcggagagcgtgcggaagccngcgcctgcacttatgcaccgatgatatagaatatagtatagactgatagaatacgagctagtagagacataacataccagaganaccacacgcgcagaatacggtacaggagagtacgcaatagtacggtatatcagagggatatgagatacantatcgttagagaagagagaggcgacgcgactgagtcgcgacttggacgggtgctgagcggcggcgaggagtggccggacaagagagggcgtgtagcgagagctcaggctctccg

SEQ ID NO: 8052 - DNA, 1384 bp, Homo sapiens
  misc_feature (1)...(1384): n = A,T,C or G
caggcagagaccaccaccgacgaaccgcagcaagaccgagagagagagacggccgaaggaagacgcctgcgaggggaggngacgagcgccacgacgaacgcgctgaagggaggaaaaaaaaccaaggagagagagagacgcgaaacacaaaagacacgcagcagagacgaaaagaacaaggggacgcggacacgggcgcaagggcgcgccagagacagaaacaaccagggacgagaaacaccaacgcaacagagggcaacaccacanagcaagaagagggcggaggcggggagaggcaggggggaacgaagaaacgcgagagcgacgaaaccgccacaaggcggccggagacgaggagcgcgccccacaagaaaaaaaagcgcccaacgacccaccaagcagcgaagcaccgacagagacgagagcaccgacgacaaacgacacgggaccaccgagaacagacgaaaagaaacaacaaccgagggcaaaagagcgacggaagacaccagcgagacaacagaacaaacaaancaacacaccgcgccagcacacgccgacgagccccgacaaacgaaggagcaggacccgccggaggccgacacacagcacgacagcgacgagcaggccgcaacgcgcgccggcgagacagacacagagccgnagnagagaagcgcacgagcgacacgccaccacacgcgccgcgaagaaagaccggacaccgcaagaggacccgcgcacaacaaagaggcacccacgacgaccaccncacaccgcgnanacaancgnagagacaagaacgcgcagcgacgagnaccaggccacagaacaacgacacagngaaggcacggagagagagcgagcgagacgacaaaccncgccgcgacgcgcgaanagaacgcgcagcncaaganagacagcacaggcacgcagcgagcacacaacaacanacacacgagcacacacanacgcanacgcgagcgcagacaaagagccaccgacagcagcagcacgccagacgacggcgcgcacnacggcgaccacgtcgagaacgcgacggcgtgcncaggccacgccgcggagtgcgagagacgcgtcngcggcgagaagagcagcaacagccgcgcgcggagaacgcagcgagagcgaacgccnccacgtagggaggacggcagngacgcgcggacgagacagagacgcgccagataacgngacaacgaaaccaanaaaacgcagaccgcacgagcataccgcgaccgacgaccacaggcgcaggaaaagaggggacgagagcgagaagcagaggaggtaagacgccagcggcggaggaagaagaaagagaagcgaggagagagaaaagagagagagagagcgagaagaaganaag

SEQ ID NO: 8053 - DNA, 1070 bp, Homo sapiens
  misc_feature (1)...(1070): n = A,T,C or G
ttggaaagagaaagagaacaaagaggggggcggcgcgggagccgcgggcgaaggcaacgcaagaaaaaaaaactctaaagagaaaacaaacagaccgcccccttcacagcggccacaccagaaccacacccccgccacaacgacacaacaaaagagacacctcaccggggcgcgcggccacgccgcccgcgaggagggaaggacaaggcaaccgccgcaaaagagnggcagaggagaagcgaggggagaaggaggcgggcggcggggcgcgggancggagggcgcgccgcggacgggggcggaccagcgcgggcgagcagccgggcgcgcgcgaaggaggccgccacacagggaggcgacagcggcaaggaaaagaacggagacgcgtatagggccaaacggaagaaacacggccgganaacaaccccgcaaaaacgacaaagaagaagaacgaacacgacaaggaaacacagggacggccggcccgccgccgcgagaggccaacccaaaaccaccggacccgccgaccgcgccgggagaacgacacgagagagagccgcgtgcgggcggcaccggagaaccgcgagacagaaaaacgacaaacgcccccgcccccacccggccccccacgcggccaccccggacgctacaggagaggcacgccgcgacgagacgcgcgaccgagggcagcgaggcggccacacccaagggacgaacgcacacgcccgcgaccgcaagacgacacgacgcgcaaggcagacacagaaaaacagaacgcggagagacgaacggcgccgacagtcggcagcgagaccgnaccgatgagaccgcaccgaacgaagcgccggccgggcgcggcgacggaggcgggacgagcagggggacggaaagggcacccagcgaggccgagagagcggagaaaccaggcagagagaagacaacgagaagcaccgcggacaccaaacggacgacgccaggccgcgagcacgggcacacaacagcaccaccgacgccccaccgacacgcgcacgaagccgcagaaccgaaaccgcagcgccagacgccagccg

SEQ ID NO: 8054 - DNA, 857 bp, Homo sapiens
  misc_feature (1)...(857): n = A,T,C or G
aggagagttagtttctcctaactttccaggctattgggcccagaaaattttgtttccttcccaagactgggtgattcggccaatcatggaagtaaggggctttgtggtagaagttttcggccaatttattatcaatgaaattcaggcaaactaagcaaattaaattcatgtcccncaggcctccattctggggctgattctttaatatttcaccaatgaattttacatggatagancagaaaataagttcctagagctgccagatgatagcatgctggtagcagatgacacccatcgtcagttaggaaggcgagcatccaggacaggattagaattccaaatggtctggcaagatggggaagaggtggaggcagaaagaatgaacttcattagcaactatcacagagtaatacgttattaagagggaaaaacagattataccaacatagcaagaacagtgactagcaatgagtgattattgcctgaaagagttaatggtgggagttactcataactggaaatgagacagaaagtcaaatatgattctagaaaaaggaccaataaatagcagtatgtcgaagtaaatcaattttcccaatatatactgtatttttaaaaatcccttttcgagtgctgttttgttcctcagtgttgttctggacatctttgaaaaggcacacagaaagcaaaagcagtctttacaagtgcagaatgtaatctgggaggatggtgaagtcaccaacatcctttaattgaaaatgagtcagttgctggcaattcatttgagaatcatttattgagcaccatctatgtgccagcctttgtgctgggtgctgaggacaaaaaaaaaaaaaaaa

SEQ ID NO: 8055 - DNA, 1315 bp, Homo sapiens
  misc_feature (1)...(1315): n = A,T,C or G
agaacaaagcaagaacacaaagaagagaagagaggaaaagagagggnccctagnntgtgtgacgtacaagcacaacnncgcctccnnaagcgngnaaaccnacgcaancncnncgnacaacgncacaccagcaggcgcgcgcgccgctctctgcactgggggggcgccttcaacacccccangcgccaggaccgcgacggcagcagcacacaaccaaacaccgacaccacgagcgcggaccgcgccgacgagccggcgccggtcacgagagacgtcggcgcggcacagagaaacgaccgcacaccacgggcgaagggaacgcgaccgcaagaaaggcgccagcagcgcgcccggagcnaggacgaacacacgcgaccgacagaaatctctttttcacaacgtctgttcgcgacgacagcagccacaggncagcaccacagacacacaccgaagacgcgcacgaagcaagcgcgacgcgcagcggacgtaggcgganaaacaagcaaccggcgcaccagcgcgccgccagacgcgccacacgacatcccagccgcacacgaccaacaggcagagaccacaccagacacacgcgacgtgcagagacccacggccgcgcgngcagcgcagagagtgaggaaacgcacgacgcacgcagcggaaaggcgcgcgcggccccagcgcgtagcgaggcggagggtggactgaacgcagcggacaaaaagacacgcaacaaacgggcggggggggaggtgaaccgagggacgcacacaacaagacaacgacaggaaacaacggagcaccacgaanaacagcgggacagccgtacacaccactcgagacggcgggggcgcgcgagcagaggacagcgtccgatcacccgcggcagggcgaacgcgggcagggagggggaacgagcgcacccgaatgcgaagaacaccagcccgaggccacacgcgcgaccaccgagagagacgcacgccgcgcggcgangcgccgggcggcagaaanacagcacagggggcgcgcacgaggacgagagcaccaacanacgacacacacctcgacggccgcgcaccacggagcaagcgagggagcgcacgacgaanttacacagcagccccaccacaccgaccgggcgtcgagagcganaggagaacgccaccgcggcacgcacactccacggcgcacaaacaaccacaccacaaccgggcgcaagaacccgacccgcatacaacgggacggggggagagacaaacactggcgaagcgcgccggagggagacaaacagaacaacaccacacgtagacgggaggcg

SEQ ID NO: 8056 - DNA, 1208 bp, Homo sapiens
  misc_feature (1)...(1208): n = A,T,C or G
gggacgcaacccggaaagaaagagggcaaaagagagggggagcgagaagaccctggggggggacaccagcaaagagaacaccttcggaagagacgaaacaccgagaaagcggcgcgagcccgggcgccgcggaagacaacacagaagacggcgaaggccccgcagcccgggaccccaacggagaacacagcaggcacagaacagcgcgaggaccgggagaaagcacgcggaacgaaaacacgcgacacggggaacgagaccacgaaaagacacagcgcgcgaggacgacggacaccaaccacaaaagaccaagagaagcgggacgcgcgcgccgcgccgcgagcacaaacaagacgacacgcgcgcgccgcgtatgacacaagacagccgggaagagaacagaacagggcggcgcacccacgcccgccacagagacaagacagagaaccaggaagagaaanaagcaacccgagcacaccacgagaagacccgcgagagagaaccggagcgaaagagacggaggccaacgacaccagacccgaggagcgaaccgaaagaagggcaggcacaccagaggagcgaagcggacgccgtcaacccacacaggccgacaaacaagaacaggcaagccgacacccgaccgacacgagaggaggagaccggacccagcacccacgcaagagagaagacgcccaacagcaccaacccgcagaatcagaggcaggagcgaagcgacagccaccgcagacacaccaccaaaccacggcaacgacgccgcgaggcacgaacagaagaaaggcgcataacgggcgcagcaagcggagcgggagcgcgatagccagagacaaagaaagccaagaaacgaagaaaagaaggcaacgcgccccacggagaagtacaaacgaagaccacatagaaccgcggcgcacgaaccaggccgccggagagcggaacgcgcgcgaataggacgacggcacacgccccgacacgaagcgagccacaaccacccatacaagcacaacaaaagcgagcgaccgacgcacggcacggaaacgggcgaggacgacagaatacgcaacggccacacaagcacgacgagcatgaagcactacagacacagacaaggggcacgaagacggcgcccccggccacgacaccngcacgaaagatgagaagaacgcaccgaaggacgacgacaggacgaacgg

SEQ ID NO: 8057 - DNA, 1186 bp, Homo sapiens
  misc_feature (1)...(1186): n = A,T,C or G
gtataaaaagagaagggaggaagcgacaacgggcgaagcgagagtgttgcgatagaaagatacggaatgctaccacgagacacaanaagtgactccttttgcgtgggctggaccctagacttcgcggaagcacgataggccgaaatgtagtatattatttttcttaacgtgcagagtaacaaccaacgtcggggcggccacccctgtgtatacgtcgtatatcatatgtcatactcacattaatatatttcactaccacgagcagtgaggctagtgagggagggggggtgggtgggagagaagggtagctgagttttattgatagtgtgcggcgcgcgtcgtaggtgagcgacgcacgtacaccctgccaccgccctctgcgtcccgcgtgtatacgcgcggtcgccgcggaagatagatgtgtggatatattgtacacactatagagataantgtatatgtagatcatagtaagcggaagcgggaaagcgtgacagagagagtagaagggtgcgatgattatggtgcacagaggaggcggaggtagcagaggagggtttttataattgtgctgtatttcgtttttagttactatcccagcatcctactccacacaatccatagagagacagatccatgatcagtctctctgagtgttcttgtccggtgcgtgttgtattaaagagacgatatatattcaatgtataaagtatatgagatattgaagttgcgattacatctacatataattatcgtgttgatgcgtgcatgtgtttatatatgcgtcgtgaagtatgagncagtatgaaatgagaagacatgtgatgtatggtntgcatgagacaagttagaacgatgccttctccagcccgcccatcggtatccataatattgctagagcgacggtgcgcgagtgtatagtatagcggaatcaccgctggcattgttgttctacgatgacantggtagtgtgacgcgatgcatctcttntnctgttgccntctcgtctctatccttacgctccgaccgatccaccgcattagagtatcgtatnnacaactgccggctgantaanaacacacatgagtgtgacantcttcgcatgcgatttatacngtaggtacgcgtatgcggacgatccgacacggtngacaccatgcactacgcacacgtgctggcacatcgt

SEQ ID NO: 8058 - DNA, 853 bp, Homo sapiens
caatttctgtttgtaaaagacagatccagactggtggacttggaaggtacaacctttaaaaaacaatttattaaccttccgtcttcagcccaatttttgcccctcaaaaaaattttccattctttaaggccagtcagggtaatttggggcttcctggctctccctagccaaccaacaaaggaatttgggcttcttgactttctaaatccattctcactcattcatctgccttccaagttcccaaaattggaggtagtaattcatcttctgttggctctgtcttcatggcttaatgtttttttaaaatcatttctaaatgtttaagaaggttttggaggaaccaaagtaaaaatgtcaccgaatgaacccagcctcatctaagcaattggaattttactttcccagttttttttttttctttcgtctctttatctataggcacagctgcttgaagaaaccaggcactgcaagagctttgtgaccccttgccaaataccagaagaagataagacctgcctggaactggtgcaaactggaacaagtgacccctagttacctttagatcatgaacatataattataatgctgaaatctcctcctctaaaagaaaatctctaccattttgtaaacatgcggtatatggagaattaagatattgggactgcacctgtgtgtctggaactccaccctgcatgcctacatctctcctggcccgcatttaactctaagattcccctgcctcccaacactctgggggcggggaatatgcctttagagcaagagctaccccttctccattctctggccattgaataaaaccctgattgctttttctttcaaaaaaaaaaaaaaa

SEQ ID NO: 8059 - DNA, 846 bp, Homo sapiens
  misc_feature (1)...(846): n = A,T,C or G
ttttttaggttccaagaacaataagcttccccttgtttttcctggaaaggattggtgaaacccctaagtttttggtttatgcacccaatcaccaaagtttgaccttaacaacttcattccaactcgctctcaaataattgtttactggagttttacaggcactataaattactcattttccccaagtagatccctaaaggttcatttgggcagacatgacatcagaggtaaatactattccccaatgttaaataatcataatattatactgcagatcagtactacagcagaattcttaaccaatcggtggggtgattcatgagtttatgggccacaaacagaatgcaatgaaagactaccaagatgcaattactctaaaccccaagtactcgctggcttactttaatgcaggaaatatctactttcaccacaggcagttttcncaggtaatgtgagttttacttaacgctttctttttgacctggaatgctttctttattatatatagcttcaaagtataattcatacaatctcaggctaataatgcattggctattagctcttttatttaaaatgttatctttcataagaatgtttataatttatccattaaatatttatgcctctatggatttattctcctcattaacacttgtaaacatttttttctttcatattttatcataataaatgtcttgctagaatcttattgagacataattgacatacaacaaatcgcacatatttaaaatgtacgatttgatgtcttgacatatgtgtacccctgcaaaatcatcactacaataaaggtaataaacatatctatcagcaaaaaaaaaaaaaaaa

SEQ ID NO: 8060 - DNA, 1812 bp, Homo sapiens
  misc_feature (1)...(1812): n = A,T,C or G
agagagggnannnngggggagagacagagnnacagaagaagaggagcaggagngagcgcacgcggccacagcggcggnnngcngcncgnacnatcagggcgaggcacngnacgaccgtcgggcggtgaagcacgacagcagaaacactccttcngcgnacagcgcagagaanacacacacagcgngcgagcgcagnacgaacaggctctcncgcgcgcgcagaganagncgcacacaacccgccgncgnnagancncccccgcagcgcgcccggcccgaccgcgcgccggcgnacagcaacccgacgcagagcananaaagcctccttcgtngcgcgccgccgcggnagagnagcgnagacggggccgccggccgcgacgagcgcgacgngcgngacnccntcanncccaaccgcgcagacgcgccccgcgncgcgcgngacgagagacggngacgngtcgacggaggagagagatcgangagcagcggcagatgaactaacaatcagcacganacagacagcntaccgtcncagacanccangantataagcaactcngaagagcagccctccggtcgcgagcgcggacgcnngcggcggacgnagcgggcangcgcgacgagcncagcgaggcagccgcgtagacgcgcagcgaggngagagtcgcnagacagcgcgcgncacgccagacagcacgagancgagcgagacgaccngncagccacgggcacgacagcgcgacgtgacagaaacgcgcancggcntggggganacgnccangcgagcgcgggacgcgccangccagcgacgcgnatcacgcagatngganaaatgtacgcgcactctgcgccaacatcatacanacgcaccnaccacccggaacanagcaagagtatcacagaantaanacgagagagtcagtctacgcacgcagcgcgcgacgcgcacggcacnacgaagagagacacacgagagcgcgtgcgccgtacagangagagagcagcaggatgcgcgagcgacgcggcctcgcacgcgcgcgatcgcgcgcgaggcgcgcgcgcaccacgcagcacgctcagcgcgacatancgctcgacgacgcgcaacntccaggnagtcgtagnantcgtacctcggcctactcaacgcgcatgaatacgccgtagcgacggcgcggcggcagtggcgccggtgagagcagcaggaaccgcgaccgancngtgacgacgagggcgcgaccgtccgcggcgcgcgagcaacacacggtcacagccgcgccgacatacaagntacgccaccaaacatgagangacgcaagcatataccgcgacaccgaagcaacacatcacaccgaacaatagaacaacgcgacgcagaaccgctataagagaagaagcggccactatagcggagagcaccgcgaccagagtggacggggaggaggggagcggtagccggggaccgcactcaccgaaggaaaacaaggccgcggagcggacacgaccctcgagcgaagcgggagagcggaacgcggcagcccggagcggtggagtggtgcgcgaggccgcggcagggcgcgatgggcgcgcggagcgcgccgcgcagaagtgggcgggcaacactgcgcgcgcaggtgcgcgcgcccgcatcacaccgcctagaagcccacggcacacgcgcgccgcgacgacagcacagcacacaggcggagcgggcgcggtgacggacggaaggangnagagtaacagccgaggacacgcggagtggtagcacaacgtgcggtgcagagagtcgacgaggcaggcagagag

SEQ ID NO: 8061 - DNA, 425 bp, Homo sapiens
ttagaacacagacacatacagaaggaagaccatgtgaggatgccaacagaaggtagccatctgcaagccaaggagagaggccccagaagaaaccaaaccctgctgacaccttgatcttggacttctagcccctagaactttgagaaaattattttctgttgttaaataccatccagtctgtgatattttgttatggtagccctagaaatctagtcatggaaaaacatagtaatacttttatccagacaggaaatgcagaaaggacattttcttttcttgaaatgtgtgtatgtatgtgcgtgtagccagtaattaaaatgaaataaaaatacgaaggcaatgaattaatattttaaccacgtcaatgcgtattttgagaaaataaaaaggatggagagttgcataaagaaaaaaaaaaaaaaaaa

SEQ ID NO: 8062 - DNA, 848 bp, Homo sapiens
ctgttttccctgacaagcagtgcatttactgcccacctgaggaagttctgaatgctcttaaaaaggttctggaatgcagctgtgaagccagagaagcctctgcacctctcacatggagttcattcaattcgttcttgtcttctgaaccccacatgccattttaagctctttcaccacagggtctgcagctctgcccctcagcgccaagccccgtgcctggtcaatcacagatctctgcaaacagcgattccagagttgatgcccagctttcaaaatgctcacagcaatttccctgcctctgtgaactctgaacaaagagaggtgttgctttttggcaaaggaggttgtcaagaagcttggggaaagaagcctccctctggcccctaacctccctgaaccttcctttgccccatcttctgcttctggaatattctggatttggagaacatcagttacacatgaagggagacatgagggaaccaagtgggtggagagacaagcagaaatctgtctctgcaaaggcaccgtctagagtctcctcgaacccttggggcaaaccccatagaccttcctttatcttcatccttcctggacaatctcagcagccgagacctcctcctctccatgcacagtgcccagcccctccttctcccattgctggactccatccagctagccatgtttgcttctgtggaaatttcccccacccaaattcttctctaggcccaactatcctggccacgaaaggagagtgaactctgtgtagaaccaactgaccctgctgtgcaaagacaaacctgcctacttagaggagggcgacccaccctctgcaggcccaggagcctaag

SEQ ID NO: 8063 - DNA, 821 bp, Homo sapiens
agaagccaggggttccatccccccgttctttccctttgctcaccccgtgggtgcgcgggcaccccacttttgctcacgagggtggcccgcttattggcgggagccgcgcgtgggtgtgtggccccccgggtcgtggtagctgggcccgggcctgggcgcacccaaattgtgtcgccgcccgtatttttattcagtgccaagttgcgcggccgccgtgcgccaggtttccaccgcttttatttagggccacgccaatacgccgcgccaggcggtcgccatgccgccagaccgttgacgataccgtgctgccaggacacgggaacggcgcctgtggggcggaaatcgtggggggggcgggttttgcacatttgctcggccccccctccccagtgtggtttgcagtccacacgtcgtctgttgcggtcgctgtcatacaatccctttccccgtaacacgccgggtcccacagggagaaggggtgaagaggaatattttatcagccgtgtacatatgtaaccagaaacggggctgaaaagcaaaacctcgtttccctgaatagggggaaggagggagggggtggggatgctggtggaggtggcagaagggacttatctctaggaggtcaacagtgggaacatgcggtgactgatttccaccctccgtcttgtcaacgcggggagcgtctgcacaaacggctgtttggggcacaaagtttaaaaggcatcttgtttttgtatttagatataagaacccaatatacatatcataggtgaaagaaaaaagaataataaatattctaaaaccaaaaaaaaaaaaaaaaa

SEQ ID NO: 8064 - DNA, 1335 bp, Homo sapiens
  misc_feature (1)...(1335): n = A,T,C or G
cagattgctcggatttcggggaacggtgtatcacatgtgttgacgttaataagaataacttttacatgtgactagtacgtggcacacacggcacgcctataatagcatatacagcagataactgctacatatgctcgcacataaccagagtaactcaacgctacgagagcaatttcaaaacactacctcggttcgtgtgcctttacgtcgccacgttcgtcgatcaatccatacgtggaataattgaaaaaggtaatgtgcgtcggatcgtctgccagttctctattcactacgccgctacatcttatcctctattatcgtaagtgttgtatatgtgaatcatctggacctctaatctacacctgattggtcgtaacccatacaacgtgattacaaatcatagaccgaatggtcgaatctccagtgcggctcccgcgtcccgttgtgggcactagtatacctcatggcggctcgtatcacgccctcttgtcgctcaaaccctccaccacagatgtgcgcatacgctatggcgcaccaacctatctcctcctcatatcgtaattgtctaattctctctgtagatattgcgcgtaacccgtgttgatttaagttcccctctctcatatctgatgtctaaggcgtcctcgcagttagagacgataanaacagtgacagataaaagtgtcgcgcggatgggtgtgaccgttgcagctcaacaccaacctactttgttaacgttctcaacaatgggtgctgcattaaatgtctttgagcctctcccccctcgtgtgtatatttgaataaaaaaaatactcacggtggtgaggtgggattagcctgttaatagctgaggtgaagtgctaatgtattgtgtatttgtatggcatttctgcgtgactacatacattaatctctacntctatatgcgctgcgtgtctgnaccttcgcatgacacctggncatgcattatcaccatgtgttgtaatattgtgcacgcgaactctgtgagtgtctcacaattatnacgtaaatgcaacatacactagtgcgtataggatgtatattaanattgtatgtaatatctgtgttcttgtcatagtgttgtctacaacntgtatctcgcgttgtgnttgatatatgtagtgttgactccattgtatctacttcatacaccatcgcacatgtcatatgntcctccttatatagtcgctgtagactatcagtcgatcgacgtagaatagtcaactatttgtggtgacaactatctatgtgtatgtctagtggtatnnagatctgactccatcatcgcatacatactctgcgcttctgatatat

SEQ ID NO: 8065 - DNA, 1135 bp, Homo sapiens
cacaactgaaccgaacaggggagaaacagggaatggacgggggttgttatttaactaaggacaactccacggcaacaccactggaatataaataacagaatgcgcaacacatctgcgcgatcgcagatcacctgcgtttcgcggatccacgttcagttctattacacggaccggctcgactacgatacggcggacaccgcaaagggcctcccaactaacgggcgcctggagtgttaagacgggtggccaaaaaaccgatgaaacactggtaggtcaataacataagaacaaaatatggtggtgtttgggcaacaccccttcgcacattctatatcgaacgcactacgtgcgaactccaccccaccgtaccgttacttacctcattccaccaacagcacacggcgtgcacggggggtgcgagaaaagggggctgtgttgacgcaataagggtcacccaaggcgtagcacagaatagtacgtcaataatgatgcgggacaagcgggggggtgccggtgaattaacgcaaaaccacgctccaacggcgggtgtgtgtggggtgacatacaccgggagtgcatatatataagtggtacacatttgggccgtgttgctgttggtctaagtgggataacgcgaataaacgtacggtgtgtgtcaccgctcgcaacacaaatcaggacatgggtacaagggggagggaaaagggagggaaaaaaaaccatgcggtccatccttgtctcaccctcctgctggtgtagtaagctcaatatgtaattaggatgtgtgtgcgaacccaagctcaagagaacacaggcggaggaaaaactaattggggcgattgttgtctccagcgggcgtactcggagaataaacaatgtgattctaatccgtgcgtaactcttgtgcccaaccattcgccatccctttgagtttcagtcgcgaaatataatattgatatctttctcgtttccttggactatccttatgttgtctaccttgtggacactaccgcgtgctcgcgtatctactcattatggtgcatcacacggaccggcaacacttggagagggggccacacacaacgcagaacaggggccgcggaacaactacacgacagtcacgtcacaggacgag

SEQ ID NO: 8066 - DNA, 1104 bp, Homo sapiens
  misc_feature (1)...(1104): n = A,T,C or G
aagataaaagcgcagagccggccaaaaaaaacaacaaaacaagcgcttgtgtaggggaaccagncgncggaccttgaagggcagcaaccaanaggagcgagcgcaacacgaaggaagccaggagtggaaccggcccggggaacagccccagcccccgccccgagggccgcccggcgcacgacggacgcgcacacgagaggaggaaagggacgacgcccaaccgagagaagaacccaccggaagaagaaaaagcagaacaagcaaagcgaacggcggcagaaagggcgaattttttggaacccacgcgtaacggagggccgagagncgagaaggggaggagcgccagcggccgcgcgcccgtgcggcggtcatggggcgcggggccgaagggcgcacagagggaaagaagatacggagggacaagagggcaagggggctcgccggaggcgtgtggagaantcgcgggctcagggccccacaggcccgagagggctcgggaggccnccaacgcccggaggcccgagagagaccgaagggcctgggcagctcgagggattcaagagccacaacagagccgaccggcgagagagttacgaagccgccggcgcgctccggagagcntaaaaggacggcaacagagacaatagcgagaataacggaggagntcacggggcgcaagggagcatcgcggacgcgacgcccgcacgacgacaagagagaccaagagcgacgctacaagagagggccagcgcggagacaaggcgaagagagagagcacagaaagggagcacaggaacgagcggaggccagaggaggggataagggcctaggaggggggcacgagacggggcnacgaacagggccgaggagagcccgcacagagaagaagaggagaacagagaccacagaaacggagagcagaaccccaaagaaagagaggcaagncagacgaacaacacaccacaacaaacaccagaccaagcacagcagagggcctcacggagtcaagaactacacgcgccaacagcgggtcactaaagagcgagagccaggggcacagagcttacagaacgaatgagagttccagaagaacaagaaggcaga

SEQ ID NO: 8067 - DNA, 1259 bp, Homo sapiens
  misc_feature (1)...(1259): n = A,T,C or G
gcaanntggggngaggaaaggggaggcnggnnggggggcgggcgggacggganggacgcaggngagggggagagcagagnagtgnaagagggaaggagncctcacgcgagnaggaaaccaagagaaaagaaaaggccctcacggacggcgaaaaaacacgangnangagagcggagggagcccgcaaggaagacgaggaagaggcccttcgcaggggaggagggcgagacgcgcgggagcgcncacacgcaagcgacggccgcagcgcggcaacggggaggggagcaaagagaacaaaaccgacaacaacaagagaggccacgacgccgggcgagagcgccggggccgggcgaaggacggccgagaacaccagaacacccaccacgcgcgcgccacaacccccccccacccggcgcgagggaagccgaaaagaagggcaacgccccccgcaaaagacggaagaaaaaaaacgaagccacggccacgcagcaggaaaggaagcggccgcgagccgggagggggaggaagagaaaggggaagagaagaggacaagaggaagcgacgagacggggaaggagaggagaaagagcgcggcgaagaaacagaagaagagacgcaaccacccgaaccgccccgcgcgcccacgacagccggggaccaacgccgcacagcaaccaccgaggcacaacnaaaccacagcagccgagcggagcggcacgggagtacatangagacacacgacagcgagagagagcaaacgagacaggagagagcaccgggaggaagcaagaaagnaaacgcgagggaggcancaacagagctagaggagagaggaggagcgagaggacaggagagcgngangcgaggagagagagcgcgcgaggacaaggagcgcaaagccagaacccgcacgagcagaacgcaggaccggcggcgcaaccagaacagcacgcgcgtcagaagaagaagaggagcagcagacggaggaagagacgagacaaacgaccgaccgcagaacaacngaggagcaggaagagcaggagacgagagagtgagcgagacggacgcccgagacgcacgcagcgcaccgcgagcgccacacagcgcgaggcgacagacagacgagcaacgcagaacacggcgaccacgcagcagaccgaactgaggacacgaaccagatacaacaccacacacgacagcacacacggcaagacgcgcagacagagagcggcgcagaccacgcgagcagcgagcgcggg

SEQ ID NO: 8068 - DNA, 817 bp, Homo sapiens
gtcttatcatggcaagggggccagcaataaggttattctcctaggcaggttttggtctaggaggccactccctaggttctagactcctttatgctgcctactgtaaccataatccacttcttctacttgttattatggtatggtctgtatcactggaccagacagattggtaccagttcacagtaagcctgcttcacaaatctgtggtttgtgaaataagacaaataaatatcacaagtaaattttgtttttcctacgctctctactgctacgtagtgacacgtaaaatgatttatatgtaaagttttatgtaaatgtttataaataaagtttgtaagtacaaactttacattaatattggacttaacagatttaatcatattagaattactgcaagaggtgagtaaggcaaatacattagaaaatacacaaattactctctttaaaagttttcctatataactatcctttaattggcttctgtatcttttcatatgaatattaatgtatatttctactagagtaacttaaaatatttggattattgcttttgtccatataataaaatctagggaactagcaatctcatcaagatttgtatgcacccatcaagtgacttcgaaatcttttttcctccacctttctctcaaaccgcacatacatttcagaaaaaaataaaaatactcaactttgcttctggttaggatgcataagtgaaaaaccaactatcctactattacaatgaaagaataccatgtaattcatgcaatcagaactttaataaaacctatcagagagctaaaaaaaaaaaaaaaaa

SEQ ID NO: 8069 - DNA, 1496 bp, Homo sapiens
  misc_feature (1)...(1496): n = A,T,C or G
tgggttaatatctgatgtgttcttgaattctatgtggtctaccncagctctagtgatgcgtctctgagtataagtggtatgttatattatacatgacgtgacttattatnacatagtctgttcactctctcgcattattggcgtcaactgcgacgcgactacaganatgtactctctacatggcttagccatccatctattcacgactgcgtacgcgctactcattagcaggcatagttgatcgtatgctgcctatcggcngcggtgccnaggtgtcatattataacattctncgatgacagtcagtctcatacactatctanatcggcgcgtcaacagattcggcgcncgggtgtaacattcagacgactgtatccgtgttatngccgantcgntaattactcgcactncgcgccgcggccaaccaatntatactgcagtgattgcgtgcgtgagnagtgtatgaggagatgtgactcaaatatgtatacctacaacatgctacacggaccgtatnatacggagtaaacaaccacgaacgttcgtctgtttactcgatactnctccacaatatcgttgtgtatgtcgtccgggggnaggtctacctcgtgatatcacactgagtgngctcgatactactattgtgtgtgcgatcgtgcgtgcgcggtaatagtcgcggggtgacctcagcgcgacgggcggaccacacacacaaacaggggtgataacaaaatggacgcggccctggcagtccacactgtacaaactaaataacaatcacgtcaggatggggtgacaaataccgagtgcgaaataaaacgcactcaccgattatgtgagcgaggcgcggtgctctgtaagagcgctagctatatccgcctacatacatgggtgcgtggttgtgcgttatctgcgtagataatatattatatctgtgatggcgatactgatattcttttgtacgtgtaattgatcaatacataccattgacataaagtggtggggcttggtgtacatacgcatctccactcttattacttttgggtgtgaacagatgttgtgtgtgtggtggttattgaatgtgtaaagtgatacataactagggtgtggcgtagcgtcattgttttactagttttatgacatatgtataaatcgttgaaacgcatacaatggttatatatagggtggttatacgtagtgtcatcagtgtcttggcgtacactgtttcctgtatattgtatatggaaagggataattgttccattgcgttacctcgttatcatgtgtgtattcttaatgtattgttgacggagcgcatgttggcgaatatatctagcaggctgttttgatcaatatttattataatngncgttagacatcacggtagcgtcatatactatcgggcgagtgagtgtcattacagtcagtgtatataacaatcgcgctgggggngcataagtatcacntcaatacagcgacggcaagcagngtgcgtc

SEQ ID NO: 8070 - DNA, 1716 bp, Homo sapiens
  misc_feature (1)...(1716): n = A,T,C or G
cccggccangcgcgagctgcgccgcacgagttagtgctgttgatcatattccgcgacattcggctcgcgtactgccgcacacgcttatatcgcacgantatttagtctcgaccggcccgatcgcgctatangagttcgcggcgcatgccanaccacagccgcggcggctgacggagacggagtgtcgattatttcataagtacgtaattctgatacagcagcgttctctgtatntcttagagctctcacacgcaccggttcaccgaccgccggagtcgagccatattattatcaagtcacgcaccggctcagtcgaccatgcatctcgataagcagcgcactgcgggaccgtacttcacctcttcccaccacgcgtccgcgatcgtgcccgcgtaatagatgatacgtagatgctgtgctcgttgtgcacatatgcctgagtgtagactcacgcagagaaccgcactcgctaggtagatctttcggtagtttcgtcancngcattcgcgacgatnatacatggcttgagcacgacaacacggacatactgtcatatacgcagacgcagcagcagttgcgagcgatgccaaagaacgatgcagcctcctgcttgtatcgtcgtatcgataagcagacacgaccagcgcagcgtatcaccgtcatactgtcgagcgcgtcactgaagtggcgcatatgatgctgcacagttagtccgnatgtaagaactttgtagacagcgatatgtactcgatatcgtgctcgctgctactggcacgcctgacgtaccgtgcgtttctcgcganaccgcgcgcaatncgcatactagctacgcgtaccgaggcttatctgcgcgatgtacggagtcagatcctatcgatgcgcgntgtgtgccgcatcctttactgtatcgcgcgccagcagtgatctaatctgttatctcactgccagctagcacatatatntctcataccacacgatatataacgagtacgcagactattacagcggntggcacgagcttcaagatgatatcgagtgcatgcgcagtgtagactgctataccgttagtccgcgctgatgtcacagactacgtacacgctgtcgttataggagacgcgctacctcgtctntacgtcgatnagtnctctacganccnagtacagcntccgtgcgngagacatantnttgctcncgcgtgaacgatgtgcgcgcagcgcatcgcgagcaggatatagcatacgangtgctcgtcgtctngatatcgacggnctcacgctcgnnacatgcagacntcactaacattcgntcntctgnangcatgtcagacnacactgctcgcgctnagagttcgcacgnatcacgttcntatgaccgagcnacaannagtcntatgctgctgtnnagtnctacgctnagcgatgtgttcancgactcaatctgacgtcatngtctgtctgctctcnnttgacgncagtgacgntgacgaacgttagnctatatgagtgcggatgtcagatagtagtagagtntatcacnagtatacngtcgtatgcgtcactcacatancgccacacgatatgacgaccntatagtatagagtacatgacagtctgtactgcagnnatactgccagcangcnattatnactatntatctgactcactatcattatcgctcgacgacgcatagtctcacnacgtcatntctagcgctagg

SEQ ID NO: 8071 - DNA, 1090 bp, Homo sapiens
  misc_feature (1)...(1090): n = A,T,C or G
ccgcaaccccccccgagagcaagcccccgaacccaaagcccccacctcccgaggaacacccgcggcgagcctcaacagagacaaccacccccgcgggggggaaggggggagagcaaccaagggagagccgcggccgagcgaagaagaagaacaacacgcgacgccgaggagacgaggagggaaccgccgcgcgcagcgacgcaccggaggccagaagcgcaagagaagagaggacgacagccgggggacggcgcgcgggcgcgagaaggaagcgcacgcggacgccaagcgcggcaccacgggcgagcccaagcgcagggaaaggaccgcagggaagaacgcacccgacgcgcggacaccgcggaggggcgacgagcgcaaacggcgcgacgggagcagaaccggcgcgggacggaagacgacacgcacacgaacacggggaaagaagaggcagcgcagacgagacgcgcaatgagagtacagcaacgagacgaaaaaaccaccgcgcgccacaagaggcgggggcacgaggaacataacgcagcaccagagagaggagcagnaaggacagagacgccacnaagcagaccggcggaagaggacggggcccgacggacagcgcgacgacgcgacgagcggagacacgacgagccaancgacgcccaggccgcaccccgagagccgccgccaggagagagncagcacaaccgccgcgaagacgcgcagacaagcccggacgacacgcaccgcgcaggccgcgaccacgtacccccacgcggacccggcgcccccacacgcgcggccgacgcgagagcacaagaacacaccggacgggccaacccganagagacgacgcgcagacgcccccgaaaaaggaagaagaggccagggagcagcgccggccacacagagagcgcggcgagccgcaccagcccgaacggaagaagcgggaggagcagggcacgcacgggcgcgaggccacccgacgaaacggcgccaacggagagcggccgacacacaagcgcagcggccacgcaccggggcaacgaggccaaaccgcccgaaccccccagcacacaaaaacaaaccg

SEQ ID NO: 8072 - DNA, 1174 bp, Homo sapiens
  misc_feature (1)...(1174): n = A,T,C or G
acggtacataggaccgaacaagcatatttacaataagcggaccaaacaccacagaanggttcgtgataagtnnaacttccgccncccnggnngccgtgganagaggggnacaaancgannnagnnngcgngggggcgccgcggaacacaaagcacgacccgcccttttcagaaacagaaacaagaaaatcgagagcgaggacaccacgaacgagaaagaaacaccaggaggaaacaccggaggaggagagaaaggacgcgacggaacgcagaagcgacgccgccacgcgccaccgagcaacttggacgcgcgagcggcacgagacaaccccgaacgaacagagcncagaagcggggagagcagcncgcgcagggaatattttttttttaacgaccgggcganaagaggnacacggggncggaggggaagagggaacagagaagcgccgggaagaggcagcggcacgtgggagttggaccgcaagaagaaggaagaagaaagggggccgagcgacaacggggtaaagaaataaaaacatgagtcgagaggtcgataggtgaggacgccccgaacccgcggcggaatgtaaatagagccacaccgcacacagaggaatagggacagcggatgtagagccgcaatgtagagcacgtccgcgcctcacgcaggattagagaaagtacaacggccatcaagtaacacagacgaacaagagcctcagaatcgccacgaaagcgacgcaacgggcgcaataaggactgagaaggacataagaaaggcaccaagcgcccttagaaagagagaagaacaagaagacgaaccgaaagcttcagggaccccctgcgggtaaagtgccgcggagggcgggggacggacgaggggtcgatggggacccacggagagaggccccggcgagaagaggagaggatgcaccccgcgtagacgcaggacggttggaagcccgagtggaagaagggagagtgtagaggttgagaagcggctcaaatgaaaaacctgcaccatcaactgagaacacgacatcccaccagataaacgtagattntctgcagacnagaggagtggacgcctagacaacgcccgcgctcaagcagaccagcacagacacaggagaggctaccagacagatccgcgaaactgacccgatgacacaccg

SEQ ID NO: 8073 - DNA, 1415 bp, Homo sapiens
  misc_feature (1)...(1415): n = A,T,C or G
cccactgccccgctcccgcgcgagtattatatatatgtatgctgccgtttgtccgtgtctgcccgcgcgttcttatatcgcgatacctccgtcaagatcgnctcgcttcttaggtacgctgctgcacaatccgcctcggaaacgagaccacgcgtgtggctctatcggcggtgaagatttgtttctctntctcttttgtctcactcgtagctggagaangaggagtnctaagcgcacacaacataaatctanacagacaccggtatcggtgcggctgtgtctctttcttctctatcaacacagaaaaaatgagtcttcttgttatgaatggagcctggtgtgcgatccatcctcgtctatctcttggtgaggagacgacagtccagcgtgtgacacggagctacccttgtgcgcagtgaataagacacgacgatatggaggaggntgcgctcgcaaggatcaattataatcatgtgtattttgtgcgctgatgttccgcacgcggtcctattcgtgtatgatgctgacacaacatacgtcagcagagcagcaacgcgtgtcgggatagtgatgattgttgtagtatcacatacgtacctcatgctgtcagtacggtgatgtagacntntgttgatgtggtggcagcgtgcacgcgccgcttgngcgagccgtgtccgtcgtcgtgtcgttaacttgctgtcttcgagcggngtaacntgtttactcatatcttatcatgtcagcgtgccctgtccttatacnctgtgcttcttcagnactgccgggcgcacagatagatctgacatcgcgcgcgcatcttgtagcgttatacgttgcgcacatagatacacctagtactaggtatgcatactctattgtgcgacagttagacatcggtgcgtagcggacacccagagttttacgtaacacctgctggcgcggggtgacagcttttcgtcgcgacgatgcgaaatggatccaatcgtgcgngtatagtctcgttgtggctcgatcatctcttaccagagtccgttgacagcggtgtctcaatgttgtgaccgggcgaatgttgaacgcagagcgaatatccaccggagagatacgcggttaacagataattcgacgcgtgatgcgcaacgcgcgccagtctnacagctatgatangtcgatattggtcgtctcagcccgctagcatctcagnatcaggcgcttaatacgccggctcgccacttcgaccacgtgctgttaatttctttaccgccgagacggataaccgagccgccagtcgtattgttgccagccaccctgcactccgcccgtccgcaggatctatggcccacagtgcgcagtcaagtgagcgctctgtgcatgtcacacttcatccgtcgtccgcgctgctctacacaactccgtct

SEQ ID NO: 8074 - DNA, 1240 bp, Homo sapiens
  misc_feature (1)...(1240): n = A,T,C or G
aagaggggaaaanaagaangaangnaagagagcgggcgggggggcggggagganagcaaaagacgaaagaaaagataaanccttcagaaaagaanaccacacaaaaaaacgcgctcnacacggaggacgaaaccacgaaaacacgccgcagacacgacccgnagacacacgggnanngggctttcgcgccgaggggagacgcgccagagagcacagaaccgccnnccccacaccaaacccacgtccaccgacccgaaagtcccacagaacgagagaaaagggagcagagggacgagcgcacagtaggagagcgacgcggagagagagcagggaggaggcaggcgcgcccgcgcaccgactccgggcggccagaagccacgaacgaggagcggcgagcagaggggaggaagaacggcgacgacccaaacccgcggatntacaccacgagtgagcgaagaggggagaagaggggagcagcctcacccaccctcagcacaccccgtagagataacgaaaatgaacacggggcacgccaaggcngcgcgtgcgtgtcttatcaatagatgacagagacaagcgcgaccgtggacacacacagcaggacgatcaatagactaatgcacattcaaccccactccccacccacacaccccccacaataatacacagagcgcacgccgtcgctagcggccgcggcgtccccgtcgccacggcggtgacgcacgcgcaccccgaagagacacgccagacgacacaacactgcagccgcaccacacaaatcactgganacgatgaaccacaataatagcacatcacacgacagagcgcaacacgaaagntagagataatgcacgacgaaataatgacagatcgatggagtgcggcggacgagtatagacaggaggcgcaacagagcagagcgggagcctggggagcgacgtacgcgcgcactcggatggtcgacggcgaggcgatgggagagcgcgcgcgttcgccagtcccgcgacgcgacgggaatcgctcggaccagtcgcggcacgaatgcgctcatcgggccgccgacacgngtcggccaagcatcgcgcgtactctgcgccgcgtcgcgcggcggccgcgcgcagcagcgcgccacaacctcaccagcgcnccacactacgtcacgcgagccatcgangcgagagcccgagagcacaggtaacgcgacgcgcaagctctctcgacgccggcgtggcggtacgcg

SEQ ID NO: 8075 - DNA, 605 bp, Homo sapiens
tcccgtctggagaagcccaccgagtgcaggtgaaccagggaggcgaagtccatagaaacagctgtcttgggggtccgggaagagtttaacactggaatcacatctgcggaaaccgggaactggaagcaaattgaggatgcggccagaagggaaaatcaagtttttcaagcaatgaggttcggccttggcctaaccaatagtttctaccactctccgcacccctaaaatttccatctattcatctggttccagaaacagattatccagcgtctttgtagatctacgaatatcccttaaagtcgggtgcggtggttcacgcctgtaatcccagcattttgggaggccgaggcgggtggatcacttgagatgaggagttcgaaaccagcctgccaatatggtgaaacccctgtctccactaaaaatacaaaaaattagccgggcgtagtggcgcacacctgtaatcccagctgctcgggaggctgaagcaggagaatcgcttgaacccaggaggcagaggtcgcaatgagctgagttcgcgccactgcactccagcctgggcgaccgagtaagactccctctcaaaaaggaaaaaaaaaaaaaaaaaa

SEQ ID NO: 8076 - DNA, 1294 bp, Homo sapiens
  misc_feature (1)...(1294): n = A,T,C or G
aagagaaataaagaggaaaagaagaagaagaggataagaacggagacgacggcggagcancgaccgacagacaanagcagaaaanagaanacacaaaggagaaaaagnctcctcaagaanaggggananaccacacaganaatcgacacancgggcttctagccgcggagncgcggncanagcgccanagannaacccggcggcagaagacgacagacgccagcaggacgcgagaagcaaagngaaattcattcgaggcggcgcggagagacgncncaagcgcgcgnacgcgcgagaaacgccaaagagagtcacgtagcgcaggcgacacatcacgcgcggtggagcaggcccgccggctcatcgcggaggcagggaagcggaggcgcgacggaaagaggatgcgggagcgacggcgaggggaacgaaaaaacggggaggaaagcgaggcgatacggaggggcggcagacacagggcgagggggcgaggggaggaagcaggaagagagcgggcagagggccaaccacacccacacccaaagaaacccccgcgcaccaggccggagaaaaagccacaacgtgaaatagaacagacagagaaaagtacggagaggaagcacacgggaagaagacgcggacccttaaaatagcgctgggtcgggggccgatggggcgacgacgaatggcgcgaaggggaaataaaggcaagacatgacgaaacgatgtccccactgtttgcccaccagggggggtgggacggagagaaaagatgagactaaacgagtgcgcactagcggcggaagaagacgcgacacaggaacagttacgaaagggaactgcataacaatgagataagacacgaagaagcagaagtagtatagcgaacgaaggcggacaagcatagagagaaggcgagaagagttaagtgaaaatgccgagcaggagatgagcaagaactacagcaaaaataagtcacggacgcgaagtggnggtagttaggacaagcggagacaagcgcgcagcggagagagataggagacgcagcgcaagaacgacagacagacgctacccacgacgacaanacacggacgccatcccggccaggaccgcaatccagagaagaagagcggaagcgggagcaccaagagcgatacgacgctacttaggagcatgagacagaaacagcacagacagacaaatgaacaaaacgctaccaaagacgaagtcgcggtcaggccgcggccaccgacaggcacagcgcggaaagggaggaagcgagaagagggaacgcggt

SEQ ID NO: 8077 - DNA, 828 bp, Homo sapiens
cgtcaagaggtacaaaatcgggcacaccgcgtaacattattcttccgtcgtttgcagactggcaaatcacactgtcaagctcgggtgagggctccaacaacaacatccattgaagtcccaccatggtactctcccacgccaatgggaaaataacgtagcaagagacacacagtgaaattattgcccaaaaagccctcctttcaccaactatattaaggaccccgtatggaaaaagcccccctatgtgcagtgcaaccagttggctgaagtccttatacacaactgtcttgggggccaggaagagtttaactctggacataccatctccggaaacccgggaattggaagcaaatttgagaatgcggccaaaagggacaaacaagattttcaacccatgaggttcggccttggcctacccaatagtttctaccactctccgcacccctaaaatttccatctattcatctggttccagaaacagattatccagcgtctttgtagatctacgaatatcccttaaagtcgggtgcggtggttcacgcctgtaatcccagcattttgggaggccgaggcgggtggatcacttgagatgaggagttcgaaaccagcctgccaatatggtgaaacccctgtctccactaaaaatacaaaaaattagccgggcgtagtggcgcacacctgtaatcccagctgctcgggaggctgaagcaggagaatcgcttgaacccaggaggcagaggtcgcaatgagctgagttcgcgccactgcactccagcctgggcgaccgagtaagactccctctcaaaaaggaaaaaaaaaaaaaaaaaa

SEQ ID NO: 8078 - DNA, 144 bp, Homo sapiens
aaggagggctttttcagttgacattcaaaaacaataaataaaactgaaagcttgttataggtctatgtctcattattcaaaccttcaaattttcttacaattcccgttggaacgaaacccggtggtaacccagtatttttttgc

SEQ ID NO: 8079 - DNA, 875 bp, Homo sapiens
  misc_feature (1)...(875): n = A,T,C or G
gggcgccgttggggcgagggggcctttttaatcaccaggttattagtctgtgctcacttcccatcttggataaaatttcaagtggccgcacgggggtgttttaaaaagatccaccctctctttaacaagaaaaaaattccaggattggtggtttggtaggtgggttgtcttttttttacttgggaaaaaaatggtccggttatggggggggggggggtctttttggggaaaaaaatccccggggggtattcccctcgagggggaccgtgtgggggtaaaatgcaaaagagggtggaggtgtacctccttttgtaggagagaccaccaacgaggggaggaggggggagggtgaatattttgtttttggtgtatgggtggctggatagatttattttgttattagatcgcgtgggagagcaatggcagagggtgcgaatttgatgacaaatcgggtgatattaacaagtctgtggtcctgttgtcgttttttatgtgctctgccttccgtttttatggggggtgtgtgtgtgagatgagtcgagtatggttttgtcttatctcggtcgtgttgtgggtgagtggtgactgtgagggtagttggggcggacggttgactatgtttgccgtcgcctggtgtccggatcgtggtagtggacgagggaggtaggatgagcgtagcgtatctcttgtatttagtttaattagcttgtcgataggacgacttacccgatttgtaagatatctgatatcatctcatcattatatgntggtcgggtaaaatattgatacgggttcaggggagtctatgttgagacggcgacgtcgctcaacggagtaggtaaagagtaagctgactgcgtgttcctctgctcgcg

SEQ ID NO: 8080 - DNA, 527 bp, Homo sapiens
ctccttaccatcgaatgttttcgttgcgaaagtaacacgaaatataaacaacgtgaaaagaagtggtgcataactcgactatcttctatactcatgaatattacgttgcgcattaccaactaataactgtccagataaactaacaatcactatcaagatagctatccattcccacaattttgtatatattactccagacaatatcatcccgatagcacctacgcctggtgcccgccaatacgacaggtgctatccattgcaacagtgccatcattgcgcatctaatcaaacataccaatagcaactcactatatacttatattcaatgatccggatattctcactctcatggtcgcaacgccctggtcgcagtcgcaatctataaatcactgcacatacattaaactgatatatatacaagcgcatctggatggtctatacaagcatcgatagtcactgataatagtaacagaataaaggattctaccattgcatgtattctccgtcgtgtactacatctcaaccgc

SEQ ID NO: 8081 - DNA, 1741 bp, Homo sapiens
  misc_feature (1)...(1741): n = A,T,C or G
ccggatcgctccgccgcgccgctggtatattactgaatagcgacgacgntgattcacataagacacagccttccaattacgcggagtaatgtagatctgcacgccggncctttnttgcgaccgacgcgacgcctctaccgagacgccgcgccgtcggcggtagaggagagaagtattatacatcatccatgctaccacggacatcgantgtgtgtagatgactatctatatggtggctatgcacacgtcgtggcgctgtgtggagtgtataatatcgcggcggaacgcgatcatgtgcgtcagcatttgacatgctctgcgtcgncggataggatcttcgatacacagatatacagatgttgtcgatatgaatggttcacttatagagtgatgatagtgtatatatatatgtgcgtatancgttgcgctgacatgatcgaagacgtgtgggaagctgggtgaggtatagtgtagtagtcgtatttagtcactcangatcagcgtattcgtgatgcgtgatagaagcgtcgggacgacgcttacactactcgagtcgggcgtacggctccgatacgaatagatncgacatgacaactcantntccnaccacagttatatcaagcggatgcaagtagtgagcgctgtagtcgacncngctagtatattcgcgtgagttgtgatagtatatagcacngagcgcgtagcgcgcggnagtagtagatctgcgcgtatcgagagagtnctctagagtgnangatcgacgcgtantcgagatantgcatgataatatacgtatcgcgcagcgcgcgtagacgaacgacgtacggtagacagagagctactcgacgngtagncgacagtagacgttntagctcggagtacgcgacgatcgacgcnacatgtcgtgagtgagtagtgcgctgacacagctcagatcgccagcntactgctacatcacgactgngntactagcngcgcagtgctcngtgtntcgtacncgcgacacgantgatgtagcntagtgtgatcgcggtcgcgacgcatcagtgtatgtatgnatcgtaagcaccctgcgtacgcgncatacgctnancgacgagacangactacccatgacagcgcgctcgcgcgcactgactacgcacacnagcgacntgactgattgttnatctaatatatagtacttgtctgcgtgatatagtgtatncgagatcaatcaggcactatatcgcgagtacagccactagtgcgttggagctacgcggagacgagagtgcgaagcgcgagtcagacgtgatatgcgtcatgtncatgtgattgcgcagcatcatccagcgatatctntcgcgtcanagtaccgcactctcacgcagcgcgtgcagnagtagatcgntgtacttaggtgcgangntgagagcgtatagtgcagcgatgatagcgcctgatgtatctgatgagacaatgaggatcaccgggcggcattcggcgagcatagcacacatgttctatgtatatactgtacttactntctgagacgacgacgcaaggatgatcgctcgcgcgacggcgcgactgtatcntagtgtagctgatcgacatctgtcngttgtgagacatctcactcgcgcgactcgtgatagtactctagcgcggttgttcgatctatgtcgcgagatcacntcacattatagacagcgatatcgtagcgcggcgcgctgattagactcgcgatnctgtgtgt

SEQ ID NO: 8082 - DNA, 932 bp, Homo sapiens
  misc_feature (1)...(932): n = A,T,C or G
ataaaaggttagggaaaggagnnnggagtnnttagnaattaggnattttnnattttnnattttgaatnnacagnaagagnnattttnnaataaanatagttatgaagatgaaggtaaaagntagattatatagaagcgaatttttgtgctgttggtgtaatgacaattttcaaattctgtcattatcaccgtttactttctttgcagctacccagattatattccgtgatccatcgtctctgtccgtacctttgacgncccccgcctccgaccccgccacccatcaccgctttcagtgacccgccgccatctgttcccttttaaatcttttttttgttagttcataattctctgatttctacctttnatttgggattttttatactcagtactccctattccatagtaattcttttgttatttttcgatttctaatagccgcaatagcagacgaaacgaaacgtaggaggntcagtgatgccatttcgtattttattagaagcccctcgcccaccgctctaataccacctcgtcccaacgcatgcgacaacccctcgcgcctcctctccttgtaatcatgatgtactctttcgttacatttttatcattctcacaccttccnttgccctgcagcgcttggagtctttatgagtgtgccctctcttgtctcccggctcttccacatcgatcgtttcaacatactgttcccatgtccagctccccccttgttgtcctttactatcttacctcccccccgcctctcctgatgtncccgagatggnaccgcgatatagcaacatattccctctactcccatagtacatcctacttgacatactatttanttatagcgaacatatatactgttggcaaagaacattcagaattctcaataaggcctacaggttgatacgacccagaagattattgat

SEQ ID NO: 8083 - DNA, 294 bp, Homo sapiens
tcctaggcttctttttatccttgctgcctatttgtaagtaataaattcacttttcctgacattgtgtgagtgctcagtctgaccaagctcaagcaggtggtaacctgagctccttccagatttagaaacctttgcactctggacttttgacagtgctgcatttgcagtggacaccattgatgaatgatacagtttttctcttggggataatgaacaggcctgctaaccattttctatacaaggcaggcttcccaagcttcatgttcctcagctgtgtaaaaaaaaaaaaaaaaa

SEQ ID NO: 8084 - DNA, 1226 bp, Homo sapiens
  misc_feature (1)...(1226): n = A,T,C or G
cgacgccccccccccatatgtctcgacttcccgtttccgtcccacgccctcatatcgcgttatatttataccgcggtcataatactgatcaccccaccataacgcacgcgcgtgcgacgattcgatatttttctcctcatacagcgcatccattttttataataagaacggattgtccgacgcgcgtggcgcctgtaattataccacaccgaccgtaagntaccatgatggtcataccggccacccgaagtgctccgccaccctcacacccgcgcctgactgaagtcagatattttttctcctcgtccgctacgtctcatgccagaagtacgatagcgtagacttacttcagtcggttagtatattcgcgtttcctccattactcgtacagacactataataccactgtggaagagattgcatgagattgcgctacaacacgacgcgcttaacgtcactcgcctgccggcgcagtcgactcgctagtcgcccgatatccctcctcacgttacgcatgatgacgcgcagcgccccggtaacatattctgataatatgtaaaagtcgctgtcttctttacgtcccactcccactagtcacttctacttgtatcacatcatgtctcgagcgctgcgctgtcgtaatcgcgtacttcgttataactgattgctgagccgattcggtgcgtcgctatcgagctgcgacttactttactatctcacatacagcggaatatttgattctatgctgcgcgaagactagcaacgtataccgagggtcacgtagtaatccatcgcgacgattcacactcatgtctctcattctccgttcttccacgcgctgtctcctgttgtcgcactaacactcctcttcttccgctgactgacgcatcagcagcgcgcatattatctcagttctgtcgacgagatccncgagttctcgacaagtcgccgcacgccggcgcagtagtgacgctggatcgtcgcgccgacagtacacaccgttctctanctacatgaccttgcatgtgattacgcgtctagtatcgattcgcaggtgtctctgttctatatatcattcgacgccgcgtagtatgtncagccgctcgacagtactatatactaataagcgtctggcagtccgccgcatggactatcacttccaggaggctggcgcgcatacacattaagatcgatagttgggcgctccaatgtactcacagcatacg

SEQ ID NO: 8085 - DNA, 1829 bp, Homo sapiens
  misc_feature (1)...(1829): n = A,T,C or G
ccagacttcaccgctctcgccccgatattgtattcagtgcgcgtcgccgatatncgcacaggacgaccgcctccagtgtggcgcggcacacaagagtgaggggcacacgnccttttggtggcgtgagatcgacgcccctgtatctgaatcggggcgcgcgcgaggngcgagcgaaaggtgaggtgaatgtgtgatatacctanatcgtcaccccgcagtcgataagtgtctcatgtggagaagtggcaactaacgccgagtacgcagcgcgtgcgtggcgccgcggtcttagattgtataactgccacgtaccacantnccacatcagaccgcctaacatcangacacactcgctccgcgcgaatctgagcctccctactgcaataccgtctcgccgccgccgatgcacaggtcatactagggatgaacgacgtgcgatcgacagagtgtactcacnactacggtgaagcacatcaatgatatacgcgcgctcgcaacgagtcgagtactgagttanagctcgtgctatttatattcgcgctcgcatgacgcgcgcgcggtagcgagctgggtatgagaagagagactgccacactactcatgcantgtgcggtagcctacgttcgtgcatgatgagcagtagcgagcagctgctgtagacgcgacatgtcagacgtcagcacaccacatacgtgtacgtgtaagcgcaccgtacacgaagacgagcgnaagtacgcgagcatcagctctctgagagacgacgncganactcacagccgtcagtctcggcgcacgccgaaccgtgttcgcgtacagacattactgcagtacgtagttcttgtgacttgtgtatgtcagtctgcattgatgcactataccatacgcgtgtaacacacgctgaatcanacgtgacccacngatgatcagcgggcgtgcgtttagantcgcgcgaccgtcgtatgatcatgctctncgtcgcgcgctctatctcgttagccgatattagttgntgcgtcgtcactcatatccgtgatanagacgctccacgccactacttatatctgagtgctgcttgacgagcgacatcacgaacgagagcgaggcanacgcgacgttgagacgcgntccgcacacctctgtccgtagagtcgcatgacgaagcantacacggncgtatncacgtacggtagagcgatctnatccagagcacctcagcgtgatcacgctacgcanacatgcatctcgtatcaccgtcagggcatcgcagangtgncgtatgtagagcgtcgagngctattcagcgnactcatgnagagtcgcgtcactatgtaccgcacgctatntacagatncggcgtcgtcgcgcgaatgacgtcggcngcgcgctcantgcacagantcatgatgatcgtctagtctgcgntgcgcgctctgtgtctgcgcgtgctcgcagcgantagatatcgcgatctangtaatcaaatgtcatacagcagngctgtgtgcgcacgacgcantgcaggcgctgtatatatngtntgacatgactagtgtgtactgtnacacgtcgaccacacgangtagtgatcgcatgcagtatctctcgtcgtngagtcgatctactctgatcgctncagtcgcacccgtcggttgnagcggacggcgcnncgacacgcatatcgagtacagagcagcgcacagcacgncgcagacgtnctgacgttagcaccntgacagcagtaatcgctaagnctncaganatagcancgacgatgcgtcgcgcatctgtacgacaccnatcntcgtgtcgcgtagntncagcgcagcacg

SEQ ID NO: 8086 - DNA, 807 bp, Homo sapiens
cgccggagaaccggtatgctcgctcttcgtatctatattgaacgcggctatcgcttttgtatggtatgtcttctattatgagacgttacgcgagggtcaatacctcgtcacaacggtgttaacgcggccaatgagattccgcaaattaacggtggaaatctcgtgtaaccagcgggagactcaaacttggagtgcaaactctagcaaagtgcgaccactccaacacagcagggtttcgtgcgtaaccacatggatagaactcaaataaaagggagtctgaaaatctatgtgggcacaccaatctgtatttttaggtatagcgcaaaataaaagtctaaattggaggttcggtctttcagcttgtcatctttctaataccaccgaaatcgagaataaatcccacagtcatttatggaaatatatccaatgtagataaaagcccgtatctttggtaggtgctccgaatctcccatttaataagccaacatttaaaaatctgtatatacacatttacatttcctctgttttaaaaaataaattaaacacacatccaccctagaacccagcaattccactgctaagtttttgccaaagggatgtaaaaacatatgtccacaaaatgacttgtacaagaatactcatagcagcttagtttatatcaggaaaaatactggaaacaatccaaatgaaaatcactactaactgaaaaccacaaattccattatgttcatataatggaatactttaaaaaacaataaaaaatgactagatgtatctaaaaaatatgttcagcaaaaaaaaaaaaaa

SEQ ID NO: 8087 - DNA, 1126 bp, Homo sapiens
ccgcgcccgcccctccattgatttattgttcgcgatgacccctagcgcccctcttgtccacgtatattttttccccttcgctattacctttacccctcacccacacaacgtcgccggtcgggctcaaggtgttggtgttctcacaaccttgatgaacaatggaccatgatctaaatcgaccagactcgctccgcacactcgctcacgcggtatattacatctatgacacagcatcaactacgaagtcctattccgcctcagtagtgttttatcctcatctcaccgccgatgaatgtacttaatatattatgtacttgacatcctaccccgtacacacgcagccgcactactcgagtataagaattagacttaatctctctccattcccgccgttggtctactattgttcaaaatatgtttgtcttggtcagaagatgatgcgagaagctatgagtcgcagctctgtacttaacatcgtgtgcgcctgtaaactacgtttatcaacaacactctatctcctgttccctttgcttagacaattacctactccagctcgactactctctgcatgtcgacgttcactcgatccaacctaacgatacgtgactatgcgagccgccctaatgggatgccatgactccccagtatggctggtagtgatgttgatcgatcgccacctttaaccgcacaacatgttgttgagcacttctctctctcgcacaccaccgctccgcgtgcttccttatctcgctacattgcgttctgagtaaattgtcggtatccgaacctgagctgaatacagcctctacgtgtgttcgcccgcgagaatagtacacgctattattcgacctcttaatctcgatccaggtatatcgattgcgcatgtctcctactcttcaaaagactgccgctataccgtgcggctcatgcaatgtgtatatgagaatattctgctcacaacgtttctcctcacttgtgtgattttctctgccgttgccgctattcctcatctgtgctaccttgtaatcatctaccgtgtggcactaccatctttaaagacccgcatgttacttagcagcattctggtgtctcgtcggacgctccgtcatcttctgcacgtggcgag

SEQ ID NO: 8088 - DNA, 1212 bp, Homo sapiens
  misc_feature (1)...(1212): n = A,T,C or G
tgggaaattgagaaggggaaataagagagagnngaggtaggnngaagggnnnggaagtagnnaatgggnnnagagaggnnnngaagtggggagnnngggaggnaagaggnnnaattgaggngaatagcggaagagtagtatgttacaaagtgagtagggaagtaggaaagtagtnaagaaaattagtnnaaaaaaataatgtatgtgttntacgtaggnattataacccccgatttncccgtcgctctcgttctccacatagtcncctcaatcaagtcacgtcncatactctcacaaaatcgccaaatactacagcacccgccaactcnccaaagtagtcacttttcatcttgcncgaagcggcgttnctccaaatgaccgtcccctccacgcccccctcgtccnaccaccgtccaccaattcccgaccttctcactcaatgcttcgagctctttctacttcaccaaaacgncacaagatatagaggtaggnggagtatgggaaacagtttacaaatatatttatattattgcatcgtaagtccacgaaggcntagagattcncattgtgtacgctgncacgacatgctaaggtgtttcgataaggtccctctgatataggaggcctcctgtgacccncaaggcgggccgaaaaaggttatttgtctttgcgtcttctccgcccttatgatcagtacatccaaacacaattcatataaaatcgcgaacttntttctgtccnnccctctcgctgcgcacttctcttaccttccaacccagtagtttcaattcatccaccctctcagccaccacctgttacactgcccaacagacactcatatcttagtcactattagtatactcccctgtcttctcttacccgcagacttgtcctccttagatagatgaatcccccagatgacatagccccaaaacacatgacacatcacccacattcaaatctccatgagacaataatcttaccactagtcgatgcccgacaagtcnncctactattgtntctttttatgaagtcaactgcctattctcaccttatgtaccatctgttgtgcnacattgagcgtccctcattgtatttntctctctattgtctacactttgtcttttacatccncagactttctgttacctcttactcccncacttgagagcctatatcgnantaacacaattctatatatagttaaatatg

SEQ ID NO: 8089 - DNA, 819 bp, Homo sapiens
cgggaagacaacaaactctttattcagaggcccttggttataatcaaaaagaggtaggtcctggtttattttgtggcctcagagggcctcctgtatcatcgcggggcgggagcactgtgaatttgccacgttatataggtgcacaaaggcatctggtaccacttcatcaatgacgggcgggtcactaggccacgcccaaggtgtggagtgatacccctctccttcatgggccacaggggtggactccttggggccctttgccatagcctgagagagggcctccatatccttctatttcggtccacttggaaggtaattcagtaccgttcgcttaagaaggtccaaggggataaaggtggggccctctggaagaagagagggattaaaccctgatgtggggtgagggcaataatattccagtcatcctggggtggcataaaggagaaggcaaaggaacttttgttaggcacggtgtttggggtggacacctgcttgagccatctgataacatattcccagagataagtagtgagggctcaaagagctagcagtgggctcaggccgacagcgcattcccgttcgagtaagagatccaccccatggggctgtgatgttaaaaaacaggacagggaagcataccggctacagtgagtgagggagtagctcacactcagtagtgttcaataggagactgggcccccatcctgagtccctatgcattttgtagaaggcttgtttaatggaaaggaaaaagccatgctataagtgatccatttattttattcaataaatatttactgagcaaaaaaaaaaaaaaaa

SEQ ID NO: 8090 - DNA, 1696 bp, Homo sapiens
  misc_feature (1)...(1696): n = A,T,C or G
agaggacggcaaagttacgccagagcacgcaggcgagagaagaaacacgaggcaggcggagggttaggggggggagaccagggaggaggaggattttcacgggccaaaaaaccaacgaacaaggaggcgcgcacggagcagaacgcacgagacacgcgacagaagaacgaggcagaacaagagcaacaacgcacgcaaaacacgcgagaaacgagagagagcgcgcgggcagccgagaggangagcgcgaggcaacaggcgaggcncacgcagacaccgacaaccaccgcacaagaagaggacgcgagagggccgcgacacagccgcgagagcacggcgggaagcgcggaggaaagaggagagagacagacggaccgaccacacagcgagacaaaacccggagggagacacgaagaagaagaacatggacaaccgagagcgaagacacagcacgagaaggcgccgcgcggagagcactcacccgcgacgaggcaaagcaagcacacgggtacaccacgagcgcgtggagcgacgaagcgaaacgacgcgcgagagcgcgagcggcgccaacgcggaggggtcagagtagacgagcagacggcgagagaggaacacgcagagggccgagtggaagagacggcacgcgacgagacggcatcagagacgcacaagcacgctcaacgacggcaaccgtcgcgagaacgnaccgccgccagcgcgaagcacgcgcagacaacagccgcacgcgcgccgaccgcgacgagagcggcacgcgcagcaggatgcagcgcgcgagtcgagcacacacagcagagnangcancgcgactgagcgagctccgnaggacagagcagacatcgacacagacgagggcgcagcacgcgagcaccacgagacgcaaagacagagagcaccgcctcgccgcgccngcgagcacgagcntcgagaccatgcganagcacaagcagaagcagagcagcgagcagcgcgcaagcacgcacgataagcagagcgagtcgagtgacgagggccgacacgagagagacacaggangagacggngcatgccgagcgagagacagaacgcagcaggcagacgcatgacagagaggngtgcgagggcgccgccgcgcggacgtgcgngctacgcacagatgcggacgtgacgagttgctagcgagnagagagtacgagagacgacaggaggtcagagagnacnccggcgcatcgncacgcagagggaacggnacggncagccagnagataggangcgagagatagcggagacagnacgccgacgacgacgcaccgacgcagnagatgatgtataacaccagacgcgccgcgacacactacgancgagtactgcagcgnacacgcatagangacnagaacggcagtagtagcagctagctgacgcacnagngacgcgagcgncacgagctcacgagcgacgcagtgcatagcgngaggcnagcgcgctgatgaatcgatncgagtcgacgcgagnatcgactagggatcgcaaantgaccnacatactacncagacgggantgagatacacgagcgacgacgacgcgtcgtcgacgananacgcgtgctgctncantgagcacgaccgcancggcgtgcnctgcctgtngatgctgnagnacacgacgtacgtcgagnagacgccggacnagacacgcagcg

SEQ ID NO: 8091 - DNA, 1208 bp, Homo sapiens
  misc_feature (1)...(1208): n = A,T,C or G
gctcagngtgtcacgatatgtctaggcgctactataacgtcatacgcaggagactgacatgtggagcagcgagatcaagaagcgtccctggacctcgtagacatccaccccantgccacacagcaatattcggaggcaggcagcataaattagtcataagagtggtgcattcatgacaactgactacgacaatacaacacagtgtccttatgtattgacgacacatgaatggtcactgtatcgtcgaccgacgaatacacttcaacacaatgccttgtcagcacgagtaacaccaacgacatatcttcttcatcacacgaactcaaacccattaatctagacaccacacctaatagaggcgctcacagctctttcgtctcgtgcacataccacacgagacgcgaagccacactgccgcgaccgtcattcacacttcgcgcgcgacggccctacacgtcactcgacccacagcgcctacacctggaagcacgcctcggatcgtacgatacagatacgcgacatggcaaggtaacgccgcatcatacacgacgtcacctataaacgcgcaagagaataccaccgaaccctctccccacaaactcgcaggacagacgacgcacagaccgcacgtggcacacagggcgccgcactaaaccgccgcaacgagtacacggggaccaagacacacacgagaccagcagcgcaccgactaacgcgacgacgccaacagtgaacacataagcgccacaccaaacgcaacaatgtgacacaccacagataatcacgacgaccgctcnaccccgcgcatacaccacaacctccacccagccgcgcagccgcgagacaccaaagcatcgagccacaaccaagacagcgacagagcgatgcgtgcgccagccgcaacgagcatctgcgcgatcgactacgcgcgtgtccgcgcccactccgcacgcacactacgcgcgccgcagcctcacagagcacatggcacgacacactcacgcctctagcagcacgacgtcggcgcagcgcgtctcgctcagtcagcacccgtcatgcacgcaagagcacacagagcgaccgcgtcgtccaagctgctagcgctaagcacactcgaacacctgtcgcgcgtcatcagacattcacgctctcagccagctctctancgcacacgactcgcacgcgctcactacgacgacagcacatcg

SEQ ID NO: 8092 - DNA, 1152 bp, Homo sapiens
  misc_feature (1)...(1152): n = A,T,C or G
gataaggaaaaattnnnnttatttntattttgattatgtatgnnttatatgtgagttttgttagttattgtttatgtttatttangaaatatatattaaaataaaaaaattttaatttttagnnaaaagaagagtataaagataagtatgatgtaaaaaaaaaaaattttaaaatatatatanattgaaaattaaatagattgtattaatgggtagaaggtatgaaacaagaaggggatggaacgggagaggagaggagngtgttaggccgcgtgtattaagttctgagcttgaaacaataaataagaaccatgtctaacgagctacgcagttctgagtagtttagaaaacanaatgatatagaactccctatgtcctcgcgcatataataataaaaatatttttacttgatgcctttccgtcgccctctgtccggaacgctctcaaaatatcctacagtttgaaacaactccagtgatatatgagagaaggcacgacgacgaccacctggcgggcgcgcggtatctggtggacgagttaggcgcccgatcaatacatatataccgcatcccatcttccctcgggtgcctccttatccgtggtctgcgcgctgctcgccccgcgtgtcctcgtcaccacagactcgccccctaggattcacacggttattgagcgtgttcacgtcatacgtgtgtgatccgtcacggctacagcgccgtctggccccgcgtggcgccgacgttgtcgcccggtgtaaagtgagtcgcaaagccagacgaatgtgaaggcaactgcccgcacctcgcaccgacaaagctgtagtggagcgagcgctatgttaaacaggtcacaatacctgattgcatccacccagcaccaccattctgacaccgccacaccatagctgcggaagatctctagtacactcttccccggagaacagtaaagcgcaacaagaaactgccaacgttataatccgtcgagaaatgccgtacgagttactacgccaaccgagcaataactgttctaatgtacgcgtccataagcgcactcgaaccgacacgatacacagacgagagagtaactatgccggcgcacatcttctacaactaagatcctcaccacnctccacaggaaggagcacgcctcccg

SEQ ID NO: 8093 - DNA, 1639 bp, Homo sapiens
  misc_feature (1)...(1639): n = A,T,C or G
cccgtccgccgcgcgccgcngaccaagttatttgatcttctcgcgtcgcagcacacaccgccgaggacaccgccctccgcgtatggagcacaaancgagacgactatanacgcaccgnctcgatnaagagacgtagcgacaccacgacagacagacacacgcacggcgatgaggagnaggnaggatgtnctggttntgagttcaagcatatgtncacctcaacttacgtctctgtgtgtatggctattcgtnctgcacatactatgtcgtatgcncacgcgccgacgcagcgtcaggtaggtattacgacataacgtcncggacacggcgatcagtccgtgtacgacaatacgtctantcacgtgtcgcgtagtataatctcatctactgacatgcactctcgtgctgacgtcgangacgaggcgttcgcatcgntcgatctatcattgcngtgcgcaggtgtagtgtccttacgcatatagttgcgtcatgatagtngacgncatcacgttgtaggtatnagtcntatagtgtacgtctgantnttcttatctctgactnccattacacgcatcttatcgtactatatacggcagcgtcacgcatactgcgacgtgtcaggcacgtcgttgtgtgctgtgactcgatgttgcaccgntctcatacagtgtattccacacctgttgttctgtatcgtcatatatccggcgacgcgggcgnagcntctggatgaggtgacgtatantcacntgcacctacctagttacactactagtatacgcgacgttnagtgagcactccacagacgttggtgctgatgacagatgntagacacatcccatacgcgcttatntgtctttcgcgtatcctatactaacaatcaccgtgtcactgtcgtgaacatcgtgtctgcactaccgctgacacatcactaattcatacgactgccacacgcgagagacatctgcgtcagacgccgcgcgatggctacagtgtgttagaacactgtctccgagcatttgttttctctgtataaccctcgtgtgttgtatcacacgtgacacgctatcgcgactgaccacatctatgtgtacgtcgatcgtcctgctgaggaagttcggcgtcggtgcgcctgatatacntgnantaggattatatgtacgagatcggaatancnctcgaatagncgatcagccgcaccatatctatcgtagagctgtcgcgacggcgagcatatcgtataagcgattagctaattctgcgactatgcgtcgagcatggacncagtagttcagcacatctcatatcgatacgactgacgctctagatactatgattatatgtccgcgctggagtgcgtcttcgaccagtcgcgactgtgtgattcncgactggactcactcagcgcgcagacgacgcgactcgcncgtcttcgacgatatataaattacgatcagacgttctcgagtctgatgangtgcggcggtagacgattatagaatatgtacaacgaacatgtagctgcgtcgcccgcgcatatagtctgcacatcgccgcatgcgtcgaacgtaactcatcatgttctcttcgtgtacagagctagatgcatcactgcgtgtagaatctgtagtgtacctcg

SEQ ID NO: 8094 - DNA, 1686 bp, Homo sapiens
  misc_feature (1)...(1686): n = A,T,C or G
gccgccgtccgccgcgcgcccagtatttgttagtgcgtgcccacgatgcccccgaacacccccttccctattgccacgcatattatgcggaccgcgcgctttggtgtccacggcgcggcgcacgacacattatccagcgcggggcgcgggaggaaggtgtgtattgcgttaccaactatgtagtatggcgggcgaccttcaagctacggtactgctaagtaatacgactctggacacgccgcgcggacgcaggttggatgataggacaatcacgctcacccgtcacctgacactcctgtattcttggtgtagccgtcgcggcaggngctgcnacgactacagccgcgccgctctgtccggcgtcgccgctgcgcgaagtctacgcgcgcaantgtgtatgtcgtggtgcgggactcctcacgacgatcatgcgacgaagagtcaggagaaacgacgcggcagacacacgccggtcggacgagagcgagtagcattctttatcgacctgcactatcgcgcggcagataatctagcgagaccacgagcgagacaacgaagagcgacagatagcatgccgcccgccggatgagtgctagcacccacgagcgctcttcgtccgcggtctcatgcggcagcgcaagcagacacgtgtgcggcggccgagtagatgaccgcgncgnctatacgcgatatctgcgcgtggagctgctaggacatatcgtgcagattcggcgtcgctgatagcagtagcgcactggatcaagactaagaatcagctcgcgtgtgcgttcgcatcgctcggncggtcggcgccgccggactcgcttgcacgctaactccacatgcgcgccccgaagtatccgtacgcagcagagcgatcgacgacgcgtggagcgagggggcgcagaagcatgcgagcgaccacgtcatttggcgctgcggcgacgccgcggtcgtgntgngtacgcatcgcatgtgtctgcacgtcgtctgtcgcgtgncagacangtctaggtgcancgcgcgcgtctagtgatgctcgacagtcgcgagcgcgacganaagtacgctgtatgctcgcatctgtcgcgtcnantcngacgcggtacgtctgcgaagacgcgtagtagacgccgcgcgctatacgagatcntcgtcaatnctagtcggtntcaaggatatacgtgagactacgctgagtagataatctccgaagctacacgtantgtcctcgtacatatcgcgggtnatatanacatacgcacantcgacngcagagaagaccagcgcagantatgcaatgctcgtcgcgagactgcatgctcgtagcgnacgagagtcgcgtagagatcgatactaagagtacgatactacagcagactctatcgcggcacgtgcgtgcgcgtgtcgcgtcctgcntcatatcagatactagaatctatatangtagagcgctcgcgcgtagtgtacttggcacacacncacatgacagtgagcantactagtaanagctgtatagcttnacgtctctgcactagcgcgtcacagacacgtangtacgagcaggcatcgatcacctacgactcgcggncgcacgcantncgctctgtagagatntacgcgtagccgncntatgcgctagcgcgacccgcgcgatntagtacganctcgtccgnctcgatctgt

SEQ ID NO: 8095 - DNA, 1136 bp, Homo sapiens
  misc_feature (1)...(1136): n = A,T,C or G
agagaaagacagagaaacccttaagagacacccaacggaaaaancccttttaggttaccgccgccccnnnnctnagagggnnnntactanacctcgnnnnannnnnannnnnagagncnagaactttttaaaagacagtgcnaaagccctttttgtcaccggagggccagcggcagacaacaaacgggcgcaggacagagcaccaccaacgcaagaggccacaaacggaccgcgaaaagagcgcttccagcaccagaacggccgccacgagcacggcccgggagaacgcagggacgcaagcagaaaaaacctcccctccgcggggtgcagggaccaaggaccaacgacaccccatcaccccacagcgaccacaagaagcgacgagaaacggacccaaagaaaaccgctcttccgccctnagaggaggcgaacgcggcggcgacgcgccgggcccgccgcccgagcgggcgggggacagcacgcagaaggccccgacacatcccaagagaaagccagcgaccgcgccaacaccgacgcacacaaacaaaagcacaggagacgacccgaccgcgagcacgatnacgcacaccacacacccaggctaccgcagcgncgtggaccacgccccccccccacccccgataaacaaatacacacacgccgaaaacacacacccacaagcacgcgagccaaaagcgcacacagcccgcccacaccgccgacagaaggagcacgatacacacgcgagggacaggcacgaccaaccaccaggcggcagggcaaggcagngcagaacgctacacacacgacgcgcggcacacccccacaacaaaaggaccgaagaagacgacgccacgcagcacggacacgaacccacacccacaagacacccaacaacgacagaaggacacagaccaccccaacaacgcgccgcccgagacaccccgagacaacacacgcacgacacaaactcacaagcacccacaaccagacgaccagaaccagacagaacacaccccgccaccaaccgaccgaaagagccaagtcacgcaaggcgccacgcccccgccacgagccgccgccgcacgccgaacaaagaaccgacaagagaccaaacagggctccgccacctgcca

SEQ ID NO: 8096 - DNA, 1094 bp, Homo sapiens
  misc_feature (1)...(1094): n = A,T,C or G
gggaaaagtgaaagaataaaaaagnnaagaggaaaaggnaaaaggggnaagggnnaaagtgnnnagaggaagnngaaagaagagnnaaaagagnagaaagnaagttagtgaaaaataaaagaaaagaaatatnaatataggaaaaataaggtgaatnaaaagttttttgtcatatacgagtttttactttagtgtctaaaattgacgcacacccaatcttcattattcatttacttatgtacaatattctttttattatttatattcaatcttaccgccccccctcttttcacttgttcattactttactgttntctttaattttatctntcaacctcgcctactactctttaaagctctattagtcctaatgattaaccacaccncaaataccatcattcatatctcctaatctattcctacttcttgcgctttttttatctctttatctcctttattccctcccaccccctatctcctctctctctcctttcctaatcatatatccccatatcatctctcctctataatattgnctatctatcagactagctcccatcacaaaatactctcaaccacgttcacaattgacccacacctccttgcagattcctctgattcatatcatgtcacgttgataaacaattatagtattaattntatgtatctatcctattcatatctccttgtnncagttgtttatatatttttcaaatatatgttttaaatattttcnactaatattcgtnaacgaaacatacatnncgcgagtaccgagatttaatccctcactactaccctatgtccatcctttcctcctccactccatctctctatcatataatacgtacctccatcctttctcatcttctatacgtnctcacactgcaatncnaacaatataaatgcaatccccaacaacccttatatttacnaatatagtcattcnctactttcgacacccacacgtatatttnnnctttaaatatcccactcatgtntctataaatgtantgagagacacagtccatcaatgcccccctctcatggccanatgtatnnnagatccgcagtcntcattatgtcacacatcg

SEQ ID NO: 8097 - DNA, 1579 bp, Homo sapiens
  misc_feature (1)...(1579): n = A,T,C or G
cctcatacccccgccctcgtctattcttcgatccgatagccgaaccaccgcctccttttcgccacatcgtggcgcccgcagcttttatcaaatacacaccatcaacacacgacgcgggcgcggatgtatggttaagttttttattctattttatctcgcctagataccattgtagtatactataagcctattgctctttccgctgcggtgcgctctcttgataattttcactccgcgcactgagttatctatcacttctcaacatacatagggcgacaaacaactctgattcctggctcctatcgcgccattcatcttcaccgcgtaataatattatgtctttagtccgcccatactactactagaccatgtctatgcgtaaagcttactcaagagcgatatctgcttgatgtgtttcgcatcgatcatcgcacccttccgtctctgaaagatcatgttgcaaacaagcattccgatcaatgtagaacggcatgatcgtagcctgcgacgacntgttacgctgcgcgtttcgtcttatcgtcacatgtagtctccttacctccactgactgttgtgactccgagttcatgacgaaggtacacnattatcggtaatagtatccaattgtcgtacatctctactggctacacgtgtcgcaatacatatacaacgatacgacatcgtacgctattatagcacacnctgctaacgcaagattgcggctatatanacagtctctcgcatcatccgacagctcgngccgtgctgctgtantatcgatattaaccnactagtgacgtctcgatgattacgtgcgtggtgctctactcatggattcatagtgcagtctaatcttactgatgttgtncgcactcgcgcgctgttgatcttgctcactcagcagagagacgcagacagagcgcatagcacatcagtcaggttcttgtctatagagcagcnacgactgtaccacacggtatacagcagtgactcantctagcgaccagcntcactatacccgacgngacgctcctatatacgacgcactagtgaatgtatgtgtgaacagtacgcagtacaacacancgccgactatacgtgtgagatagtattccttcatcactgactatncctctctttncncagcgtcagatacacatacactcatactatgacgtagacagcgctccgacactatactctntgtgatctatgtagcgctgacgtctgancnagttacctactacgtctacgcgctntgatcatagangangtgcatgttatcncaccngcagtcgcggacccgntgagcggatatatatctgtcgancngtatgtagtactntcgctcctcaccgcatactgacttgcantcgcgcacantccgcatatactacgntnactatacacactatgtcaccgtgtgatacgcagctgctactacacgttcgtctcaacgcatangagatacgtactagtacgtgtganagcgtactcatgcatgntganagtttagaagtgtangtttgnaccgntactacacgcactacaagacagctagttcaacgtnangcgcagt

SEQ ID NO: 8098 - DNA, 999 bp, Homo sapiens
  misc_feature (1)...(999): n = A,T,C or G
aaccagcccagacaacctaaaagggaaagcaagaggagcggcttgtagcaaccgacgccgagccctgcgggagcgaacancccancaaanggcaagacaaaccgcagagacgaccaacccacaaccgacgcccgccggaaaaaacaacgccaaacaaaagaagcggcaagacgagacccacccacggcccaaagcgacaggagacaccgaaaaaagccgcaccacccgaacaacagacgaaaaccggaaccgagagaccgccacaccaagcaaagacccaccttttttaaaaaccgcacacaacaccacgacaaaacacccccaccccccgcgcagccgcgaccaccccacaggcccgccgggcaacccccgaagacaacggaccacacccgacggccagcacccggcgcgcgcacacccaaagccgcccagaccccgaggggaaagacccccaaaacgcacccccaaaagaaacacaccgccgccccgggcaggcaaggacacaccccgagacgccacaaggagcaccgcccccccccgccccaaaacgaccccacaccaccaaaccgaaacgccagcacccccaccgcaacacacacaaccgaacccaccaaaaacaaacccaaccaccccaccacgaaccgccccaccccaaacccaccgaaaccacnaaagacccaccccaccaaaccgacgcccgcgcgacaaacgcacgaagacaggaacaaaaaccaacgggaaccaccccccaaacgagaccccacgaagnaccgccacgccccaccagacacacccaccaggaaagccccaaaacacacgaccgagagcaccaccacaaccaccccacaacaccccgcccccaaccgacaccacccaccncacccaacacccaccccnacaaccacaacaacaacaagcaaccacaaccaccaacaacacacaccacaaaacaaacaaccaaagaaaanaaacgaccgcacacaccaccacaccacccca

SEQ ID NO: 8099 - DNA, 1583 bp, Homo sapiens
  misc_feature (1)...(1583): n = A,T,C or G
aaaggaaaaaaatgnngaaagnnaaggaaggaggaaggnnnaggtataggnnnaatganagnnnnnaaagtggaggnanagagtgtnnnnnaagaatgnnnaanatgaagangaaggnnnnnaaggaggnnaagatgnnnnnataaagnggnnnanatagaggggnaaggtaatgatttntnnnatagagggatgaatagtagagatgttaaaaagatagttnnnaaatagtgtagtggnnggtaggangtaggatgtggtgtggngtnagcagttggnttggtgtatnntagtagatgtctcctcacacttagctcgcttcgagatgagttncncacagaggtgggtgtgtgccnccaccccgcagcgacgagattccacagacacgtcacgcgacctcacaagagacgtgtaccacctaacaggtgnaacatcctcagagatggtnnnctcaanagtgtgtttnncttcctacatctntcatcgcttcntcatcgtgtcntatcgtcatatactactctgaatggtacgactcgcgtcatctctgtatncaggcacacggatatntcatgtctcagcctgcagttctctgcgaagcccccgagagttacatccaataacctacnnctatgtgtgagccanaagccagttnnnaagaggcgaaggtatttgtgtgtatagtcgcacgactgtgtgattgatgagtggnagaagtgcagcncacactcgtgctcggtaggatcncgcggagtcgcncctaagatagcccctatgtgtgttctatagtgatgtagcgtatcgtcncatctaccgctccacccgagacatcttnccactctcacgctacgtgatgtgccataccgagtccaaccgcgaccccatacacccgtcaaagtctctcgcgcacgaagacgtactgtagccacggcacagacgtgnccttggtgcttncntctcatttcgttcgagcgtgttcatgccttgcatcgcctactctgtgatgtcactagtgatgatgtcggcggtggcgatccgctatgtttatatttgatattgatgagagtncgtcggcttagatctcgaagataatctatggtcgcgcgtcaagcagtgcatgctacnagacatgtactacactgcccacattgaccacagttgtcgcttctttattctccacgtgctccgcccgcgtccnacacactctctctcntttcacccgacccatcgtcgtgacgatcatgcgatggcgcgtactnatanctggcgcctagcagtgcgtgcagtggtgcntcgtacgcgcggtgtgcnnnctcgtctgcagcgcgcgtactcaatgctanacgtagactaactactatgtgctccnatgngatgagcgtatntcnagcacagatacgatatcgatctagagtgatttgtgnnnnggatgtagtcggtacacttcgagagtgtgtntcatgttgtgcttnncnnctntctagacgtgcgtnctcgctatgctgagcgccacggacgagagatgtcactcgagatgagcgnnncacgtcggcgcgatgacagagctgaagagatcagacatagag

SEQ ID NO: 8100 - DNA, 798 bp, Homo sapiens
ttacaatagtgactccaccgtgctttaaatgtcaatatatataccgtgtcagataaaatagctaagccagcctacaggttttataaagctagtatcctaccactggtaatagtaggactaacaaaattttactctcacgtcgatcacatttaacaaagagcctcatggtcctcacaaaaaaaattaacggcattctctcactaaccaattcccactcatagtgtaagttttctgggcattccgcatgaagtaagcatgaatgtttgttattcagacagaatcatgttttgtcgcccaggctggaattcaagtagcaccctcagggcccattacagcctggagctattgggctcaaggaatccttcccctaagcctccagagtagtggggtttacaggtccacacctccacacccagttaattcttttatggtttgttcagatgaggtctcgctattttggccaggctggtctcaaactcctgctttcaagcaatcctcccacctcagcttcccaaactgctgagactataggcgtgagccaccaggcctggccaggattttctttcatatagaaaaaatagtgtatgacagcaatagcacaaaggaaggaaaggagtaaaatataagcgaactcttggaaggctcttatactcacagtggcataattttaattcactgtagatatgatcacaatagatatgacataatcatcaagtacaatgtaatccttagagctactaaaaacaaagccaagagaagaggaaagcataaaatactaaaaaaaaaaaaaaaaaaaaa

SEQ ID NO: 8101 - DNA, 1160 bp, Homo sapiens
  misc_feature (1)...(1160): n = A,T,C or G
aagcgcagccggaggcgccagcgacagcagagagaagagggagaggcctttgtttgtagaccgccggggcgnncgccttctgcgggggagaaccgcgcgcccggccggcgtgaggcgggacgacgcccgcttttccacaacagggcgatagattcttactttctccacggacacctgacgcgacggcagggacgcacgaaaacgggcgcaacagccacacagcgcgacgaggcagcaagcatagtcagtccgggcgcgagagatcgtgtgaaaggcggaagttcgctgacaccacatgacggcgtgacaacaaagaaagcggaagcacacgcggttctttttttcaccgagggggccggcgcggtccagtaggagacggcgctaataccgaccggcgcgcgctccagcgtggaggaggcaaggcgcacgcccagcaagcacaccggcagagacaaacacccaacnaggacgagcgtcgcgctcagacacccgacgccgcggcacactctcagacgcgagcaggcgacggagaactcgcaccgaagagagaacgcgcagttccataatgagaagcgccctgcagagcgcgcactgcgcgacgaccgccggcgatgtggcgaccacatgccgcggatgagagcggccgaggtcgcgactgcggcggacgncacgccacacgcaacgcgaggggacgacccaggnagcgtgacgaggaggacgaaggcgccgacggagacgagggagttctcgccggcccgaagggaaagaagagacgggacgcaacgccaacgagcacgcgcgacacaccagcgcagagcgggagcgccggcgaccgccccgcgagagggcgccacctctataacaccnagggcagcgaggagcggaggcacgaccgcaacgcacggcagcgggcaggacacccgacgcacggcgcgcacggcgaccggcacgacccgcgacgaggcgaaacgcggagcgacgagagagagaggcaggcgaggccgccagggcagcagaacgccgcggagcgacacagcgangaacgaaggaagaagatcgcggaaacgagcgagcgcgccgacgccacaaacgtcggaaacgacgaaggagaagacatgcagcgcacgcagcaaccgagacgcntcaccacggacgacggg

SEQ ID NO: 8102 - DNA, 1399 bp, Homo sapiens
  misc_feature (1)...(1399): n = A,T,C or G
agcggcaggcgcgcgcagaggagacagacggcacgagcagacagagggagacacacgccaacacaacaaggcacgcggctggngnnnngggaaagnaactnnacaagcannanagaangccccctggaacaggggngcgacanagacccacgcgcagaacgccggaggaganagacgagaggacgggagnagcncacgacagcacgcaggcgccngnacgacacgcaacgcgacgngaacagaagaaggcgagcgacagcgacgcaaacacacccgcgcaacggaggagcagcgcacgaccgcagacgggagaacgncaaaccgagagagaccagcgcacagagcacacgccgaggacaccacggagcacccaacgcaggcagcagaacggcagccccagacggcgcgagcgagcgcagggagcgacggcgcaggnacagggccgcggagaaggcgagaagacaaggggagagacgcagaggccagaaccgagaccgccgaagnagaacggcccgcgacgggaacaagcccagcggcgggcggcaacagggaacacacagagcgaccaacaagggcgcacgaccgacgaacacgcacacagcaccggacgcgaccacacgaccaggcgcacacagcgcaggcaaccaaagaacacgcacgagnacagaagagcaacggcgagcgcaccacacgccacggacaccgcgcacgacggcgagaccaagcgagacagacaccgagacagggaggaacgagagagcgcggaagcaacagaagcgcgccagagcccaaaaacacgagacgcacaacgcacagcgaggcggaggaaagganacggacacacangagcgagagcgaggagagaagaccgagcgcacaacacacgaggccacgcagccgaagcgacagaaacaaacaagcaagcggnaacgaggagacagagacgggcggacagccacgcgcacgaaagacgcgagcacgcaacgcaggaagacagcaggaggcaggaagccacgagagcagcaccaagacggagcggcgcgcnggancagcgacaccgcagaancggacagaagcgcgangaggcgcgagagagcgcagaggagaacagccnggaagccacgcagaccccgcgaacacagcgcgacgcacacgccagccaccgacaggaagacgagaacaacccgagacggacacagaccagaaccgccaaccacggaaggcgagcccggcgcgaacgcggggaagagcgagggagagagaacacgaaaccagagcgaaacacgagaccacgaagcggagcgcagcgagcacacaagaccaccgaccggcggaacaggcaggagcggcgcgaggacacaagcgccagacaacacgggcggaccgaaccgcgccgacc

SEQ ID NO: 8103 - DNA, 295 bp, Homo sapiens
  misc_feature (1)...(295): n = A,T,C or G
tagaggggccaagaactactttatgaagaggaagatgaggatactgacagagtaaaatcatggagaaaatggaaaaactgggtgcaggcgtgagaagttaaatcacagaagaaaagttaagcaggaacttgagagagggatgaactgtgacaagttgtaagaaggaagaccaggactcaccaggaaaataataaattgtccttgatcgtacaaaagaacgtgttaatggaattttgctgatgaatgtganagaatgtcancataaatattgattttaaaaacaaaaaaaaaaaaa

SEQ ID NO: 8104 - DNA, 1314 bp, Homo sapiens
  misc_feature (1)...(1314): n = A,T,C or G
cgcgcccgccgccgaaatactaccgcccgatcccgcgaccccgctccttttccagtattgcgggccccccgcttttgaccgtgggcaccgaacagcacgcacggggggggggaggcgggggagttgacgacatgttcacncggccccactacccaaaacccaatcttcgccctgccgacaaacgcacgggagagcgattcatcgtgaacgagtcagcatatccatcacatatcaccgcgcgagttgtgttgtctgacgtcaatgacgcgaccatacctacaccacgtcatcagcacgtcgatagactgagagtctnccgtggagagtacacacaccaccgcgcgcagacgagcagatgcgagcgtaaatatcttgtcgcgcaacggttccacgcgtcgagnaaggatacgacatcggcgtcaatcaactctgaactcgtgtagcctacgcgataggctagccaacgacaccctatccgctcgcggtatcnatcacccatgactgtatccctaacaagctgccaacccgcagcaattctgcaatcggcatcacacatccngaacatcgcgttgagaccacgcagacatcgaatggtccgaaaattcgcgacagttacctcggctcgcgtctccgcagcacatgcgagccccgttcgactgacatgaactacacgacgatcacgccgcggcgtaggcgcggagatcaccgagagtgcgggctgctgcgagtgggcgcgcggcgtgggcggcactcagtggatgcatcagngcgtgttgtctcgtcgcgtgcagcgcactatttagcagtcaacgtcgcgaggcacacgccgcgacagactggccgggtcgagcgttacagagacagcggcgcacgcgcgatgatantgtataagtgttagacgctcgacatcaccgtccgaccgacttcgccgctatagtactatgtgtacccgtcggaggatgcaatgcgcggaacgtatatcgaccgtataccccgcaacacacgcgaaggtcgcgctagcggaatgacgcgcaccctgatactggataacgatgtacagttccgcttatcccgatacagcttatatcttcatacggtattaccgggcgcgcgcgactgtcgacggagcctgacgtatagaatccgcacgcgccgcgccatcctgcgcttcagcctctactgtagagcacgttttcctatctaccgtgtacgcactgcattgcgattagccagagccgctgatatcgacgtagcacatcacctattgggnatgaccgaaaccgccctcgcgatcatagcgctgactcgggaagg

SEQ ID NO: 8105 - DNA, 1862 bp, Homo sapiens
  misc_feature (1)...(1862): n = A,T,C or G
cgcgtctccgctcgcgtccgcacgcnctcagatgtgcgtgttctcacacgtcccacgcgnatactcccgagcgctacacacccgcgcgcgattgtctaccagctatatctcttctataccgcgttcagctgtgtctattcatngttctccgccgcaccatctccaccacctccaccgccacgagctgaagtgaagntgtgtgtgtctcctactacatattaataagatcgcgagtgctgagaactagacgcacgtgacgagtccacagtgcaacagcaacacgcgacgcgtgtgcgcggtcatgacatgaggtcacgaatgcgtcgcagtggcgcatatacacgtcgcgtcagatactgttccgcaccactcgtcgccggtagatactcatcttcgtgcaccacnagccagcncatgncaggcgcagacagtagcctacacacggtacatgttagcttcntatggtanatctcgcgccagtgtcatcctgccgagtgcgnagagactgacgacacgcatgagtagatgacgccagtacgcacggagatgaagatagagantgagtagcagccactgcgactccgctcgcgacgaaccgctgtcnctcgtgagacctgtgttggagacactganctgcattacgagtgcatgtgantcgagngacgatggcgctgcaatgagcntacaccgactgcttatcgtcgtacatctagcctggacgacgcgangcngactgagtatcctacagcngcgagncnntgnagactgacgagagttccgaagatcacgtcgcacgangttcgncgtcatgtgatacgcgcgcgtcgtcatacgcaacggacagaacatgtgttactcgataccagtgatcnagngtacattngcngcgacgactactatcncgnncgtcgagacgncgcgcgatcactatcgcacagagagtagcgatacagacgactcgaccagcgaccgtcgttctacgacgccgcatcagcagtgtagtccgagcagacgtgcgatatctcatgacagtagagtgtancgcgacgcagagtgcgatcatcgacgcngtatgagtcgtcaccgacgtgcatcgatcgcgtantagtcagctcgacacacacacgcagtnatgtctgattgctctgtgnacacacgtctgactgcctcatacagcgactgtcgacgtctcncgtagcnttcggcgcggtnacantgtctcgaggatcgcatcgtcccatttactctacactatcatatgatcgcatnaatagtcgagaccaacatgcagcgagangcagtatatnantngcgcagcgactcgatcngctcgtgatacgacgcgngtcgacgnctcgtcacncncacacggcanacatatttntacactacgntctacntagtnctacgtagntccncgtcgagattcgatgcactatcgtngctcgcagtgcgacacgccagctngtacagtacctctgattcatactgggnatntgagtgagncgatcgactacgctctcacgctctctctgtcatacgatntacgatagtcgaagaaacacgctgancgctctcgacgcgctgcacgcaccgtagatatcgatcgtntaacgaactactagtatccggatcgtccntcccgcgagtggcgantagcgcanagcatcacgctactctatcantatagacgtcatcgacgtcggctcgatgcacacacgtgactnacgcnatacangntctcaggacacgcgacgcgatgacacgntngtagatatcacgcgaccnacgtatgatacantnagtganacgaaggtcgtcacangcgcatatntaagatgtatcgagtgacatcgcgccgg

SEQ ID NO: 8106 - DNA, 1312 bp, Homo sapiens
  misc_feature (1)...(1312): n = A,T,C or G
gagaattgtanaganaagtaagngagnnaaggaggnaagaannnaattagggaaaagannnnnagttnnaaaacgcgaannnattggnaagtagaaatatcagtaaattcgnnaagtatatataagatgtgaaattacattaaaaaaggaaaaaagagttgnnccgaatcaagaaagcggttgcccagtgccattatattctgatggtcaccgggtgagagancggcggtttccgcggagatatggcgcacgcggcccctatcgcaggagttacacggccaagcgctgccaggtgcggacggtccacggcctctgaatgagntgtcccacttctcgtatccctacatctctctctcttctattccgcagtcgtctgcatcttccgcacgtagacatgaanacagcgcccatcatagttcccatgatggttccatagtatgtgtatatttagttatacgactgttntttgttgtgttgtgtgtctagatccagtagctgatgataaggtcnacgcggttgttttatatatttatgtacatctcctcactcctcctattcgtgctctggctagtgtctgtgcggtggacgagatagagttntagtcgtacgccgcncctgcacggaccgcccctctcgacagagtagatagcctcttcccnaacgtccgagtcttcnactccgcgaccgagtcatangccaccacgcatggattcatgcttntgctcacgacttntcntcgtacaatccnagcntctagctacggtgtagttccgtgactatgtggtgttaatattgcttntntagacacttatgttcagtatcgacgatcgatgcacatgtgtantacatgagactcgananacgtgtgctgngtgctgaagtagtgataggantgantattatgtagtagtacatgagctgatactccnacttaagncaacacgtatnttcaacagtcgtcngaactactctctctcgccncgncatgctctcccncgntatattatcgtctcatacggtagagttgtgtctcgtcaagcacacgctacctgtaccaatatgtagtacacctggtagtgctatctctccgtgaggcgacggtctactcggctatgcgatntatgacgtcacttncagcggtgtggnnatcggtagaagtgcnagcagcagttantgttcctgttatgcgtcgtgacttgcgagtatcactgctgtctactctacgcagtgtagtccntatatgagtcctcgctgtgnggctatctgctgtgatntnactcgagtgctncgnccatcagtggaccttggcgcg

SEQ ID NO: 8107 - DNA, 156 bp, Homo sapiens
cgtaaatccaccaatccgtccgcctattgttacatcgacaccccactacaatcccccaaaatgttctctacaatcccttcggaaaatatcacggggggtaaatcccaggattcttttgccctaaaagccctcctcaaatcttgttttaatgccact

SEQ ID NO: 8108 - DNA, 1041 bp, Homo sapiens
cggcccccccccccgttgttgtgactcgcgaagcgccccccccgttttcaaattgttgtccgcgctcattcatatcgaccaattgactcgccggggggggatagcgtgtgcgcactttatcgcggtccatctagcacatcacactcctgcgtccctttactcaccacgatgattttcaccgagagcgatataacgactaatcttctcgccgacgaatgattcatgcaaccattctcgtctcgacgtaagctatcgtgataattgtgaaagcttccgttgcccgcctgttgagccgcacgtcacggatagacgtgctattatttcgttcgtcgccgctatgtgtgggagacgtgtgagactcgtggccacgtgcggccttgttgttgaacacacaattaccgatagtctgacactaagagtgtaggcccggtagaattgacattgcatagctccgatcgcagcaatacacgtggtatcgcagctacgctggctatatctaatcatcgacttttctgttaagctcactatacgtcactctcccggatcctgatcgcttcaccctccatagccgcacgcactggtgcggcgcgtagcagcgcaatggagtgccgctcttacgtatcccacgccccttgtgtggccaccacctcccgtacgctacagctgggcatgggtcaatctgatgtcccgtcaactgtagagcgcgccaacaccgactctagctttatccagactctcttatctcgcgcggattcactaacgtgaattacacctactcgcgtctaccgtgataaccgaaagccctgcgcgcgacgtgagttactcgaaggccgaggccggtcccctacacgactgtgctgagaattaccgtgcgtccgtaattcacgttattgagtattatgtatctccgcccatccatggtgtacatcttgtagcatgggtcgacaaaaatgtgtacccacatgtaacgagcatcgtgcgtaaggtggtctatctgcgagcatctgcctacacgtgcccgtcctaatgagtcgtctcggt

SEQ ID NO: 8109 - DNA, 278 bp, Homo sapiens
cctaggcgctactggacaatgagcatatataaaaagatcaacaggtgactgtgcagcgcaaacctggtcagaatgattatagaacattttatctcttcttttggatcacctcagtcctattgatatcatccaattaaatgtattaattgagaactacgactctaatagataataaaagggcctaatttttttctcgtagactttagttctgctatgacaaaaatacatacacattttggaaagtacagaaaataataaagaaaatgaaaactaaacaa

SEQ ID NO: 8110 - DNA, 1146 bp, Homo sapiens
  misc_feature (1)...(1146): n = A,T,C or G
gagggaaaagggaaagaagaaaggggagnnaagaaggganaggnagnagagaagaaaaaggagnnnnaggagnnnnaagcggaagannnaaggaanaagaggnnagagagatnaaaaagtganagaagaaatatnnaaggaaaaaatgagagaaanaaaatagannagaaaaaggatgtgagaagaggtatgacacaataaaacgtactcattttcatttatttcacacagcaaatagcaatactatnncagatctactcccnccactgaacgcagatcccaccgatcgtcgcacccacctccccgtcatgtctgcgagtggttcacaatactatcccctcgtctacccttatatctttccctttctntctcgctttccacggtctctcgctacaccgcaggcgccagcnatccgctcactttgagtattagtgtttttgttttcttcgcagtgttcttcttgttccctatattgtttttgtgtgtcggcagcgttgagatgctgggtgggggagctcgcaccacgtaccngagtgataccccggacggctacttgtcacacgctctagatattgttcaacgacgtgtcccccatgtgacgcccgccgcctgattgtctttcatctctccccctggccctcccccttcatcaccgcncacgaccgcccagccccgcgcncccccgctcctatcctnatntcctattctttactagtaattgcgtcaccctaactgttctgatcctgtattttgtcgagctcatatatgtctcatataggtgtcttctagcatctacatgggttnaatatagtgagagtgcttacaaatgatattctctcattctctcatcncaccatgtctaattgcctgctccatctcaccctcttctctanccctgtcccccacccttcttatcgcacagctgttttaaggttccctgctgccctcgatctgtacccccccgcgaganctcaacgtccactttccccacacctctattgtgatgcctacacaaggttnacccgtgatcctccctttgttgctccctatagctcctccacgcttctaggagtccccagttctgttttcaaaacgcccacagatgcagccggcgtgtnatacacgctgccaccccatccactacgg

SEQ ID NO: 8111 - DNA, 1186 bp, Homo sapiens
  misc_feature (1)...(1186): n = A,T,C or G
gctgtatgggaagaccgtggcgtacagagtcgaacgccaaaggagagtttgtgtttgttgtactnaaaancngcgggcgttcncccggccaaaaccnccgggcgggatggggacaggggagtgcgcgcgcgagaaaccttcgggattgggtagagtaaaacataaacacacgcagaggggcggcattccgggctaccttccagcaaatgtgagcgactccgcccggctacgagacctggagatgaatgaactcaaacatgagttggatgagagaaaaggagaataagatcagctgtgaggagagaatagaggcagaagtgagaaggctgagaggaggggaggaaggacttttttctaggaggaatagcggggggagcagggggccaaacgggaaggtaacggaaggacaagagtcagatgggcaaagctcgtgaaagtgataaccaaagagagcaagggagatggatacgtgaacaacgtgccgcgttgtagagtagtgtacagccagcggggctagagacggtgtaaaccacactgcgtccccgcgacacgacgtatgtcgacactaagctgccgcgccagacaccaagagttctataaatccgagtcggtagtatggaccggtcaagcggccaacgtaatattacatggaatgctggttatgtgcgagcggtgcgtctgggagagacggcacggtaatcacaaacgcgcggctgcaccgcgaactgcgggtaggcagggtatgcgtgggagatgcactattcgttgcgcagatcttagtgagacggcatcgcggtgcgaggaaggtgaggtantgcgcgcccgtttacccggagcatacgccactatcgaatatatgtactgcgctgggtggaggttggtgacaacacacacaataggtacgatgtacgatggcgtataagccgtgaggggtcatacacagagacgacgtggcaggcagctacgtagccgccacccgcgacttacccctgacgtctagtgctcgtacggtgtcacgtgcagcatcgggcgtcgatattctcccgttcaccgaggcaaaatagcgcggatgggagcaggaggttagatgcgcggaatggcgggtgtaaaatcattagatagcgtgggcgagattcgggcggggataaatcgggtacagtcctgcctacaggacaggcaatgaaag

SEQ ID NO: 8112 - DNA, 812 bp, Homo sapiens
gctagctgcgacgactctcttaattttccccgctacagctgccatgcaggctgcagtgtccagaagcgccttatggatggtctctccatctgccctgacggctgcccagaggggagggtacccttgcttaccggttttacaggtggagtctcgctctgtcgcccaggctaggaccgcacgccgcaatgctcgttcactgctatccgtgtctatccagtctataccatgttgctgcttaactctacggagtagctgggactacaagcgcccgcccacactcccggctatttgatcttgcaatcagatacagggctttcaccgtgttatccagtactgccttgatctcctgacccgatgatcggccctaccatgactcccaaagtggtgcgataacgcgcgtgagcccccctgccaggctatatgttttgctaagcatatccaacatgaggcctctattcattgtcatggtataccttaatgattattatatagccttgcaacttgggagatactgctgtgcaacttgccaatactctagcctgttctttcaggaatactgtaaacgcaacctcttaatttcttcctttggccaaatccggatagcacctcttaacccctctaaccttgaatcggtatcctttttagaacgtatatctggggtagacttttccaggtgttatcgttacttcaatctcctttcatcttgccctcttggcatctgcttcacgacgggtatacagactttactaacgtaagtgtgcaccagtctcgcgccgattcttgtctatattcaaattacctgtttcatttgc

SEQ ID NO: 8113 - DNA, 1660 bp, Homo sapiens
  misc_feature (1)...(1660): n = A,T,C or G
ctcgacatcccgacccccgccggtttatatatattatgtgtcgccgatatcaccgctttagcgccacgcctttattgctcattttatataaaatgtacacccaatccttttacgcaatgacccacgacacactacaacgccgagcgcgcggtgcggcggtgcgaggaggagatgatatcggatagactgattctagtacgccaatcgaccttacatctctcattacaacgactggttctggcagtcctatactagcgccctagagcacaccgngcgatntgatcagatcctggcgccatcccacacttgcgtatatgttactactgagttcaaaagtcgtccggcgctaccgcgaaactctaggcacaccgtatatgaggcgacgcacacgggcgtgatagactgactacgtgtgcaagagagatattcacntggactcaaaccagcagatgttctgtctacacacataagtaagtagactcngcagcaatactgagagtagaggagatagtcatcagtatataacatatcgtncgcactcagcatgcaccgctcaanacgaatagagatcacagtctgacgacaacgacgatcgtcgtgaggatgatgacgcactagaaccgtataggagcacncaccgatacgcgatatcagcccgcgtcgcagctgcgtgcactgacacatgacgctgatcctcgtcntccacgatacatcgcgacntatccgtcanggcgtggtgcgcgactcgcctctgttacagcagtgatttcgacgacctggcacgacctgtctcncattgtcagatgatgaacgatatttaaccggtctacagtagcgtctcgatcacgttcgagcacagcgtgccttcactccgcgcgcacgagaactgataccgcatctccacacgttactgcgctcgcacagagatatcgncgtctagtctcgcgcgtcatatcgtgcacacatcgcgtggcacagtatnagatagatatattcactgatgagataagcgcgcgcatacgaggatgtagtctgtngctgctacgctagcggcgtgtcgtgtctgttcgcgtcgatgaagtgcagctgcgcgacagaacaatgcagatgagagctataaggtcgaggcgcgtcgcagaatggagcgatntctaataanagcgttatatccatgtgtcgactgtagcgacgcngatcagtagtcagcttcctacactccttctctgggcacgcgatgntancagcatgcatacgaagatgatgtatgatcttatatagtagcacgattcgagcacacatatcagaccgcgatgagcggtatatcatatccccgatgtatgcagtgantaatcgtcgacgagtaatacgcgtgtccgcactagtcatcatattgtgtattatatgantacatntcacatcatccgctacactaacnagtgtacntgatatatctgttatgtcagtgtatcatgatattacatgagcacgcactacgctagccgcatcactactatagtatgcgcatgtcgactaacatggtttacgccagagctcatagtagatcacgtctataagctacacactgatatgaacatctatcactgagtaagatgacgagagatagcgcccgccaccgagcataatacgagatctcacngcg

SEQ ID NO: 8114 - DNA, 1619 bp, Homo sapiens
  misc_feature (1)...(1619): n = A,T,C or G
gccgtagcgcgtgtgcacggaccttatggcgagcctcatttcgattacagangctcgtccgtggcgtcgtatactctctgcgacgactggtagcgaggctccgttaacaccccnatagcgcgcctggtccgtcatgtagatctcggtggtcgcttnatacgatactgttttctcctaacatctgatacgacgcacctaccacgtctgagacactaaggtaccatcncaccacgtaacgatagtatatctatcttctggtcttcacgtcacaccgtgactcgagcgcgctgtccgcgtccaatacgtgagcncgaggatctggaactggatgaagcgtggttacctataggtcttcgttgtctcacaggagcgcagacgtacagatcagaacagacacacanacagtatagagtcgacagtctcatcgattcgtncagcgaacaagatatgcgtccagctctccgcctgcgatgtatagttatccatgtggacagcggtaccacgcgactctcacgcttgcgctcctgctctcgcgccacgtacacagatctacacgcagaatgtaccgtcagccgctgcgtcgctgtacgtcgactgacgagcgtgccgttcgccgtcgcgcctacacncagtctctactttctgctctcgctgtggtggctctcgtccacgcacgtggctcgcgcangtgatactacctatatcatgctggtatatcgcatagagtcagatgtacttctacatatatcatgctgtaaaacatgacacgagcatcttnanactgatactaacanagcnagatggcgccgtgtacgttcactggttgtacgctcgaatgtgtattcgcaaggcagagcgacgatctagtatgcagacacatgtgtatctcaatcgccaacagcctgtcagcgagcgataantcacncgactgtaagaggtatggnctgataggtcagccgatatagctgtctgatatgagtcgcgctgtccangcgcgtccgctgcgacgagtcagccgctccgcgacgcggagtacacactgcgtctcgtcgtctgtncgtacgcntagctctctgcgtctgcctcgacgcgccggtctcatcgacgacaccncgatntgactgntgtacacactccgcatcctcgatcatatatgatgcagcctgctgctgctacttataccgatcactcatattctcgttttggtcggccacgccccggtggcagagcgcgtcttcacatccactcactatcctgtctctcctcttcgactcgtcantgtcttctcgcgtatgattagtcagtacggtgtatctctctctgcgacgatgtgagtgtctcgcancgtgcatatcaccagctccagtccgactgattnangacgcntatancattntgtgcatcagactacgcntcgcatacgtcacgcatctcgcgtacgccgcngatntctcatganacagacgcgacaggacgcgcgaacgcagcgacgagcatcagctagcggataggagtnatcgcgccgcgatcgcgcaacgtcgcgctgacatagcgcgacgcctacttgtanacatcgttgctcaggcgcgacactgganatantgagctcgtgactgcag

SEQ ID NO: 8115 - DNA, 1035 bp, Homo sapiens
  misc_feature (1)...(1035): n = A,T,C or G
cggccgaggatccgtatcaagctggtgtgaacgtaccattcgtgtgtgctaggaacagccattgccactaatgccggagcggtgtctgtagagtacgcgagtaaaccactttgactcaactcactcttcgcgaagagtaagcggaagagaatagagctggccttgtccctgctcgaccgttcattcttcactgtgctgcttatagaagacttccatcgtcgcgtgctataaccgaccgagctttgcaacgtccgtacctacgtgacaatggcctccaacgcccgtgaagaaagagctaagctcccacatcaactaagcacagagataagaaaaaccgctccgagataagttttatgtgcccctttgcagacagggataccaaatccagacctggtatcaacgtgactcgctgattaggtgcacgttgtctcgttatgcctccgtggtagtgtcacaagtgtcctgcctcggtgctggcgcctactaaacgccgtcaccctgggggatgtggaatgacatttgacatttatcacgtgctctttcatacttacatagtattgtatcgtccagtatgtcagttaaaggaatagattaccaaccacttacacaccgctagccgcgtagcgtgatatgtcaggacgacctactcctcatgtgtctacctagttccatacgcaggaacggggacgcacccaactcttaatacgacagtatgcacttgaggtcagtctgttaatttacggttaagactgactatcgtgggacagatgcgatgagtgtctgtcccttaacaccgctcacgcatacagcgcccactagtccctacactagtcggatgcaaacacacaaaatgaccgatggtgaatccatgatgccccgagcccggacgtcgaacgacagacagaagaccatacatgcacagtcatcttaataataagttctgtggacggcncgaacgcgtgtacgcacagcacggggaggagaacccgagccataatccccgacatgacagcatgtttgttctgaatgaagacg

SEQ ID NO: 8116 - DNA, 1702 bp, Homo sapiens
  misc_feature (1)...(1702): n = A,T,C or G
cgtcctagaatatgatatctgtcnacactgatagccagcgcgactcatatatatgagctgtatgtgtnatctgactggcgtatctgcgcggggagaattggtgcgtnacgagcttctcttaggatacagtatgtantatcaatactatagcagatataagnatactgtnacttatgtatcatcacgatctgcgcacagtcagtagctctacagactatcgtgcagagagtaaatggtgtgtagttnnnacatctatatgtnaagagaatctgaacgtaatgtcatcatcagtcaagtgcatgatatggctcagttaatnagttcacacgacgagagtcgcaaggcgtagatacacacagcgtagctcacgcacacgtcatgtacgtcgtagcgatagtatgaagctcgtcatatgtgcngcagatgagtctgaccatgacgcgancaccacacgtgcgacactacgtacgtgttcgacgtcgtgtatgtgtctnnccctcatgatgcnnctctcacagcacggcgcgtacgcagcgcgactgttgtgcagcgtcgatgnccacagtatatagcagatgtgtacagctagagggcgngnctcggctacatatatgacttgtantgacgaactcgcccgccacttgtactgctttattcgcgtggacactgcttctcctataatttcatacagagactcttctatattaacattaatgtgagatcgtgacgtctcaccggctcaactgtctccaatatacattgtgatcgcggcgncaacgcggctctataccacgccgtgagacgtatctcgctcntgtactngcagcgacgcgcgcgatncacgattacancgtacgacatatgtntnctgcatantcacagcgtaatctgtnacgagngcatcatccacgcatctacgcatactggtatcatcagcttaaatgacggtcggttggcggnccntcagagtgcacagctgagatacntctgcgcgcgaacganacagcgcgagcntactatactntcgctcangntaatacgcatcactattgtatagagtgttgtatgtgagtagatgtcatacgtcattaaacgtgagtcatgctacatgtctagaggtctatactctcatacttgttacatatcatgctgtctctatggaggctaaacgtctgtgccttctagcancgtcgnactatagactgtatctcatgctgcagtngagagtcatatacgagtagntgctcatcatacactcacacagacgatgatctatgtangacactcttgtactattatgctagattcgcaatagtgtgacgtacgtcngcgattgctnatgcatgacttacagcacgtcgcgtacacgangagcgctncgcgagtatgcacacggtatatcacattcantagcaacntatatgcactcgcctgacgcgctgcaacgagcacgactntgcnagcngcgccgcgcgtcganctctcgaantgatagacaatatancacattgtactagcacaaacacgaagcaccactctacgtgtatccctcacgtcgcacacaatagtccgntccgagtacgcgctcgcgctcagagactgagatacgtactngtttctatctcaaggacgacatccacggaccgcgcgatcgtgccaacgtatcgncacgcgctctgactgcttcaacgagctcanccgg

SEQ ID NO: 8117 - DNA, 1833 bp, Homo sapiens
  misc_feature (1)...(1833): n = A,T,C or G
tgcaggatgaatggagtagtagtatatatgctagtgtagctgttgtgtacggtgggtgcttattcgttcgtcgtggtgtcgagtatgattgtatggactcatgattcatatatctagttgtcatgtgagagcggtatgtacgaagagtgaaagatgtgtcatcgaaccactctaaggttcacagatatgagatgtatgcgatatatgcgtgcagcacagatcagtgaccgtgcgtcaaataagcgcccacagttctagtcgtagtgagcntaaagagttntctcagtcatgacgcacgatataggttctngtatgggctagctccgtctggtgtcgttgcgcgttgcgttcataccgagcggtnagntatagtagtatcagcagcttagtganctagatgagcgctgtcacatcatactggtgagatgagtcgtcggtgntgcngtcgtagatatctncacataagactncacactagatcgtcacactgatgttcatgatatatgtctancaccatgtagatgagatgagagtgttcggtcgacgtagcagcnacgcntctaccgacacacgatnacgtccgacactagtagcgaggagcacagtcggccgtcatatctccactgttcacgccttgctcactncntcacgatgatgtcnactgatgcatgtgatcgnnctagctcatctagtgacgactntcatgctgacgcgtcgcagtagatgangtgctgtgcggccngtctgcgnatgcgcacgctcgtacgcatgnacgtctgtatctactggtcgtctcgaagcgtcacgtacgcgccgctgctacgcgacagaagtcagaccgaacatctcgtgctcttcgtacgacgtnaccncacatctctgtacgctcgtgacctgtnccnattgcgacgtcactgaccntactgacncaccagcgcacctctncatctctagtangtctcgctagtcacatcgaaacgatgcgctgctntacgtctgcactctatctacgcacgacacgcgcacgcgacacgccncgcgtgccacacgcacttcncctngcctgcatcctcaatagacnctctatgacgtacgtcncagnanactcgctagtgcactgcagngtagagagcngatctggtgctgttgcgtgtacgtgatggcatggagcagctcgcanatcgtggctagnatngncgagtatcgtacgcactagtcgtactgctcgactantcagtgcactcntctaacncngacctagccgncacgtctgcgtcgcgtctnacgcagnctgctaccgcgctcgacgtcgcagtcgtacntacagatgcaatgntcacgtacgcgtgtagttaagtcctgtgntgtntgtgcgatgagtggnatggtgtctgtcgagtactcgatcgcgcgcgcgacntgcactctgacgcgcngntgcgctgcagtcatgtcgncgtgatctacgacgcacgcagcncatcatgcacacgagcgcgagcgctagtgngctgctatcgctgcgtgtcgtagtcgatgcagtagcntgagcgcgancgcgacacacagccntacgcggcagccgacgcgcgcgcgcgcgcatcgtgctcatgctattttgtcgtgcgtagangacngtcattcggcgcgtctacggcacatctatgatgctatcacactctgcgactagcgtgaacactccaacacggtgcnaagcacncnagcgcacgtcctccacncacatactgacgcgancttnctcactagcgcgacgncaagtgaagcagtgacgactatagtacgannanataacgcaaccacacgacgtatcag

SEQ ID NO: 8118 - DNA, 2009 bp, Homo sapiens
  misc_feature (1)...(2009): n = A,T,C or G
ctcctgtctacactatatcactactcgctancactgacgccgactacccagccgtctgcgtngtntangacctacatacgtgtacgaacgtcacgagcgactcacacgacaagtgccagacatggagatcgtgcacactgcgtcngcctctaccctcgttggtcacacacacgccagatgcacgtccttacacgcaccgantctctaccagtcgtatacatcgcagcactacgtcgccatatacgcatactgatagtgagaacgatcatcgcggtgatggnnnaacgcagtattctctatcaatgatcctccatcggcacacactcctgtagctatcattcactactgtctccacgnttcgacagcngcaagatgctgtntanantacaacaatagctntctcctagcagcaagtcanacatngacgacgtgaatagcgtgatatcnagtcgcngantatatacgtgatatntctgatcattagaagtgtancanagtacactatagtgtacngtcgcttatagcagcgtncactacgcgtagttcggtcagagagcagatagacgacgctcatnacccaatagatacacnatgtgtgcacgtcagcgcatcatcggcatcagcagtgagatganantgcatgtcnaccacattagtaantaaaactatgncagagtatacatagtcagaccaantacnctccgcatacacacaccgaagcttcgctnacgcgactcagtaccgcttacgcgtgacagttacaatgacagacagcgtagntacatctatggcgagcgagataacatagcactaacgagatcgtcgcgatgaaatacgcagtctagcaaccaacagtacctctacatcacgcctcacacgatcgatatagtatctctagcttgtatnctngtagtctgacttctcatgngtcctcggcgacacactaagtcacacagtgttntcnanctcatcgcgccatgactcatcactgcacgcgtantctgtagtgantatatactctgcgttcatntgacacgttaggatctcgtcagagncatacnagctcgcagtgctacactggccacatatcatgtcgactgagctcactcgtagatgatttagcagtgtgtnagtgncatacgtaccgtgtcgcacgtctcntcctcatgcatctccacgcacagctactcatcacatntancatcatagattacatctcnatcnatctatantataccagtgtgatatacatgttngacgcgtatnttcgctgacgcagcgcaggtgtcgcgcggtncgnctgagcgcgtgctgacgcagcgcacgncntgcctcgcgcaccgtcgcntcttctgagccgtcactctgcctctactctancaggacgtcgagtgagatcgancatagatcatcgacacaacacgagcatgatgatgcgcgtagcatatanangacgtagagacactgcacacatgacgcgttagtgcgctcatacgcacaccactcagtcgaancgatctcatacgcttgattgagtagtgtcagcagacagttnctcgcacgtncgcgtatcattntgccngctacgacgtacgcgtancgtacgctgatcactnantatcanntctantgatcatcaattagntcagcttcacgacactcntantanctntatntccagatgtgtcgttatntactatactcancncgcaaccgacgcgnctacntcctatctagcagcctcgnatactcagcangtatagtggtcgacncgactgaccgcaacnctaactcgactaacgtacgntgagtcgctaccgactataccctcgacgcgctctacacncncatgtcgaaacgtgacgnagtacgtacgacgacagcgacactatnacttcacgtcaancgagctcgcgcacacacgtccgccantcgatcactgcactgactanactgagtcatgagcgagcgtcatcacttcgacagcacagncaaatcagcagcgatag

SEQ ID NO: 8119 - DNA, 1799 bp, Homo sapiens
  misc_feature (1)...(1799): n = A,T,C or G
ctgatcacntcttacacgcagcacgacggcttcgcgcgatctgacgcgcgtgtctgatgtgtgagactgtagatgntggagttgtgtgacganacgtgttctgacgngtgtctatctgcactactcgagttagtgctnagtgctagccgagtcgctgtctcgagcgcgcntctgacgttgatacgctgctcaacactatatgtaagtgatcgcgctctgcatagactaaatatgatagtctgcggcggcacgactcncgacagngatcagcagcgctgagtatatcgctgtatctgcagcgcacgtgatatctatagntgctgtcagatcacagacgancagacntanctcgtacgcacaacagngcatgcagnataccggcaganctgcaggcgtacgcatgcgtgtagctgacgtgtgcattanagacacagtcatgacagtctgtactgagcacactgcgcgnagcgcgtcgactgagactncactgacacttctgtgtgcgtcatctgcagtctgtagcctgngtgcnagtatcacgtgtatgcganaacgacagacggactgtgactcgcngtcgtgtangcgtcgtgntgacangctatgatgagactggcgnctgccgatgaggcacgctgntcatgcacgnactctcgtcgctgcctntagcactcgacgtgctgcncacagaaanagcactgcataatagcagagttactgagagantacactgagcggagacagacagcaganntagcaacggtacactngcactctgcaacagcgtgcgtntctgtcgacgtcgtngctgagtccgatnctatatagcgcgtgtgcagcgcntgtctcatacgttgcatgtcgagactgagcgcatcgacgaccncgacttactagactcctcgtctgcgnacctccagtgtatcgatgactgntaatacaccgcagtacgtagtaggatcgagacatctagacgtctgangcatattactagcgcngtagcatcgcgcagtgcgcactcagctcgccagatcactggcgacatagaataacgatagtcacgactatcatantagtgacagtgtgatatatgagcacgccacgctgaatcgcagntangtgtactatacacggtttagtcgttgntcgcgtctgtgatcacggcatntgtagtctcatcggtgacagcgacaacagancgantacngcgcgtactgatgtggtcgtntcagcgtgtgcgtcncgagcgcgctatcgtaccntatacactcatactacacacgtcgcggtnatcncgcagctgtcgctgcgtagcgagtctaggcactgagtaatcttcgagcgagctagtagcagtagttagtgttgtaggngtgttacgactgtctcngattgacttagcatcagctgagacacgcgcacgacgaggcacgcgcgtgagcgatngcacgcagagtcacagaagaagatgagagccgagctgctgcgtgcgtgagcgtcganataggcatgtagtcagcactacatgtaggnagtctcgcacgcgtctcnattacagcagtagatgtntngaatgctgctacgtacgcatcgagtnaacgagatgagtctgctacagcgatctcatactcgacggcgaggcacganagaggtcatggatgncgcgcganctcgctggagacgtgagtgagacangacatcnancatgagatggacgantgggacgcgagnagatgacgtagccgactgtgtgcgagaacnatagtgagtgtatccttgagtgatgtgcatgcgntgag

SEQ ID NO: 8120 - DNA, 333 bp, Homo sapiens
ctagggcgctacggggatgccaaattccaggggccagaaagagcttgggataaaaagaaacttcaaggggacggctttgacctgggctggggctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcgtatgcagaagctctgcatctgtagattcagcaacagcagatggaaaatattcagaaaataaattggacggttatgtttctattgaaaaaaaaaaaaa

SEQ ID NO: 8121 - DNA, 1324 bp, Homo sapiens
  misc_feature (1)...(1324): n = A,T,C or G
gcggcagagcacgtgccgtcacgctcatccctgtcatcatatgttgcgacgcggaagagagggacttcgttaaatgangaaatnagagaagaaaaaagcctcaggngggagagaggaacaagagcgtacgacagcgatcgcgtaggtacgcgaagcggncgacgcatattgcgctcacgtgccccttacagcagctgtagctgcatttacgtgagtacgtgtattcgttgntgccgacccgtgttcggtctctcgtcttagaatttcgttccggctgctgtgggctggttggcgtgtccctgtcatatggccatccgaactcgtctcgatggtttgctgctatcattcgcgtctgtagtacctcgcacgcgcggtgtgtttgattagtaatgagtggagcatatgcctttggtgtgggtcgcgacgctgcggccgctccacgctaccgaccgtgggtgctcgctgccgcgcccgcccacttgcccgcctcggtccatgcctccgccccgtcaccgtgctcaatgtctccggcgcgcgcggtgtcagacgttcgtgcgcgtcagcgtgagtagcgtgcgagtaccggggtcacgcctccgcgcgtatgggacggtctacgtgtcggcgccctgcgtcgtagacggaccgcgagctccgcgcggcacgatgttgtgtcgtgcgtctgttgttgctcgtgtctatcgaccgtccggctccggatcctgaggtgattattctgacgtgagatatgagancagtcgtcgcctcgngtacggtcaggctgagactcgtgttcggtgcgcactctgctgactcacgcggcaggcatcacagtcgcgtcgccgnctcgcnctcgagatgccgtgcgcgccgctcgccgttagtctgggcagtcgctcccncgagctgctctcttacctcgcacgcgcgcngagctgcgtggcgctctcntcactgctactgtctgctttcgctgtatgactgcgacgcgcaccccgccctgctcagtcttgctcgcatacatctgcgcacacgttacactgacgctgtcancncngcacgtgtgcantcactcgcgtctggatactgtcactctgcgtcacactacgaccgtacatagtgcgtcctcgtcgagagcgagtctacacgtcctgtcgcncagactgtagtacgtctctgtgtcgcccnacgctccctcgctcgcgtgacgggtgctctgtcgcctgcgcatcagtgttacacgtcacgtctgtaagcacgtgcgccncaaccgagtgatatacagtctcgtctatccgcagcagttcgctaagcgtggagcgac

SEQ ID NO: 8122 - DNA, 849 bp, Homo sapiens
catcacctttaagtttgtggagcaaaggtgaggggaggtaagggggggcccttacatttaaccaaaggactgtgttctccatattcacgcttcaaacaaggaagatgccacaatgaatggaacaagttcacaagcgaaaagggaggaatatggaaactaaaaaagcaaatgtaatttgttattttacatgagtatgttacaaataataacatctctattcttacagcaatttggcccagattatctaacagacatacctgcagctttggctcttggtattgtcaaacatgggggaaagtgacaatactgttggtccttgtaaatggtaaaccaatccaaataatatcatatcatgaatgatgtgcagttaatttatttacaacttatactaccacagaaagaatgaatattttatcactttgtaattttctttttaaaatgtggtcagaaacatttttccaaccaaaaattgggatttctaattgaggccttttaaaaattacttgctaaaaagaaggaaaatgagtcttcctttaatgcaaaatttgcgagcgcttttaaattacaggatcgacttatatacaaccgaatttttcaaataaatcttttttggctaataaattatacatctgtattaacaatgtcggaatagtgacatattaacatttaacagaacaatttttatgaagttcttagtacttttatttttttcaggctaacacgtcaagtttaggtctccctacattatatttatcaccattttccggttttaaatccaatataacatgcttcaaacgaactaacaataaacttatgtctaaaattcggctaaacgttcatagtacaatt

SEQ ID NO: 8123 - DNA, 492 bp, Homo sapiens
  misc_feature (1)...(492): n = A,T,C or G
ttcgagcttttctcccttccccccctccnnnnnnnnntnnaanaacnannnnnnnaaattccaattttgtcttcccttttcccccccttctttaaaaaaaatttttccccactcccccctcctctcttaaaccccgaggttttttgtttctccccttacgcttaaactctgtnccccntattccttttcctctttttctcccccctcccccccttgtgctttnnnntttttctccctccctctcccccccccggcnnccnnncnnccccccncccccccgnccctnccncccctctcccccccccccccctccccccccctcccctctcctccgcccccctccttttttcccccnnnggggntttttnnnngggggggcgcctnntttccccccccccccnnnnccccttttaaaaacaccctctcccttttttccccccnntttttttcttntcccccccctccctctccctttcttnccctttnnnnnct

SEQ ID NO: 8124 - DNA, 815 bp, Homo sapiens
  misc_feature (1)...(815): n = A,T,C or G
gctgngtggtactagaggtgcgggtagatgtcaggacatgcttccctcaggaattgatgtgcatgaggaatcctggagaataagaaggcatgaagtagagatgaaagagaatgtttcacacaaaggaaacatatgcaagcatcaactcaactctatgcctacagttctggggcagaagaactgccaagggagaaattatgcattgcctgcccccagttccctcaggattctttacattaaggaagaaatcattctcaaaatgtggaagccaaagcaaactcccattcttgactagaatattcagcttgccatttaccattccattctgagaggcaaaagttctttctctcagtcccttttccccagaaactgtgagaaggtgcagagttgttggatgaagaagcccgttcatcaagggctcctccctgtttcctgtgctctttctcaacccaaactcagtgtgcctccttggccttagcagtttccttcactcctggactgatgggtggcacatgattgtgcactaaataccacagtacatacgtgaggaacacctggctaataacctacagccccaatttctaattcaggacccttacccatgtaacccagactagctagaagcagggaagggcctctttcattcctggttacatgccatatttattacatcctaaacagagatgattacatttcacattcaactgtccctaaaacatttctttaggctcacaaaacatagcagcagcttatcctccactaattagagactaattgacttttaacactgttatcaactgagacaatccttcctg

SEQ ID NO: 8125 - DNA, 1887 bp, Homo sapiens
  misc_feature (1)...(1887): n = A,T,C or G
cgcggacagcccccagccgcacgactcgacctggtatnatcgcttctgcgttctgccggctnctctgctatgtgagccaccgcgcgctgttntgagcgtccagctttaatcgtgctgtcgcgcgcgcgagctgctgctctctcgaagntggtcgcgtctcgctgttccctctactgccgcgcggcgctgtcggcgggagagatngtctnagatagntgtntatacgacgaatatatcactctcnaccgtagtgcncagtcacaatgagtcaggattatacagcactcttactccgagctctcactccatctcggtcgactccgtcggtgtattatcggtgactaagtcactgcggcgtgcgtatcaagacgatgtctgagaancngtatccacaccaacgncatctacgtgnacgtcgactccatgtgtctcgactgctntagngagcngangcatgcgntgcggatattcntngccatcacgatagacntatatcancagtcgtcgtcagngtgngcatacacgatagtncgctgtgctgcngnngcatgcangcgctncgtgncatgactnaggcncgcgcagacagcgcagcatggaagtcgtgtacgtagatgcagtgtttcncgcagtnctgtcgtctgcactcagcgctgtggngntattgcgttanagagtcatgcgtcgtcgcagaacntcgcacagttattcgtaactctgcgcgctcgtgctacgacgttactatntgacacgtagtgcgatcacgcgtatgttctccgtatctccgtcgatgcancntntagtatagctagacatagatgccgancttagcancanagagtcgtgatactcacacangatatcacgctagcattcaggtaacgatacagtcgcgcgacttgccgatacgcgcacgtanctantgcacatgtcactcgcgcacgctngtcgactgacacgcgtactcgtcgtaccctactangctncgatgcgtcgtcgtattactatacacatgctcacnantcactgactntngctcactcgtgccacatagctacgcagctcgnatgacgctacgatgtactncgtaagacatagatatcacgactatcgacacactntacgtgatgctgaccggcgtgactacgcgtcgcgctgctgttaatatcgcgtagcacgagttaatcagcngtgcagttgcccgcgcacgtacnagatcgagtctgcttgcgacggcgactcgtcatacatacgagagcacgagangtagccgcggcgcgcgtagagtctcggacgctcgatcgngatagagacgcaagatgctgttantcgaggtgcgtangcatcagctgtcgcgcatctcgctacacacgcgatctatcgctgcacactcgcatctcgtacaanctgcggcgaccagcgatntcgagnactcgcgtctgngatgttatgcgntcacagatctcgacacgcgatctcctgtacgtcatatcnatggtgatctacgcggcaacgacgctcgcgctagcgtaacggatgagaatatgcatgatcggcgatctgcggctcngcgcgccttgtcaccctncnatgtatagacgatngtacgactctacgcgcgcgtgactcgacgctgtgcgcgcgtatacttgatggttcgtgtgatctgtataccggactgcgcgcgtgcggtgtactggcgcgagtctgtctcgtggtctgtaatgttcactgatgacttcccgatatgagacacgcgtagatgcntgtattngntgcatgtcgtcgtccgtntatgctactatctgcctcactatcatctgcagtcgctcncgtcgtntagctactgatacgcgcacgacactcagctccatatcatcccacacc

SEQ ID NO: 8126 - DNA, 2253 bp, Homo sapiens
  misc_feature (1)...(2253): n = A,T,C or G
ggttatttaattnnnnnnnnnnnnnnntntnnttnnnnnnnnnnnnnnnnnnnnnntctngtnnngtnnntannannnnanggantannnnanntnnannttnannnaannnnnnnnaannnnnnnntntnnnnnnnannnattnnnnntnannnnnnnannaanatttttttnnntntannnanantanganntanngttttnnnnanattttnnnatatnnntanntnntaanntnnnannntacanatnannnnnnnttatnnttntnntnactattattnnnnannannntnagatntnnnttnatnntnntatnnttatttttnaantntntannanatataatatatgatagcagtatacgaagaangagagangagagcacagtgacgagtataaagagtgagagggtagaaagattgtgatatataatatgtnncgatgtatattnttacgagctgacatgtaagtcagtcgactgaagagatgtagaaaatatatatntactgttatgttggttagaatgtatgtagaatttntngtnctntattagattatataaananattattacatnattaaagnataatatntcatctacatntataantatantaccnatanaatnanncanctttanncactanatananatcaactcntnatncanccngaaanatattatnancacacatgtcgtagagatgacancatatcgtcagacagagctcacgacnacgatatgcaggtctacatctcacactngtncnctcntgtgtctngctcctagtcgtgctngacgttggtgattgagtatgnangctgtgctgacacgctcanangtngnatcagtagngngttccntantactantancagtncntagtnnaatttaatagacactattngtatagctagcntatcgctcattngttgtatcgacnatatcactagcacacagcgcagcagtctacatcaccgtaacagccgctcacgtcgtatcactcgcancgctgactgtcgctgtcgtctcttgtgacgtcgttggtcgtgcgtgcgtgcnctgctctcgtgnatgcgctgcatgtcgtctacaggctgatgtagctacgcatnactagnctgcgtcanatgaatgntcgtagtatgacgatangtcgttcngntgtacgcatagtgatgatcgcctgatacacgagcnactactgcncgtccgtantnctaantcgtatcatacactcactactcacagtacgatngcacatcntcatntctaganacatgacgtcattgtgtngtgccaactcatactactactgaactcancatcacacacnatcctatcgcatcgctntnacggtacacacngaccnatctcattacanntatgtactgatangatcgtactctcagtcatanacactgacancaganatagtcnttnatgngtgacgagtnagacgacagcngtctgactngntgatgntggtgattatgtcgtctatnagcgangctanagtatacagctggttcgggtcgtagtagcagnagatgtagtancgaacgtnanntntgatctgtatgantatatcactagtntgactagtgatcatacgantcatngtcgtagtagtgnacngcgtngtcnntgtnctgcgntgngtcatggtngctantgnactgntcntacgtctagtgatggatgtccatgatgcatcgncatgatcgtancgnacntnacngtacgacgtcgaccgccgatagctcatcggctcgtcgagaactncgacgcatcgncactgcngaagcnacgtcgtctcgtactagtatattagacgantnctaccgatcatncngaccanactnctatctactatacttcnatantcctntagtcntcaccantnncgtncatcgtctactgtagttacaatcatcgtctnactantagtatgccgacgacanctaacgtcatnatnctgnatgtagtagtgttgatacagcatcgtatgatcagtaancgangacngcntnncgacttgatgctanattgtagcgncgtccagctagncaacgctaaccgcgcagcntcangactacgtgaatcnagttntnttactatcatcanctacngtagctnatcgcgacttagctactntcactgtantgacgnacgtagctgntctgttgttacgtatcatttacatcatnagangcangtntgtcgtcttacgtactncgtntcttgct

SEQ ID NO: 8127 - DNA, 1494 bp, Homo sapiens
  misc_feature (1)...(1494): n = A,T,C or G
acatgagactgcctactgcagtaacgtacatactacagtctccccgtataggaggatttacggttagtcctctctagcacagcgaagctatgctacgcgcgcagcctcctacgctcagtcnccactcacctcatctactcacgagcacacaggcatctatgaaccagcaatatagaagccaanttgctcaacgacttagactctatccgccattacacgcagagtgtaccgagcgcgatgcgtcgtcncagcttcagatggaactnactatccncncatagcacgcagagtactnagctacatctncttcaacacacatgatgatgccacaccgtacaggagtcactgataacagagtcgacacaaacacaaagacagatcattctccggaccaggacgcgatagataggcgtacattgttcactgcgagcagcgtctcgcagtcgactatcacaatatagtcttcaaacgccgagcacgacgatgagtcacctagccactcaaagagtatcgcgcgagctcgatgcatactagccgcgctgatcaattgtgcgatcgcgcgagcataaccaacatctgtagcaatggtctgtcactaaatagtcgacgcacaatctacgcgactactctatcctacactgttacttcaaatctacctcatccacctctactttcgatatactagaatagctatcttggtgatagtctcagctacagatgtttactagtctcaccggccactaccatgaccagtccatgtcccgccgcgactcctcacccaatacctgccgtctgagcatgacccactcggctcccactcactgtcatccctcaaccagcacgctctgcacataccacagagagaccacgaataacagcnactgagtcgagatgcaagattggtaatcaacatcttcttcctgctcagtcataagccntatgcacatatactactagagcacgtgtcgtcatcagtctgtagaatagccgcatcgactgctcgcagtctaacagcaccccgaatatataacataactactacgagcgctggctgtgtactctctgtagctaccgatatacagcttctcgcgctcgacgctccactaatctaactagctgtatcattccagtctntctacgcgtctatgtgcatctagccactctgcataggacatgtcgacggacagcctgcaatccacgccgactcatactccttccgtgaatccactctgatatctcttcttntctatcacgctgctactcgacaccgacgtacatgatntgcatctactcanacttcacatcgctgcagcatntatagagcgagtctatgcacacgaggagcgctacactcacagataagcaacagcatgcacaccactgatggtgtatcatataatacacacacacacagactagagatatgcacgatagcagatntggcgtattgtactgatacagcgacgagtgagatgaagacaaggacgagtctcg

SEQ ID NO: 8128 - DNA, 1292 bp, Homo sapiens
  misc_feature (1)...(1292): n = A,T,C or G
gagtgctgtagtagggcactagtgaatgaagctgatgcaccggtctatatcgcactagtcacgttacttatcacggtacacacacgaagagatgagtagactgtgttgcatnactccatagttctgtacgatntacctgtactncagtatcgagcgctcgcacgacggtataacagatacaggcagacatgcgaaactcgctagacgatagaataggatgtagagatgacgaggcntcccgcgcgtcagcgatgaatagcgacagcagcncgcacgagatgggagacacgatcgaggtagcattctcgtcaggaaggcctctgatgtatctccggcatgcggcacagtgacgcgatgcctagcgacgcagtcgtgtagtaccgatgccgactcgagtatgacatctccacttgcctactgtgtgacgtcccaagcgtgtgcagagtatgtgggagtgcatctagtcacgatgaacctacatatagtaatgtgagattgtgtcttctaagaagattgtcctagtgtcgtactccttgtagcagactagcgcagtgatgtgatggtgcgagggataagtagtatgggcgcagaggctcacagcgtaactaacatcacactactcattgccgcgcactgagggtatgtaggttatgagtccacggtcgacacgcgcagcggtcagcacgccgagccggcgcggagtgagaagtattaaccattgtatcatacgccgtctagtttagcccatatataccaggacacgcaggatgaccacacacgaatcaatgacgcaggaactgtctactatttgcggagggcattgntgtcactgagcaagtgcgcggaagatncctttctaggacagcacgggtccccatgggaatatagatgaagattataatgagtcttgctgtaggtatgatgttgccgactggatagcgcacgtgcnatcaaggtcgttggtgtgtatatgtgcgggagcaacatgcactctgtcgctcgctgcaacatagnattactatgattctggctctgctggaagtgctgcgcaacctacttcgcgcgaggacgcgaggaacagtgtatcatgcatgatagacgcgcgccccgcatncaacatcacttcagtgcgtagaatcaggatgggagtaacagtacaggcgatcagccaaccaggtggaggctatgaacgaggcgagggacgaatgagagccacaatgcagcgccgaagagacgagaggtacgtgagagcgtagagagtcgatgcgncgtactcactaccagcgagcgtc

SEQ ID NO: 8129 - DNA, 1257 bp, Homo sapiens
  misc_feature (1)...(1257): n = A,T,C or G
cctccttctcactctcgttacatatcccaacgtcttccctctcacgtcgatcctgctcctaccactcacttatcaccgaatctctcttcctatcattctctgcactcgttatcctcacacaatatacatactctaggacatatagttttattgtcctccccacaccctcatctcctgcgtcctatccgtcgctctaagctctacataccttgtcgtagatcttacgttcaaccacgcgattgtgtaatcgttccattctctcttgatatcttcctgctctgtgatcgagacctgtctcatgctcccaacgttctctccatgcgatcgacattatcacacccagcccacttcctccatcctctcgtcgtactgcgtactccgtagtgtactcgagatcacccgcactcctgttgtgaggtcgcgcgactatagcacagactctcgtcttggtaggccagacctgcatatcagtttacagtctgctcccatcgctacttctactcgcagcgtacacgcaactatcgacatcacagacgcgccttactcgactctgcgcagtgccgccacgatcagctctcttgttactatcattcaatgtaattatgactagtacatgcatacttatcctgttaactcgatatctcactccattactncatctctaattgtttatcaagctgtgctgcacgcctactgtctacgtcaatctgagataacagttcacatatacacttcgccacgtcaacccatcttagcagtcgagtcacacgcgccgatcgactccgtatgttctcgatgtgacatggtcctccgacatttgcagnacgctgtctcgtaaaatcttntatcacatctatgtctgtacatctgccttctttatctatcatacatcgagcagcaactctgcttatgagttactgacctactctctcacatatctacgcccgacgaccaacatatcctccgattcttctctggttgaatactatattcatcgtacctcgcgatcgctacgctacactactcactctgtcgcnatagtccctgtcttttctagtgagacacatagcacatgttttatatagtccacttactacttcgcactgcgtagttctatatatacagtgctacttacaatataatagatatccacagacgatcatcacagcctacgtttactgcacttccgcagcagcaccgccagtggttccgcacaccacttgatgaaatatgcacaacggcatacgagctacggat

SEQ ID NO: 8130 - DNA, 1118 bp, Homo sapiens
  misc_feature (1)...(1118): n = A,T,C or G
gtatagtggtgttaacgacaagcagagcaacagagaaaaggggttttcggggggaatgggggcgaggcctactgaggtcgaaccagaggcgctcctgaccggcatgctcacgacggagcttgaccaccgccgagcagaggcagtgtgcgcagttcactacccgtgtttagtcgttgtcatcgcgtgagagtacgagcgtacgtcgccccagccaggtctgaagagaaagtgcgacacaggcggggagagactcgtcgttgcgcgccgtagcgtcgggatgacggcgggcaggaggagaatataggctattttcatagagccgtcctaatgggtcgtggctttaagcgatctgtacctctgccagatcttccccactgcgccagatctggactggacgcgatctattattttcgttatgtagcactagtcgagcacatatagattatgagcagctttcacggatcgcgagagttcgcatgagcgcgcgccgttctgattgtcgtgggtaagtgacacacccacgcncgtcggacgtcttctgccgagggacttcgccggggcgccgttggcactgcggtttctctagtctgttgaaggcgtacgatcggattaggcagagggattgagaggtagtttacatcaatcaggctgcccgattcgtgtgcccactagcactgaacatgatgtctgtaggagtactgtctgagcaactgagactcgcgcgtcaacgagaactaccgatatggatactcgtatggagcacaggctatgtgagtgtgcgcgcgccgtggagtggtttggcaggccgaggaggagatctcacgactatcgctagtattcagtttggcgtcgctgatagccgtactagattgttgtgcgcgaagaggtaggacggcgggaggtactcggcgacaaggtcacgatcacgcgcgtaatcgctacattatgtgtggccccgtcggtatgctcggatcgcntgcgtccgcgggatgcatgcccgctcgtcatggtgaatgagtcgcgtcattgtggcgcggcgctgtccggccggagcgaagggtgatgacataggcggtcggtaatgcagcgcccacgcgtagcgagccgcgcggtaagag

SEQ ID NO: 8131 - DNA, 2165 bp, Homo sapiens
  misc_feature (1)...(2165): n = A,T,C or G
gcaggacgacgcgcngagagaganacgacacgacangcacgnagcgcgacagctgcgagangagagagacgacgccagcgacggcggangagagancggcccgccccctttgangagngnggggnagggnaacttnnagagcancgancnacggngnagcgcccctgnnacggagccgngaagagagagaagngacacacgcgcacgngagcgngacagcagcgngagcagacacgcgcngcagcgcagacacagcgnnacgcgagacnagaagcagcgacgagcagcgaacgccganagnaagcgagagcacacgagacacagagccgagcgacgcacgacgcacgcaagaccnacagcacgacacacggcgagcaagacaacanagncgcaagcgacggancgaacacanagacacacacgaganagaaagaggaacgcgagcggcgcacggcgagcgcgcgacagcaanagaccaacagacgcacagcacagaagagacacgacganaccacgaaggagcgccgacgangacngcacgaccgcnacangagcagacgcgacagcngcgcaggcgaccgcgcggcancgcgcgagcagagccagagacgagcgcacagagcagccgacgcacagngncacnagaccnacacgncagacgcaccgcncacnacancgncnncgacatacacgcgacgcancgcgcancncgcacgcgcgcagcagcacgaggangcgacgncgagncgagacgacagcncancaacgagcgnacgacagncgncgnangcgcaganganacggcagcagagcagagagncaaacagagcncncgaccncgagcncgcagcgcagcgagcgnacgcgcaccancgagcganacgagancagcgancggacgncgnaccgcnacgcgcaccgcgcgcgnanncngncggcacgacgcgcgagagcgagcgcacgcgcgcgacacngcaggagcnngcgcncnagcagcgcaggacgcagaagngacgacacacgcgcngcagcgcncgangaagccngcacgngacacgccgaagacacgacnacagcacgngacggcgancacagnnacgcacagcagcngaccagacgacgagcagacgngcgcgngcccacgagnccgcanacgcgacgcnangaggnagcncggagcgggnagcgacgancgnnangcagnacgagagcgcgcgcgaagccaggancgacgacgcngggcacgagcngacgcgggacgncgangacnangacgcgcggcgacagngcacgacagggcagaccgagacgcgcgngcgnangcncgncggnacagcagcancgangaacgcgaccgncancagcgaccgcgagacancaganncagacgacggngacanaggcgacacgcgacgngcgcacaacgagnagaccacacgaccgacagcgcgnancagcgncacgcagngacgccgaccacgcagcgacgacgnnagngaccgcggngcgagagnagcananngcggagagcgcgacgagcagacagcagcgacgancagcagcacgcggcanncgcgcgccgncnacgacgaggcgaccgcacagcgcgcgcagacgcggcgcgcgacgccagcgaacagacngaacggngcacgaggngagcgcggngcaccagaggacagcgaggacgcacgcacggagangagganagngacgaganagcggncagcgcangacgacacggagacacaggngggagcgcgnagcgaagcgagagagcgcaggcgcgacgacagcgagananagancncgacacacacgnacacgcgccgcggangccgcacgcaacacgagagaggncgacanagngagcagagagcgcgcacgcgacgcgcgccgcgcgganacgcgnagnganagcagagacngnagacagacgagcggagccgacngcgacggagacacgnagagacaagcaacacgcgacgcagcangccgacgccgccgcncgagnacgcacancncancncgnaccganagaagcaacgacagcagcggccagggagcgacacacganagacaccgcgcgagcacgacagncgcgaggnaccagacgaccggggacgcgagacgcgaggagagcaaggacacagcgacaagacgag

SEQ ID NO: 8132 - DNA, 1236 bp, Homo sapiens
  misc_feature (1)...(1236): n = A,T,C or G
accaccccaccgagagacgcaaccacccagcaaacgacgagcgaaggtgcgcggggcagaggctttcggaggagagaccgaaccgcagaggacttctgaaaaagagcagaaccggcgagccaacgccacgacccgcgcaccagcgacgggaccccangacgacagccacacgcgaggcacggggcgcgncgcacagaacaaccccaccgggcgcgcagagagaaaggcgccagcaccgcagagggcacgagcagcaccacgcacggagcacgaaacggccgcggcacgcgaagcagcgccaccagaaggagaaaccaccgaacgaccagaagaggacagaaaagaaaaccagacaccaagaacagaacacggggggaggagcccatcacgacacgaccgaccaaacccacagcgcgcacaatcagcccgcgagagacggggggaagaaccggcgcagagcaacatacgagcgagacagccgacccatcccacgcagcacaacgagaggacaacgccgaaccccgacacaagagagagagcgctcgccgaacagcgacacacgcacgaccgcaggcaaaggacgcggcagccgtcaaagcacgcaccggacacctacacacgcaacaccgaagagagcgacgaccagcagagaacgccacacaaccgacggcagacgcgcacggcgcacgaccggacgacagccgcncccagcgcgaggagggcacgcgcanaagacacgccgaaccgagcctcagacagacgagacgcgggatgcacgccacgacgcgactcagaaacggcgcgcgacggaagcgcacgcgagagaacaccaacgcccgcgaccaacacacacacacagaagagacctacataatcataccaacagccgacgccgcaccaccgcacgacgaccgccgcacaccgcgacactgtctcgaaccgcagacgccaatcgacaacagactcaacaagcagccacagcccgaacaccaaccgacgccccgccagcccgacaaacacccacgacacacacgcaccgcagagagcccacgacgcgacgacagacagaggagaacgagcacaacaacgacgagcgccggaacacagcagcataacaccgaccagacccagcacagacacgcgcaagcaacaacaacagagccacggagacgaagacaacggatacaccgaagaccacgcgcagacaagagcgcgcacaggagcagagccgcacgg

SEQ ID NO: 8133 - DNA, 305 bp, Homo sapiens
  misc_feature (1)...(305): n = A,T,C or G
ctcgtgggcggcgcccnccgnnnnnaggaanaaaaaacaaaaaaanatcttcgcccggccccccttccctgtttctccttgggttttgggggtcgttccctcccccgcntntggtttcccgtccctttaagtttcggggttccttattcttttttnnnnnnnncccctccctttttcctctcccccccccncnncccttcctctctttctttttcccccccccctccccctctttttctctttcnccctccccncttctctctcccccccccccctctcccccccttttctttcggggggggggg

SEQ ID NO: 8134 - DNA, 1173 bp, Homo sapiens
  misc_feature (1)...(1173): n = A,T,C or G
aacaagaacagacaacgccccgggaacagcgacagagagagccgaagngctcgctgggggnaatnnagggaggagagncctgcagggggaggaaaacaggcgggagcgaagagagggacgagcgaaaccgaaagccgagctcaagcgggacaccacagcaaaacgccggaggagaagaaagaagcaacaaaacggcgccccaaccagggaaagaaagcaacaagcaccgcgaggcagaaaagaggccacgcaccccacacaccgcaaaacgcgccagccagccacaacgcagcgcccacgcaagacgagacagacgaaagacacacagaggggtttggacacaaagcgggacaggcaaggaccgaacaacaaccgccaaaacaagaaaagaaacaagcccacagcgacgcaggcgcgagagccgacacaaacaaaggccgacggcgcgagagcccgagcggagcccgacgcagaacagcagacacagacaggcagcaacagaagaggacggagggagaacgaacagaacagaggaccagcagcaaggcgaggaagcaaaaacacgcagcaccaccgaaacaggacaagagacccagcacaccgaaacaacgcagcgcgaaacgagacaccccacgggcagacagagccccgccccaagcagagacaagcaacaccacgcacacgagcgggcacccaaaaaaagccaaacaccagcgacgcgccagacacagagggccgagcaaacaagcgcaacagcaacgcaagcacaccacaaacacacngccacaaccgcgaacagagagagaagcgcggcagacagagagaagggaggaaggaggcgagaacagcaagcagggaacgggcgaaccggacgaacagcacccacaccgagcacgagggaacaagacccacaacgcagggacangcnacaaacggagcacanacagaacggcacacacagacgcagacacgnggagacgacacaanacgagacacacgcaccacgagaacgacacgacacccaacacggacaccacangcgaccacaacgcagcacacngcccgaacgcacacgcgccaaggacaccaccagaacagagnagaagacaaacgcacacaacgccccacccacggccacgcagccgaccgacgacgagaagcagcacgcaccac

SEQ ID NO: 8135 - DNA, 1489 bp, Homo sapiens
  misc_feature (1)...(1489): n = A,T,C or G
ccatagataccactaacattatatcatctttaatcatcaaagcgcagcagggcgggaaccttaattgggacaacgacccaaccaaacgacttgcgaaanaagcaaaacacacaaacagaaaccacgcccgagcaaaccacacacacacacccaacacacaccaaagagggggaggagggggtggaggcccacagacaccaacaaacacgaccgacgcagaacacaccagcagtaacgcaacccagacgaccgaagccgacagcaccagccgcgcgcatcgcgcacaaaacgagcagcaggaaacacgncaacaanagacacaaacatacacgcacaccaacgaagcgaccacatccaggacacgccagcaacaagataccgaatacagtagcaagagaanacaacacaantcncacaatctctatatactaacatggggtgtgggtgagtagacacatatgcattatataccatccacctaataatatatataaactataatatcaatacgtctccagtcactagaacgtgaacatcatctacctcctcttatcatttgancgactacactacacctcctactatcacgtccantatattattaataaacacacaacaccgcatcttaactatacgtacattacacgcacagatgaactcaaatactaacatcacatcnacacgtgatcacaagagaccagcattangtattcaccagatatcntcacaactctcgtaacgctataacgatacatatcatcaagctatatatgagcntctcattagctcattatcacttatgctacacatagctgcacgcggctactctatncgtctctgaatatattatacatatacactctctatgatcatactagcgtaacatcagtataacagacatagagagatattatagagtcancacgcactatctcaactatatagacagattactctatgacaccacagcacatatcatacgcgccacccactacagtcacatccagatatctaatcatgatatgtactgcagtagacatacacaacatcgatctagactcgacacactctcatataatatctcaacctatgactgagtatcgtcatccntactgatnatatnacntcatcagatacacncatcatattaattattcatcatagcagtcgactcatnctactcacgtactacgatctcttatnactctctatcattaactcatactcaacatcactagcgactgtgacgacatactatacntagtacagcgactccaccacntatgtacatcttacatctctacgatcgctantccgcgtcacagtgcgtantntaatgcatcgactatatatncacncggagcaatnacgacatacgantacactgtgatgcttatcacgactctcgatntcattactgctctcntactctaacaatacatctaccataacagcacgccacatatactataacgtacatcagtcacag

SEQ ID NO: 8136 - DNA, 291 bp, Homo sapiens
  misc_feature (1)...(291): n = A,T,C or G
cccctcccaccnnnnnnanncccccnnaaaaattcccttaaactccccaataatctttccccccctaaacccccccccccttcttcctcctaccgttactcccnnctacnancttnnnncctcncccctcccctctttncctccnccntnnnncctctcccncccttttcccttttntnnnnntttntttcttntcctcccctccttnctccctnncccccnnccttccncttcccccccctgtgcctccttccnccccntttcccaaaatacaccccnnttcccnnnttt

SEQ ID NO: 8137 - DNA, 829 bp, Homo sapiens
attatattactcgtcagtattttttatgaggtagatggaaatttaaggtgacactgttgcaataggctgtttctcctagagagtcagcatcaagaagaatcagcaaatttcaaccttacagtatatttaattcaaggatcagattttttaaaattaccttaacaagtgatgaaattattttcacctgtaataggacaaaccaatttcatgtgttgcactgaggacctgccaccttatgtggtgtttttgccaaaaatgcatgatttttatctaaccctgaagaaacatcatacaaatgtaaagtgaaggacattctactaaataattgaccagtactcttcaaaaatatgaaatttaggaagacagagaacggttaaggaatcattccagattaaataacagataagagacataataactaaatgttatacataatccatgattggatcctaaacctagaattttttaccctggacaggacattattgaaacaatttacaaaatttaaatgtgcattatagattaagtcgtagtattgtatcaaaaaatagttttcctgattttatgctttaggttatataagacaatgccctggatcttatgacacgcactttgatcttcttattgttaagggtttgatgaaatcatgttttttaagtattcttatgccgctacaaaaaaaatatgcttatcctattttgatattgttgtttttcctaatttatgtctttattaccataagaatcctttttgtatcaaaatatataaatagattctttagtcttaccagcgtaaaattaagccgatatctttaaagaagaaatatttt

SEQ ID NO: 8138 - DNA, 916 bp, Homo sapiens
agattagaaaatatacgtgaacttatattatggagagatgggactttaggtgacactaacacgggagctagctcttcctaactaattagagactaattgactctttagcactgttatcagctgtgacagagcccttcctgcctcctgtctgacagcgtacttgggaccatgcctctgtgaaggacttcaatttctctttacaggaatcaacggggagcagactccagttgcctactgcctatcatccttgctaagatacatatgtatataaaatgtctttatatacctgagaatttaaaaatagaaaaaatttggcctctttggcctcataggaggagatctgtagacgattaccttgagagagggatgattcataatcctgtataactgactctctcgcactcggtcatttctgttgtcagaaagcaatatatatttaactacatagagaggcaatattttctgccccacagaatatagaggtgataacgtatagataataattagtaatccttatggctcaagatatggccagaaatatgtgaaaacgacgcgtgttgcgaacagtttttgcatagagattcacctgcccaagtatgatttgtaaataaaatatttcgtgacgacctggaagatgtttgttatactcgcacgagatccaaaactgagtctggggagaattgcacttagctatatacccacagagatctattcgtttgctaatccctacacaacacacaggaatattaacactatctctttttcatctatcattatcatttttttcttgtccaataaatcgcactgacggctgtttccttatatcacgttggtgagtcgcctgataactataagcgagcttgaccatatcacgcggtgatataagatcggtctctatacacaatatgatattatt

SEQ ID NO: 8139 - DNA, 1397 bp, Homo sapiens
  misc_feature (1)...(1397): n = A,T,C or G
agcgagcatgaggtagatcggacacgcgtggagcggcagcgatagtgagctgtagagcgagcagtgcgcagagcagagncagcngcgctttaagcgcgcagcagacaaacgacagcgcgacggcgccagggcatgtttcnacgcggagcagngacagacacgcggagcgagcagacgagagcgcgtagagactagcgcacgacgcgacgcgcgacacacagcacacacacgccgcgacgcanaccagagcacaagagacgaaagagatcaganagagagacagacagcaggcgacccgtcgcgcggaggcgacgccggcgacgcgcagcacaccgccggcgagagncgcgagagacagagcgcgcacgaccggcagagcggcaaggcggcgcaccggcacacggacgcaggcgcaaagcgcacggaccagcgcggacagaggcgggagtgcgccagccgacgacgcggcgacatacgcagacgacagagacgccaggcgcacacgacgcgtaggagcacgacggcgtcgcgcagagctgggtacncacgcgcagacgagcgcacacggcaccgatacggtgntacgccgcgagacgcgaacacacgttgacacggcaccgagcaggcggaacggccgagacacaacgagaacgcacagccaggcgacggccgaacgcacgtcagcgcgagcgcccaagtaaagagcgacggaccgcgcgcggagaaaaatacggacacgcgcgcgcgtagcaagcacagggccagaccaagaaaacagatacaccggnagcgcacaccgcgcgaggcgcgcgcacacgcccgccccgggagctgagtaagggaccgcaacgaccgggacgagagcagcagagccccacatagcacgagcacagtaaatgagaggcgcgccgganacgtcacagacagatgcacaaggacgagcgaacagtcgcgacctcacggcgagcgcgaggcggcgcaacgaacaccaagacgagcgcgactgcacgggagcgcgaacagccgacagaggacctacgcgcagcagccgccctatacacgaacagaacacgcatgcagcgcggcacacgcgacggcaaggcagagacaagcgcaaccgaagcgcacccgcgaagcacgacggcgcggcggcaaccggcgcccgcggccgcccacgccgccagtgacgcccagcccgcgtgccgcgaggaggaaggacagncgacggcgagtgagggaccgagacgcagagagacgcccgcaagagatcgcagtacgaagacgagcgacactaggaggagagacgcagagagacgacacagagccagcacgacagagaacgcggacgcggacacagacgcaggccatgccgcacagacgagataagcaaccacagt

SEQ ID NO: 8140 - DNA, 1563 bp, Homo sapiens
  misc_feature (1)...(1563): n = A,T,C or G
gacgctgtaccgccggcgtccgttttattataattcgttcccgttttccatgcgacgccacgccctttcttcgggatttttattgtatccgcgcctgtggttgttatatgctgcgaccccgcgtcatcactccccgcgggagcgtgaggggaggatantatgttatgcaaagttgactctaacaatcatatatatagataatttatctcaaatacacttctcagccgcagggagtctgtaagctatatctctctaacgttataggtgccgatttgtattgcaatagaatgatttatgatcgtagcttattagacccatactaataatctcagtaaaatactatccgacattattctgacatacaaatcctcactcatatgacgtgcgacgcagantgtccacagacgtaattctgatatatagtatttatatggtcatcttgcgctgcctatcgccttcgaagcgtccgcactgcgacggcactagtcgtcaatagtgctgatacaagtaactcgaatcgcaaagactaactcacnctgctagctatcttacagtctacggtaataagatactggctctcggcggtgcaaatcgggcgatgntacatgttgcgatgcgatgtatctcaaattgtgcgcgtcatgcttgcagatctacgcgcgtggtgtgactgataatatattatcatgtattatagcgcgtacatagtgctgtcatagacgcgtgaacaatctgtgcgcgcgtgnacgtacgcatatacggngtgatctcgtcgaaccgtgtctgctctgcgtagtcgtgatctagtttcacaatgaccagatctattcttcgatgacactgagtgcatctaagatcatgtttgatattacaacttctcagttcacatatagttatctcgctctaccgctgaatgtatttatgatgtgtgtacgagagatganccgcgacctgcgccacattcatttgccccttctcgtgtagtccacttcagtgtgagatacacaaccgtcgagttatacctgtgacatagagatgatcgcagttgagacgcgcactctgaagacgctatataatgntgctatatcgtgcgcactgtcttttatgtagttcatcgtatcagttctgacaataggacgacacgagatttatactcgacgtcagagtatacgacagtgtgtgcacagagagtgaangatagcgagcgcgcatcgacgtgcgacacacgctctagctaggtattactagcagtcagtgtggctgactttcgtatacttcacgtatgcngctcgtgatattattatcgcatgtgttatatggatgcgagctgctctgtgagatgatgaaggttcgtagccagcgcactctatntgtattgtgcggtgacnactgttcgataatgctgcgtgcgatacgctcgnacagagttactctataactcagtctgcgccgcggatcgacacgttagtgtgcggagcgccgactggcgctgacgtgcgatgcgtgcgctgtgtagcgtcgtatagaggacaccatgtganctnatctctacaagcgacaccg

SEQ ID NO: 8141 - DNA, 1612 bp, Homo sapiens
  misc_feature (1)...(1612): n = A,T,C or G
ccgcgtccacgcagccgtaatatattggcgcgagtccgcataccccccacattacctgttttggagccgccataggtgtcaacgccacccaaacaacagccgccggttgcggagaggggtaatgtacaaaatcaagacggtacatacgatgtcataataaaccaaggacgatatagagtagcagagaacggtcgngagtgtctacatcgcgtaccgcggatacctacgataatgtatgccgtcccatagagctatcatctcactactttccgcgacaccctcggcgtatgtactcagcgagattagtcgtgcatatcgacactcaccctagcgctacagagacgacacgatatcgaaattgagaatgatagagaatatgtgtgtaatcgctggcacgatcgcgcgcgtagtgcatgcaagtacacaccgggtatacaatcactcttgagcnacgttcgcatcagtgtaatagtgatgacaatacacctgtatgcgaccnctctatcgtcgagcactcattaacagtgcactcttggtgtgatcataacagcacgtatccagcgtcacggactgatagactcgcgagcaatcgcgcnacgtgagctcgcggcgagacacgagccactagatatatgccgaagatgtctagcgctgaccgatgacacggctacgntgncgtgatgtgtgtgatgctgagctcatgtagcgcagatgcatcgtacngncgctgccgagcgatatggcngagtgtatactacatgtaatggtatgcangcactcactggcgtacgcatgtgcgntantcgtgcatcntactgtgcgctgtccgcgatctattntactgtctngatnattccagtccgagtacggtcgtntgatcntantgtagacacagagcgcacgtatctcgccgactacacgactacgcgatctagctcacgtatgctaccaacgcagcgcgcntgacgagctgnatcgangntgcgtctatctacatactgatgcacagactatagcatncggctgtgagcgcatgacgtcacagcagacgacgatagatncacgctgctactacagtganagtnatcantnctcgncatctcantcgctgcgcatacccgcgacagcgtatantatgcttctgacgtgctatntcgctcgncgtgtatcnacacntaatnantagcacagtgacgctgacacagcgcaagcgtctcgctacatcagangcgncgactacagatctagtctctactgaacagcggtcgatcactcnttatcgacncgtatatagtctagcagaagactgcgatgtcatcagcgtcgtcgtacatcgcgcncgcgctgaganatagntagctctgngnactgtacagagtcaagtancgcgagacggcgcagacgcgatgtctttcgcgcgcgnagactacgtcagatgagcantagtcgcgactactatgtgcgtctagtagcgtcagctgcacacataagagnagtggctctagtgagtcgtcagtatcgttgcagaagangcgatggaagagagagatngtgcacacgtgcgttacctcactactgtacgcacagtcagatcgatcatgctatccgacgg

SEQ ID NO: 8142 - DNA, 844 bp, Homo sapiens
tctgctatagtgagtcgtattaatttagtctaggttctgatgctcacttaaccatcaatgagatgaagaatattgccagatgtggaacctgcagatgcagggggctgacttaagagacgaggatccacagacgctgacatccattgagacacaatgcaaagaaaaaacatttcaaagataaagagtttcatagacaggaagaagtcctaatgctgtgaactgtgggaaaaactgttcacatttaaggaggctgtctgtttttttgggagaaattcccctgcttagctatacctccagggtaccaatggggtgacagttactaatgtgtggaaggacccttctacttgggagaccaagacccggagcccaagggtttgaagtgttgtagcgagttgatagatggcattatctggactcgtgttttgtgatatcggatactgtgatgcggcttggtggtgtatatacgcttattctcgaggttgtttttagagaatcagccctctatcgtgagaaagcgtttagactagcatgaacctgcatttgaaaataacagtttaattgaatacccctaacgaagtgttggagatgtcttcacctagttacacacttggtactctggacgtgcgatgggcgcgagtaatattgggttacaggcgtctggccattatcaattgtaggcataggacgtagtgagcggttgcgatgttgtggtgtgtgggtgaatgaggtgctatgggcgtgtggggtttaatgagtaacgtatctgcgcatcgattgtggggtccgctacttttgagtcggtgtatatagtgaggcagtgtgccgggtatagtgcgatatcgcg

SEQ ID NO: 8143 - DNA, 1366 bp, Homo sapiens
  misc_feature (1)...(1366): n = A,T,C or G
tcgtctatcgtgtctcacgcagtcgcgcactattctcctgaacgtcactgcacggtggaaggattggtcacattctagtacgcccccagcaagcgttcntcgtttgctttatgtccgngctaccgatgatgcgtgtcaggccgacagctgtgacgctcccacgtggcgcgtgtccgccggcgatatgatttgggtgcgcgcnctctctctgccgtcgtggttacgtcacgctccccatgtcgcgagcggtctcgaggcgagctagtgatcccgcgnacaggaccgacgtgggcgtgttcgnccagcgctcgtgtgctgagcgcgcgcagncctcagcgagggcgactcggctgcnaccgcatctnccctatgtccatgccgcacggcggtgctcaggctctgggctccgcagcgtacgtgattgtacggctcgttcctgtnattagacgatactcagtcntccgctttgtattctagtgcttgtgtccacgagacgcctcacacgccgattctgcgtcagtccggagtctgtanctcacatcgttacgcgctgtctcctcgtgcttcgagcactcgcgtgtgttgtgactgatctcttctgactctctncctcgttcaccacgtcgctcccactngcatcgtgtctttgggtgcatgttacnactcgacgctgcgcntcgtcgctcgtctgccgaccggtcgcgctagtcntcatacaggggcgctgggtncagcgcgcgnccgtcgacctctcaatgtgacgtcacccatcactagctgntncntcngcgcacatctcgtaccatacgacgaggcgacgtgagcgcacacaacagtctcagctcactacgcgatctcataagacgtgtcacatnacnanagacgagcgtcgttcatcgcagtactacgtgncgattcgtgcccacggccgtacatatcgtgtctttcttctacagagctgatccgtaaccacgataactactgtctgtctccagacgtaatcactcagactccgagacgcgctacgcacagcaccatccagccacgtcccgcaccagcctggtcgccacgatctggaacttgccgcgtagaccacgcgtatcacgcctgtcactgagcgcgtcgtacgtggcnacgctcgcgtccgagtgtgtgcgctcgcgtgctcggtgcgtcctacntggtctataacactgcattacgcttgcacatctaatagtgntatctgagagtaactacnttacctcctatttcagcgtatacgtcttggtctcgctacgcgtccgactgtgagcgatagtcgcgtntatcntgccgcgactgcctttcagatacgtcgctcgcggttcgcgcatacctgcgcctg

SEQ ID NO: 8144 - DNA, 1505 bp, Homo sapiens
  misc_feature (1)...(1505): n = A,T,C or G
cgcggctcaggccnccgctccacgccccgagaatagcttgtcgtagcagagctgccctgtgatgagaccctncgagatccacgcccgccgtcttatcgtctctcgcatcgagctacgcgagctgcgctacatctgacttctcttcgccgtgnacacgcgtgcaccgccgncggatatccagacggccgcgatgagcaggagtagnagtgaatgtatgatactctactcaacactcgatacatccgcgcgatacgatactacacatagtacccaccatagagacctaccctcaactcgcgtacgacgcngtgtgantagttcatgcgcacggccagatgntacgagaactctgagtcgtcgcaatcatctcatccgcaggacgagactataacatcactccatcgcgacgatcgtgcacaccnagaacgccacataactagacccgcgggctgacggcgcgctgcactacatgcactatcaagcatacgaatnagaagccggagagccgngactagatgacgaccgccgagtagtggacggagcacctaacgcgacgcgcgantagcagcgaagtgaccgtatatactaagtatcgcgctagtccgaagcgacgacgcgcacatacgatctgacagcagcgagtacgcgactcgcgactacgagcaggtgcagtggcacgcagactagaatcatatattgtacgactgaatcgtgttacgtacgncggctcatatccgctcgaccaccgacagcatcaggtctgttacaacggttctanacgtcgcgcgatctcgcagatagcgccggaatcggcgcagtaaacagggcgagcgcgcactcgtcgagagctggcacaantgcacataggacgcgctgcggtgcccatccgcatacacagacggcgcgagaaggatcccacgcatacgtactcacccgtcctcgagcgcgctaccgtctaagccgcgtagtcctgtcgggtggacagcggtcggcacgcacgcgaacgttagcgtcgaagtatcatggtaagttcgtctcgcggggatatggtatcgtgcgcgcacgacgcaanacagaggcggtccgcgtgcacgagacgacgcaaccgcacccgccgtcttgcatacgtgatcgggcaaacacacgcatacggggagttcgcagcggccacggtccgggcngcacggcggggtctgccgcaaaaaccgtctttgtagaggtagaccgaaaacacgctggatggaacccgccacgcccgaacaaatgcacatgggaccagtcccttgaatggtatcgtagacaaagtacgaccagcattacgagcctcgcaccagtagatataagattcatatacgctgccgactacagggtctgcgcgcatcgttcactccgctacgcagagaccttggacgccacaccgtggtgacccgaggcatcggacgcgtgtgagacgcgacggagatatgttgggagtacgtgaggatcgtcggaacggcctggtcgcg

SEQ ID NO: 8145 - DNA, 1229 bp, Homo sapiens
  misc_feature (1)...(1229): n = A,T,C or G
atgagatgtatagananaataataaatanattnttttgtaatgaagaagnnagantcttgagaaataaaagnttgggaaaaaacttnggcaccgngagacagctaggacgcgagtggtttgaggcaacgnaggggncatatcgatttttgtttgtttgatgaggtggtataggagaggggatttgaggggaggttgaggaagagagaatatatgaaaggaagagtttggggacagtgagacaccatatgaggggaccggcgggggagcgaggctgccgaaagcgcgtagcgggagaaggcgtagacggggaaggaagcgcgagacgcacagccgcggcggggcgggggagcagacgcgcgggtcatatggcccgtcgccgcgccgcgcccgcgcccgccgcagcagacaacatccagcgagggcggccaccgggcggccgcggagggcgcgggccggggacgacgagggcaaaacgcgaggcgggcaagaacagaacagggaggagggggggccaaagggggagggccgtccgggccgcacgggccggagggacccccgccccgacacccacgcagcaggccaggggaccccgacagacgggcgggctggagcggcgcgagagnggtgtggccccgggcgccccccgcgcccggcatacaccacacccaataactcccccgccccgcgcaggcgcgcggtccgcccgtccccatcccgcctgcgccgagctacggcacgcaaacacaggcggagcggagcgcgccggaggaggcggcgaggcggggggaagagcgagccggcggcggcctcgagtgacagagcggcagcaccaccacagcaagcccctagcgtgtaggcgccccacgcgcgcctntcccgcgcgacgccgcgccgaaggcgcgccgccggcgggtcggngccgcgagagccccagggccggtccactagtaggnaaggcgctgcgcgcgcaacgatccagcggcaggccagtgcaggcgcgccctgcgcgggacgcgcggaggcgacagcagcgcgtacgcagcgacgagagtcgcgcacancgccgcacgcgaagcgcgcncgagcgagagcacgagcggcacgagtgcgngaggcgcggcggcgggacacggcgagatggagcacggacctgagcaagagccgacacgcgcagacgccgagacataagacgcaaaccgccgcagcaggagacgacgggacggccgag

SEQ ID NO: 8146 - DNA, 1246 bp, Homo sapiens
  misc_feature (1)...(1246): n = A,T,C or G
ttggagtaangtnnnnttnnntttnntntgtgttttgttttgtttaaaaaaaaaaaaaaaaacctagnaagagnacgaaaaaaaaaacttaagggngnnnaaccngnngnggnnggnnnnnnnnnnnngncggggnngggttgnnggggggnnnggngggngnnnggggggggnnncgnggccgccgggcggcggggcgggggggnccgacnngccccanccgcgcnngcgcggnggggccgggncgcgggcggcggggggggggcgcgagggcccacgagacgacgcggggggcgcnacgcncacaacaaaaaaaaaagaagaaattttttttaaaagncgggnctaatgatcgacagtttatatctgtttggttgttgttgtttgtgtttttcgcgcccgttggtcggccgcctgtctcggtgtttcgtngtttgtggtgngtgtaatgtggcgtggttcgtngcgctctcttccttcccctccctcctcacctaccacttcacccgctgtctttagatatgcatccgttctttttgttcttttctctcttgttgtatctttgatgatttgtgtctcttttctccccatttcgcacgactccanactttaacttattccgctatactctctctgtcatagttgtatagcttggcgtgattgttattgtgtgcttcggctcatatnttggcgcgtgtccacgtcgccgtcgtggtntccagttatcgcactgctccgtaagcnccattgtgttttattatacgcgttgtgtacgtgttgtgccgttattgcacgttgtcgctgcgcgcttcgctttcttctactgtatgnatatatttctgttgcattctcgctatattgctctcttnactgctgtcgtgtgcgcgcgtctgtcgttgngtgtcgtatggtctctctctaccttcagtgtcgtctcctctcctgcgtcgccattatcgatacgctgcgttctcttctctgtccgtctgtcgtcgcgcccgcacggttcgccgcagatctacatgtcatcgcngttaagataatgacaactgcgacgcagcgtcncgacgcntcancnatcttcatgctctctcanctctcgggttgttttctncttctctccgtgtctgtcgtgtacttatcgctctgtctcattctgtattgctttgtgcacgactcgcgcngcgcncggtgngngttcagtgagtgcgtatgtagtagcgccncatctatataatgtctatat

SEQ ID NO: 8147 - DNA, 1126 bp, Homo sapiens
  misc_feature (1)...(1126): n = A,T,C or G
gtttctcccattttcacccacgttttccacccctgtttttattcctctctccctctcaccccttttttttcacctttcccgctttttattctttgctttgttcacaccccagtcttctctacgtagagtagctcatgtagaaatgtatgcccccacttagctgcggaccctcgttatcaccagctgatgtctcgacacgtcgataaatgtaacagaatcagtccactatattttctaggtaatgactaagcccatgtaagaccaacaacagtatggaatgtacacttatcttgattacccccttacgagcctttttagtccccccactatttttttttgctctggtaccgaaccaccccacccagtatatatccttactcccccgtttcttgccctccaacgcaagcccacagcactcacgtagttgaggcgattgggcagtagcatctgtggacgcgaccacacgcaagagaacaataaatagtaattagattatacccagatcataccccagtgtatgactcattacccttattctgacatcccaccccacacacacacccactcctatgtttgtcccccctccatgttttctagtcggtctcattcgcaccgtcaggttcgcgctgttttcttttaatccacaacaacactcaaggcgattctccgcgattctcctattatatacgccccgcgcgtgtgcgcgccacctctctgccccagcccacgtgcctctagcgtgcagtcaacactngttttcccgcgccccaaaaaaaacacctctctctctgttcacgcgctgagtgattactcataagggtcaccatcgccggtcggtcgcggggtctgtcattgcggcattaacgcctcagtcgacgatattcctagtgatcagtgagagttacattcgactataagatccacattcacgactctaagccatgcatgactcgcctgtctctggccggcgggggcgccgaccgattgcacatttgagctatgatatggcctgctaagccacatatgcagcttatggtttgctntccctcaaggctgggggggccgttttcccccttaggatctttttnccgcgtctgtttcccatgatcgattatgacccacatag

SEQ ID NO: 8148 - DNA, 740 bp, Homo sapiens
  misc_feature (1)...(740): n = A,T,C or G
caaaatgaggttcccccggtgggggccgcatccagttttatttaattccagaattaaaccaagaacattttctttttcaggatggttattggtgtaattaaagtatgtaattccagtaaattgcaaaacaaagtttcttttattaagttaaaccaccagctttcccaatccgggatcatgcagggttggctttaaaggaagggggaataatgtccccattgtttctgttttcaatgtacctcaaaattgtaactgtgaaccaaggattattcagagtattttttcnaaacagatccaataacatattactctttataaagacagcccctgttatatatttttgaagtacaatttaaagagataagggttcaaaatgttttttagttctagaatttcatacaagataaatatttatattttggacttgtttttttccatttcacatattgctggatctggtttgttacttttttttttttttttctttttttggagatggagtctcgctctgtcacccaggctggagtccagaacatgagcttcatgcaggcggggattttgtgtctgaatcttcagccttagctggtgattgtgaattgaattttaagtggagagtgctttgaaaagcactttataaatgtaaaatacttggtaataatgcgttctgtgtagggctatgtagtgtgcaaagttctcttacatatattattcattttctcttccttgatcttcccagcaat

SEQ ID NO: 8149 - DNA, 739 bp, Homo sapiens
attattaggcctggaagccaccagattcccaccacgggttatgccaaaaatggcttccaaatgttgatgatttccccatatgtgtaagcagcttctttgttaaatttaaaccagtgtcctccatgtattcttcttgattccaaaccgggaaccacccaggggtccaccatgcaattccccagcgtccacatgccagcactggcagccacagcatccagttttctgtaaaattccacttggtctttgcacttgaagaagataaggtttctggtgaccaggatcaccacatagaataggaacgtgaggtacatgtgaatgtccagcatggcactcacaatttgcagaagggcagcccaaacatccaagtcttcttgatgaggtaggtcaagcgaaatggcactgtcagcagaaaaacgctgtggaccaccaccaagttaatgaccgccatggtggtcactgaccgggtgttcattttcaccaggaggaaaagaatggaaatgacacccaccagcccgccaataagcactatgaagtagaggctgattaagtggggtgtcactataggatcgcaagaggaattcctggaggtattgtggccaggcatacttgggaagtcaccgtaatattttcctgggatctggtctttctttacacctagaaatgattgaaatgtctcagttactttctcagttgattctccaatatacttttgctaaggagtgcagctgatcccaggaaa

SEQ ID NO: 8150 - DNA, 1260 bp, Homo sapiens
  misc_feature (1)...(1260): n = A,T,C or G
atctgtcgcgcgttcgcgttgcgcgtcgtgctgccgcccttgtcgccctccgccttgtgtgcgtctcatgcgccccttcttcccttttcctgcgctccgtctgccgcgtgtacgcgccctgttgtcttcctctgctgttttgtttcctctcgtgtttccgcgcctccctttccgttttcttttctggtttnctgtttttcctgtctctcgcgccgtgtctcgtccgtcgtgtcgtcctttccgcttgtctttccgccctcggctgcccttcgtcgctgcctttctcgtctccttcgcggcggctgtcctcgttgcgctcctggtcttgttctccgctttgtccccccctccttttcttcgtcttcgccccctccatcctctctcgttctcggtctgtctgcgccntctctggtctgcctcaccnccgttttttgcgcgcccgcttcgctggtcggtcctccttgcgttgcgctgtcctttcttcctcctgcnccgttgttgcgcctgcgctgcgtctcgttgttgtcggtctcggtcggtgcgcggtgcgccgcggtgctttgtgtccgcgcgttggcctgcccttcgcgtctctgtgtcgtgccccgcttgtgtctgcgttcttctccgcggcgcttctctgtcttccctccctctgggctttccggtgcttgccgttgcggtctttctccgctcgggtcttcgcggtgtgtcgggtcgcgggccttctcgcccctcttcggccgcccttctttgtcttgctgctcgcctctgcctggcccgctcgccgttctgccctctcgtgcccgcgctccgtcctcgcgtccttggccgcgctccgccgccgtctcttttcgctgtcgcgtcgcgcttccctctctcgnaacagaaaaaccctcctcgcgttgtgtgctgcgctcgtgctgggtcttgtgtgntcgtgtcgtctctccggtcgcgcggtgctcttcttcctctgtcttncctctctctgtccncctttgctctctttctcttcttcttttgctgtttgcttctctcgttcgtttctgcttctcctccgtgtctcctgttccccgcggcgtggtgcggggggcggttgcccttctttcctgttacacgtcgtcttgttcttgctcctgtcctcttctcctncgcncttgttcccccccccccgcagggncgcggcgcgcgcagtcnnactaacaacgacccctttgctccgctgctcttgctcttctctcgctctcgctcgccgct

SEQ ID NO: 8151 - DNA, 702 bp, Homo sapiens
ccccccggggcggcgcatccctttattctttcagcagaaggttcagcaaggaggcttcttttcaaaaattttcaaagtcgtggcataaagcaataaaagtttactttaaaggttttctgtggcccctttccctcacttcaggtaatggaggggaaagcgccaaaggctgcagggatggtggacatgcaatcctctcttgcttttttttcaggaatagaatcctacaattagctgccacacaataaaagtcagtagttggagctgctgtaaggagatgaagagaagataaagcagcaagtcattacccatatcatccatctcccggactcagacagagggcgtttccagagacctaacctagctctggtccccatcactgatcattcagactctgatggagaaagcagaattagcaggtgatcttatctccctgagcagatcctgtgtccatctgcagcctctgttcgaggagtacaaggatctccatgcaatgctatctcaatgcagggaaaagacaacacttctccacctgtgagtccagtcatgccaaaatgtcactcttgaaattttttaaaggcagaaatgagatgctgtggacgtctgaatcaaaattgagtttccaaaaaaaattacactgtctgtcttctttcaccatgagcctctcaatggttttcagttggttgtttcagtgatacacgaggg

SEQ ID NO: 8152 - DNA, 1811 bp, Homo sapiens
  misc_feature (1)...(1811): n = A,T,C or G
ctcggtcgtgtcacgcgcctctctccgagatgttatttcgtctcggatactcgcgcggatgtctgcgctctgatcgccgtcacgcgctttatgtccatgatgtcttgtatgtagtgagcgacacggatgtcgtggtatctctgtattcngccgcgccacaatctcatctcgcgcatcccgtatgagacgtgnaaagngtctgctgaatctttnatcgcaacattgttgatagncgcnttgcgtcaccttcgctactatatactagagtaactcatgtgtgagtacgtactcgcgtgcggtgtcgcgcgcgtctgtgtgtatgttacgtatatatatntcaccgcgntantagtatctgtgatcgtgcgcgcgatcacttactgtgtcgactaccgcgcggtagcngtatgagagtgatctngtngagctctctctcgctgctacgctcgctattcagctactgtacacgtgcgantagatgatctataatcacatacngtcgtcggcgcgtcctgcgagcgtaagatgcgcgcgcangctatctgagcgcgtccggtagcgcgtantgttcntgttcaatatgataatatacgaagactgtgtatatatcgccgcgtactggtgcgctgcgccggcatctaccgtcgtgtgtcacacgcgtctggccccangaacagactgctacgtctgtacacctcgcatcacgtggtctgattgtgtgtagcaggcngaatcagtcatgatctctccacgagcagcttggatgtactcgtgatcgtcgctantagctagctcggtcncgctgntcgagagtgtagtagtatacgcatgtcagcagatctcagcantatgtcgttacgtccgcaccgtctcgactactgatacttatcagtctatgatctctactcatacgtcgntgatntgcngcgacgagtcgagtaaatgcnacattagtagtggtatacgtctcgtacgttctataacacacgctcgcacacgatnagagcgcgtatcgtacgcantgtgacnancaacgtcaccgcacatacagccagctgtctcgctgatngtntattgatgtattgtatatatacgacgatacattagcacgcgcgactgaggtctctcgacgtgtatctatctgtactgatagtcaccgcagctntcacactcctctatctgtgcacgctcgccgctcgctgtgacatatgtgctcagcgcgtcgcagtactagcatctcactcacctcatacttagcatcggtctcgctgcgcgagtcgtgttncgcgtgcagctgtctcgagcatagcgatatattttagtttgtcgtgatatancgtcagtctgccatactcgaccttctctctgactcgtactcatactattacagtgtcgcgcgattcgttctcgccgtgatctctgatattctcgtctactcttgtattgcggcgctgactcccgattgtgattccgctaatcgtccgtgtcctcgcgcgatacagctacgatatatcgcgtaggtatatgtgactcgcttacatccattctcgctatgtgagtgtatagttcgtagagttatccgctantgtactgcaccttgtgcccgtggtcgttgttctctaatattattgtagagtactgcgaagtctagtacgctcgttgtcaacagtatatgtatacacattaagntctcgtgtcgtcgcgcatccgatgtttgttgtagcggcacgttgtcgtgtatgtcgcctgtggtggttttaggagcgattctcgcgcctacttctctgcgtgagtgagcttcgtcgtgtgcg

SEQ ID NO: 8153 - DNA, 263 bp, Homo sapiens
attatgagttgttttgaaatgaatagagcagcatctctttttgagttcagaatctcgtcaaatttcacaatgtattttccttggtgtcattgtatatcatctaatttgaactccacaatacctctgacagttgtataagattttattcccttgtgttgttgtgttgtctccaggatgtacagttgagatcttgatctcagagtagcattgtggagaaacttgtctaaggttgcagactcaggggtgaagcctcgtttcatcca

SEQ ID NO: 8154 - DNA, 955 bp, Homo sapiens
  misc_feature (1)...(955): n = A,T,C or G
tgccctgatgatgagtcgtcataacttannngnagaaccaanacacacggggtggggggtagatttgatcccattttcccctcccagtaagggctgaggtatttcggtcagggccgctcgcatcgactcaagctcgggtttatataatatttctcgggcttattattaccattcggcaaacccgtaatactccttgtgtgtattgatgcgcgactgtgtgcgcgtagctccgaagaagagaaaaagtttttttttccgggagggccgcggctgctgccctgtccacatctattcgccgcgtctcttttgtattactcacgtttctccctgttgacctagaacactgttacgtcatgattagcggaccgatgggatcatcgtaacttccaagtgcgacgtgtatatgttctcacatagccgaatccacctcatatcagtagtgtaggagttaaaccgtcaacatgctactgtcttcgtcgcagatctgggtcgtacgtgtaggcgccgcatgggctatatttctaccgtgtttacgatccaccccggtgtgatgctccatagttgcccgaggcgcatgcgttgctggtcgaattccaagatcgcgccggtctcgttttcatggctacactagttaattgtcgcgcttctcttcctccgcctctaccggcagggacaattacccatcttagcctatacggagtgcagtcttactgcccgccggcttatacgtaagatcaccatgtacgtcatcaccgctcttgtattcttgcacgtgaacgctctactcactgcaccccgatgcgtgactattttggcgtacctctccatgaggttgcagacgttcgatgttttatacccatcatctttgccccgtacactgaagtaactcacacgaaatattgcttagccacactatagcctagagacagcgacaggcgtcgtggtgactagaacg

SEQ ID NO: 8155 - DNA, 712 bp, Homo sapiens
ctcaatacttgttttgtagatatttttcgtttctctctctattttttttttatcattctcaatttgctgatttgtattcatatgtatatgatcagttttatcatgtctattttttcttcttttatttcttgattcctgatgtcctgttatatttagttcaatatccctatcaatctttatatcttaatatatatgcgatattagtttttattattacttctctcgatttttttttttttactgtttgtcctgtttttcgttctacttatctttaatttgtatatttatcatataatgttgctgtttgtttactcttctataaattatagtgttcaaagtctgcatttatgtttctatgtttattctcctcgtttgaattttgttttttggttttgatttattttctacacagtatatcagttatttactttatatcatcatggttttaatttccctcataaaagttttctatatttgaagctcctctttgttgtcgttagcaacggtgtttgattaagcaatatattataaagtattcatattgtcagtcttattaaaagataggtagggtgaggtctgtaggggtccggcacagtagcttctgtttccatggagatgggctgtgccatcctaaaagcacgtgtattaggtcttcttcaccctcctgtcagcctccacgtgttcacctctgtggaagctctccaaactctgt

SEQ ID NO: 8156 - DNA, 728 bp, Homo sapiens
aaagtcagacagttcatcttcctaaactcggctcaaaaacgaaggtattattttctaagcatttatcactattcttacaacaggccaacccaatcaacttgaaataaaaattaattaatatttctccaaggctgcttttctttaaggtctcttttaattttactgaagtagggttatggtggtaaattgttcaagtcacttgtcactttccgaaggcagtaatttagcatttaaaaatgaagctcgtaggtttttaaaaatgcagaagatctgtagctgatgctgggagtgcagatagacccctttgatcatggtaagagaacactctccagagtgtgttaggtaaggaaataaaatagggagttctcctgggaaagtgatagatgttgaatatatagaaagggacagttgttatggtagtcgagttaaattaataaataattaaaacggattcaaatctcttatttataatccgctatgcaattgcggtgtcatatgctgtgctgtgggttttgcaagcttctctcattcaatcttctgcaacaactctgtgcgttgggcaaattttttaactcccatgaatttcagtttataaatttgcaacatggaaataatggtaatacacaagtttataaagccagtatcaagtgcgaaaaaccagtttgaaaactaggtcctgacttccatttccaggtaagatagaataaccgggatccgcttgctctcca

SEQ ID NO: 8157 - DNA, 1252 bp, Homo sapiens
  misc_feature (1)...(1252): n = A,T,C or G
tcttcactattaataattcatccacagccagtctgtccgtcgctccagtcgacacccactgattggtttacatttccataccctgtcgctgtgcatcgcctcgtccttctcgtatatttcacttactacgtccaggttagtgaacgccaccatagtgatctnagtcggacagtgcgacgggtcgcgccagagcctccacacacgccacaaccgagatatgcacgatgtgtagacgcgcggcgttcgtacacactatccgtatatctattgcgcctcatntgtctatcctctctacgcgtcttccactcattatgtagcttgtcacacggctgatagcgtagttgttcattcgtaccgccacgatcanaatgatctgcgacgcggcgcagccatgcgttatcagaagctatatttctacgcgctactaacatcgagctcgtgcgcgcgcngctccgtgcgtattctcagagcgtcgatcatcgtctgctagctgtgcggccctgctgtacccgatcgtagttcactgtgcactatcgattacgtgatggagctcgagagtctacgaatacgcacgcccctgagcgtggtgctcgttatccgctcctactgttgcccgcatagactactatattcgcatatcggcgtcgttatcggtgtctctgtctgttgcacggggcgttgctatcctctcatattttcttttctgcgccttttcgagtttcattacggaatactcttccgttctgtcgggtcttgccgtcacctcttgaaaatcggtacaatagtggttttgattatctcgcgcttcattcgcattctctccttctgtgctgtttgtattcgccctcgcgcgctccgattcagatcatcgtgtcgctcgtgttgcgcttgtcgccgcctatcgtgcgtaaaatgagtgtttgcattacgcgtccgcagagtgtcgccattcgctccgtctctccgattgggccgcggcttcgccgcgttgtgcggtgttgtgcgtcattgcttcgctcttgattaactctactttatcagactctgccgatctcgacgcacgcaccaccttatcatgtctctgccggcggcggggcggtccccacatcgcactcggctccccgctacgcgttggctttagtccgctctttgcctctggttttggcgcctcaaaacgttttgtggttcgttttccccaacaaggtgctctgtcctctcgtgtcaccagagcattgctgcgtaccacagttct

SEQ ID NO: 8158 - DNA, 119 bp, Homo sapiens
  misc_feature (1)...(119): n = A,T,C or G
gcatatcatacaggcccacgtacgacacacgaaaccgacgcgaggnggggttcncagcggggaacacccacaacgcaagcacaagncgtgttgcgacacgccattagtatacacaggac

SEQ ID NO: 8159 - DNA, 1127 bp, Homo sapiens
  misc_feature (1)...(1127): n = A,T,C or G
ttgaaagtggaaggnnggngatggggnnngacgtgnnnagagganggggtggnngatggnnnagtgtnnnntgtgngngnnnnggaggnnagggnnaacttctgnnntgtggtnggaattattgnatgtgggaatggtggaggtagagtttntattgtgtgtntagaagtatatatctgatacgggctttttgtanncaatgttacaaacgcatatacctatcgntaacaatatacgagcaaacacagacggcgggcaagaccgtgatatcgaagcggccagagaggagcgcaatagagtttcctcaatggcttttctctccgccggttccatagacagtcacctttaacgacatcagagcctactctcttgtcactttgtcgcgtcgcttgatctttctcgcctcctacaggttccttagttatcataatcttaattatttgctccgcgtcnctactcgtataaaattttagccatatctcaatagaatctntcttgtaattttctctaccttctcccatatggttattagtgctcggtatgcacgtcgatgacgtgttgattcctgatctnatctagatcgcccctataggctgtgttcaactgctgtcgtaactcttccctccatcttcaatctcccatcgtcttgggtgctcgcgtggtgctgccttttcttatatcattaatagatatttcacaagctaatgttgttattcttcgatctaattatactgttctctgttgaaagatactatattgtatttgtttgtttttcttactcagatgggtacgaggcgatgtagatagaagacagcacatcacgtgcctacgtcacggcgacaatttcgccccgcgtgatgctaggtgaggtaggtgaaagcgacgtattggcgatttgaacncaagatggctattactaaggtcgagttttgtcgttatgcgtcgagtatatcctagtgcgttggcctcagacgactcagctccacgatatagttttcaagactagtataatatagaaaangtatagtaatattnncagacttaagagattaattataggtggntacgcgtagcgaccactccgaagcgcntctcgctatcactcgcacaggacagcgagagagcag

SEQ ID NO: 8160 - DNA, 717 bp, Homo sapiens
ttaaagtagattcagaattaacaaggccaaagatgtaagcttccagtcatcagaatccatggttccctccagataagaattaaggtaaagtatgagccctgtaaaaacagtggccagatttttatggttatagaaaatacaaagttccttttataaaaaagtggatagaagaaacagtattttcatattcttattgcaaaaccttttcttttatgtcaataagtaaattctgatcacaaatatagcctttcttcttgtagaagctctcctaactcttcttgttagccaacattggcgtaagtatttcaattttctttgtcttcaggacacgtgtgggtaaattttcacgggcataggcattgtggagataacgccagactcctgagaattctgctggaatgtcaaagtcacgatatttcttggcagcaactttaataatgttcagcttgggtaacaagctacaatcagccagtgttagctggtccccatccaagaatagtcttctggaaactgggggttcctcagcactgtctggatcaatttcatccagaagtggggtgtttaagtagtcatccagacgcttgaattctttgagcagagatttttcaaaattcttatttgcctccttttgtgtattcttaatgtatgcagaaaacttggcaaagaggttacagcccacatcaaaagactccttgtacttgggactcaggtgagggt

SEQ ID NO: 8161 - DNA, 1159 bp, Homo sapiens
  misc_feature (1)...(1159): n = A,T,C or G
aggaaatagnaaggaanaaataaangaaaacaagnnanaagnnnnaagagnnnaatgnnnaaatnnnnnnaagccnannnnaaagannagannnnanactgnnnaaatagnacatgataataaaatatagagtaaaaagnatataatnnaaaataaatgnaaaattatataaaaganatagagcnnaggtggaaattatctcaatctagcttacatatagtacaacattctgtgcctatcggtacgtgccaccggtttgcgtgccgatcggtcactcagttccggatcgtgtatcacagcgttatatatataattcccactacacctcctctaccatatcctttcacctcgctcatagccgtgttactgttcagtgagccgctgtggccggtgtgcggttattgctcgcttagtgcacccgtgctctgtgattatctcttactccgttcttctacttcacttctatgcctaactacatatgacccgaccgccgctcctccccacctcaccttctcttcccgtcatctgtcacggtacctccgttagtcccactctgcgtcatgttatatctcgacgactgcccgctcctcacagcactacatcctcccagtctcgtattctctgacctgcgcctcatgtctctcgatgtttaatatacgtggcacgattatcataacgatccgatatagtgagtgntgtgtgtgtaatgtcgcatggagctacacatgtacgatgttgtagagatgantctattagtgttgattgtatgggtgctgcatattaaatatggcantcatgatcatacgtgtcacactgttcatggtttcgttcgagtcgctatcctctcgtcgtccaccgacacgcccncgcagactagcgcgcgtctacagtcgcgaacgtgcatactcgtgcccaccgagacatcgctatcccacccttctctcactatatcttcagtgcccgtctcacnctcacctattacatgaccntcgcctgctngtccacacagtcgtcgcccacgctattgtgtnttcgtcaacacgtcgccatgagagaccacatatatacgcnacacanctgacgtgtcngcacgtcgacgtctacgcatacgctccctattcttnagctcgtctacgctactacgtcacgtaccactcgc

SEQ ID NO: 8162 - DNA, 795 bp, Homo sapiens
attgatagtagggtatcaggatttagctctaattatgtaattaagcgagaaagcaggtttaactaaaaagagtataatgtgcctccaaaccctccaagatatttggagttatgttaaaatcccaaatctagttcttgattggtgcacctaaaagatatggggggaatggaaccaagttggaaaccccttgccaggatattatctaggagaacttccccaatttagtaagacaggccaacattcaaattcaagaaatcaagagaatgccacaaagatactcttcgagaagggcaaccacaagacccataattgtcagattcaccaaagttgaaatgaaggaaaaaatgttaagggcagccagagagaaaggttgggttacccacaaagggacgcccgtcagactaacagtggatctctcagcagaaactctacaagccagaagagagtgggggccaatattcaacattcttaaagacaagaattttcaacccagaatttcatatccagccaaactaagcttcataagtgaaggagaaataaaatcctttatagacaagcaaatgctgagagattttattctatgtattttatatgtttacttatattctacttattttacttatccatcctgttcattttctttttcttccttctagaatgtaatttccacgatggcaaagttttttgttttttgttttttaatatttcctaagtgctgtatatacgtaacaattttaacagtgccaagtgctcaaaaatatttgttgaatgaatgattaaaaaaaaaaaaaaaaa

SEQ ID NO: 8163 - DNA, 860 bp, Homo sapiens
  misc_feature (1)...(860): n = A,T,C or G
attttccacctttgtcccccctctttccccaccctctttgttttcctctcccccccctcctccctctctttctacccaacnccgcttatatgttttattttgtgtttattccccctgtcttccttcgcgtctcgtcccttcccttggtgaactctctccccatgtttgccatctgcgacgtatgtgtgtatctctctctcttctctcccactagcctgctctttgctccctcattctcctctcttctctaccttatctttctatgttcccattatttctatcatccaccagtgtctgtgagtcacaatgtctgtntttcctcctgttgcgcgtatgagagtactccctctatttgtttattctcggctcttgcgttagccatacccccattcattgacactttccggcgtattcgttctctctttctaccctctctcctccctcatattcctcctttatcagctcttctctccttcccttcgctcttaccccctttcttatttattattttgatacctcccctccctcccttcctattttttcttatcgcatatttccctatctcaactcctccactcatccattntttttatttcgccctccaatgtttatacctagcattccctgcctccatataccccattttctttatttcacgtaacgtatctcggttagtccctacctattactctctcacggcctctgtgcacgcttctactaccactacttcctcgtttcgttgttcgctcccgggtttctccgccttccaaaaaaaaacgttttctccgcgctgtctctcccttcctcccccttctctgttggcggtttctccccgtctctattcccggtctttccttttg

SEQ ID NO: 8164 - DNA, 608 bp, Homo sapiens
  misc_feature (1)...(608): n = A,T,C or G
gcatcaacgtttatttagtaaaaagcagacaacccttgcgttntgttgggacatgtgacccgtgagtcgcaaacactctggagaaggctgagatgccaccattccccacggggactgaagacacattacgtgaacctggtccaggcctcagtgaggagatggcctcagctgtggggctggtccatgttgcccactcactccagtgggaagtgnggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggccggcatggaggaaggactccaagggaccgtctggcaccgccgggctgataggaacccatcttgtctgtctgtgaattattcatgtgctgcactt

SEQ ID NO: 8165 - DNA, 353 bp, Homo sapiens
  misc_feature (1)...(353): n = A,T,C or G
gcaacccgcccgccgtaatttaagtacggaataanngcnnnccttgttgttacggnacatgagcattcataaagagacaacaggtgctcggcagccaaacatggtcagaagcgattatggaacatgtgctctctcttttggatcacctcagtccgcatcgtgtgatccactaaaaagtattaaatgagaacccctttaatagaaaacaaaagggcctaattttttacccgatagaacttatgaactgactatgacaaaaatacaaacacattaaaggaaagttcagaaaataataaagaaaatgaaaacaaaaaaaataaactatgaaatggttctagaaggcctcaacggaa

SEQ ID NO: 8166 - DNA, 717 bp, Homo sapiens
agtttgttctttaggatgtcccacaggtggtcgtgtttaaaggttaagtatagggcacttaatatgtaaaggatctttccacggcagttgactgacgtagaaaaaaatgctgagagaaggtccaaatctctgtgggttcctgaagctgtttaaggcgatcatccacagaaacctgtaaaagttcccatcgcatattaaggtcatttagctggcgagacatctttagagaggaatgcaggtcaagtggagacagctgactggataaaacattcaccgttttaactttaaagttgattggtgcaatttcttctctaaatgccatgattttttcaatgtgatcctgcagcgagtcaatgagtaagtctcccacgggcttccagccattccgcacggactctgcctccttcatgtcagcgtccaggtcatccatagctccctgcaggtctctgagtttctccaatgccttgtccacttgcttttgccaattgctagttacagcatttagactttcccatttttctttgacttcagaagactgtttgcgcatggctttggcaatcttttgggctctctcctcaggagttaattctgtttttgattgtaggtttcttcttggctcttcaggggcctcaattggctgatcagccaagaaaactcgggcctggtcgacagcattcaggacagaatattctttctcctttaactcccgtctcaggg

SEQ ID NO: 8167 - DNA, 1139 bp, Homo sapiens
  misc_feature (1)...(1139): n = A,T,C or G
cggtgacgcgcccctcctttttattaccgcacccgtatccagtgctccccctatttcacggtttagttgtcctcctctttgtcctactgcgccccgcgcgacaccacgacgcggggggagggggtgtgtttgtgtcattttatccacccggagcgtcattctacgccaaagattgcgagtcgccgcaccccggccgccgaggtactgtgtaaccgctcatcgtactcttggatcataagtacgctcacgcatgactacttctcttcgtgcgtcacgcagtgttgctcagatatatctagcttccactatgcttattgctagatgtgaggacgctcgagatggaggaacaatgatacagatatttattcgcccaacgccgcctctctacgtggcgccttaggtaccccgatccacgcgacctcgcaatcaggatgctctagcgctctccgtcctgagcacccagacgatgcctaacgtctcgtcctttagcggtctttccctatcgcccggctcgcgcggatagaagttcacctgtaacctatctgcattgtcctctagggtgtggtatatcgacgccgacaccattggacgaccgtgaatcagaccgcaaccggactctagaccggtccattagacagcgccgtacggagggtcaccacgtgtacctgagagtggctagtaacggcagctgatatttctgggccgctgcccaacgcgccctatgctgcaacttcctcacaactacctccgtatatgttcgctagagctcaccgcacccgacaacgatttaccgcactcacctcatccgtcgcgtcgacgctatacggtgcaagatcactcaatctccgcttagccgcatgttactacacacggtacgccgccgttagaagttcaatctcccgctatcgtgtccctgctccttattctcgtgcagtccctgtgcgagactccgatcatacgcggacgtgatcgcaatactatactaccaccgccacacctcgctcggctagcactttctacttatcagacaccttgtacgcaaggccggtcgctgcaatctctctcagtacacgcgcgtagtatctgccatatattgcagcgggtactgcgtcgtacccgatagtctaatccgctnatcg

SEQ ID NO: 8168 - DNA, 1894 bp, Homo sapiens
  misc_feature (1)...(1894): n = A,T,C or G
cacggacgtgtcacgtctcactctcctccaatagtatgtataattatgtcgctcgccgnctgtccacagctgtcttctcacagccccnactttatatangcatgaataatcctcatgtgttgcacatctgacagtacttgtccatgagngactccaagaacgacaanacagatccangncngnagcggtgcgctcgtgtagtnaggatagcgtatatgctcgacnctacactacctgacatagcgcctgatgcagcgcnatgtagtcgactctacatacacatctccagactccgcacacgcgcgctgtcagggtacgntcgtattcgcatgtacgctacgccagcgcactaacantacatntatcataatcgtatctgtacggcgcgcacgagcgtattattgntaggtccggctcctctatcgtcgaagctcatntgctacgngtggtagtgttatatattacgaggtaacggtcanacagcactgcagatatctacancntaccagctcgaatacgaggcataggagtagagaacgncgatgtcgnactcattagtatgtattctgtnatagtgtcgcgcctctctcgcacagcatgtgctgctgattgtcacgtacgcgtctagacanacacacacctagtgagcagtctggagagagcatatcgacgtcagcgatgtgtatcacancntactaaactacgtgtgcctcgcactgtcgtagtcagtgtgttantnatagacacatgatgcgtgtatgctacatggcantaattcacgtcatatagcacgcantagagcgttcagtatgtcatgtcgcgtgacagtatcaccgtctgttcgnctatctacgtanacngatgtctcatntcacatntgatatatagcactantagttangtntctcgctacgtgcatgatncatttgcgtacgncngtacatgtagtgtatagtagaccacngatatgtatacgtcgtcatnctgtcgagagcgtagcagtggatactaatactcacgcaacagttgattgatcgtactcgatcagagtanagcatgactgaagtatgactcatactgtgttctcacgcgtatcgatatganattatatgcgcagcgcactcgcacacttgatgtggtcgcntnanagnctagcgcgcantcgcactacgagccgctatctagtaatctgnactctctctcgctggcacgtctntcaccacgcgnagtctgctcagattatngacatatgatgtgtntctnctcgntcntgtcactacataccggactagtgcacngtatatttacgtcgatcacgtcgttgtgcgtcatctncgagcgcagctcatntagctngaaggagcgataagactatcatacgaccganantgagtagcacgcgtctactaccgcacgnatcgacgcatacantctcatcggcagcaaacagcagttgagctcnactgtgagtaagtgtgatancatcgcgncgatatgacatctgtacgctccgtgtgctatcgatatgtgtctaatgaatatagtaactacntcatcacatgcgtactgcgcgcgtacgagctcgnacgagtgcgtgtggctgtgtacgtacatgtgtncgtcctgctaacncgtccgtcatgngacnanngattagtcactgntnagtattntctctagctaatgtactgtncatacctaatcacatatcattatgatgcancnacnagacacganctatgatgatatctgactgctgtcggttcatgacgcatgactcagtacntgnnangtagcactntacgcatagnaggtactacgannaactgatatantacgtacgacgtcntccgtcgtagnntatanagcgananantatnacgctgcgcagacg

SEQ ID NO: 8169 - DNA, 1652 bp, Homo sapiens
  misc_feature (1)...(1652): n = A,T,C or G
cattcgtccactcctccgtgatgccccccgcccggggcgtcgaacgtgaaacaagcgagaacccacatcgtcagccgtcgcgtggatacacaggcaactacacgtcgacccatctcatcatttcaaacaacaacattatatctgaactganaatgatgatatcataacggatgcctatccctcttttcacatataataataccgagacggcagggggtgggcagcggcacacccaccaacaccaagagnnngccggntgagtatangattngtatttgttttgtataattctacaatacaaaccagcagatcaatgctatgaccgccacacccgccaacatatcacagcaacatattcagatgaactccatatatcatcgacacgcgacgtcacatctgatgctttcgcgcagcagcacagtcttaggcgtacgactgagacagaacgagtactggcgtacgactgacaccctccngagtgccgtcgaccatcgtcagatatctagcgtcgactgacgatattcgtaccatgactccgatcctatctaccgttgcattagctggcangtagtatcagcacacgatacaagccaaagagacacaatagcacacacgattatacttccgaccgtctggttcgcaagatacatagctcactntaagcacagncgccagacatccactacgtataacaagacatcgatggtactgcactccgtactatacacggcagcaatgacactatatctctatcagaatactctacctcgtaccgcgctagtcactactcactaatacgtantatcacactaatgtaatacgatnacaacacagtgtagtgctcaccgatgtctggttattctcgctccatatatctctctatcatcgatcaanattaatgtgcgacaactgcatggacgtcactagtntactctacagcgancacgctgccagatgagataatacgtgacaangcctagncatgactcaactaacatctagactactctctactagtctncatgatgntctctctacatcacagcatacatagtagagatcattacatgtacacncacatacatacagtcatctagtcgatctagtgcgacacacgaccctagtcacccgcatacagctactcattatcgcatctactacagtacntaagatatntagcngncatantcgcatagcactacatagagatgctgntacgatgtagtcgtntatacatnatctagcgattgatcgnagactaagctacacgaacactacagcacacgaattaccacngtcacnagagtctntacagacgtncgtatcagacgtagacgtctgatcgcgtntctgtgttactctcacgtgcccgcatacatgtcgtcagtactatctcgtattnaactgatagatcacacngatcccagcgcactcncagatcacactatggntnnacanaggtnganaattgaatgatctagctcgatanataatagtcatagaangcatgatataactctaacatanacanctggcgtatctctgtgccgtagtagngggacatnaatgtagtcgtcattgatgtacatctgccttcacanagatatggtgtcacatacaactagaattctctaaatcacgacattctatat

SEQ ID NO: 8170 - DNA, 1230 bp, Homo sapiens
  misc_feature (1)...(1230): n = A,T,C or G
aagaaaaatgggagagaggnagagaagagagagagnaaaagaggagggnaggaggnnnnaaatatgaagaaaaggnnnnnaaggtgtnanaagaagagaaaangaaaaggagggaaagaagnnacagaaagcgnanataaaagtgangaatgaatatgatngaacgggagagagtgcagagctganaaaggagggnntatagtaagtaggngacgaggtattaaggtaactgtaaagcgctnaagaagatgtcacatgatatctgatgtatattgtctatagatctatcccacgtgtggcggntccacatgcgcacctcggntcaatgtcaatgagcccacatagtccatttactgcntgtgagcgggtccctcgctgcgtgcccctctcgctttccactccacctctatgctagttctcacaacgtcttgcgtcgtcctctagttatctgttanccgaacgtgcccccgctcactaggctcatataggccgtactcgatagaagagtcgcgacagttcctgtgtgtttggttagattggcgacgagtactgagacgtnatggtgggtttatatggactatttntctgcggttatgtttgtgtcgctattcccgtctggcctggcgctccatctgcgtgccccctgagggcncctactgagttacactcatccgccgccgtcgccctcgacctctatgatgcccagcgacgtgtctatcggcgaccgcgagactcaccatcttntcccactcgatgccgtgttactgtttgtcggttctatgtgttaattcgttaatttnactcagcgtagtcgtatcccgatacgtgtactgtgntagtaaaggcgtctatagtagtatcctgtttagatgtctctccgcgcaatatccccattgctagtgtagcgtacacacttcccgtcggtgttagctgtcaacgtccctcactcatatgtcgcgatactgtactgtgtgtcagctcctcagtgccggcactacgcgtcgncccacgaggtgattncatcacaagagtggcgnggtgcncatcgactccacgatagcgtccgaaggtagatccaccatcgtgtatggccntaacttgcagttcnancgcagagtagccccactatgccncctatgacggtacaccataccgtagcgattatctgtgttcacccacggcggttcacgtgagatcttagagagagcacacgaacgcggctacgacgcg

SEQ ID NO: 8171 - DNA, 193 bp, Homo sapiens
atgtacacacatagcatgtcagtttgtatgtacttagcagttacagagatatatttatgccccaaagcttcctctgtaccagccatttgttggtttcatttttaatcttaataccttcacacataacaattatatatttattaaaatttcagatcacctagttctgttaacaaagaaaaaaaaaaaaaaaaaa

SEQ ID NO: 8172 - DNA, 1580 bp, Homo sapiens
  misc_feature (1)...(1580): n = A,T,C or G
atccccttgcgttgcgcgtgtgtgtccgctgtcctggtgctgctccgcgggcggtttggcttcggcgcgtgagcgtgcgagcgcgcgcggtgctgcggtgtgtctccgcccgccgtcccacgcctcgttctcgtgttagtgtccgtcttcggtcccggtgcgtggcctcaccctcctcttgtccctcgtgtgtggccctcactgttgttgtntcctctttcntccccccctgcccctcgccggttgtccgctcctcgcctgctcatgctttctctcttcgcccactgtgcgcccgcgcgncgtctcggtgngtgccctccttgtgtgtgttggtgcgcggcctcgtctgtggtcctctccctccctcctgcctccactgtgttgccgtttgcgcgctctctcccctcctcccgcaccggtgtgtggtcgcggtggttgttctcttgcggccactcgctgctcctctggtcgtctccctccttcggctccgcccgctctaggtctcgtgtgttcccgccagcctggcgctcctgctggttgcggcctctgtgttgtgcgtgtttctccgcgtgctcgtcccgcacgctcgcccctcgtctgtgagtgccggcgcgttgtcttccgctgctgttgttcatctcctctcgcgcctgtcgtcctcctgtgctgctgtgtgtgtcgcgatgttgtttgctggttgcccttctcccgctgtcgctcctgtctgtgtcctctcgccgctgcagagctgctcgcgcncttctntcgtcgcngctttcgtggccgtgggcgccgggtgtgcgcctggcctctccgttgctgctccgtttctggtggtcggctntcgtcgcgtgctctttctactctgtcctcctgctgtattatcacgttgttgtggtggtgctgtgtctccgcctcgcctctccgcgntnttgttgcttcttgtgtgtagccttccttctntccgctcgtctgcgtcttctgcggttcgcgctcgcgctcggtgttctcatacacaacctactctctcgctcttcctcgcgtgtgtgtctgcgcggcgtcgctgcgtcgtctcctcccggtccttctctnctcctgtctcggcgccgctgttgctcggtncggcggtctctgtctcgtctgntgtcgtgtgcttcggcgtgcgcgcgtctcgtctccgtcggctctgcttctctctctcttggntgtgcctcggctctctctctctctcctgctttnngcgtgtgtctcgtttctcctctctcctgtctgcgctgtgtngcgggggngcgtgtgctttctncgtcgtgctnctgctcctgtcggcgtgcgctgctccgtcgctctntctctgcttcgtcgntggcgtncngcggtttgnctcgtttgncgtctgtctctcgtgctnngggtcttcctctgctctcncgnctgtnnccagnnncngtctngttttgtgtgtctncnnaagtcncnntcccanannacncaaaggcgcnncttcttgttgtgntgcctcgctctctctctgcgncgtcagtcgtgcagtcgtcgtgcgcggcgtgctgtctccacgcctc

SEQ ID NO: 8173 - DNA, 1094 bp, Homo sapiens
  misc_feature (1)...(1094): n = A,T,C or G
gcccacgcccgcgccgcacattaattagtcagatcgcccgctccccacgtcccccccttcttgacagtggcnctaggagaccccatcgttctcaacacccgcaccaacaaacggcggcgcacgctgggggatggattgtacccacatcctagctcctaaagtattaacaaattagtcgttttacctcgcacgcagcacatctcaacaataccaccacatcgcatcaatcgtgcaagaacgtcgcggcgcacaagagccatgctgattatgtgacgctcaagaaattacccaataatacgagtcaccactcccgcacaacgcgagtacgattgcgcatcgaaacccactgaaaagacacaatatgctatatccaacacatggcgccacggaagtgggtgccaccagcacacaccgccgcgacagcagagactatcccgtcgaagaccacgccacttccgacgacgttcacatggtagaacaacggcacctcctcctcgatatgaagcgtgcccgcgcataatacgatctgacgacgttccctttgtcgaaccaacatctcgactaccacactccgattgacacattccccacggcccctgctccacacgtctatgtctgcctcccatatatagcatacatcctcactccatcaactcgcgtcacgctacacccgcctccaccgacgagtgttctcaaaactcattttgtctgctgcacggatcaccgcccgacagctgccgagtttcgctctagtctccatttcaccgcggttacttagacatttctaatcaacacttcttcctctacaatataacgccatcattctttactccgccacaatccacctgaggatttccctgatcgctctcccctcgactccactaaccacacccccagaagaactgctctagtaacggacacccgccaattcctcgtgatatctcatccgctaccccccctccccctctcttactatttcaccctccgacacttcacacctacgttttattcactttcctgctcccatgcaactgaaggctccctatccaacccgtcaccataaaccaaatgcccgccctcaaatctgtccccat

SEQ ID NO: 8174 - DNA, 1483 bp, Homo sapiens
  misc_feature (1)...(1483): n = A,T,C or G
ggggtaaaagaggaanaagggaanngagggggnannnnnggagcagnnangaaggnnnnannggtagnnnnnggnnnnnanagagnnnnnannggggnngnannnnnaaagnnnaagatgcnataggacgcgnnnaangaggaannaagattaatattnnaggatgtgccgggaagcgagaganncaagatgannattgggtatgannagacggtgtgagatgaagagagngaacagaggactgttgttttactttatggattgtaaggtaatggctcatatagtagatcgcgaaggaggtcacggcaagcagcgcgcgcagcgcccccnaggtanctcccctcgcccgcaagccgctattacatatgcgtgtgntggagagctaagaggccattgcggcgctgcttcgtacttctttcgttctctcctctcctccttactacttaattacatagacgtcatgatcgtgaatatgagagcgtagatagaagtttataagatggcacagtgagcgcccaacagaggcgcgtgatatttttatgaatgttctattataattgcgtntagacgctaacggagcatatgtatattattatatgcgtgcgataggcggcggtagaaatcananaaatgaatcaactttatgagttctattgctgcgcggtgttgcgtcgctgtcgtgccctcgtctggtanctccgcgttgtgttatagtgagctgatgccaagtacggccacgcagtcgcggcccacacagcacccgcacaatacagtagtgaggagacacgagagtgcgcgggacggtacgtgaaactntnccacgtgtgtgctctctttcttcttccttgtcttctatactntcattccagtatcaacngcgagcggaggaaangttagatgcatcgttatagtgtgagtgttagataagatttagtgtgttgtagcgagtgagtaggtgacacaatataggtatgcgaggtatacctatatatgtatagtatantatgttggttatgtgacttngagatataaatgttcactgcagtgtattatgataactatagattagttgaactagtncaatncctcattcacgagtagtctgagagatggcgaagtacngtgtccgcncactagcgatgatatgtagagtatagatatcgagtgtgcgtgtatntatcgaagagatatcatatcatgagacggtgtncgcgacagtatgtgtacntntctataggagtatagtttcagatcgcagatagtgtctaaccggatagttacccanatgatggagatactanccagcgttgtgtgtgcctcaactcgctgtannnttctgcagacagacacacacantgaacacagataatagacacgctacaatcacaaactagttncacatatagataaccgtgtatatacaatagtcatatgaagtgttnttagatatagtgtgctgctgtactcgagtttctatnatatg

SEQ ID NO: 8175 - DNA, 733 bp, Homo sapiens
actagcagtacagcattctaactttgcatcgatgaccggattctaatcacaacacgttctgcgtctccctagctctagctcacagttgtggtacctagcctttttaattcgcagtaacgccacagctttttagtcgcttttttgtgcgtccagtctttgtatcttatgtcgatttctcccgagattgccctcaccgtaaagtaatgatatccatattattaaatttaaagtgccagtcctgtggcttttcttagtggaataaattctacctctttaggctttgttagggctatgcctagtattctctgaagagttcttcttcactatactaacctcttcgcccacccaacggtgctctatttcccttttaggaaggaaggagagaataaaggaagaaagaggtagtataggtgtatggagaagaagaagaaagaagtaaagtacaacaactttgtttctgtctgggcctgcacaccttactttgccctggctggcttttctagtcaacaaaatttttctttaaatgccaacatgtcagggaattctgccttgtgtttaccctatttgaagtatttcctgtcccttgcctgacctagtaagtctctattatcccacagtgtcttttagcttcatagcaataatctttttctctaaactcaccttttaaaaattgtatttgtttatttatttatgtgtttgcccctagaatgtgagttatatgacaagagacttt

SEQ ID NO: 8176 - DNA, 700 bp, Homo sapiens
ccatatggcgggaaaggtggatgtaagttccctttttggtcgatcaagagccgcatgccccatatttcgaagtgtctcactctcgggggattctaacccaacaataagattgaaaaccttcagattttggttgcccattcaacagactttgctccattataccaattcctcacgggaaagccatactgagacttccaggggcagaggtgtcatccatggaaagttgtcaattgtaatggcattcagcatcaatgtccacctaagggtgtagagcactcgaccatcatccaaattctcagcatcctgttgggggtggtgatccagtgtgcatcagcttttttggaatttctgaagaaagtgtctggaatccagattttccccacccatgttgctgttcaatcggaggactttaatggtgctgttaaatttcaaacgtctgtcataccacgtttgcgcaaaaaatatatcaatagtgtattccatattgatagcgttcactggaccaatgctattcacatacatgtctgtgtgaattaacgttggcttcactcctatatcaggccgaagtttattgtcatatccttccagcaggttgtttaaggtgacagtgacatcaccctcaggaacttttggagtcaagacccatgttttgttagaagcataatcttcatagtcatcatcagatttctggctagtgaag

SEQ ID NO: 8177 - DNA, 1060 bp, Homo sapiens
  misc_feature (1)...(1060): n = A,T,C or G
ccgcggactggcgggccatggaggggaaaaaaacaaaaacccctaagcagggggactgagggggggnggggctcggcaaaaggggaggcaaggagcaaagaaaaaacacggaaaagaaaaaaaaggggggggcgggggggaacgaaaaaaaaacacgcaaagagggggggggcaaaagagaggagggcgagaaaacgggggaaggggggggggaagaaacaaaacaaaaaaaaacagccaaggggggggcgaaacaaggagcacaaagggaaaccccaaaaacgcaccaaggggggacaaaacgggacgcaataaccccagggatcgaaatcacctccatttttcagaggagatggtggagggaggggggaaaaggagacgggggaaaacgaaggacaagtggggaccaacaaggggngaggaacccacacagccactgcaacgggaccaggggaacaaggcgtggaataaggggggactagggcgggcgaaggggtaggggcgaaacaacacggnggccagcgcggggggggaggggaacatgtgggacatgaaacggagacgcgccaccacactgcataaacgcggggggtaaacccgacaccaaactggggggggactcaacacggggcccaacccacagggaggaccgaaacggggaacacaaacggcatcacggaaaacccagagagacacggggggggcggccaaaaaggaacgaaagggcgggcggaaaaggggggggaaccaacaaacagccaaacaaagggggaacaagggggaagcgcggggggaccccgggcaccccggccccaccacacatggggagggacacacacaaacaacacacagggggaaggggggggcacaacaggcacacgggccacggcacagggggggggcgaacacacacccgggggacaaggggcggcgggacccccggcccccccgccccctggggccacaaaggggggggcaccaccacgccgcccgcggggcggacccacacgggcggcgcggggccaaggactgcccaaagggcacaacagggagcggggac

SEQ ID NO: 8178 - DNA, 357 bp, Homo sapiens
aacaaacaaaaaatgcacagttcataataatttctcttcgaaataatatgtttgagatttcggatagacttattggaatttacaagacatacaacataacaaaaagtgttgctgtaaatccaaaagaaattgcatttaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttttaaaaaaaaaaaaaaaaaaaaaaaaaaaaaa

SEQ ID NO: 8179 - DNA, 724 bp, Homo sapiens
atttttttgcctaaaaatcacccaccagcattaaggacgcagccagtctgatgatcgagctcataaaccaatgtggggccccaaggatgaggttatccatgagcattttggaggctcttgctactgaagtcggcaagcagtggataagttgcacacgatggtcattctcaagagtttctgcaagcggtgccaacacagcactcacttccctcttcaagcagtgaatttcatctgatgctctctgcctttctgggttcctcaaggagggggtctgctgtggttagtaaaacgtctgcggagctagtttccttcatggcagagagatgcgcaagctagtctcacttcaccagcacctcttatttaccccaaagcaacaccttttaggaagcctcctttcaggaggcagctttggaataaggggctaattcaaagtaagttaacacaaaggctgtacacagtggctcacacttgtaatcccagcactttgggaggctgaggcaggcagatgacttggggccagaagttcaagaccagcctggccaacatggtgaaaccccgtctctactaaaaatacaaaaattagccagtcatggtggtatgcgcctggagtcccagctacttaggaggctgagacaggagaatcacttgaacccaggaagcagagattgcagcgaaccaagattgctccactgcactccagcctggtgacaaagtgagaatgtgt

SEQ ID NO: 8180 - DNA, 877 bp, Homo sapiens
cgcgtcggggcgcgtgagtccgccggggggccgctccgcgtgtgggcgggcgcccgggggggcgctgcgggggcggtctcgtcgttcggcccccgccgccgggggggcggggggtgtgtgtggcgccgcttgctttggcggcggccgggcacccgcggcgccgccccccgcgggggggcgggggtggcgcttcttgcgcgcgtgggggggtgtcgccgcggcggggtggggggtggcgcgcctccctcgcgcggtgggtggttggcgccctgcgccccccctccgcgtcaggtgggcggccgtgggggtctcgccccccgccgcccccgcccgggggtcgttctcccccgtgcccgcgcctggcggtccctgggcgcgtgcgcccccccggggggggcccgcctctctcgctggcccccccccccgcccccccggccgccggcgcggggcgcgcgctttgttggtgccgcgcgggccgcctggggcccccccgcccggcgggcgccccgcccggggttcccccccccggtcgggtgggcgcggcccccccccggggcgccccgcggcggggggccttttttttgggggccccccccctgggggggggccgccccccccggtttttttttgcgcccccccctttttcggggggggggccggccgccttttttggggtgttttccccgtgggggccctttttttccccccccggttttttttttttggggtggatagtttttgggccttttccgtccttttttggccctttttttttgtttggggttgaggagggaggggagagggggggggggggggggggggggggggggggggggggggggggggtgcctcgtgccccagctggagctctcggcgt

SEQ ID NO: 8181 - DNA, 726 bp, Homo sapiens
ctttttacagactttggaggaaaggggcagtttacttggtcagaagttaaaaaaacgtgccaacatagggaggacatttcctaaaaataaaaattaacgagtgtttggcctatccagtctccagggtcctggaagcttaggcagaagaacatttaaattcagaagcagaggttgccatgatgtgagatcatgttttgcaattccagtctgggggccaaagtaagcctctggccctcactcaccaaaaccccaaaaccataaccaaaaccaaaaaccaaaaatgtatctgtttatattcaatgccaaaatatttaaaatgccttttaatgatgtgtataattttccaagtttagaaataacctccatttgtttgctttcacatattttgtacatttgtttttatcttaataacttgagtctattgacagaactatgaagatgcttatttataccatatctcatgttctacatgtccagtttagcaaatatgcattatccacttatttgctaaaagccatccttttttctcttcataatttagatgattctcaaatatcacacatcattttgcaatctgattctaacttctatactgccaaatggtctgcaaaattaaccgaaacttttggtctggagggttggagaggctgtgccttgactcagtgggtgactgctggggcattctgtcagaacaaggactggggaacccacatgtaatctgtccag

SEQ ID NO: 8182 - DNA, 307 bp, Homo sapiens
gaacattctaaatcagttgacaaagaatggctgatgctgaaatgacttgctgtttcggggtggagtgggaacaatcctggtaaatttcatattgcaggggccccaaagcaaagggcagatttcaagacaacttttattgaaatgggaaacagttaatttttactaaagaataagagaaatgcccccagaaataaaaggccccgaaatcagagggcaatgtggggaactttatattttgaggccccccaattggaacaaccccaataaatgcccaatgcccaagaaaattaatgttacttttcagagg

SEQ ID NO: 8183 - DNA, 532 bp, Homo sapiens
agcaccaaggccgaagattacccctcttctagggcaactaaatttgtagtctccaccgctggcgaggccctcacatgcaactatagtttccaagtgcacccaacttgtctcctactctatcgagactcatatatttccctcacgcaccaggctaaatccacactgggcgacagccattttctgcaacagatctaataacaaagggttggaagaaaggttctggtgcattcccccaaggtgatcttttattttctctgttccagcagattagctccgttgtctcatctcatttcaaagatttcagggccgggccccttgtggtttccgccctggtaatccccagcccctttggacagcccagaggcaagcgggatcccgaaggtcaacagatccgagaccatccctggctaacatggtgaaaccccgtcttccctgcctgtgcagttctttcacccttaaatttgagggttccatcacgatcccttttgcatagtttgtcttgccacctgccgggtccatcccatggacactg

SEQ ID NO: 8184 - DNA, 576 bp, Homo sapiens
aaaagaaaaaggaagacactcttactggtcagaggagagaacacaattccttcagtggaaccagtaattcaagctactgcatatgccaattaaagaccaatctggggaaaggtggatgccctgggctccatctgccattcaaccactgattacggccttgtacggatggactttcagcagcaggaacccaaaatcattggtgaaataggaaagctattgtacagatattagaaaaataagaccttcacagtcatcagaaaagttatcacttaatgtcatgtgtcatcagtcctttcttgtgattgattatgtttgtatacatgcacttgaaatgtgtttttaaaagagtattataagagatatttttccagtaagtacaataagcattcaatagtagaacaaatagaacattgatatctcattattagtattgctcacatgtgtattatgaggcagaattaaagctgaaatgcaataagagccatattttatcataatagatacttttcattttctgaaataatataataaaataatgtggttggttaaaaaaaaaaaaaaaaaaaaaaaaaaaaa

SEQ ID NO: 8185 - DNA, 714 bp, Homo sapiens
ctgtgcgtttctgctttctcgcgcggggggctcggctcttgtgtgctcctcctgtctttctccttgccggtctgattgtcggtccttcgtgccgcttcttgtctgtctggcgtggggggcctcgctctctcgtttttccccgctcgttttggggttcgcgggctcctgtcgtcgcgcgctgtggtttgtggtcttttgtcgcggcgctggctgtccttccgctgggtggtcccgcggtcgttctggtttcgttggcttcgcttgcgcggtgttcgtggtgtgcgtctctcggccctgctgtctgtcccttcctgcgctgcggcggctcgtctcggctgtgcgtttcggggggtcttcttgctgtgcgtcgcggtattcggtctccgctgggggcgccgcgggtcttccctgggggcggtctgggcgtgcttgtgtcgtcttcgtcttgggttcggggggtcgggtgtggctgttttctttttttttttgttgcgcgtgccccgcgggtgtgggggtgcttctttttgggtggtttgttggggggggggtcgcttccttttgcttttggggtttcgccccgtctcctcgtggtgcggtgcccccgttctcttggcgccctgtgtggccgccgttttctctgtcgttcggcgttttctttcgccccctgttggtgctcccgcgtttctggctttttttttttttttttttggatac

SEQ ID NO: 8186 - DNA, 1433 bp, Homo sapiens
  misc_feature (1)...(1433): n = A,T,C or G
gcgcgctggcgcgcccagcggcagccagttgttgtatttgtgtcgttccangcgatagtacctgatgtggacgccgngcacgcttatagncggcgtatatgactacgactgtgcagcggngcgttgctgttacgctatgacgcacgctgcagtntatatcgctcggacgcggtgcgngganagtggaggatgaggtttctatatcatatagagtaacacgcacgccttagataccttgtcgtatggagactatacacacactgcgtagtgccaggagtgatacctcgttgtagtctatagaagcaacgagaaagacacactggccgccctcgacagcgtcgttggtgaagagggtagtggcattagtggacaaacacgagtcctcgtggtagaggcgtgagcgctatcttcagtgtgtgtgggggaggggggcgtgggagtgagtagcgtgaaaatgaacatttgtatatattggccgcgaacgcgagagtaataantggaagaggtgacgactcgtggtgtgctatgaaattggagtaggagggctacgcaaatgcggccgctatctgttttaagaggaggaagtagaggaggagggagagtttatgccgtcgtgtcctcatctcgcgcgcgctgcagngcgacccgacgggcagagcanagggcgtcgagtgtatgaaatgagtggatcagttctagtactgtcccagtatgtagacgttgttaggagcagtgtngagagtgcgtcacgttcgagtgtattgctagacgcaggttgagataggatctgtctgggtcgggcttctgatgtaaggtgttgtagcgcaagacgtattatgtcagctcggcgagagtagagtaggtatgaggcaggtgagtgtatgcgtcgacgatgggagcgctcgacgggcaggctcggcagtgaagacgagagtaatgtatcagggagagnggtgtgagggntgcgcaaagcgtggtagcgcgcgcggaatgatgtcgtcgagacgagagagggagtgagtngtagagtagctggtntggactgcttgagtgacgtgagtactggaggataacggtagtgtccagtcctatgtagcgtacgacagagacatatgtaantagagacagaggtgatgcgcacggcgnacatagagagtcngcgagtgtgagtagtcagagcagttagccgtcgtatggaacgcgcagtccgcatcagatagctgaggaganantatgcatgcgcntggggcgttggtgatctagacgtccgtgagtgatggtatctagttagagtggcgangacagtctgcgctcggcagtgtgaaacgacattagtgacctagtgagagcgatagacgaggtatgagtgctgcgtgagctaagatgcgaaggagtctgggacggcggcgatagaggtagagagaggagacagg

SEQ ID NO: 8187 - DNA, 999 bp, Homo sapiens
  misc_feature (1)...(999): n = A,T,C or G
cttatctacaattttcttcccagtttctctcccccctcctttcctttccagatgcttactctatcttcttctctctccacattctcattgcccctgttccctccgtttgttgcgcctctcggttgtcgtgcagttgtcgcccgtgtgtcccggactgcccggagtgtgttgtgcgtggtttcaccccgttcggccctctctgagtttcgttttgtggtccaccgcctccgtccctacctgtctcgtgtcgcttgcggtgtgtcgctccgttggttcgctgcccgacggcagcccccttcgttgttagtccacgcccaccattccactcgggttggtgtggggtgtgtggtttcgctcacacattatgtgtgcgctccccgttgccctccccggtgtgctgccgtctccttccgccccgtggttctcgcctctctcaccgatcacgtttctccttgcgcacggccctcttgtgtgttgttcgtctagcccgccgccctgtccttttctccgcgccctgtcgattcctatttcccggcctaccttattcgctcactctattcatctctacctgggtgtcgctccctccttcacgccccggcgcggcgtctcggttatttgttttgccgctcgtttagcgttccgccgcttcctctccttctggggtgcggattcccggtgtcgttcttgggctttggtcgtgttcgggggcctcgcggccgaaacctctgctgtttgccgaggtgggtggtcgctctcttctgtgtcgccgtgggtgcgtgtgttgtgtggtccccgctttcttgtggtgctgttctgtcgtctcagcgctttttctcttgccacttcttttcttcgtgttgggggtggggggcgggaccaactgcacttctgtgctcttttacctctcggctcgctttcgttcctcgggtttgnccctttacngcgtgtcgtctttcccaaaacgttggtcttggctcgtttattgcgtttgcgctttgc

SEQ ID NO: 8188 - DNA, 1498 bp, Homo sapiens
  misc_feature (1)...(1498): n = A,T,C or G
acgtcgctcgatgtctctgtgtagtttctgatatgntagtcgatacatganagggactgcntgtgcatatgtatagtcacaatgacangatatgttgtgcgtgactggtatcatngtaggcatgctatagagatggtcgtagagtgatgtgggagantggtgangncgatagcgantgtcgcgagtanagtagtnantgtgtagtagtgatgtgnataactangggtagcaggacgttgntgtacctcaggaagtagagtaatgtgtatacgatagtagactatagtgagngtgagaagagatgctagtatatgtgacaagatagctcggtactgantatgagagtgagtgagncgaatctggtcgctgagcgtgtatctagtgtcgtcgagttacgtgtgttgcgagcagtcgcgcggtgcgacgagtgcgatcgcactatgnggcatgtatcgatagtgtggctgtgtagcgtgaggtggagtagagaatcgggtagcgatcgcgtgtgtctgtattatgtcgctgtagtatgtgtgtgtgtgcacgctagtgtcgtcacgcaactgatgatgtgcgtatagtgcgcgcgtggtgtggaagcagtgcgtgaggataacagtcggaggaactagatcgcaccgtcgcggtctacgtgtgtatgtagtaggtatctgatgatattccatgacgatatagtagtgatacttggtagcgtcaatacaaagtcacgnacaatgtagtagattgaatcatgatccagctacgaccgagcgtcaacgcagaagtatataacaatacggatcagatcgtacatacagctgagtagcgaacacgtatattgtatgtnaagcgaaggtaggattgctaatagattactaatgtcgagatataaatattatgttagtgagatataggaaaattttttgtcgtgtagtgtggggtagattataacgtggggtgatagatatataggtagatagtgaggaatgagagttttttgaacgttaaggagtgaatttaattgaatttgtaaaatataaggaaggataggagtggagagactgagagtaatgtaaagtgagacagtatactatagaaaattgtattagttgggtgaaggaatgatgtgagaacatatatcgaatggtagcaacgttggtagtatagataatgctgtacacactacttactattttagatagagatgaggaggaataggtggaatataagagttgctggtgcatatgtatgtactctgggncattgtgacgtgaatccgtgaaggtgcgggctgcgtataggctcgtctggaggcgaagcgaagcatgtctgtgtgaatatgtatgcaggatcgacagacgggcaggtatgtggagtgtgtggggtgtgggtggtgcgagggacgatttgtgagagactatggtaaattgcatgagggcagaaggagagtagagaagagcggagagtcgggtacaggtagctaattagagacgga

SEQ ID NO: 8189 - DNA, 1492 bp, Homo sapiens
  misc_feature (1)...(1492): n = A,T,C or G
atcgtactcgcgatcgagctagncgataagtnactgatcgtcatgcgagtgtcgngatagtgantatctctcggcgccactacgcgactactcgctctatatcacgctcacagtgatgtgtatgttatctatacttaaatttattgtcaantatgttgctactttgtcangttccatgtatacgcgcaccgagtagcancacacaatcctacgcccggacacacactataatacatacagcggatcaacactcgtctntaccacgatcgcgcaacacacgacatcgatgcctcataacagagcacgctacaagtttcacagggcgacgcgcacantgacactgccactcntcactcagcactacacantgcataacacattggcatgagctaggcgttaaccggacaatagcaaatactgtaantcgatcgtgcgaacacgcgtgacagtcgtgacgctctcacgtcgcttactgtcatacagcctatcatcgcgcgagcgtatacattctctgtcnatcatctgtataatagcgaatctgcgcgcgtgtggtcngnagtagcagtgcacagaggatcntaggcaggtaagaatgaacatattagtgatcactatgtctaacacacgtagaatgtagaatattcagagtcattatgtatcaataatataccatagaaataacagacacacgcacctcgcgacacatgatgttgtcatgtcggtgtattgttgatatagtcatacactaccggcgcaaataatgttaagctacgacgcgcagagcgtgcatcttctatcatcagatccttgtgattattatgtctctatctactatattgagcgcggggttatgtgtatcactgatagacgtagtgcnagagctagtctgatgtgtaagcatgagagactgagtctccccctctacatcgcatatgctgcgactgtgtggtattctcgtctcgagggagaggatcgccggtcgccgcatcttctgtcagattctactaactacgttgtggcggcgcgtatgcgtcgcgctgtctagtgtgatatagctgacgagtaattctcatgtgttccctctctgctgcttactaattccaccatccatacattattcttacgatgagatataccgagtgctctncagtagatcatagatctacatgatccctactctatatatnagtctcagatgagacgcgacacagaagcgtagctaaggctcatatgaagatactacatcgcatcgactcatcagactgaatagtatctcagcgagtcgacagacatgatccgccanctgacactcgcctgcactctacaccnagcccacttgcgtacactcacgctactcgcactcgctctctctcgtcgttctcttcgccgagtacgcagcccgtcaacntctctcaccacctctattgacgagatctactacaaccgacatctcacatatgatctctncattcgccacgatcganagtncnat

SEQ ID NO: 8190 - DNA, 842 bp, Homo sapiens
  misc_feature (1)...(842): n = A,T,C or G
cccgtttttccctttttcccattttcgccttccctttcccccccttccccctgtttgttggtttgttgttatttcagttttttccttttttttgttttcccccctttgttttttagttcccccgtccccgttttttttgtttttttttcctcccnattgcccctttttccttcccgtttaaccttttacttttttgccttccattttttctttctcccattcacttcttaatctttaactttatacccttcatcggtgttttttgtttcctgtttttccccntcctttttttttcccccgtttttgttcttgtttttttttcctgttccttttttccatcngcttttttcctttctttttatttattctattttccattcacctttttcctttttacgccgcatgtttccacatttccattttgttgttccccaatgtgagtcttgcggttcgtgtaggttggtagcagtattagccaccattcctttgtattttcttataatgcagcaccgttatgttttgtatgttgctacctactttgccaagtgtgaactttcttctgttcgcctccgtagttttttatccctcccttttgcacgctgtcatatgtatagtcctttgcccttcagcttttttttgggaaaaaatagcggggtccttaacaagaaaggtaagggaagaatgaacacaagtcaaggtattttgtcttcagggtgcctccctgggaagttacctcagtcaacaggtatctctaaagtgattcaagtatctgacttctccgataatcttcctaaccgggcaagtttatctgtactagtcatgaagaaaaaaaaaaaaaaaaa

SEQ ID NO: 8191 - DNA, 608 bp, Homo sapiens
  misc_feature (1)...(608): n = A,T,C or G
actctagcttttgcaggccgactgagcaggctaaagcagaaatgtgcaaagtgcctttccccagacagttagaatgtgtaatgaagatggaaatttccgagacctgaatccccaaacccagactgatctctcttctcttcttgaatataaaaaggagattgctgatgccagactcgaagaacatgagcactatgcatgtgaagatgtggatgattacgcttcaccttacatgatgataggaagataactgaggcactactgaggtgtgattgcaatacagcctgccgaactgcgagtggaataagcctgtttgcttgatggattaccggagctgaggtatgtttttataggtttgtgagaatggactacttctgttctattccctccccccgcccttttcttcatcctaccggactactataatcaagacccctacactattcgccccagccagctntttcttaaatctaacgccatgccacccgccatgaacccaccccccggtaacctcgtcagccagctgtgccccggtagtagttacagccggggtgcccaagatacgcagttaggttgacctatataagtgaggggcggagtccgcgagacat

SEQ ID NO: 8192 - DNA, 641 bp, Homo sapiens
actcctgaggagatgagaaagtgtgcactcaaggaacagtgctgtctgaaagacttagagcaacaaggtggatctgacaagcagttgaccatgaacaaagaagttttgcaacctccttggacccctgatgacagccagatgtctgtggcctccagtcacctccagacctccaccccctgcatggtccctcttcctctaatatgaaagaagcctaaaaaaatctatcaatctaagttggttctggctgggcacggtggctcatgcccgtaatcccatcactttgggaggcttaggcaggaggatcacgaggtcaggagttcgagaccagcctggccaagagaccagcctgtggtgaagccccatctctactaaaaatacaaaaattagctgggagtggtggcgggcacctgtaatcccagctactcgggaggcctaggcaggaaaaatgcttgaacccaggaggtggaggttgcagtgagctgaagattgtgccattgcacttcagcctggacaacagagtgagactccgactcacaaaaaagaaaaaaaatgttctttaggacattggtcctccatcttctcagttggaagctcccagaaataaagtcatcttccttaccccaaaaaaaaaaaaaaaaaaa

SEQ ID NO: 8193 - DNA, 651 bp, Homo sapiens
actcgaggtttggaaggcagaagtgaagcataaggcacaagcgaagcagaaggaataagattgatactttttaacgcgggcttttgcacatgacccattctacacaggcttccacttgtcgtcctcggcatcttacttgactgactgacccagccccgtcgtgtcatacataagttagtaagtggcagaggggccgcggcccccggggggtgggacttcagaggaagagtgtagaaacgggagagaaaataccccgcgttgtggctgcaaccgccgtccacccgcgtccgcctcgcacacatcgtataactattattacattgcgttaatattctctagggatatataatacacggttcccctttgggtggtgcctgaagtaccaaccgtacccgtacactgccgccccgttgagtgcaccttagcgcacgacgacgtaggcgacgcgacagcgcccgcggtatggcggaggagctgaggactgaccaacacgggccagcacgcgtaccacccagtcctcgagttggacgaacagctttcatttattctgcctaagcagcccttgaacattctaagatgaggttcgacgtgggtgaatacccgcgtccataacgcccccaccaccacggcgcacaaacactgctgcgcaaa

SEQ ID NO: 8194 - DNA, 670 bp, Homo sapiens
cagtttttaaaacggcttcccaaaaaatcccttctcagatccttccagagtgttttccaacttccctgaatcaaaaggaaacaattaaacactgcggagatgaattcaccaaccttcaaaagctgttatacagatagcttctttccaagtttttacctggatacatccagttttatcttgagcctcaatgggctcccaactctctctttgtatattcttcaaaaacagtgatttcaacctgctgaatcaaaagaaaagtttaactctgtgagataatccacacatcaaaaagcagtttcacagatagtttctttctagtattttactgggggtactccttctagtattttactgggggtactccttatttccacatgggaagcaatgggctccaaaacgtcccttcactgattctccagaaagactgctttcaactgctgaatcaagagaaagttttaactctgtgagataaacccacacatcaaaaagaaatttcacagatagattctttctttttctggcaatattcagttactttccataggccccaaagggctcccaaatgtcccccagcacattcttcacaaagagagtttccaacctactgaatcaaaataaaggtttaactctgtgagatgaatccacatatcacaaaaaaaaaaaaaaaaaa

SEQ ID NO: 8195 - DNA, 475 bp, Homo sapiens
gccgccatccgccccgctccactccattaaatgcggcccgggcagcccacctctttactcttcttcgcccgtctggagtatagaggggcagtgagggggtgagtgggacctttttagtgctgcggtgggcggcgcggggtggggcgccaccggctggccagtggtgcggtgtctcccaacgctacttctattgcccgggtcgccttcgttttgtcttctccacccctgccttttacccactcctccccacgctgattgcggcagcccgggacctggtcggacgcaggggcccgaggggccggatgcgggccggtagcgacagaagttcgactcatagtcgcaccctctacttatgccgcgcgactgggctcccgcgtcgccacggggggcatcccacgtagaatgcagtcgcatacgtccgaacgcccgccgtgcccccgtcgccctcctcgaatcccacccatggccggcgaag

SEQ ID NO: 8196 - DNA, 384 bp, Homo sapiens
ttctgcccctttagagaaccctgactaatacaggtgctgatgacactcaccccacatcatgtgtctggagaagcagaggccactctacagagacagaagagtgagagagcagcacagagaagctcatagaagagaccccctgagagagtcccatcagagctcagaccccaggttccagaggaagagatagagctcatctccattcctgcccctaaactcactgacacacatgtctgctcactagtgtcccactttgggctttatgcttgctggactcttgttttggcctatgaaggcctctgagagctgtatgaattccctatgactgctgtaacaaattatcaaaaatacaatggcttaaaacaacataaaaaaaaaaaaaaa

SEQ ID NO: 8197 - DNA, 627 bp, Homo sapiens
aggagacggggtaacaccgcggaaagcagaatggaattgaacaacagacctcgacatacctcctcctcgaactatcacagggaggggataacaagctagactaaccaccccccttttttacgtggtacgaaagctacagcgagagacccccacttcaactccggaaacagcggcgaaggacccaagggaactattgaaaggaagccaccaccaacataccaacaacaccaaccaacacaacacccccacctacacacacacgcggaaaagcttatgacacacccccccactaccgcccgccacctcgctcgcatgcttacgaaggcgtaacacggaataactgaatatatagcaaacataggtagcatagtccgtacagaaccatatctacccccgctccagacgcgcagaagcaacaccccctcaaccaagctacaagagcccaccacacctaccatccccgcgcgctctcctccaaatagccacacagcagcacaacacacagtaccccacgctcgaaatcccacactcacgctacaccatatccagatttatacatacatcctaccctacaacaatacaccttcgagagaccacgcctaagaagagggcagcgtgtctcccagt

SEQ ID NO: 8198 - DNA, 343 bp, Homo sapiens
ccggcgtttgtgattgcgttttgtgcgtactaggcgcgtccgttacggtatgctatccgagcgcactaaggatgtgcattgattcgtgtttcagagcatgttgttctccatgttccagtttgacaacccgtgtttgtattcattaaccgggctaaccacgtttattaaggttgttattgatcattgcgcttattttctattaaggtttttttaagcaccgaaatatctgtgggtgggattgttaaaggcccatttagttcttttttttatgccttataatgttcttttttaagccagtgccaatattcacggtgcatattcagtgattttttgtccatataga

SEQ ID NO: 8199 - DNA, 399 bp, Homo sapiens
acccggaagccctaacctccagttgtaccgccttaccggatgcaaccaatgtacagctgacacatattgattgacgcctcatgtctgcctgtaatgtataaaatcgaactgaaccacgaccaacttgaacacatgtcacacaataactagctgaagctagactccaggacacctctcttaacacagtggcaagacacaacgcagtatgcacgtcctccccctttcaagggagaaccaataaactgatccctggatcactgactaccctcgacacagtcgatacgcgtgctacacaaccgaattgagcaaaataacgagaccgaaacacgtgatcccagcgaaatcgaaaacaccccattaagccgacccgtcgacaccaatccaagataatgccgatat

SEQ ID NO: 8200 - DNA, 772 bp, Homo sapiens
acctgagccggacgccactggctcaacgcaagcacgcatgaggggaccatatctgcagggaaataaggtggcttcccctgtatgtataagcaacactgcacgaaaattggggcaacaaaatcaactgatcatacgcactactgcatcagcatgatcacatgccagcaccgcccaccgaccccatccacacccccataccacgccctgacccgctcctcacagggcccataactgtagccagtgtccagtatcgccgaatcgagcggcgacagtgtcttgaacgtgccctgattcggggaagcgtgaacgtatccgttccgctaacacaaaccccatgttgatcacacacacacgacaccgcgcaacgccgccagcaccgcaagatcaccatcgagcagaccaacctcagcgaccagggcttgcagaaagctgaggcacatacggcgaactgctcatgccactctcctacccgctcacatagccctcgcactcactcaccgcgaacccagccgccaccactacactcgacgccccctccacgcgcactcaccagccccactacccgccggcccccctccgccgagccccccgcggcactcatccgcccccgaacaccccgcgccgcaataggccccagctgccaggcaccaccccgtcgcaccacccccgccacccccgcacaacttatggccccagcacacgcctgcctcaccccacatccaacgctcgcacgacactcccgcctcccctccattcctacacgccacaactg

SEQ ID NO: 8201 - DNA, 460 bp, Homo sapiens
cccttgttttcccatatgcgcatgtatcgctcaccctttcactctattccgacgaccatgttttgtgtgtaaacattttttccaatatcaatcccaacgatttgtttcattcccgcaacaacacattaatttatttttccgagccattatcttattctcccctcgtataattttcctttacccccccacaccctcttttcacgttccttattaattttacactttatatttcacattttatttggttcagtttgcccccacgttttttttcaatttgaatgtcccattctcatcgcatccccatgtcaaaagctactttatatacgttttttttaatcatttatcatccagtatcgaatttcacacttttatgtcccgatatgcctgtgtatcacgtcagttcttattatttatggtataatttttacgtcttctatcatgttaaggtgacagtatgtta

SEQ ID NO: 8202 - DNA, 840 bp, Homo sapiens
  misc_feature (1)...(840): n = A,T,C or G
atttttgttaaagccaagccattctatagaagatgattatatgtcccatttcttaaggaaatcaaaaagtgaaatattgtaagcttcacaaccgtaagaatgtcaaaaagacaggcaccaagctctcncacttattattttaggggcagaatatggaggctcagaaggtgaggaaaatactttgtgcattgttgtgagcaaataatgctttgttgtttgaaaataagaccccataaatcatatcttcaaaaactggaattacattttccattaactcaggttaactttctcatcccttccttttcgccataaatctaaattcatacaatctgtccgaaggtgtgggctaaaatacgatgtggattcttgagatctctgggttataattttagagttttcaaaattggatttcaaatctattgtcactagtctaagggggtgaagaccttggcagcatgattttatcatgtagcaggagcagaatgatcgtcagcaggaagcctcacctttaatggctttcaaagttcttctaactgaatgggacagtggagatacggtaaatgcttagattcccagtgctgatgatagggagcttaacagcacttgtctcaatactcatggtagcctaattaaataatacagaaagcatatcagttaagcaacaaacaaaatttttttaaaggaggtagcattttcggtatcaccaaatgaaatgctgactatatgcatatgaaaaatacatatacgtgtgataatccgtctatacaaaatgcttaacagntgatatattaaggaaaaatgtttgattaaattatacaaattaaaaaaaaaaaaaaaaaa

SEQ ID NO: 8203 - DNA, 374 bp, Homo sapiens
cagacagtatagtctgccttctttatgtattcgataaccaattggcgagatagttaggagacaacttagagtatagggaacaataaaagatagagtaaaagtgatagataatatagagtatttaaaaaatcaaggtgtcaaaaagcaacaattataatagtaaagaagaggacaaaagagaaacgatgactctaattaacatgaaacaatctaatgctacaagctgtattcgttattatgattaaatagatgggagaaaaatgtataaatgtgcggattagatcattagtcttaatttataacaggttgttaaaaggacggataattccaactattcgggttagttttagggacagagagcattgtttaataaa

SEQ ID NO: 8204 - DNA, 164 bp, Homo sapiens
ttttaggggctaaagtaaagggcggtaaaatggggttttttttcggtttcaaagcccaaatcaagtcaaggttggtttaggccatgagcaacgcttgaagccccaaaggttttccgaaccatggcataataacggtggtattccaggattttttgacaaaaagg

SEQ ID NO: 8205 - DNA, 1283 bp, Homo sapiens
  misc_feature (1)...(1283): n = A,T,C or G
aaaatgnnnnnnnnnaaggnnnnaaggtnnnatgagataaatatagnaagaggagataagagtaatagatgtagnnagagatatgaannagagnngagtgagttttatagtaatgaatagtataaggatatgatgttttaagactggagttagtnaaagatatgagaagnatagaattnatatattnaatatgaaaataaagaatttattaaataataagatagaagnttataaataggttaaatgttgtctttatttctatattaaaagaganagtaaaaaaaatagataagntcaatnattagaaagannntactttaaattttgttttaggtttatataattaatcttnntaataaaaaaaatgnnaatatagtttgtnaatatnnaaatatgtatttatattagttatattnanatatttnaattaaatntatataaaacaagannaagaagatacacaaaaatcaaagccataatnactcccaaggatcgacaatgtgcacaacacttgaatactctatagnnnncacaatatacncttgatccattctcacttattccatccttccaaacccacatcgatatcaccgcgccaataaaccatgctccacaaatcataactaccactncgtcccctccccaccacactccccacacacnncagtaacaacacccacgcacatatatcataaaccaccnactcnaacaagtcccttcctcatccccaagatcctctgatcgtaccactaattntacataactcctcccactaattgcacaatcctagcacccatccagtataatgnnnacaaagtaatagattttactaataataatannnagaaagatatatatgttgaaattaatgtngtatatagaagatcacagttctagacattcntnttntatatcatgtatgtactcaacaccattctctccccgccgcccacaactcactatatacatcaaatgttatcctcatactactcgctcttattctatatcgtcctccacccaccacttatagtcacangcaaagtcccatacaccagtgtaaatatgtacttccgcacaacgtcatacnttcactgtggctcatcacagttcgcaggatctttagattntntcaagtctcttcgtacccctcactcacaagcccgttcacgatcatgtcaatatcagaatccacaacatattctacacataatactaataaatagtaagtaggtatnnnctaacaaacaatgtatctatacacatttcattactctcttcatcat

SEQ ID NO: 8206 - DNA, 358 bp, Homo sapiens
agagacaggttttcgccatattggccaggctggtttccaactcctgacctcaagtgatctacccacctcggcttcccaaagtgctgggattacaggcgtgagccaccacacccagcctcatctgacaagttttaaagtggcagtaagaagtggcctgtgttccatgatacagaatatgaatctacttccaattgaaaaatattcatgtatcacccaaccaggatggctgcagcaggaacaaaagcaaacatgctgagaaataagatgtctggcggctactcttgatttgaggctgtttgtacatagggtctaattttcaaaataaaatcttctttgcttgttaaaaaaaaaaaaaaaa

SEQ ID NO: 8207 - DNA, 201 bp, Homo sapiens
aggcagagataccagagtactctctctctccactcacacacacaagaaaggccctgtgaagacacagcaagaaggtggacatctacaagtcagagaagcctcatcagacaccaactctgacactgcctcactcttgcacttccacccctcagaatggtgaaaaaataaattttgttgtataagccaaaaaaaaaaaaaaaa

SEQ ID NO: 8208 - DNA, 605 bp, Homo sapiens
cattcagctctgtgaataaaagcattctgctgatttctgctgacctgtatccagacagaaggaatggatccatgttgcaactgggagcatggggaaatctggacacacactttaccaaaatgaaacaactgtcgcctgacacaggcttcaagggaaaatatgacactcccgaccgactacatgctcccccccaccacacacgcaccaccaccccccacacccagacccgcccccccggcagtcccaagctccctattgtcgccctccccccttttccccgcgtagaccctatcgcgccactctgtatcctgcgagtgctcgatagacacagttggtttcaattgtctctatacgtcgggtgattgataggccacacacatagttgtccctcccgtccctccccacttcacgatttcccaatcctaacactttatgtttcccattatgctacccctccccaccactccagacttgtgcgaggtacgcagagagcggcaatgcacgtcttgacctcgtttaccccacacacgcaagggcgacaagatggagactggtcggggcgcccgtgacaccatgcacacaagcccaccagaatccccggctcg

SEQ ID NO: 8209 - DNA, 820 bp, Homo sapiens
cgatgataaaaggaactctcagtgcagagaggtttactcgggtaggaacatatgacctcaacttttttagaggaagttcaacatcaggaggctgatggggttttgtgtttgtagtgtgaaaccaaaggtgagtttctttattcttaaaatataaagtaaatttccttatgggtaccatgtccagttataataaagagtaacaaatggctttggtcagaaccaaaacttattgaggtagaaccaataattttattatacttgtgaattctgggaacgaggtaatttaaacatggcataggggacatggctttatcttctccacaatttctgctccacaatttcagctgtctcgataaaataaaaaaaaaagattaataatattctgtgatcacaatgcaaggaaatagaaactaaatcaaaataaataatcaaatccccatccaaaatgtctgcaattttaactctctgtgaaagaacacttagacaaaaagagaaaagagccctgaagttacagaatttttagaacatacttttaatgaaaatactatatatcaaaatatataattaaagcaattatttaaatacaatacatagccttacataattattttaataaaaatgataagataatattttctaacacaaaagtttgaaaaggaactttaaattaaacaaaagaaaggacaaagagcaaaattatacagatagaagccgaaattaatcaggtagaaattagtaaaacagcaaaaatagtgatggttcataaaaatatccagcaaagtaaacaactagctaacttaatttgaaaaaaaaaaaaaaa

SEQ ID NO: 8210 - DNA, 1048 bp, Homo sapiens
  misc_feature (1)...(1048): n = A,T,C or G
aagggaaggnnnaanaggaagaggaagagaaannaacaaaagaantggaaggaccctcaccggggnaaanngggccgcccaaagctgcagngagcacgacatcaacgggcaccgccnggaggcggggggcgggaggggagcagaactctgacgggacaagggcaggacagcgccgggggcggcggcgggaccaggcgccagaagagcgcaccngcaaggggcgagggcggccgacgggaggncgggncagagaaaagggcgggccggggccagagcgaagcgggncagaaaggaagagggggggggaggaagcaggagagaggggggcggggggggggggagagggagaaagaggagggggctggacgggnccgcaacaccgcggccacgcccgccccagcacaggaggcccgcagcgagcaacaaagcnnnagacacaacgagggtgcggggcggggaaggggcggccggcggccgcccgcgcccccgcccgccccgcgcgcccccgcgaccccgccaccacccgccccgaccgcccccggcacgcccgccccacccgagcgacagcccacaccaccgcccaccccctccacgcccacgcgcnaagcgaacgccgccacccccggagccccacggcacgccgcgcacaaggancccgcgacaagagccggagagggagaacaccagggacgggaggaagggctaaagacaggcgacgagagaacggcggggcgacccaccgcaggctccccaggccgcacccaccctccccgccgccgaccccgcgcgcccgagcgcccagcacaacgagcacgagaccnccgcgcacgcggcgccgcagcccacgcgcaagagagaagaacaaaccgcgccgcacgcccggaccccccacggcacgacggcgcgcccgcccgggnacacaaaacgagcgggcagggcacagagccgagacggcacaacacagaacccgagagcgnaccaaagacggaccggaccagacagaacccacacaaccgacgcgagcccgcgaaacgcagcacgacagagg

SEQ ID NO: 8211 - DNA, 991 bp, Homo sapiens
  misc_feature (1)...(991): n = A,T,C or G
aaagggnnngnnaaaggnnnaggngaatagaacgaaaggnagagagangagagangaagnaagnnagaaaggagagagnaaagttgggagagaaggaaggagagagtaggtgnaataggagaacacaagagacgggaagaaggaaagggnagaaagaactttggaagaaaagagagaaggagtaattgaagtgnccattacactttattagacatagattattccagcattactataattataagtaagcattgaagtcataaaggagtncagaagaaaatnatataattnaaaatnaaatagggaagaagaaaatnaagagnnaaaaagnngataataagnccagatcatgataagaacggttctacatcacacaccacaggacnccggagcagacaagggcncaagacgcaccccctgccacgacgccccccgcccgcccggtccagccccgccccccccgccccccaaaaaagaaagacacaaagccgagaacgttccagcnntaggcgcacagccgatggtaacagagcaagcttgaccccccacatcgcgagcagctcagcnaactaactacccgcccccccacactcgcctaccacgccgcgcccgtttnagaaccttaagtgcccgttatgagtcactggacggataggatatacaactcagaggcgtcccgacgttcactatgtcccntccaccgccctggntatgtacgctgctactcagctctacctctccttcncttctaccctcgctcccacacgcccactccccgtgtacccccgtaccatccagcaagcatacccccatatgctatatgccacatcctctgtcatccggtcctaccagcctccgagcgcccttccagtgtnctgttgactcacactatagaaggtcccacgacgaataagagccnccactacatcacatgaactacaacacacaaaatcccacactctgttactacctcctcctaaccagaacccca

SEQ ID NO: 8212 - DNA, 365 bp, Homo sapiens
ttttccccccgtgtccaccgtgttttttttgatcccttttttttcttaattaatttagccatcccccagttgatatttcccccttttccaccccccattttttccccccccctcactttttttctttttcccccaccccccaccccctttattttataattatcattcagcttcccgtgttattttatcccaaagcacgtcatccagttttttgaccagaccacccattcgcatcgggatttatcaccgcgccaccatctatatcagcctgttatccccttccctttgttttccccgcgtcttcccaggccccgtaattcccatctgtttggtctggttataggcacactcactcactcctctct

SEQ ID NO: 8213 - DNA, 153 bp, Homo sapiens
cataaccttggtattttcttacggtcttaaagccgtaaatccagtgacggttggttaaggccttgacaatgattaaagcttcaaattttttagaatgcattgagtaatcacgtggaaatccgtgatttttggccaaaaggcgggcccgcactt

SEQ ID NO: 8214 - DNA, 1490 bp, Homo sapiens
  misc_feature (1)...(1490): n = A,T,C or G
aagagaggaanaannaanaggnaaagagaagaaagggaganggaagggnaagagngaaagagagagaaaggaagaggnagaagagaggaaaaaagnnagagtttagagagaggagaagagaagggaaaggaaagaggttttaggaagaagaggaaagaacaanaagagagagagaaagaaagaagaagaaaagagagaaaaagaaaaaaagttttgagggagaggnaaagnggcgagggaagagnaggaaaagagaaaaagaggaanaggcgagangaggagagggagagaggagaggagcagcagaggagagaagagagaagaaaaaaagagggnnaaaaggagagcgcaaaaacgaaaaagagaagagaaaacggaggagagagaggaggagaganagaagagagggnnngagagggnagaaaggcaaagaaggagnagngggaggggnnnnagagagcaagagaagagnnaacaagaagagagganngcaagaagaaagcagaagggagaccgcaacngagacaccacagcagagacgcanagcaaaancacaggaaggcccagaacacaagagannnccacacgacacaaccagcgagcgcacacgcaagagagcaccagacggcaggcacgnccacacaacgacggccgcgcgcgctaggacgacaccacgccgatccccacgacacacgcacgtcagcacgccgccaccgtaaccgcaccggcgnnccaccgcgccgcgnacgggccgcgacgaagggacgctgaggctnccgcgcgcacacgcncnccaccaacgccaccacacacgaacgcgcgacgtnnacagcacgagancacgaagacacgncacgagaggatgcgtnnacgtgcacgacgcggcgaggagacgagcgacggnnnacacgcgagaggagagcggtgacagagaggagatgcgagnnnacaacggaggagaaanagagtnagaganagagagagtatacaacgagacancaggaatgagagagagangaagacacgcgaccgacgcgcaagagacacgtagcagcagagatncagnacgagacgagaccaacgcgcgacagcgcacaggagacgagcgagacgcacgacgacacgcctcgccgaagagacacaggatcagagctataccaagtggcacgcacgccacagagccanagcagaccacgccaccaacccacgaagagcacacgagagaggcaagatacgcaccggagagagcacgacgagnncagacgaaagacanccgcagaacgagcgagcgcgacggacaacgccacccgcaagacgcgacgcgagcncacaccagcccagcgccacacgacacgcgcgtgacaaacacaacggnncccctcagcacgcacctatcacgagcgagcgccacacacnacgccgacgcgacgganncnncncacacgcaggagcgcagcgccacaacaagagganacagcacagacangaag

SEQ ID NO: 8215 - DNA, 620 bp, Homo sapiens
cattcaacctgtcatctacacatgaataacaatgaaattctcataaagaagcagaaatactcaggaggcatgaagagtcatcatgcttcaaaagtacatgtattaggacttcacgacctcaggaaaagtagactccgtaactcttaaaagctcaatcttggagaggagaaacatgctgtttgatgacatagcacagaaacttgttgaaatatccttggagcttgagatgtcgagagcgagccatcagaatgttctcaagaattaaattgaaaaatgttgcttcaaaatgtcttagccaaccaaatacaaacgtttttgtcattgtgacaaaaaaaaagctcaccaattgtctttgctagtctcagcacagcccaagaggagcatccttcatgagccaactgaaaaacagtgtgtagtctatgattctgaccagatgggcttctcttgtcaccataacattatgtattaggacttcatgtattatgtattatgtcaacactttattcattatgctgatcatactctgtatttcacttgctctggttatttgtaaagcttttcatatttcatcattaaattatctttgtattttatgcaactgtaaaaaaaaaaaaaaaaaa

SEQ ID NO: 8216 - DNA, 1366 bp, Homo sapiens
  misc_feature (1)...(1366): n = A,T,C or G
aaggaaggaananaaaaaaanaaagaagaaagagagagaagaaaagaggagaaaaagagagagggaggnnaaaaaaganaaaagaaangtaagagaagaaaacnaaagnaaaaganangtgtaagaaacagcaggacaggnnggaggagaggaagaagaaggaaagagggnaaagagagaagttttaggggggagggggatacggcgggaggcaaggagagggnaagacggngtggaggagagacgggaaagacgcaaaaggagggagacgagttaggcaggtaaaaagaaaaanaanagaagacaggacaacgaagaaagagagaaacaaggaggnaaggnngaagaaggtnagagaagagaggnaagaannnaagaaggnngaaaggagngagaaagnnanggagaaaagaaaaaganaagaaaagaaagagnnnaaaaggagaaagacaaaaaggaaacgcagacccacacacgcgacgccaggaggcngcacacgaggacagggcaagagagntgagagacggacggacgagaggcaagagcgaggacatncaaggacagaggcagaagggaggagacccgaccnccacgcacccccaacacacgcagcaacaccgcgaaccagctccaccacgccgccgcccgggacgngcggccggcnntcagggagacggagccgggcagcagagaggggcaggggtnctaccaaacacggcccccacagccgacaccgacacgccnccaccgacgccgagcagcgncaccgagagggcgcccacacagggctcacaccgcagacgaacagcgccgagcgcgcnngccgagcggcgagacggcaggcggaggaggagntcnacgagacgagagagagcatgataagaaggtacacaacaacgagaggcacggaggagagaagagggacgcgcgggccgagcacgcaaagacnnacacggagacgacgtacacagcgcggccagacgcacggccagcgacgacgagacgccagcagcanacgcgacgagaggtnccaacacagatnaaggccccacnaccgcgaccgacaacccacgcgccanccacgcgagccaatgcatatcacagacagcgcagaagagcncncacgcgcacgacagggntncaccacgatgtgcnacagggaagacgccgagagancgcgaagagatntcagcgcagagacagcagagcaacgaccgaagagcgcactcacgagagagagnacagcgagcgcggcgnccnccgaggcgccntcagccgaagacggccgcgccgtcgacgcgacggagaggcnnccacgcgcacatacgacgtaaccacacgaccgacatcacacacgacccaatgg

SEQ ID NO: 8217 - DNA, 837 bp, Homo sapiens
gacaatttattgtaaggataatttagttttatctgtcactttagtgtctaataacggttaacctggtatttatgatacaacaattgtagttagaaacttgaagacacgatgcctattagaaagagtggtagctctaagtatgtatgttttatcggaatgacgtgtgtggtgataacaatgcaaatcttcagacccagttactgcatgaaaatttttttcttttttaaggcgaactcataagtttttgggcaatatcgagcctttctcgatccccttgtgaaagggagttcccctcccttcagttccgagccccagtgttcccgaaggccaactgtctcactgcagacgttgggcttgttagctgtaatggctcctaaagggctgaggccacgttcaatgctgtgtctaattcagctttgtatccccaacatctcacgcagtacataaaacagaataaacccttttgtttataaatgactcaatgagtgacattgtgaatggtgaaataaaaactggttactacatctctccatgaagtagtctttaactctttgaggcagagtatcacaccattattccttagcaattttgtctttgagagaaataatccccaccccaaatcatatttgttttatgtaatcatttttcaacttgttgtatattggaatctgatatgcttagcatctgaagtatgagatttaccataacaaaggtcgggggaaattctagcctttggattctacttcttggttttgtatatttaaagtttcaggtacatcaagttttttggaagtgaataataaaacttgagaggtttcacttaaaaaaaaaaaaaaa

SEQ ID NO: 8218 - DNA, 1660 bp, Homo sapiens
  misc_feature (1)...(1660): n = A,T,C or G
aaaataaggannannagnananangnnnnnaaagganaannagaggagagagnagaagagaaagaanagaagagnaaaggaggagaagagaaaggaaangaagaagagaagannaaagcgaaagagtttttcgagnagnggagagagaganagaagggagaaagagagacagtcttttaggaganacagagaagaagagacgaangaagagaaagagaggagagagagaaagagatcgaaaaggganaagaacgaatcaagagntnttcagaggnagaggagnagagggcgacgacaagcgagnanngagagangagaganaaacaggagagnnnnaggnngaggccgcgggcagacagngcgcggagcggagcggcgaggggacgcgaggcggcgccggcgcgagagaagacggagaggannnnangcgacaagcgagacncagcagacgaagagangagcgagagagagagacgagacnnccnagngnnagagagagagggangaggagaggaggagaggnagagagagacnnaganagggaagnagggaaganagcgagacagaggnnnncgnaggaggacaagagaaggaagannagagagaggacaacgaagcnnacgaagaggcacagacagcagcagcgcacagcgcgcgcgcgacgnccggccgccgcagagcacacacaggacggccgaacgcgaggacacacggcgaagagggcgnacgagagaagaggcaagagagaagcgcgcgcctgcgggacggggaaggagcacaaccggagcgggagaagagagcgcgaagacgcccagaacgagaacgaagaggagaggaagagagcagagtgagacgtgcgnagcaggacggcgcagcaagccacgaggcgcaacagagaggncntcacgcggcgcgagagcccacgacgccgggagcacagcgagagagcagacgacncagagcacgcgacgacgaccncgagcggtgagncngacacgcagcgcncggagtcacgacgggtgacgggagaggnnaccgcgacacgcgacagcacgcacggcgccacgaccagccgcgcgcacgacaagtcgcagaggttncgncagggagatgagaagagagacagccgacgaggacagcnnnnaagccagtagagtgtagagcgataaggacgggaccatcgcacgaacagcgaggcnccagcagcaccacacagagantcacatcgcagaccacagcacgcgactacatgcgacagggagtcttaccgcgcagggncgcaacgcacacgcacagcagccacacgcgaggtcaggacccacgcgacatcgagcggcncngagcgcgncacngacgctcccgcgccgcagacgacaggagagaggacaaccacggacgccgcacgggagcgtcgcgagcgagcgacagcagaccaccagcagccgcgagagcacaccggcggagcacagaggaggcgacgcggccgcaaccggntccgcgccgcacgacgacgtcaggcgaacgcgcgaccagcaagcaggaagnnacagacagagganncacagagaggcntnaacgaagagcgacgcacgggagnagagcaggagctncacaacgccgaggcggggcgacggcaagcgagagagagcagcacgaagcg

SEQ ID NO: 8219 - DNA, 848 bp, Homo sapiens
ctaatttggccttggaagccttccaactcttttttagtgtggcatgttattttcaagatcccactgcctagtgcagattccagttttgcccaaagatcttaaagaaaggaccatgctcatttttgcacattgcagcacaatggaaagaatgggaagcctatgccacagattggcagggataccactgcacatctactgcttcaaagtctagttcttgcctttagccttctctctgttataaatgatgtctaatccatgtaatgaaagaaaaaaaagcctgcaaatcttaagacatctggtttttttcttggtatgaaaataaaaaccctaatgcaagagaggttcgccttctgatgtaaacatgttgattaaatatgttcaagtctgtaaacactttacaaaagctttcctaacttgattcaaacatcttttatcactctcttgaaggtcctggtctagccttggtgaaatacttgcagttcctcaaacttatcttctatatctctgttctttctgggttttaatgttccctctgctgtgcctttttcctcactatctcttcttttttctgtagctcatttcttccgggaagtcttccttggtcatcaccacaaaggataggttatgtggcctcccatgtgctgcctgtacttaccatcttgtcaatgagggcaggactcttatctgtctatatttttcattgctccattttcaatacaaaaagtgtatggcacatagtagttactcaggtattgtttttccaataagtgagctcccaactccagataacaagaagatacatcttctactcagaaataaaatttgaagcataaaaaaaaaaaaaaaaa

SEQ ID NO: 8220 - DNA, 837 bp, Homo sapiens
tgtgtgattgctctattactgtcctctctgcttttaatttttttctaagggtggtatgatcattagtagttgttaatttgtactgttatctgtattatatatatgaatgggatatgttaataattatatgattaaatagcatttctcttttatttgttattcttgaaatctcttgataaaaatgcgtatgtatcgtacgtattttatttggagtaagaatggatataagggatggtggtagaaatgtgtattgggttaacttgaggaagatagaatgtatgacatttatgttctcttggttgttgttgtattatatctaaattttttatatgaatctgaataaagtctacatattatctactgatataatagtaggtgtaatatctattattatagttttcaatatagattaggaccattttcatttcattatctaaacgatttttgtttatacatcttattcggtgaaaatggttttctaagatttgtgcctttggtgcatgtatcacaatatttttgcttgatgttcgccccttttgccgcagtgtccgttttaaatgagcgcacgtccccatgcattgatggctctgggcatattcataaataatggctcaatttgttaaattagatcatcataaaagtaaaatcagtattgggctcaacagaacttgactgaaagcttataatgtggaaaaccttgagttgtatctggaacaaagaagaactcacagaaacaaaagggaaagtgacatgggagcttgttggagaaaacgatcaatgtaagagaagagatgtgatggaaattaaaaacaagaataaggaaaaaaaaaaaaaaaa

SEQ ID NO: 8221 - DNA, 166 bp, Homo sapiens
atctcagtgaaatgctacaacacaaacctgaaatggacaaactaagtgcaatctacacaattcagtactgcagatcaagctgttaaactctctgcgtaaatgaatatatgtcctttaaaaaaataaaggaaatgtactctgcaccctccagaaaaaaaaaaaaaaa

SEQ ID NO: 8222 - DNA, 1353 bp, Homo sapiens
  misc_feature (1)...(1353): n = A,T,C or G
ccttagagggagaacaggggggagaggggccctgagaggggggggggaacccgcggggnggggcggggagaagaggaagagagaaaaanagaaagagncttagaaaaaaagcggggcgcggcggggcggcgggnagaggggagcaggggcnnccgacgnccccgggcgcngggggcgggcgggaagcggcgcaggagccgcgccgagcgcgagggagcnnggcgcnagagcgcgcgacggcccggcggagaggcgggcgcgcgcggggagaggggggggaggagagggggngggagaagagcgcgggnaggggcaggggcggggcggagggcgagacagagaagggngaggtgttggccgannccaacgccgcgggccgcgcgccccgcccgaccccatgccacgcggcgcccgcgggcgccccgccgggagggggcgcgggagacgngcctggcgcgcgcggcgcgaggcgaccgaggggggcacaccagccgggcggcggccggggcactgccgggaccngggcacacgcgcgccccccgccgccgccgcncacgcccgcaccaagcgcacgcgcgcgcgcnacgccggcccccgggggccggccccccggcggcggggccggagcgcacgccagcgcggnacaacgcggcgacgcggcaccgcccacgcccacgcgcgcggctgccgcgcggccgcgcggcgggcgccgcgcgcgcgcccgccggcgacgcggcgacgttatcaggaggangagaggncaggcanaggcgacaggagaagtcccgagagcgcggcggcgcggcgcgaagagagaagggagcgcgcgagagtcgagcgntcggcgtcaggcacagagtcgccgcggagcggcgcgcgccgacggccccagcgcgcgcgcgcacgaacagcacgcgagcgccgccgcgactcgcgcgcaacgcgcgcgacgcgacacggcgcgcgcacgcgcgcgcccatgcgcagcccacgccgccacgcgcaccactctcgcgcgtgcacggcganccgccacgcgagcgcctggtcaggagagcggcacggncgtagagacgggcgcgacangcagagtgagagncgagcggcgttcngncgacggcgacacgcgagagacgcgtgncgacgngcgaccgacgggcgcncnngcgagcngcgacgcgcggcgaggcagcagcgccgcgcaacgcacacgaggagggncnacagagaacgggcgccgacagcgacgncgncgcccgagacagcgcgcggcgcggcgcgcgcgcggcgcgcgagcccgcgcgcgcgacgcgcgcgcgagccacgacggcgacgccccgcgcaccgcgcacg

SEQ ID NO: 8223 - DNA, 859 bp, Homo sapiens
cgggtacttgtcacctagaatcatatgagttgtctccatacctttattttaaaatttgtactattcagttattattatgttgaaagaattcgtttaacgtatgatcatttaaatatacttgtttttaactcatacatattcaatctatcagttcagttttagagtgatctgtaccgttactcttggtgtttcactctcctcaccttttatttcattgtttcatcaccaaacgcaagttctatctctcaagcattctaattttagtggatgagcatatatttccattatcatatagttttttattcatcaggggtcccttttacgtatgcagggattacctccacctggcggattcgtatctagagaatattattcacccttctaaaaaaggaattcagacacatgttacaatgtgtatggtacatttaagccattacgctaagtgaaagaagtcaaatgtcaaaaggtcaaatattttgtgattccgcttattcgaggtatatgagtaatcaaattcacggagacagagagtaggaaggtggttgtcaggggctaggggcagtggggatggcagttattgtttaatgggtacagagtttcaatttagaaacatggaaagttctggaggtggatggtgatgatggttgcacaacagtgtcaatgtacataatgccattcaactgtgcacttagaaatggctaaaaaggtaaattttatattatgtagtttatgtattatgtattttagaacaattttttaaaaggcttttaaaaacgtcctctattgcaaattgtctgttcttgttccatgtgaatgaattctgaataaaatatgaactattaaaaaaaaaaaaaaaaaa

SEQ ID NO: 8224 - DNA, 1210 bp, Homo sapiens
  misc_feature (1)...(1210): n = A,T,C or G
aaaaaagannaaanaaaanannannnannnnnnagnnagacgaaggnnngagaggggnacgaggaggagaaagnaaaaaggaggagaaaaaacaanntttaggcgaagaanaaaanaagggaagaaaaaaatttttaaaagaagaaaccggnagngnaccgagagagagcgaggagagaagaggggaaaaaggnacagngaanaggggttttggcgaaagagagagaagaacaaccgaacaggnataaggagaatataaaagacgaaantgtaggagatccacacggtgaaggagcagtgaaaaggtagacgggggaacgagacaccagagagagaggancacgcccggtncgaacgcggcccgagaggaaggagaccaatgaggggagttaggaaagggtgagagagaaagaggtgaggagagggaagaggtgtaacgagaagagaataaagacaaggacttaagagagccagagacagcgaaagcgcccgganccaaacagaaaacaacacagtcgcgcagagaaggagggaggnacaaggggagaggggggcgacgggcggggaggaggaggcggacggaggagaggcggcgtcccgcgcccccccccccgcgacgcgagcagagnaacgaagagagcacacgggccgaacgggacacggaaggccggcaacggagagaggagagccacgacaaaccaaccgcacaccaaacgccaccaagccacaaaaagccgggagcgagcggaggaggctacagagcagacccgaggacgcacgcntccaacgcgacaaggccacacaagagaatcccacaacagagagcagatggaagcaaagccaaaaagcaccagggcagcagagacgcccgagcggccccaagacccagcacagcagcgcaacgcgagggcagaccagcgagcggccgacaaggcccccgccccgcgcaggcaaccgcgggcaagatcaccgccgacagagacagagcagcccgaacgcgcagcgactcgcagcgcgaaggcagccagcggccgcgacccgcagcagggacacaacgcagcgcgcacgcggcggccccgaccagcagaagcagcacagaggcgccaagaagacaatacagaaaggcacaaaacgggcgccgcgcggagacgaaaaagaacagggagggnccacgaccgagagcgcacgcacgacgaaccaaccaacacac

SEQ ID NO: 8225 - DNA, 798 bp, Homo sapiens
aagtagattatatttgtaactggcttggtatataactatctgtcgtgagttgacattgtgatgtggctgatgagtgtagctgtatgataacggaggttgttgcgcattgataaggttccgttactgtgcatcttgatataggtgctgactgggatgaggcgctttgttgttcatattcatggataaggtgttgcttgttttaacgtcgcgtcggatggagagattgtttatcagtgacggcgttgttgaaccagataaggagattagctccatgccatatgttatgtgaaagtgactactaagctcccccaattgttcaaggtctatatctgtatataaatccattattccatattgccatagtggttctgcttttctaagtgatagggattccattgaatcttttctattcagcaatatgtacttggtttcaaatattctttagtgcatgcctttcttttttaaaatttatgatattgtcaaaagaaatagtactaacgtactgagcctaagtatgttattttattctcccttgttttggggatagggacttggaatatgctcttttacacaattcctctcaaaactggtaagccgagagagtgggagtctgctccataaccagagaatacagaaaaactaacaattaatttgaacttcggcataataatgagttaaagactacttgagtgaattagctgcttcttcgaaattcgttttaatgtgacacttggaaagttatgtcactcatgatgaaatctaaacattaaaattttgaaaacagaaaaaaaaaaaaaa

SEQ ID NO: 8226 - DNA, 1141 bp, Homo sapiens
  misc_feature (1)...(1141): n = A,T,C or G
gggggaagagaaaagaaaagggngaaggacggggggagggaagacacgcaagaaaaccgaagaaacaaccgtacgagagaaaaagagaaaaaaaattagacccccggggcatccggcgccgcacagaccaaggaccccccccaccccgcttcgcgccgcagcgggagcccaagaccacccccaccgcccccgcccccagtccagggggggcaccggcagaggtccggcngggcagggaagagcggagcagcaagacccaacccaaacagagcaccccccgccacgccacgcccccccccacaccccacccaaaacgaacatctccagaagcgcggcgcaaaagacacgacatagctaagagaaacaagcaagaagaggaagcaaagaacagaaaaggacgtgaaaacacaaacgcatccatgagcaaagtatgaaaggtgtaatgaccccaacagacgcacacagcggacacaaggccaacagggaagccaacacgcgccacatcacgcacccgagcggcagcaccagccgaacaccaataccgagagacacaggcgaaccggcccagccccccccggtggcgccatactgcccacacccacagtcacgacgcacatagcaccgacgaccgagcgacgccgcagacccaaagacgaatagacgcaaacggagacgctcccctcccacacctgcagaccccacatacacgcgacagcagcaaggtccgcaaagagacgagggacggagatgaaagagcggcgcccacacacacgccgccaagcacgccggcggcggtatacagagcggaggagcngaccatgacagggagtcaggccgagccaagaagcacgagcgcagaagaagccccgacgccgcagcagatagaaagaatccacagacgagcgcacagncgcacagcaaccacacgcgccagccccgacgagcagacgcgaatcacaggcaagagccgaagagcgngcagacgagcacgacaaaaggcgacagngaggagcagacgcacgcacncggacggagtgaataggaggaaacaacgagagagcagacaagagaagcagacaggaccgtacacagacaaagaagcctgggcacacacgtgcgggagagangcgagcacgaggcg

SEQ ID NO: 8227 - DNA, 807 bp, Homo sapiens
tatttgcaggtggtattaggaggaggttggctctctctgactgaggtgagaagcaagtataagttgcggcgatttgtagtatagtcttgagggaggtgcgcgtgttcagtccgagtcgtgagggactttaagatggaggtgttgtccccagtgatgtgaggtctggccagggtcttttgctcaggcatttgaaagggcaggcaaaagtagatccctgtcaagaaaattagaagaaattcacctatttaacccaggaataaattaagaaaagtagtagcatttgcaaaattctccgtgtgataatctctcaagagagtatttctgtcttattctctcatttagaaatttctcaataaggatctgtttttatgcatggagagatattagtatgtttcaaattccaagacttcaaatcaaattattctgtgacaccaaactcagcataattttccatctcattgaaaacaatctctagtttccactttttttataaattgttatggctcctagtcttaaattcttccgagtaattttgtaggaatgagtaaaaacattttagcatgtttgctgcatgtttgtatgtataatcggtcatctgtttctgtagattcagcatctactgattcaactaatggcaggttgaaaatatttttttaaaatacacaataaaaaataatacaatttaaaaaacaatacaaccactatttacatgggatttacactgtattaggtatcataagtaatctcaatatgatttaaagaatacaagagtatgtgcttaagttataaaaaaaaaaaaaaaaaaaa

SEQ ID NO: 8228 - DNA, 900 bp, Homo sapiens
  misc_feature (1)...(900): n = A,T,C or G
tcgagagggtccgtggatatgtatgcgtggacagtgggctggtaatgctactgagcgggacgnttatccctantacatcgttcctagattaagtgaantaattatttcacgttctattgagaggaaaagcgttgtcgtgaagtagtatggatgcgttagtattattctgacgatattgggagaattaatagcgtcagcgaattcagcaccatatggtcttctgatgcagacggcgtggaggtataaataatataagttgggtcgttctcgtgtccatactgggtgtcatcagggctggtagatgtccaatactgaccggattgaggttgcgtcgtatggttatgagtatttgaagttttctatatggttataagcgtaggatagtatggttatttctttacccagagaagttgtgtgtaaagacactaaaatgatgtaaggctttattcttattgtctataagggcacatatattgttttccatatgatgggttaggtcgcctgaggagtgttgagaggaggttaataagggaattaaagttcttatgttatagcaagttccttagccttttcaaatctcaggtttcgtcatctgtcagatagtgtaatagtaacttttcctagcttttcagtgactgtgattattagagataatatttataaaatgccagcatagactagtacctggcccacagtaagcacttagtaaatggtggccacggacgggctgtatgaggatgagattaaaatatcaactcagggccgggtgtggtggcttacgcctgtagtcccagaactttggtagcctgaggcaggtggatcatgaggtcaggagattgagaccatcctggctaacacagtgaaaccccgtctctactaaaaatacaaaaaaaaaaaaaa

SEQ ID NO: 8229 - DNA, 847 bp, Homo sapiens
  misc_feature (1)...(847): n = A,T,C or G
gggggaggaagnaaaaaaaagaagaaaaaggngnnnntggaaacctttgaaattgacgtaaaatggggcgatctttaagtgcaactattgtctgtgctgagcatcaaggaaaaaggctaatagggtgaagtaaacccatggactatctaagaacacagatgatgaataagacattgagatgtcgatgtgaggaatgattattaagaggaagggcgagaccgtaagctggattgtggaacggtgtactgggcataaggtgggtgagaatgggtagaactgagaagttaaaaaagagaggcagcgggggtggaagaggaggagggggggggacgccccacggggaggccacgtgcggacccccgtgacgcacagcaagcagagcgagcccagccgagcggacccgcccccccacacccccccctcccaccctcataaaaaaacaatacaagcgacacgcagacgagccccggtcacaggcgcaggctcatggactaagcaccgcagccgcaantgagtgtaagccgacggattggcattgaggtggaagagaggacgggagagaggggtggagggactgagaagaaatgtataatgagcccgccgccgaccccctactacagaccccaacgcgacgacataactcaacccacaaaaactaaganaattcgtgcagaacgtatcgtagggcgtgcacgaacaacaaccacacggcctagagagcgcatctcaagtccgaatgggaacggagagagggcaccacggtatgaaggcaggcccccggcagcaccatttgaacacgcatatcgatgcactaacagacaacaatccacacgagatacgcacactg

SEQ ID NO: 8230 - DNA, 899 bp, Homo sapiens
  misc_feature (1)...(899): n = A,T,C or G
aggagagaaaggngggnnngagnggggggggaggggaaaacgaagagaaaaacaaagaaaaccaaactaaaaacaacaaagcacctctgcgccagaaaacaacgagaaggagaatgagtgagaaaaatgcacttaagagagaagaaaacgactaggatcacacggaaatacaagaagaacaagcacaaaaaggaaaaaaacaaaaagccgacacaccaacaaacacaaggaaccaaaaaaagaggacagaaacaaaggaaaccaacacaaaaaagagaaacgccaaaaaaatcattagcgacacagacccgacaccaacgcaaaccccagcnccgcggcgggcgccagaagaagcnccgaacaacaacccccaacggacgcccgccaccaacacaagacccaacccaaaacacgccaccacagaagggacgagggagccaccaagaaccgcacacacgccccccacagcgaaagacacacacaccccccaccacccacgcacaaacccgaaaggaccaggcacacagagaagagaacagaaaccgccccgaccaacaccccaggcgaccaagaggcccaacgggaagaaaaagagacacacagcgcaaacaagacacaagccaaaaccaacacacacggagcagacgaaccacccgcacgccacaaacgcaacccaccaccgcaccaacccccaccgcccacacacacaaccacagcaaccaaccaaacaaaacgcgcgcacacaagcaaacaagcgacgnaaaaggagcaaacagacacagccacacaccccagcacaacacaaaccaccccacgagaacgcacacagcccaacgcaacaccgagcgccacgagcaacacaaccccacagacacagcgcgccgcaaagaaacaccaag

SEQ ID NO: 8231 - DNA, 833 bp, Homo sapiens
tgtgtagagtattattagtcggtgttgacaaattatgagtatgctctgagagatggatattatgcgagtagtgacgttgttaagttgatatatcgtaatcatgtggtatgacgtgaaaggggatgattggtagtgtccggttacgagtttgatagtcattacattcgcgaaattttaagatgttaatatggttgacggtgtttagtatcggtgcagtgtgtaagttagtgaagtattgccgaggcagaagtgtgatcttatttagtgataatagtgagagatgtgctatcgaaagtatctctgtagtatgggtaatggctgaaggttttgtaagttgatgtcgaggagtcctggtatgatggacttcatagatggatcggatatagttgttgtaccgtttatgatcttggatgtcttggttaggttctttatacgttattttgtgattagtggaataaaattgtcatttattaaagtaattgctcacagtcagttgatttttttatgttgaatcatacgccccccacaggtagagttttacatgttgtaataatgttcacaaacagtttctctttaagtgtaacactattgtaagcctcttttcctccattttatttcatatacatttatgcatctgtatgcatatataaccacatgtatttatatttagtaggtatagtttattacacataaatctaaatatctatcatatacagtaaattagaacctagcatgatactagccatatattagagattcaatgaaaatggtggctgtttatatacaacgtattcattaaaaaaacccaaaactgaaaaaaaaaaaaaaaaaaa

SEQ ID NO: 8232 - DNA, 1734 bp, Homo sapiens
  misc_feature (1)...(1734): n = A,T,C or G
gggagaagagagagagagnnngaggtnnnnagangagaagnnaagaaggccagcgagaagaagnaccnnnacnnncccccaacaacagnacaaagnnnaacacagcaaaanaagacgttatnncactattcggcnacnncgagcagatangcgcgcggnctcttgcgacccncatcatagcacgctccgctaacnacgtagtactacacaactnntcacaacctcgtgctacgcgtactctcacccctacatcctntacacacttctcaattctcctcgcacagtcgccgctcctcgagcaccacggacgcatttgagagaacgaggcgagtatagagacgtaganattagcagaagcagcagcgngtgtgtnatagagcgagtgcgcgacagcaatggtagatgnaagatggaggggaagagtagaagaacagagataaataatgtgtacgcacatggagatcangnatgcactgatgcatatgccgtcctaccggtctcttcacgtcctgtcctccactctataatcttctccttcaccnacttatatacagttcaccctcttcctcgctcgactctactcccgtggtcacgtagccgtccgtcacagactccagagagactactgtatgaggatatgcgcgctcgctntgcgatgtgtgtgatcgctcactactatcatangagttcntgtaatatagcgacccatacncgatatacatgatatgctagaganttaggtctatatatgaacgagtatgtatgtctcgtgtgtagtgatgtcgattaggngncgcnancaccgcgaaangcgtgcgcaggcgtggtgacgactgtggacacncgacacatacagagtaacggactcatcgagagctcggcctgctcaatatcactagagtaccatacanagttcaaagcacggaggagccgagagtcgacacggtacgcgtgacactgagtgacatcttcgatggttctctatacgctnatatgagcgtctcgtgtccgctngagtgagcgcgcgagctctggcatgacctctgcgctacacgtcatcgcgcgtccgctattgtggtgnctggtgttgcacgatgtacaggcgaccgtgtattctctccacgctccatcacacttacactcgtctcacttcgttcgccgcttataccgtactacgctcgcactcagctagagaccgtagcancgagtcagtcangacagccatacttacgtgacgcgntctgcacgacgcgatgtgacacacagcatggcacatccggcgtctaccgcgacgtcgcgagagatcatgngcgctntanaggtgagagacacgnagtgcgtgtcgatcatcaatgagtntatgagatggtctcncggtcatcaatcgtagagcggatccgccatctgtgcaaccgtncgcgcgacgcgtcacgcgnacgctctctcgtctcgttatgtactcgtatcttgccgctagctccacagcagactgatgcgttnatactgtctcggtgctnctatagtgtacgatntgtaatgctgagtgtgntggtgtgtcgtgtcgtgagacgtggagngtgacgatcgntagtggatgtagtcatgagagtggccgaacatggagtgatntagagatacgtcgcgacgcgtgacgcatatntatgtataccacgtatgcatatctantctacgcactcatcatatgttgtgtggtatgtcttcgtgatgtgttag

SEQ ID NO: 8233 - DNA, 385 bp, Homo sapiens
atcgggcgcggtaactagcctgtggatatatatacgcatcggatggtacgcaccgaaatggtgctgtggtaacgccgtctacagcggccacgagatgcactgcaatgtgtcggtcctggggagatggtgtggcgtggtcgtttgtgctgggttgcaaaagggcgatctgtgcgagattgcgggcggcaggcgtgtgatgaaaaagatataggctggggggcattctgatgcggtgcgggaggggtaacgaggagtgcggagcggtgtgctgagtgcgcgtgcggttctcaaaacgtcgggatatctaagcggactggttggctgtagggtcgttgagcgtggtcatttgaagcgctcgggaggttcttgcgcagccgactggcaa

SEQ ID NO: 8234 - DNA, 818 bp, Homo sapiens
gcctcattgatgatgagttaggcggtgggtttaagtactggttagtttactactgttaggtaatagagtaccaagcagggtaggtgttaaggaagactggcgggcgacaccttgaaatattatgtacccaaataccactgactggggtaaaggcgtaaattaggtgacgagagtctaggcgaaagtcagtatggatatatagaaaggcagggctctgccgcttgaaatggtgtcagtgtgcaagaatctaaagttgtgtacaaggcatattctttctttgggggtcaagttaacatatgagggatggcaggaatgattccaaggatagaacagcttctccaatggagcatccgctaaaagcaagaagccaggcttgcctctgtgcacacctgattctgactcctgcacagcagtcaggatttattatatgagccatacggaagtatcaggaggggtgggtgcctccaccagtcctggaaggagaagaaaagcatagtccttctgaaagctccaacatccctcttggacctcagtgggggcctgtgtgctgaggatgggggagcaagaagtcagaaggagcctgggtccctgacacatgaaccgtcattccagccctgggctccacaccaacagacttctttacaggaggaagaaattaactttgatctggggatgtttgtttcatgcatctgaatcatatccctccagctctaggcacttctccaggtttctaccccctccatttcatctgagagcagtttgccttagcttttcatttagtaaaggtgaaagatcattgtgaaaaaaaaaaaaaaaaa

SEQ ID NO: 8235 - DNA, 837 bp, Homo sapiens
attttggtgaagggattcgagtgtgaagtggatatgacgctggttaggtgatcgtagagataagagtttgtgtgagatgcgaggtgggtggtgggggggggtggaacggtggttgatccgggtattggggtgagttgttaagagtttgggctacgtgtggagggttggtagcaagcgatttatcggtatatagggtgtggtgttagggcagacgggtaaaatatagtgggcgggaggacaggcgattgagagtgcggcgtcgggtggtgtttctgagctgtgtacgggctttgggggagctcaataggattgggcgtgagcgagggattacagtggatggtgtgttttactgatagttaagtatgggtctattatattttagtcgggtgatggtgtgtgcaattggatagtcgatatggttattttcggagagtagagatggtttttgactaatatggtgtgactctccgctgtttggggggggcagtggaggattaggaaagtgggattttatgtctagaagtcagtctacatttgttagtaatgtgttgtaaaagtaagctttttctttgttcggcgatgtttcggggtaatcatgggtttttaggaacattttcattttttaaaggaatataattttgcattattaatatcccttttaccaatgtatttttatattgtggcatgccagttttgaatgaaaatataagtgcatttaacatatatccagattcgcccaaatgatgcaatttgtattttacagtttgtataaacatctatttcattcctataaaatagtaaaacactgcataaaactaaaaaaaaaaaaaaaaaaaa

SEQ ID NO: 8236 - DNA, 1121 bp, Homo sapiens
  misc_feature (1)...(1121): n = A,T,C or G
ggggaaagganggagannnnnnngnngnnannannacgcgcaagaagccgcagataacaagagtacgaagaagaaagaataagatctaanaaaaaaagaaagaaaaaaagaagactcagcncgcgcgcgcccggcgcgccctcgccggcgcgccgacccacgacgcgcccaccgtttcctcacgcgcccgcgtcagccaaacccacaggnggaagggcgcctcacgcatgaccaaccagggcggggccggccgtggccgaacaagcggaaggaggggacgttcgtattgttagtgtttcagtgtgtatgagtcatctttcctccctctccctctctttcccccctactatcattctcacttttctcttcctccttctcgtccctcgccgcggtgtgatttttatggtttttttctattttnttctggttctttcttactcgtgtgtttttgttgccatctgtgtgtttgttgtttatgtgtatctatcttcctttatacatttcagccgtcccacccgtctcccgacttctcagatgtatccttgggctcgtgtctcggtgtcacctatgtctgttcttctcgtacccatcgacagactcgccttttctcgtatntctattctattctctctatgttcacatgtttatgtttgatttcnttcttattgtcttctctttcttcacttcgtcttatatgtcttctctacctcctatcacgctttactgtcatctccgtctcttttctttatccatctctcagtcccgccgatcgtcgcggtcgtctcgtggcgtgtcacttgttgcgatctatgtgggcttattgttctttgcactcgtcctagtattgccattcntattcatagccttgcgcccgtanctcagtctacctcttcgtttcgtccgcgttgtgtttgcactcgtagtgtattttgttttttgtgtagggtggtgtagttgatgtttccccggttgtcatcgattttggaatatctattgttacccgcatcttcttcatcttgcgtcgcgctgatcagtctcttccgtgttgttccgtaccgccgtggtctcttcgtgttgggcttccctgtctcgtgttgttgttgtttttcctcatgcgttct

SEQ ID NO: 8237 - DNA, 797 bp, Homo sapiens
aaggaaatgaaacttcaagaggtttccattcttcctgccctggaatcggaataaacccagttaattcggggcccacgtagatcttcccagtgccacagaaaagcttttgcagtcccctagtcaattcccggtttttatccctgtcctcggcttggcaattttctctccatcaatcataagtctggtagccaaggtcctgtgtgtttgtgaatggtcagaattctctccagcactttaatccctgtatttggcccactcccaactctctcttttttcccttttccatcccaagctgaaaagactgcttaagaaacagtcccctcaagaacttcagtgactgagccaactctgataggtcattctgcatcaattattaatggctaacaaaagttacataggaaatgccctccatagtttacaactctatgaagggcttttaaaaaccaaactcagtgcttctaatatatgactgctaggtgtgtaagaatgaagcttcctaggccgggcacagtgggtcatacctataatcccagcactttgggaggccgaggcaggtggatcacctgaggtcaggagttcaagacagcctggttaacatggtaaaactccgtctctactaaaaatacaaaaattagctgggcatgttggcaggcacctgtagtcccagctactcaggaggctgaggcaggagaatcgcttgaacttgggaggcagaggttgctgtgagccaagatcacgccactgcattccagcctgtgcaacagagcgatactccgtctcaaaaaaaaaaaaaaaaa

SEQ ID NO: 8238 - DNA, 839 bp, Homo sapiens
  misc_feature (1)...(839): n = A,T,C or G
agcgggagagcagatcgttgggggcggcgcgtgtcgacggtgagaggtggtggcggcctggtagtatttggttgcgcatgttgaagttgttggaaaggtagngtgcggcgaggggaggtcgcagtgtcagagtgcgtgagttcgaagctctaataggggacgggcgcggtactctgctcttacgtcggtgctttggtgccggttatagtgaggattcgaggatagaacggtgggatgagatgggatgaatgtattgtggtgcgtccgaggattcatcaattgtgtggtcgggctatggagaggtgggagtgtctatgaatgaagtcgtaggtgcgagtggtgagttatttgagaagagagggtgtgtgggggcggtgatttctcatgtgtcatagtggtgtggtctacggttgtaaggaagggttcggaagtgagttgagttatgtgcagtggttggctggttcaggtttcgttgagcattcgaggagtctggattcatgatatcttggggtgtcttggtaagcattccatggcagttatgtgtaaggtctgtatagccaatggttacctgtgaaaaagtcattgtaaagttcatgaactcagagcaaagacttctagtctctatttgaggtagctaacagagtaaggtttagccagatacagaaatcaaagaaatagataatgttagatagataatgtgagtctcgacctgctgtggccaacagactaatacctcagcagatagagaaatcaaagaaaaatatgagacttatgacatttcaaaaggattttctacattggaataaacaagtctcattggctacaaaaaaaaaaaaaaa

SEQ ID NO: 8239 - DNA, 821 bp, Homo sapiens
tcaggaggaatgacatgattgtatcatacatgatccacgactagaccggaaccaagatatcattgatgtgtccggtctaaatagattatgtgcagatagagtgtcgagctaacgatcgttgacatcgtagaagttggagtgggtgatgagacgactaagagagatagatgattgctgatgggcggtgagtattaaagcgttgtgaataattatatgggtgtaagggtgatggggtcacgagattcttcggggatagtttcgtaataattaatatatcgatattggcagcgagcgccctaatttataaactatgctagggtaatgtggagtagtatttccaactaatgtgaggcagagggtctgagttttggttattgtctatgtgggattggcaaataaaacaagaggtcggattattgcgcaacctccttcaatttgagaagagtggatctcagggccgccagtatagagctaggagagcctcactgtgcaaaggttttcttcttccaagtttaatgtctcagatctcaaatcatctgctaatagtaatgtggtgcatatgtacagtcctttatatttattatattttaaagatatttttctttatttgcatccaactaagagacatagtcactaattccaagtcaaagcaatgttattttactaattacatctttacatgttatatctcatttttagtaattccttaattttaatttataactttatgaaactttgcatttagatcaatatatcattttaaagtaatataattttccccatttataaaataactttattggccaaaaaaaaaaaaaaaa

SEQ ID NO: 8240 - DNA, 1077 bp, Homo sapiens
  misc_feature (1)...(1077): n = A,T,C or G
aggaaaaggaaggnaaaaaaaggnnnnnnngacgcgcgcgagaggccgcgaggcacgcgcacgggcggaagagagtaaaagagagagagagaggagaaaaaaaacctaaaaaaagccccccaccacaccccgaaccgccccgcgcggcggccgcccccccccgtcaccccccccgacccaccgcccgcgccgccgggcgggcccgcgcggggcgggcggaggaggaggggggggcgggggcgcgaagcaggaggnccgccccccgccgcccacccgcccccccccacgaaacggccacggccccgcgcgcgcgccccccccgcgccggcccggccgccccccgcccgcgccccgggcgcgacgggccgggcgggggggggccggggccgacggggggccggccccccgccgcacggacgcacccgccgcgcccggggggagggggaggacgccgcgcgggcggggcgggcggaccgcagcgaggccggccggcggccgaaaagagcgcccggggcgccgggggcgggggggcggcgagcgcagcccgaccgcaacaacccacaccaccgagcccccgcacaggacgggcacgcggcccaccaccccgcgccgcgnccccacgggcaccgcggaccccccgcgccccgcgcccgccaagcgccgcgccggagcgagccgcgcggcgcgggcgccgccgcgcgcgacgccacgcgccgcccgaggatgccggccgcagggccgcgacgcggaaaccagcggcagcgcgcaccccgcgagcggcgcccttggcggcggggcgggccggagccgcggncgccgggccgccgaagcaccgcgcggcccgaggccggcgaccgcgcccgagcccgccacggcgcgggagagccggggcagcacacagagagaccccgcaaggcgacagccgaccgccaagcgcaggcggcgaacagcaccgcgcgagcccgcgacgccgcacgcggcaacacggagcgnagggagcagtacggaccgcacagagcagccgacgaagacgcagcacagcggaccacaccgccaggcgacggcaccagagaaagg

SEQ ID NO: 8241 - DNA, 451 bp, Homo sapiens
cagtgggcggggtcgttgggcggagcgaatgccgttctcggcgcgactacaggattatggggtacgtgggccccgtggggtgctgtgaggtcgcgggtcgggagctagcacgggccatcgctctgccccgctcgtgcctaggttcaccttgtcggtctgatcggagggcccgcgcgagggcgtgttaaacgcgccgcctagggctgcgctgctagccgaagtggtagatggcgcgcttgagaatcctgcggctttgggagcggcgtttggtctgcgagtaccgtcctgctgatgctctagcgacccggttcctggcgcggccggcctatgaccgcacagtggtttttttgaggccgtcgcctactacccatggcgggacagccgcagactctggcgtcaacacggggggcgtcttggtgacccccccctctgaggggtgttccgatcgcca

SEQ ID NO: 8242 - DNA, 842 bp, Homo sapiens
  misc_feature (1)...(842): n = A,T,C or G
ctgtcggtggcggtgcgggatgggtagttgtcggtttggtctgatcttcgcgtgggagggatgagttgtttggtgagagttgcctttagattgtagcgtaggtaggttgattgtgtgtggtggttgcggattgggtgggtgagatcgttcgaggtgtggggaggcgagcggatgttggtctgatttgggtcgggtagttggtgcgtggagggggcgggcggttattaggatgtggggtgtggaaggggagtcgtantgatgggtgggggaaggaggggttattttattattatgtgtgcctgggtaagtgatcataacaagtggcggtaggctcgaggggtgtggtcgtgggtgtggggaagaggaggggaggtgaggtggtggtgaggtggggtgggatgagcgatgttttcgaggttagtggcgatgtgggggtagtgagggggttggggtgtttggtggttgagagggtgcggaagctgtcctgtggtggtgggatccggtttgcgggtcctcgtgtcatgggggcggcgtaaggtgctgagcatatgggtcatgggcgactagcgagtgggcgtggaagtccgccggtggggttgtaggggccgatggaaaggagcgcttggcgccttggattgatggaggaggaaagacacccagtgtgttgtggtatgtaaaagacccttcctccacatgaagatgcagcaagaggcaccatcatggcagcagaaagcaagccctcaccagacgccaaatctgctgataacttggtcttggacttcccagcctccagaactgtgagaaataaatttctgttatttataaattaaaaaaaaaaaaaa

SEQ ID NO: 8243 - DNA, 851 bp, Homo sapiens
  misc_feature (1)...(851): n = A,T,C or G
acgtagtgggactgatgtgtttgttgcagagatggagagagggagagtgatgaggaatggaaggagtggtgatgagaggaaatagggggtcgagataaagtatgaataggggggagaggtacgtaatgtagtattggtgtcgagtgtgaggtagaggtgagagagagatgaaagtatgtataggggatggtgtaggacaagtgagtgtatagaggcgggggggagggagtggggtggagaggggtggtgatgtatggatagatggaagatagggtgtggtgggaatatgtgggtaacgataactctcggacgtgatggtgtatgattccgtgtgaggtatagtgtgggagggttgggaggggggtgggggtggttatgtgcgggaaggctgagtgtatggtggcggcgtgggaggttgaagtgtcagtcgaagagtagcgcgggttcacagcgatggagggcactgggcaggtttaggaggtagaagtgcaagatcaaggtgtcggcagggatggtatcttccgaggcctctctctttggcttgtgaattgccatcttctccctgtgtgttcacatgtttctccctctatatgtatctgtgtccacatttcaataaaataatagtagaacatgacatcttaatttagagcccatcctaatgaccccattttaacctaattacccctttaaagaccccatctccaaatatatcatattctgaaaaactgagtgttagaacttcaacatattaattttggggaacataagcccataatatgtactattaaattggtattnattgaaaaaaaaaagaatggcctangaggcctcagcgggagactaaaaagccg

SEQ ID NO: 8244 - DNA, 441 bp, Homo sapiens
cagtgagtcagatgtgtgcgtttcgtttttggtcggtgtttatatgagatgtgtactgatcagctttgcagtgtatgtgttagacatatataatgattgatcaaccaggataatatgtgatgacatgtgaggcgacctcgaagtatatataggggtcgcgtcgaattgcggtcgtagaaattgtataagtgtattagataggtatattcgagtcttgcaaacagtgtcgatcatatagtttctctatgcatgtttaataagctcattaataccccgcacgctcttgtctgtcaatagcttccatcgggcaagcgtgtggtagtgcctcggaaaggttcatttgcatgcccgttggtatatactcgcggagggatatccagtgattagtttggctaaaggagtcggggccctgcacgtccacattatgcgaacggttggtgt

SEQ ID NO: 8245 - DNA, 821 bp, Homo sapiens
ctgtgtgttgtatgcctaatttgcgtcccacgtatttttgatagagatgttcagtaaaagttgcttgcgggcgcgccatgtaattaagtgagctgataaaaagtgtccagttcaagcacggcccctgtccataattcaatctgctcttttggtgtagaaaataagtttggttataaacggggttatttttcttctcaaagtgatcccaggatttttttaggcgtttaggaagcatatattgtccctatgataataccacttttggtctccctaaagatatactgttacaattaaattttttggacgaattcatctcaaagaatattccactttgttgaaaaaaaggaaaaaagttttaagttgatttctcgcatgccttctttagtctttgccaaatacaaatatgaaccctatgagtagttcatcagtaccaatttcataccctctgtccaacactgggggagtatttgcataaaccaagctactcccatatggtggaatagtatgccgatgttaaaaataatgctgaataacatgggaaaatatatatgacattattttcagttaaaaaagagaaaaatacaaagttttataaagagaaatgtctgcaatgcattttaaaagtaacaaaagatgtggacagaatactaaaatgttatcaaagttgatttcttggtgatggaattacaggattgggttttttccccttgtttccttcagtttctctatttttctcaagtaaatttaattttataatcctaaaatgtaaaacaccacaaataaaaaacctcagtccttctgttcaaaaaaaaaaaaaaaaa

SEQ ID NO: 8246 - DNA, 287 bp, Homo sapiens
agcctgcttagcctgtgacaacagcagcccagaagtacctgagatttagactaaggaaatccttaacaacctcagccaatcaagatcgccattctttgtccctccatggtcaattctgaggcaattctgtgtctagttgttctcaatagtaacctactattaatcaaacttcctgactttccaggcttccctatctttctccacttccttatctgtgctgctttcttaccacctctcaaataaattacttgtgcccaagaaaaaaaaaaaaagaaaaaaaaaaaaaa

SEQ ID NO: 8247 - DNA, 784 bp, Homo sapiens
  misc_feature (1)...(784): n = A,T,C or G
gccttggcaggcgttgggtcattttaaaaaccacggtatatccgaggacatgaagtttggatctacattttttttcaaaagtgtataatttaagttttaatccaatatttgcttaacttgaatttatttgtttatatggaaggggggtagaagtccaagttcacttttttgcataataacacaccagttgtcccaggaccatttgttaagacgactacactttctccactgaactgtcttggcactgttgtcaagaatcaattgcctataaatatgagggcttattattaattcatcaattctatgtcagtgaatatgtgtatatgtctatctttatcncagtaccatgctgtcttgatcatagtaaattttgaaattgggaagggtgagttttccaactctttttttataaggctatcttggacatttttgagtcccatgacatttcatacaaactttaggatcatatggtcaatgtctgcaaagaagtaaggtgggcatttaacaaagattaccctaaatctgtagatcaattgcagagtgttgttaatttaataatattaagtcttctgatacatgagcattgggtgtcattctatttatttagttcttctttatttcagcgaatgttttatggttttcagaatataattttacacttcttgtactaaatgtttttctaaatattttaatcttttggtgatttttaaaagacgctttcttaattttactttctgattgttcagtgcaaatatatggtaatataattgaaaaaaaaaaaaaa

SEQ ID NO: 8248 - DNA, 171 bp, Homo sapiens
agaggaagattaatgttgtcacaggctatagtgttctatttttccactccttctcactatttattaaaaatctaggactgttctgagaccacgttctcttcactcttgattgtctctgtttgacctgggacacagctaataaaaccaacccaacatcaaaaaaaaaaaaaa

SEQ ID NO: 8249 - DNA, 791 bp, Homo sapiens
aaagcagcctcttccaagagaatcgggccagggatatgcaacacagtaaaatcaaagccctcttttcggaggaagtttaaaagatgacaggaattctttcaggatgctcttgaattctatctcgtgctcccggacacaggtttgaagactccagatttttcctcataatatctacaaagaaaaaccagcccatttatcgtgatataaatgatatgatcccggtttgctgggcttctagggttgactttctaactcacagtcacacataaaataagaaaagaggccaacgctgaggaacgttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattaataaatagttttttcttttaatccttacctgggtggataatataacagatcatgacataaaagtttctttgaaattttactatgatcatcagaggcatctagagataatatatttttttttaacatttggaatgaaaatcttcagcctcacaaatgcatatgatctattaaaaacaactagaacaaaaaaaaaaaaaa

SEQ ID NO: 8250 - DNA, 156 bp, Homo sapiens
attgttccctctgcacccagagcccttgccaacttcatgaaggaaacatcttgcacaaaagaggcccacatgggaagaaggaaactagaaatgacccaagactcctgataggaagttatcaataaaaacccctgtaatcataaaaaaaaaaaaaaa

SEQ ID NO: 8251 - DNA, 1627 bp, Homo sapiens
  misc_feature (1)...(1627): n = A,T,C or G
aggggggggggngggggggggggnnnnnnnnaagagggaggaagaagnngaaaccggnagaagggagaaaaggagggaaaagcaacctagaagagaaaaacagagaagaagaaaaagaccctcggnngcgggggcggaaacccgggnncggcgggncggcgcgggcgnnggggnngacggncnacagcggaggaccctcacagagaagggggnggaggcggcaaacgcccgggnncanncgcggcgnccggcgggcgaacgcgcgggcgcgcgcggcgcggcgcgcancgccgcgagaagcgcagcgnacgcgccagccggccggaggagagacgcncacgcacgcgacaccccgcggcgaccgcgaggcgccgcggcacagcaagcgcgggacgacnggngccgcggggnnngaagnancggaggcgggccgggggggcgggagacgggaanaggggaccgcaggaggcggacgaaccgcccggcgccgcagggngccgcgcgnaggaggagcgcaacaccgcgancagccccgaagcgaaancgcacgatacataccaggacaccggccggcgaggnnnacaccggcnacacggcacgagacggagccgccaccgggcgcgncgcacagagcggggcggcgcggcgcgcggcggccggcgggcgcggcggcgncggcgacgcgagccacgacacggcggcgcgcgcgcgcgcgccgngcccggagacgacgacgcgcgcgcggcgcacacgcgcgcgcgcncgaaaccccagcgcagcgcgcggcgaaggacacgagcggcgcgccngcgcgaccgcagcgcgccgcgcacgcgcgccggccagagacgcgncggcgnccgcgacngacgnaggccgcgcgcccgcgcgccgccggccgcnccgacacgngccncagcaccggcccgccgcggcgcggacgcncgcgcgaaccggggcgggcggccgagcccgcacacggnaggacgagcgccacgaagacagaggcaggcggacgaangaggcacgnagcggcgggcggcggcgcggcgacgggagcgacggcgcgcnnacgcccgncgccggcgggcgncgcggagcacgcagcgcaccggcgcgccgcncgcgcgagcgcgncgcgcgccggcgaccggccgcacccgcagcgcgcgcagacaccgccgcgcggcgcgccgacgccgcgcaccacacgaccgcgtgtgccgcgcncgacggncggccgcgcgccgcgcgccgcgcacgcccacggcggcgacgtcgcncggagcgcgcgcggagcgcgcnacacngcacgacgggctcncgaccgtcacgcgcactgcgcgcagagggcgccacgcgacgtcacacgtgcacgcgacggcggccgcgcacacaggagcaggcagcgcggccgntccgcgcancgcagcggacggcgagngcgtgacgagacagacgncncgcgcgtgcgagcgcgcgtcactcnctcgcgntctgcgcngcgacngcngcgcncgcacagancgcgacgcgctggacctcnncngcgcgagcagccgacgcgatgaccggccgcgtcgccganctactgcacgaccgactgangccgccacgaccgacgacg

SEQ ID NO: 8252 - DNA, 806 bp, Homo sapiens
tccttgaaaaccaacggtttatataaacttcccaatcccggtatttgtgctggaaaactaaaaggacccccaagaaaggaaaatccagtagtttaagcagaaagtatcaaaaactgtttaaaataagggaaaattggcatctataaccagctcccaatagtaccaagatgtaactagctataccatggatttccttaaggttccagattatatttatttaaatgacgccactttaaccagtggtataaaaataatcaaactgaacgccggcacaattaagtccctaaagtattctcacttactcattcaagaatatgcatgtggccgggcccagcggctcatgtctgtaatcctagcattttgggaggccgaggcaggtttcaccatgttggccaggctggtcttgaactcctgacctcaggtgatctacccaccttagcctcccaaagtgctgggattacaggcatgagccaccgtgcctggccctttccagggtctttgtaggtacagctgttcccttcagacactgcctgtctccagccctcaccagtgatactcttccttttacagcaacccctcctctctccattttatttaactgtgcaattgtactagccaaaaaagactactgtatgaaatccagaaattgtttaatataaaatataacaaagtatgtgaaatgtattggctccaaaatggtttttaagttggttagaaaaagtatattccaattagcaaaaataaaagcaaatgccaggtttataggaatgggaaattgtacagaatttgaaaaaaaaaaaaaaaaa

SEQ ID NO: 8253 - DNA, 684 bp, Homo sapiens
ccactttgtggcgccagagtaaagcccacagctactggaaaataacttccctagcctccccttcctgattttcatcaatcacattatccccttgctccttccagcttagtggtggtaagaaatcatactcccttatacatctttcccactgttgctggcccttgtgctttatgtcaaggcacttttcctatacttgcctgtaagttttatgggctctgttaagtttgtccaagactgttcttactagcttttggtttgtttctttataaaataacaaaattgatttatgtgatctgtcaattgaacaagttaggatcgttagatattaaattttgtctaattcgttgtgctgccaatagttagttaaggaactggcaatctgctaaatctcaatatatatcaactggaattgtttttagccacaaaatctttctgtgttctttttcaaaaactcaaagtgtgacatgcaaatatgaatttgattctgtgatacactaatcagtattagaaaaaaatgtagtgtacttgcatgttatatttatcacaatgtgactgaatttaaactaatatttttatcataaattgtgtggaagaaatgtttcatgatttgctggtatttcaaatttggaaactaatattattaaattgtggaaggtccacagagagttaaaaaaaaaaaaaaaa

SEQ ID NO: 8254 - DNA, 795 bp, Homo sapiens
tggtgaacacgcacatatctcaaactaacattgttaaggctaagtgttttgcctattaatatttttattgtcattaaattaaactgagtttccaatttttcaaactcaaaatttgagcaaaaacatgcatagataaggtttccttttggttaatttatgtttccttttcatttttaatgcaaaatggttaggacatctcttggcacatagcaagcattccaaacaaatagagctatttataatattgtaaagtgaggtaagtgaataacaatgagagtagacgtaaagcttacaatacaacaaaacagaaagtatgcagtcactgaagaccaacttttaaatatatatataaatatacatatttgaaccttttcatactttatatatatttgaatcttatcacactttgagatttaactaaaagtttacaggaaacatacagtagagaaaaacatgcttaaaaaaacacaaggattcaatcagcaaaattcaaaaatctgggaaattcttcaggacacagactccagtttcttcaacaaataaatgaaaagacataaattaagagacctgaactgaatccagctgagctttttggatcctgatttaaataaaccaactctgaaaaagcatttgagtctgtcagaaatattgtaatagtgactgtatatttggcaatttaatgtcatttgtcttgttttgttctagtgcagtaatggtattgtgattatgctttttaaaaaataattcttattttttaataacatacactgaagcatgaaaaaaaaaaaaaaaaaa

SEQ ID NO: 8255 - DNA, 806 bp, Homo sapiens
agatcacacattcagcagttcataaagtttattttagtgctcggtattattcctatactctcttatgtttggttgctttccattatgtttccaaatttattttagaatattttagtccaaatttaaaatgaaaacctctctcacttacgttaagcctaagaaatattttatttgtcttcatttttaatgttagtttaacaggataaaagttgcaattattttcccttataatttaaaattctcaatatgtttttaaaaattaatttacttctgtcaacaagtcaaatgcaattatttttttaaaaaataatttttaaataaaaacacagtaatgtgttgcttaacaatggggacttgtactgagaaacgtgtccttcagtgattgtgtgttgtgggaacattatagagtgcacaaacctagatggtagagcctactatacacctaggttacatgggatagcctcttgttcctaggctacaaatctgtactacatgttactgcactcaatactgtaggcaaatgtaacacagcagtaaatacttaaatatctaaacatagaaaaggcaccgtaaacatacagtattctaatcttatgggaccacagttgtatatgttgtctgttgctaactgaacatccagtggttcatgactgtattaaaaatttggattaaatgggatgtggataattacagtattaagaaatcaatcatttataaagtcacttattctgagttaccgtcaacggagaaatttgtgtattgactatttaataataaaaaattataactataaaaaaaaaaaaaaa

SEQ ID NO: 8256 - DNA, 355 bp, Homo sapiens
caagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcaaaaaaaaaaaaaaaaa

SEQ ID NO: 8257 - DNA, 812 bp, Homo sapiens
  misc_feature (1)...(812): n = A,T,C or G
ctcctcagcgcccgncccgaaggaggcgccggaccccatgcattcgaagggcactgggccaggtggaccacaattccccagcctccctgtgttttggtgcacccatgtgacggtcttctacccaatttattcgagtggaaaagatgtggtcactgcctcatttggcccacaaaagtcttccacgtggcccctcctccttccctctgcagccacgcacacaggatccaacgcagaactgggtggcctgaggaaaggatggagcctaagatggaaagagtctgggtcctgaatccccttgtagaagaccgcctgcttaaacaggcactgaaatgccccaggagcaagaactgaaacacctactgtgttcagctgctgagattctggagttgcctgaagtagcagtcaacttgctttgcctattgcacatatacatgctcatatttaactccaattacttgatttaacaacactctgcaaagatgttttgacatgctaagaaaaaaagcaatgaccaaacaagtacacaattattataattaagtaaaatatgtgctatgtggacagagactaaaaatatgcaaaatcaaaaaaattaaagctataaagtgttggtaacagtaaactgtatttacattcaaaaaaggaaaaaaaaactttacacaaattatttttaaataagaattgcccagaaaatttttttcaaaatattttaattaaaaaaaagaagatttactcttttatttgtttgtcatactgcatagagtaaccagtcaataaatgcttgctggcaaaatgaaaaaaaaaaaaaaaaa

SEQ ID NO: 8258 - DNA, 1433 bp, Homo sapiens
  misc_feature (1)...(1433): n = A,T,C or G
aagaaaagnaggaanagnggnnnngnggnnnngagaggggnngggggggagaggagaaaggaggagagaaagagaagagaaagagaaagatagagaaaccctaagaaagagagagaccaagaggagcgagagggncccttccggnnggcggngggaaaccangcgcgcacgacggcagcacgagaaaggcaggacgagaagacagaggaggcgcctttccgggcgngcggcngacgcgcagacacgccccgcagnccgcggagcgnagaggcgggcgcgcacgcacgccgcgcgccgncagacgcgccgagcaaagcagggcgacgcagcgcgcggcgcgcgcggcggcgcgccagcggcgccgcgccggcggccgcccgcggacggccggcgcgcgcgcgcggcgagcggagnagagcgaggcaaagagaggcgagagcagggacacacggagangnacaacgaaagcaacacgacaggagaggcttcttataacaggcgcggcgcggcgcgcgcgcgnaggncgcgcgaacgcgcgggcgcggcagggcgcagggagcggttccgctgcgntggcgagcgccggatgcgcccgcagccgcgagggcgcgcccgcgcgcgcggcgctaccgagcgcgcgacggcggncaggaaagggggcgtagaggtcaacgggnaggangaggacgggccgcgcgcggagagcacggccnacgacgacgcgagcgcgcacctgnacgccggcgcgcgctccgcgcggcgcgcgccgagcacgccggcgcgcacggcgagacgcgcccgacgcgcgcgcgagcgcgcggcgcgcggccacagacagaggcgcgngcgaagcgnncggcgcggcgagcggggcgcgacaggagagacgacatgtcgcgcngcgacggcgccacgcgcgaacggaacgccgacggngcgtgggncgcagcggggagagtgcggcgcgcgcggcgggaagaggcgcagagagcgagcgacagagaagcgcaagagccgggcgcgggcgggggngcgcgccgccgcgagcggccacgcgcgcatcgcaggggccagcgcgcgcagcggcaggcggtagaggcggagcaggagaggcggcggcgaaggagcagcagagcgccgcgcgacggcgacgcgcggcggccgacgcgcgacgacgggnagcagagagcgcgcgcggcagcgccgcagacgacagcagcagacaacgacggcgcgcncgtcgagagcagcgagcggcggcgagacacgcgagcgagccggagcccgccgcgcacgaggccagagggacggaggagncgagcgcgcacgcggcgacacgcgcacgacgaggacggcggccgcgggtcgtgcgacagcgacccggcgaggtgcggcgcgcgacgtgtcgcgacagaagcggcgcgcgcgagggt

SEQ ID NO: 8259 - DNA, 802 bp, Homo sapiens
ctgtatgtgacggacaggatataaggacctacaatagaaagaaatctcttctgcatgtgtgccatggccagaacaaaattattatatggccatggacattaacaatgacacctcattttggtctgccttcaggatgatatggccatgtaactaaatctgtcataaggaatttaataggagatatgttgctcctccccattcattttattctaatcatttaatacagtttcttggaactggatcgggctcctaagcaaccatcttcatattatgaggggaaaggccaaagttccctaaagttactggtataggaagctggaacaagcctgtgtccccaaggaattttttgagtaccgatatcatgtcactcctggattgactgcttacaagacatttttaaatgtgagataaataaaccttcatattttcaatcaactattcttttcttcttttacttgaagcagtattttattctaactaaaacaaattaagaactaaaatttagtaaacctaaggtatttcattgcatcaaaaaacttatgaaataatttaacactgtaattatcgaacataaatagataagctaacaaaaggatatgtagaatgacaaaatgaactcatccagcagtttcaaaaatcatgtcagtctttaattttttaaatttgaactatgctatacatagaatataatatacataattgcacatgtacaatttttaaaaattaggatgaaatgagcacctatatgaccactgctaaaattaacaaataaagcacccactctcagcaaaaaaaaaaaaaa

SEQ ID NO: 8260 - DNA, 261 bp, Homo sapiens
aaaataataccagggctcagaagacttctaacctggcttccaaactcaagagacctggaaaagaaccaaattggaagagcatgatggttgttgattcaaaatttctccgaggcattctgactggccaccaacatgtcaccacaaacttcgaggctccagaaactaatttgaaattccaaaagaaaacattgccctaaaaatatgctagtgacacaaagacaaaataaaaataaatctcttttctgtgcaaaaaaaaaaaaa

SEQ ID NO: 8261 - DNA, 1954 bp, Homo sapiens
  misc_feature (1)...(1954): n = A,T,C or G
aaaaaaaaaaggnnnnnnnnnnnggggannnnnnnnnngggnnnnnnnnttccnnaannnnnnnnnnnnnnnnnnnnnnnnnnnnnatnccnccctctcttatnntgnnnncngncnnnnannccannnnnnanntnnnnntccacngnattcttttttctctnnntacnganactannaccncncagaccnnntntcccnacnnttaattgtattccggtacctatacngnntactagntncncagatcggncnccnatcccgcnancatctcctctatcacgntcatccnacacngttgagaataagttnaacacgcgcncccnncncacnnagctcacgatgcangtagatgacgacaagtctgatgnctagtcatgcgntctagngtgtgctcngtcngcagacaacnaatcactgacgtangncagtatcacacacagagagancgagcatccgcgancgagngcagacgcgaccaggnagtcagtagtgatngtnannantacgtactgtngtgtagngaagtcganangcngcgacacnatgacagnacgagtctangtnagtaacntgcanncgcagatctctngaacncatganatagntgntgntaannatntagtatatntntgcagtntgtcaagtagtnnntnactgnatngagcgnancngcanctncaggtagtgntnanatnaganncancactncttaccccccncgancnanacntnatgcactannttacacatccggacntgncgnnnctcatctagacgcgctatcgcatgatgtccngtagnactagcgcacagcagaggntatgntcgagacagctgcgcagacatgatanacnactgtangncgncaggacgangtactgtagncntatcgatatatcgtctntcatcgagatagtcngtgcacactgcaggagtcgacaccgcgcccgaganatgangtnntctgctctatataacatcactgctgctcgtntctatnacgagtctctactgcnctncactggtcttactgtngtctcatcatgtcgctgcactatcgtatgtcttcttcgngctagtcnctantctgtcgtctcgtcacgcgacgtcgtcgctcagtccttgactncgtgatatagtgtcgctacngatcgatacncgcgttnntagtactgaatatatgaatgtcacnacganctagtcngtcgagtacanacgntacgagcgacgctcactgtcactngctgcacgcatacagcgctacatgtcgacngccagctcgctgcacgnctaccgagtcgacgtcacncgatcaaccncgcagcacgcagcagcagcacagacgagncagcacacataatgtagagcactgcaacctgaatatgaatactctcgaagtatcgattaacattcactcgtaaatacagataacctataatatacatctatctagaagtngtncgatatctctctgcgaatatgncgcgctcgtagagagtcnatanactagtcctcantcactatgtagctacgcgtcgcgcagctcgagctnctntngncnanctgacccatacccncactcccgtcgcactgtcancntgtatctactgcatccacgcccnatanctgctgagacacgctgctgccagcgacgttacacacatataatcatctgtcacgtgcagaacagcagacgacgtcgcacgtacgtcactaccctacgacgcacgtgtgcagcactgcctccgctnaccacatntncacatcgcatatcgtattcacgacacatcacactgcagctctctatgcatctgcgatngtctaacagtcacactgcntcnaagcgcttcgtgcgagtaaagctgacgcaccacgcggacgtctatgtcaccacatgcgtgtgtctatctcatagcgcgactacacgtctatactgtacgcactgtattag

SEQ ID NO: 8262 - DNA, 804 bp, Homo sapiens
  misc_feature (1)...(804): n = A,T,C or G
acacattcccgatgtttaaaaagaaaatggcaaaaaaaaataaatttaattttcttcccacagctaaatttatctacctgaatttaatttagtcaaaatagtccacctgtgggcatccatctatttaagtggttacctcttcataggccttaagcctttttgttatggatgtatatccaatctatgctaagaattggtgtataagagtattaaacaaatgacaaatttttgataccctatacagaatctagatataaaaataaccatctaaagattataattcagtataaaaataatcacaatatcttctgtttttacatgatgaactaggtaacactaatcaaccctcttggtaagaactaganaatgtaagaaattattaaaaacaaaaacatttgtttcaaatcactgagaaccaagacagtgacgaattatggggctgtgatctcagacaagaagaaagcccaaacgtatgtgcacctctttgggaggtgcatttcctctggaaggcttggccaattcccaaaagctccctcttgggaattaacagaaggtgccaagagacaaatgaagctaggaagacaaaaactagaactaaagagctactaacaaggaatgactggaactgagtaaaaatggaccagaaacagacaaactttaacagagactaaatttaacttcaattcctgcctagattaaagcaatctgggttcgtcagtcctttggccacctttctgaagccaaaataaatcttctatgaataaatatagcatcgtgctagccttcaaaaaaaaaaaaaaaaaa

SEQ ID NO: 8263 - DNA, 620 bp, Homo sapiens
agcagtggttcacacctgtaatcccatcactttgggaggccgaggctggcggatcacctaccgtcaagattttcagaccagcctgtccaacatggcagaactggctctccgtataatactcaaactagccacgtgagactgcccaccatctgttttctccaccttatgcgcacgctctcgctcaagacctctctccctctagtgtcatacaactaccaattaaccacttataacacaaatatactccaccacaatcgggggagagatgaagatacggctggcccaatccataccccctacttaagaaatatactcttaactcatatagtaacaaaaagaaataaaataacaacacagaatcactcatttaacacatactaatccaatcatctccctctccctccctccacctatctaacacacgcacgctcaccaccgttctcctccgacagtcgcccctcccaccttacctatccacgctaatcaataataacccccaccacatcccgatgagacagaaacaatcttttcccaccacacacgcatttagtctactcaaaggtaccactttccaaccgataaacatcagcgcagtcatgagttagcttattttccatttt

SEQ ID NO: 8264 - DNA, 368 bp, Homo sapiens
actgcacccgtggattttaacgctttctttgctgtcagagcctaggcaaaggttcctgcgaaatttctgccctcaggaaatgaagccgtgtttctagagggagcttgaacctctgagcctcacttcacctcttttgatgtgtctttgtcaaactctgaatactcttgattcagatgtccataaagtcaagaagatgatcacaaaatataaaaagctgatgaatcttttggaaagttaacaattttctttaggagtttttctcttccctgtgtaaaatgttccccccagtttgcctcttcatgatccattcagagctgtgtcaggagggagataaagaagcagaaggacccaaaaaaaaaaaaaaaaaa

SEQ ID NO: 8265 - DNA, 1180 bp, Homo sapiens
  misc_feature (1)...(1180): n = A,T,C or G
ttctcgcgccgtccgcctccgtctgcctcccccgtctatccttgttcctctctctctcgctgtcgtgtgctcttcgctgtttgcggtcgtgctctgcccgtttggtcgctggcgtgtcgttgtttgtgntgtgtgcgctccgtcgggtccgtggcgtgtgatgcgtggggtcgtgcgcgtgcgtgggttctgctctctgcgtcgcggttccatcttctcttctctgccctcgcgctctctctctccggcggttctcgctcggctgtctgctccgtgtcgctgtgccgtctttgttggcgtgcggcgttggtgctcgctcggcgctgtgtgttgttcgcgtcgccgtcgctctttctcgcccgtcgtcttgctgtcgcgcttcngcgcggcgcggcgcgggcgttgttgcgtccgtccgttctctcgtcttgcttgcgcgcctccgtgcgtgcantttctcgtgcgcgccgctcgcggcccgttgcctcgtgtagtcggatatgtccgcgccggtggtgtgtcgcggtcatgttcgtcgtgcgtttcgctgtgggctccttgtgggtgggctgtcgcgcgtttgtgctgcctgcgctgctgcctcgcttccctgtgtgggctgatgccgtcgtcgtgtgccctggcgcgcggttctcctgcccgtctgtttggtcctcgtgccctgtgctccgccgcgtctgctgtgctcggcctttgtcctcgttcccctgttcttggtgtcggccgctgcctcgtttttgcttctattgggggggcccccccccccccccccccccgcggggggggggcgtccttctcgcgcgcnccggcgccgctcgntcnncnggggngnccncccccnccncncncncngagggtcctcgttttgtgctctnctcggtctccttctcctgtgcgtgtgtcgccggctcgtggctcgtgcccctcacacacgggcgcgtgggccggtgcgtttttcttccttacgtggttccttcgcntcgtggccacccccctcggcgggggggggactgngcttgaaaanaggagcctttccccctccccnngnnnaaannncnnccccccnccncnnnnnncnnnncnngggcnnnnnngttannntcctttttaagggtgttccgctncgtagctanctacaatctgccnttttccgggcacc

SEQ ID NO: 8266 - DNA, 248 bp, Homo sapiens
  misc_feature (1)...(248): n = A,T,C or G
acagacttaagacaaggctcattatacttagggtgattaaaaaggcaaaaatattcaaggtctcgtattggtttaagggaccatccaccactagaattgaaagctctataatagtctttangaagtctatggcagagatcatcacttggtttatccaggacattctttggcctaaaggtcgcgggcctccaccgtcccttttttaaaacggtcggggaaatcggtcacatccaacgttaaagagctga

SEQ ID NO: 8267 - DNA, 836 bp, Homo sapiens
agttggcacggggatacacgcctgtgagctcaccggccattgctgggtaggaaagacctggttctagaagagctcaccgttgaccatgccaagtgtggggtaaggcaaacggtctaggcttagaacacatggaggcaaaatccccagctttaaaggagtaaccaactaaagatgccataggcaggaaattaggagagggccatttctaatgagtctgcacattttgctccaggaaaaagtttggatctgttgattatgagcccaaggaagcacaaaggagtggtagaagcaggtccagggtttgaatctcagccatccagcaacaggtgctaagagaaggagaagcaagcacaatgtctttgttcctggaaccagttccaaaaccaaaatgacattgtcctctccctcttctgcagcacaaaagcaaactgtcactgagcagatgcttcccatgggtctcccttcagtggccctggagcagagaatggctccacccaaatatgggcagctctgagtgcaatcctaggatggcgcaatagttccaactctaatgcgctagtggctcattaggactaaattagtccacagctactaatactcatttgtcatgaacagtaaatgcaagattcgatacactcgcagggcacacagacccagaaagatcttcccagagggaggtggggaggtgggaagatggctctgccctgccttgccattcagacacctctatttctactttgggccttcctcttcaccctggtttaacctcagaaaattcataaccatgtgaaaaagagtaaataaaataagatgaagacaaaaaaaaaaaaaaaaaa

SEQ ID NO: 8268 - DNA, 846 bp, Homo sapiens
  misc_feature (1)...(846): n = A,T,C or G
ggggggaaaggaaggagggggggagggggccgagaaggccagggaaggaccctaaaaaaacaaaaaaccctggggggaacccccgccccacgaaacaaccccaaaacttaagagggcgcgaccgaacaggccaccccagcggaggcccggcacagccggcccccccgcgggagcgggacgcggcccccagcgcagcgagcaaaaacnacgggggcgggagaggggaagcggggggaacaccagaaggccgcgccccccacggcggagaggacgcgaagaaagccagggaacacgggagggcgcgaagcggcggcggggcccggcgagcacgcagcgcccgacagcacccccgcaccacggcgacccacaaggacgcggccccgcggggccccggccggccgccccccacgcgcggggcccgcggcgcccaccagcccgcgcgccgggggcgcgaccccccccgccacgagcggcccgcgaccacccggccagagcgcaggcggcgcgcgagacgcggcggggggccagaggaccagccgaggacagcggagggggaacgaaggacggcggggcgcccgccgcccccccggccgccgccgcccaacccgcccgccacccgcaccgccgccgcgaccgccccgcagcggcgcgaacgccaccccgcgcagacacgccgacaccccgcggcccgacccaccacagccccacagccagcgccccccccacgagcggacgccgcgacaggcgccacgacagagagcgagggggacaggccgccgcgcgcggggcgggcgcggggaccgcgggagcgcgcggcggcgcgcgaccacagggcaaaccagcaag

SEQ ID NO: 8269 - DNA, 791 bp, Homo sapiens
tcatgtgtgttatttgcttttctgatggccagtaggtgagacaaagagctttgccagccaaagaaactacctccagatggaccggcaacctccaaatgggagaaaattttcgcaacctactcatctgacaaagggctaataccagaatcttcaatgaactcaaccaaatttcaagaaaaaaccaaacaaccccatcaaaaagtgggcgaaggacatgaacagacacttctcaaaagaagacatttatgcagccaaaaaacacatgaaaagatctgatgattttaaaaggggaaacccctttcacttggctctcattctgtcttgcctagtgccatgtaagacatgactttgctccgcttcaccttctgccatgattgtaaggcctccccagccgtgtggaactgagagtccattaaactttttctgtataaattacccagtctcaggtatgtatttattagcagtgcgagaatagactaatacacttttaagtgaaattgctttcctaaatgtctttttttaatttttcattgcaggtgtatgacatcaaaactaaagtttttgtattaatttcgtaccttgtaactttgctgaatttatttgtagctctaggagttttctttgggttttttagaattttctatatataagatcatctcgtcttccaatggaggaattttatttcttattttccaatttagacatctttaatttatttttcttgtctaattgctctgggcagatctttcagtacaataataaataatagtagtgaaaaaaaaaaaaaaaaa

SEQ ID NO: 8270 - DNA, 554 bp, Homo sapiens
  misc_feature (1)...(554): n = A,T,C or G
tgctggaattacaaaagacacagagaatctcactgtgtgaactctgccaattcccttatcctntatggaataatgtagcaaaataattagtcatagatagaatgcatgtttgtcttgtgcaagtaaaagtaatcactcgagggagggaacgaaaactgcttcttattcttatgttgtaccctcattttgaattattcaaaccagaatcttagcagaaaagacccagctaagatctattcagaggttttcccctctaagttagtaacaacctatgttgctcaggctggtgtcaaaccactgggttcaagtgatcctcctgcaatggcatcccaaagtgctgagattacaggcacaagccactgcacccagccctcttttttattcactcctctcctacctatccctttgccatgtctttgagcaatgaatataaatcttcaatacagtccatatggtactgttcttttcctgaagaatatgtgtacgtctaggctgagaaccctttcacctccaaagaattacataaaatgggctttttaaaaaaaaaaaaaaaa

SEQ ID NO: 8271 - DNA, 738 bp, Homo sapiens
  misc_feature (1)...(738): n = A,T,C or G
gggaggggggnnnnngaggggggggaagggaaccgaaaaacggaaccctggcaacacggaaaacaaactgcggggaaacccggccacccgccacaacccccgaacctaaaaggggcgaaacccgggggggcgaacggcccccgcccacccgcaacaaccccacccaaagcagagggcgggccgaggggagggcggagagaggagggagggggncgaggcagcgaaaagaaaacacaagagaaccccgaccggcccccgcgcccccccccccgcccgcccccaccggcaaaacccgcccaaagcccccccaaaaccgcccccccccgccgcccgccccagggggcgggaaggaggcgcccgcgcggcgccgcccgccgcccgcgcggggccgcgcccccgccccccaccaaccccacgccggagggcccgcgccgcagcgggcccccaccacacccggaggcgagagcggccggagggggccgcaggggaggagggggcgggggcggggaggaggcgcaggcgcgcgaggcggcgcgcgcccccccccgccgcgcggcggcggacggacgcggacgcgcccccgcccgaggacggcgcccccaggcgggccggacgaacacgcgcgaaggaccaggcacaagcagaccggagagaggcggaagcacgcgcggcccccggagaagagccggccccgcaccccgcccacggcccgccccgcgcgggggcgcggaccgacac

SEQ ID NO: 8272 - DNA, 418 bp, Homo sapiens
cccagaacaatcgagaaagattttgaatttgggagtttctcattttttcctctaacaaaactgaagtcaagagcagcttgcccaaaggaatttcagatgcttaattgactacagagctcatcagaatatgctaatgttatcaagacgtgatcatacccctcatgaaactacttcagatttagtctaagaaaaaaaacactgaattttccttcttttcttcaaatcaccaagaaggtatgaaacttacaaggagcttccctaagatgaaagtgtagcatcatctctggaatgaaagtggaagaagaaaatggagggataggcatgcagtttgagctccttacagatgaagtctttacaggatgctttctctaaatgatggaactattaaacatcttcacgtgaaccaaaaaaaaaaaaa

SEQ ID NO: 8273 - DNA, 406 bp, Homo sapiens
atgttactcattttactggtgatgtgaaagaatcatccaagtgacaacatggtgtaagtcacaggccgagacatattttcattatcactacacgaatgtttaaatcaggtgctgttctctagtacgcattttggtgttctaagtctctcactgggtctacttttctggatcaccttgccgtccccgtcccccttaactcactcctccctatgccttctatatacgcggcattccgccccctctccttcactgtaggctaatctttgaccgctatgctgtctttttcggttgttctcgttcttacttctggcgtccgtgcgtcatacgttccatcataccgctctatccaaccgatctcccagttagggggttacgaagttaaggatcatcgtagtattccaggttc

SEQ ID NO: 8274 - DNA, 384 bp, Homo sapiens
tctagctagcagtctatcaaatcaacaaaacaaatattgacaaatgggaactaattaaagagtttctacacagcaaaagtaaccatcaacaaacagacaatctataaaccgggaggaaatatttgtaaactatgcatccaacaaaggtctaatatccagaatctattaggaacttaattcaataagcaaaaaaacaaaaacaaatacatctcattaaaaaaaatagacaaaagacatgaacagacacttttcagaagaagacatacaggtggcaacaaggatatgaaaaaaatgttcaacatcactaatcatcagagagaagcaaatcaaaaccatgtcacaccagtcagaatagttattattaaaaagcaaaaaaaaaaaaaa

SEQ ID NO: 8275 - DNA, 610 bp, Homo sapiens
actatggaaatgatgctagacaaaaagcaaattcgagtgactttcttgttcgagttcaaactgggtcttaaagcaatggagacaactcaaagcatcaacaatgcatttggcccaggaattgctaacgaacatacagtgcagtggtggttcaagaagttctgcaaaggagatgaaagccttgaagatgaggagtgtagtgattggccatcagaagttgacaatgaccaattgagagcaatcactgaaattgatcctcttacgggtacaagagatagcgctcaagaactcaacatggaccatctaacctgccattcggcctttgaagcaaatatggaaaggtggaaaagctccatacgcgcctgcctcaccacctgactgaagatacggacatgagtcgcggtcctgtcttattcgaccccccgccccgtgacccctctgccgatacagtacggatgcgccaccagaacggttctttgataccaggacgcgtattcaacaccgcaattatcctgccacactacagacccgcccccccttctcctttccgacaccgcaccaataaacgcgcacacttcaggaacccctcgttacggccagggcatcaaccatg

SEQ ID NO: 8276 - DNA, 284 bp, Homo sapiens
gaatgcaaataaataataactgttaagtccaccttgaagcccacttgggaaacagttaaacccaaggcacagtttctcaaaaagtgtttgtggaatccgtgaagttactcaacctgtgggctgccacctcctcagctgtagaacagacatcttcacagtacacacctaacaggatggctgagctaatgaactttacaaactgcaagatgttatgcatttattattatgtagttatcttttgagaattaaagaaaaaaaagtgccatcgaaaaaaaaaaaaaaaa

SEQ ID NO: 8277 - DNA, 223 bp, Homo sapiens
ccaaagtggttaagaacaatatcgatataccttctccatgcttctgtcttctcatctgtcagctgatgacaccagagcaaacttgaaacaatgtgttaaacatggtggagcacaaggtagatggattcctgagtaaccgcctggaggagcttcccggaagaacctcctgacaaagaataactgcaataaaattgacataggcaagaaaaaaaaaaaaaaaaaa

SEQ ID NO: 8278 - DNA, 348 bp, Homo sapiens
cggtctgattagagcacagatttgtatacaaccaacttggtaactggacccccatacatactcttaggtatatatgacactcagtacgcttttagttctataaaccaacatagattgtgagatatggagagacgatcggtgaaagagacaatggatcacagtgggatggatccgcaagagttatagctgatgaaggtgttgggagttaggaaaagggagggctcgttgcgtgagttgggcctggggtgggggcgggcgatgagtggaggtgctagaatggtgtgaagtcgggaaacaattggtcaaattttctaagtgggcgtgcaaaggcgagtaagtttctttgcg

SEQ ID NO: 8279 - DNA, 211 bp, Homo sapiens
cccattcttctggtggaccacagatgctccagtgccagaagatctgcagtcccagatgagcagcagcagcacaagatacatttcccactatgtaatccctcccctctgctaacagttgattcactctggggtagacactggacctaaggtgtgcatccatagcttgtgaataaattaaaagtctttaatgtcaaaaaaaaaaaaaaaaaaa

SEQ ID NO: 8280 - DNA, 248 bp, Homo sapiens
tgcttatgtcccttttacaaggggtaacttctaggatggcgagcaaaacaatttgtaagtccctgggatgttgcgggtttccttttccaccctcttgggaaataggaagattccggaatggcgggtttttccaaacgataaaaggtcagtttctatggaatcgtgcacaaggtgaccctatccgtttctcggtcaccgttttccatgcgtacggatatccgattagcttcttcaggtggctatatgct

SEQ ID NO: 8281 - DNA, 219 bp, Homo sapiens
  misc_feature (1)...(219): n = A,T,C or G
ccgcctgatgacatagacaaggtgtaggggcgtaacgaatgggctacangctgaaggtttatccaacggtggatcgcgcacgggatgggtatcgacacaaagagtccgaattccgtttggcgaaaggctagggtttccggtagggctccacttttccgtaaaagatgtagaagtcgcgaaatggtggggtatccctgcagaggcaggaaccgcttcagc

SEQ ID NO: 8282 - DNA, 604 bp, Homo sapiens
ctggggagcggagcaccgctaaatagatgagcaactgacggcggcgcatgcggtctcctcatcgcggtagtggggacagcattgcagatatactggtatacgatgggcgggctaccgttgagtggatagggagtctaaacgcgctgatcgatgtgcgccgatggatccgcctcgatcgtgtacgatggtgagcggagaaagtagttgtgagaggaggcgaagaaagaagtaggggtgggctgataagtcggtgtcggctgggggagggcgggggtacgaggggggatagaggtaggtatcggagggtgtgttggagggtgagggaccaatggaggtgatggaagagtgcggcgcaccggggatccggtggtggttcggaagcgcgagtgtcgagggcagcgcaccgtagatcatagaggagctgggattcgttggccgcgcggcacggacggtgtcgggggcggcggcgataagcggggggggggagcgggggggtgaggggggaaatgcagtgtggtaatctcgcccttacctaggacaggtaagcgtgttgcgtatggtcccattggagtagtgggggggagggggcggggcaagggtggcg

SEQ ID NO: 8283 - DNA, 1041 bp, Homo sapiens
ctcctttttctcgtgaggataaaggttttaataaagaggtggcgctttatcccttgtgacgcaggtttccctgttgtttcattgccaatggcgggaattccgggagtggccaattcgtccagggtgggcaggagaatgtgaataaaagggccgggaagaaaccctgagcggtgttttttcttaacgcgtttgtgaaaaaggcccggagatagtccatcccgaacgggtttttgttaacaggaacgattgagccacctgcattaaaacgcccttaaagatgttgttttgggatcccctttggcatatgttcaccggggggtatatccaggtaatgttctgggccatgaaaggcccgcgcaaccccagcctccccattctacgagcgggttaggctttgcgcgtcgccgcaagaggatggggggtgccccacaggacccgcgccacctgggtgcactgaggcaagcaagacccggctgcttgacagaccagccccaaggagccgcagtcgcacgaccagaagaggagcgcagcggccccaatgcatcggatggcactcgggcaaggtacgtatcaactatgggcaagaatctctcaacgctggttgctgccagaggggtctcatgcagcgatcaactcgctgagagtatattgtaagcgtgtgagggcacgatcttgattctagcgaagaccctcgaaaagctagtcggggtaaggcagtaggtgcagcgcagatgaaagcaaacagcctctgtgcctgtggtcgaagtccatgatgatgcactgttgactacgtaacacagctgtatcttcgcactaccatcttcccataattccaggtgcgttggtgatggtggaggcctcctatgcccgcactacaaggcgctctgctcctcattcctggcacatgttggtccaagcaccacacactgcatacgtggctagttctaagtcatatttgcagcatgtcctctactagtacgcaaagtagatatatgcgtcttaaaagggtgagttgatgtctcatattaaaaaaaaaaaaaa

SEQ ID NO: 8284 - DNA, 1658 bp, Homo sapiens
  misc_feature (1)...(1658): n = A,T,C or G
cggaacaacaaccaaatatgtctccaccccatactgtntatggttacatgccacacgacgcagcagcnccgctganacagagagacacaccnnaagagganaagacaagcgcctacagaagaggcgagagacgacacaacgcgagncacgcgcacacganaagcgagcngactgcaccacgcaacgagatggacaaactacatgtaganagcaccagcgcagtggtgctcagctgcgtctacggttccacngacatgacgtgtctggcgacgtaacactcatgatctactcgacgatgttctgatctattgncagtgcgttcagatagtnacagcgtgtactngtggctcgacctgcgcgagtggcgctgtagtacgtccaacgtatgggcgattaccgctntgatgagacagcagtcgtgtagtcgtcggtntcgcatgatacaagagcgacgcacaatcacgcgcactagttcgagtgtctcgctatagcctaacgcttgcctacatcatcattctctcaatccaatcgcgagcgggataagagggagcggagtagtctncacagcctaacnacgcagctcgtgtncatcataagcgagtgaatgcangccgtgagaagtgtaagtgagacgtggacgcgcagcntnanagcgacgactgagtgtaacttgccgttactgctganantctacgtaacagtgtgtcgtgtgtctagtgtgtctcgttcttcttcgttagtgtcgtccccgtcgtgtccgcgtgtgctcgcgtgcnagcgtngctagagtgcagagacgtgcgagagacgncntgctgtgccgacgttgcggcgcgccactgctagngatgtgcgtcgtctgtagctgtctncgatgcgcgcaggatgcgcgtcacgcgcgcggagcacgtntctctcagcgtcgcncntgcgcatcaacttcagtcgtgttgtcgtgtgcgagttgnagccactcagacacgagtgtctgagcatgngnctcttgtagtcgtctnacactggcgcagtgagcagatggcgtcnctctcgagatgatagtgcgctcgncgtgtcggtgtgcgancgtcatgcatgggtncggatgatggttgcgcatagtcngtggtcgtgtcaatctntgtgatgtatcggcgcgcacgaggctgaggagctgatacagcgccgcgtgatgncgcgtatcatccgtgatctcactcgaccctggcgcacgctacttagcaggctcggacncaccgctggactacgactgcgcgtcgcagtatcgcgcgtcgcacgacaggactatcagtgacgcgcgngacagacgtgacntctactgatcgtacgagcgcatccgcgcactgatcgccgtnagcatggnatatgctgaacccacacgagntgatcgacgtcgcacgcagagaccgatagagtgtgtcncaatatgcgcacactacatatgtgagactgactacgctgtccacacacgtgttgtatgtctacgccntnancgtgtgctgatacagtcagcgtgcgctagacgcgttcgtatcgncntgtgcagatgtgaaggagcgtgcgnagtctgcggtgtgcgcgcgtgagaggnntctggtgagtgtggagtgnagacgtcgtgactccgccgtgcacacgag

SEQ ID NO: 8285 - DNA, 678 bp, Homo sapiens
ctagggctggctttaacctacgcaatagttaacaaacacataaagtttccggaaatcttagatttggctcctttttgcacccttagatgtgggaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatggggcacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaacacttggcctcgttggcctca

SEQ ID NO: 8286 - DNA, 1292 bp, Homo sapiens
  misc_feature (1)...(1292): n = A,T,C or G
cacaggtcaactgactgacacgtagactctaacatccaacgcgaaagnacacgaacaacacgnncaagngttcactctagtataactcaatactcagctcacacagcatntcactaaccttacccctccantagcacaccctccacatctcaatcatcncccacttacactcgaccctcccacaagagggtagtagcgtcgtgccacacaaagagatactattgntgctctaccgttaactttaactctgacagaatctccatttctagagtnccgtgcatacggcggtgtccacgctccatgcccgacgcccactgagtagacgcagcccctatcagacctccaatcccacacgactatctctctcnctcttcacataagaagccctcacgctactcctccggacacggtgtgttgtctccgcntcacgcatgtgcacgtctccaagctcagagaacataacaagtagcattcctgcctttcctcgctctacctctctactactcccacagcgagntctcggcgccccttctctgaaggccaccactcccccttcctcacatgcgcgctcactagtatattagatgacgcgctggtacatagncgcggacacagtagcgtatttacccgtctttcgttatattgaacgctacacacccgtatgtctcatgatgtatncgcagacgaagagaccaatacgcacacnctcttcctacgatctgacactcatcatacataccatctcaccacctcacgatctaatatcacaaccgactcgacatgtattactcacttcgttatgtgcaccactgtcatcatatctctgctctctcgtcggcgtagttgtgagagttgtcttcgctactgtatatagcacatcacgatgccgtgacagctcgcccncgccggcgtccgacgtgtacatcatcatgtcacgtacgcncacctcagtcacactcngcatcgcgcactcgctctcgctcaccgccatctcgacgtcgcagcgcctctcctataccgccgattactcatgctcgcgcaacgcgcttcgcgagcgcgttcagcactcgtctcgtgcncncagtactctgtgacgcatgtagcaccctcatcgctacgcacgtcgctctacgnttgtcaaatttatcattatacancatactcatatggttatgtgacactccattacctaagatgcnttatcgcgtccgagagtatcntctacgcatgattagtacncgcgagcactctatagctacgttacctcgtgtatagtctagttctatagatat

SEQ ID NO: 8287 - DNA, 827 bp, Homo sapiens
ctcctacgggaacttagcaccaaccttacatcccccgccccatctttccacgcctgcctgttgtgttcaggaggggacactctctcccgcattacgggctgcctgacaccacagcttgtaatagcaggcgctgtctccactgctagagaaacgtacccctggcctgaaggtatcagaggtggcaagacctacaaaagccccagtacgagtcaggctgccttatgcaggcagaaccacttgcgcgttatatgaaacactgcatcgcttgatgccctgactgacaaagagcttaactgaatagtaagggggagaaagccatcacacaatgcattgttactgctgcacgcctactcgtatactgaacacttatccatgggagccattttatccttatctatgtaaatgacatttgaagctatgtaatgcacacactgtgcaaacaaccttaaaacaccatcctcccaaatatgaccgaaacaacactagctaccccacactataaccccaaccactaggttcctacttgatctccacataatgactatttatccccctcccttaaacagaggttaatgaacgaacctgcctcctaattcattttcttcaagctccctcaatcaccaccacccatatcgtaaaataaaaaaggcgccaacccattattctcacgttctgcgtgcctccaatgaaattattaatgtattgaatctgttaacatagcttatagctacaattttccctacttattcgaccaacacccatactcaaccttttttgccactccaacatccatatctagtcttacgtatcacaccacctctcttctt

SEQ ID NO: 8288 - DNA, 1906 bp, Homo sapiens
  misc_feature (1)...(1906): n = A,T,C or G
cgcgtgcttgcctcgcgaccacgccgngctgngatgtctactattgcttctgagcatcacccgatagcagncgcgacagcatatcggcccctttacgctaatnggtancaaaccccacnatgcagtagaagcgcacatcgcatcttatgtgatcgtctnagatgagacaccacctcacattcatatgctacaacgcgcggcgcgagnggcgcgagtgntgttgggngtggagtgctttcgtagcatatgancgtaatcgcgctgngctgctaaacgtagatatcgctgcgtaacgattagatacgataaatgtgagttacagagagcgcgagacacgtgtcgttatngntgagcgtaatagatgcagcatacacagtcgnatgagtagcacatagcagatcanctaatatattnctctgagcgctgtgcgctgaagttggctgtacgtatactcgtcncctanctgacgntncgacgctcncggatcatgntagtagagtcgntgataatggatactgtgcngtcgttgatgatcgtcagtgctacgatgagagtggatcggcgagagtgtntcgacacctcancgagcgcgacggacacaggtcatacatcatgagantagcatgtatatagtctcgcatcgcagtatctcgaccaggactcataactatgatatgagacagctacngtgcaggagagcgacgtangttgaacgagcgcggtgncggtgtcgtaagtacagtatggcaacataagctgtatgcncactgcgcgctgtatctagtcgtacaaactataatgctcgcgcagatcagcgtgacgatatcgagcatatagactcagtaaccggagagagacgccagcggagcgatacgtcgcacgttacgacagcagcgagagatagtatgtgaatgatatagatagttgtatactgcancgtatctaactgtaatcggtacgcgacgganatgtctgtcntgcaattgcagagctgagttatacgagagtacatcgtaagtagctagctcaccagtagatctctncgtgttgtgcgtcgagcggctncgtgcgctggtgctatactgcatatgagtcaccgcatatgtactgctgtattgcggacacgacgtnactcatgcatcgtcgtacgcntangcgcnacgcantgtnatcntnntgaatatcctgtatgcgantgtcgacgatngtacgncgagatgatcgagtgacangttagcttcgtcgtgcgcgtatctangtagattgcagtcgatcatcgcattggagagcatctgtcatctgtgtcgtntagagtgtcatgcctgtgtaccgacacgctgcgtacatagtagtcgcgcgcgnatgctgagtngtagtcgaacgngtgagctgcgncgtgatagtcgtatntancacntgccagcantatcacactccgtngctctgatgcagacatgagcgcagagagatatctggacacgacgctacagtcgctctcacgctgcgagactcgcacgagcgcnanatcgcantactactgctancggtagtgcgcgtgacgcgctcagctcnacgcgttctcatggttcacncgttagtgcgatcgtacaggctgcggagacgncacaccgcgtccgcgcacagatcgtntactgangatggtctagcgatgtangctggtacngcagagagtgtgcgtcgcgtagctcgcgtagacggtgagttcaggnagnggntgcatnacgcgcagctgacgtgagtangtagtacgananacatcagnagatatanacgatgagcgcgataggacgatgagacgtagcgcgacgcatagncagagcgancatcatcgtgantcgcagccgcatcatccgatgagtgacgtgagcacactngacgtcatacg

SEQ ID NO: 8289 - DNA, 1424 bp, Homo sapiens
  misc_feature (1)...(1424): n = A,T,C or G
ggggaaggaaaggagaaggaggngnaagagnngacgcnaggaggcgnaggagnnnaaagannnagctccnagaaaaacagaagagnnaagtttttcaaaaggaaaaacgaaagnaggacggaaggccacgggnacgaggnnaaagcttcannacagaaaaggggaaagncacagggcnaaaaaacaagaggacgaccaaaggacacgccgcgaaagacgaacacgcgccccccccaccgcacgacgatccacaccccgacagcgcacccagacgccacagcaaccgcaccacgccccaaccccacacccacccccgccgacaaccacgcacccccgcatccgcgcaccccggccggcgccctcgcgcgcgcaccgccgcacggcagaaacgagagcacagaccacggccggacgagcagacgngaagagngtaggactgagacacgcgagcacgcgcgcaggacgcagcggccaccaccacactaccaaacaagaatnatacacagagagacaccgagagcgcacccgaacacgcagacgatacatcgaaagatnacacaaggacacgcgagcatncaccaacgcacagcaaccagacagcacccgcgcgagacgcnnacgcgcgccaagcgnaacccgtccaccagcccagccccgtcncgcgcgcagagccctcacgcccgccccagacgagacgnacgcgcagcccgagacgcggcgcacgcgcacgacaccgcagcgcgcgcgaccgacgcgacgcgctacgcacggnccgcgccaacctccgaagcgaccggcacgcgacgagacnanaccagcncgtagntccnaacgacagctcgacacgagcgacggaccggacgtcacggaccgccgagcgacgggcagcgcacacgacgcacatgagccgcaacgcgccgcaagaggcacggaacaatacaaatncgcgcagacgacactngaccgcagcgagatcacacgagcagaggcgcgcgcgcgnaggcangagtcatgcgcaaccaccgacgncgcgccgcagcggacagcagacgacnacagcgaacgcaacacaacaaagagacagggcaatcgacgaacancccaaccaacagcaacagacaccaagagcagcgcgcacagcngcacacaccgagcgcagagacacgaagagacacgcgacacacacacanaacnccacgcggcgaagacgaccgcgcacgcgagcgaccacgcacgcagagccacgacggcacgggccacgacgagagagcaccacgggcgaggcagcacacgcggggagcggcgcgagacaggagaggagcgcgcaccgnccaagcgcaagaaggccacaaatcaccgccacacgacgnacgagcaacgaagacgagacncgcgcgggcccaacggcacgcaggagcgagcgc

SEQ ID NO: 8290 - DNA, 227 bp, Homo sapiens
agatggggttttgccatgttgctgagaatggtctgaaactcctgagctcaagcaatccttctgccttggtctcccaaagtgttgggattacaggtgtgagccaccacacccggccagtagataaagttctgtaagaatttctttgaggagaaagccccccaggtgttattatagtcagtgtgtgtttgtgtgtatgatgcaataaaaatggaaaaaaaaaaaaaaaa

SEQ ID NO: 8291 - DNA, 1689 bp, Homo sapiens
  misc_feature (1)...(1689): n = A,T,C or G
cccgatagtccgcccgcgtccgggttgtgattgcttattctcacgaatctgccactacttccccgcccgagtatacgcgcgtatgatgttgttgcgccgattatgtttacgattatcggccacacactattaccgcgccactgtcgggagtgagatctattattatctatataatttatgcgaagaccttgtattagtgatataaaatcaatacccgcatcagcgctcgcattcgcgtggttgtgttatctcaacttcgtcaccgtactagtagtgcagtggaatctgtcgtcgcgcgcacggtatgtcgatcgcacaacgacttacccggcgccgtgctagcttgatgcggttttatataagtgtagacatatgcgcgtatcacttggcgtggagaggcgcgtgacacgactacaggttcgcatgatatcgagcgatagtattatctcctcgtttcctcccgccttcatcacggccgacgtcgacgcagacaacaatgtatggcgatgtgcagcgtagtacatgttgtattacatcatatgtgacttcctcctagatatcgtacgaccgaacgnacgatatgcgtgcactctgcgntgcgccacctaattcatctgttgactcaccgaatcactgcaagagtgatgccacgtcatccactngtctacgattactcccatcacgatacaacagtacattcacatcatcccattctgtcatagttgacgaatcgcgctcctttctgcgtcagctgtagaatagcgcatctctcagatgtggactatcgctgatatgcacgtggttctcgtaagcacgtgtcgtagattgacacgtagtgtgctactatctggtagtatcgtctgtnctacagcgactgncgcgnctctatgccaccctccagcaccgcatctgttgtgtgctgcgcgtgctactgagcgcgagagcggcacgtaatngcgctacgtagacttacatgcatgcagtagcgcagatganactgatcgancagcgtatggcatacgacacatatctangcagtcactacgcatngnagacgngnagtganagcactttagacgagcatagctgcatgtagagatatcnactcgcgagatctgactagttgtgctcntccgtcgacccnacagtcgcacncgacangtctcacagganagagngtatantagcgtccggcgtctatatatagtcagcgnagtcacgccctgtgatatcnagcagacgtactcatgagtcgancacacgangtccnacgncgtcgcatcgcgagtggntggtatgancgcggngcgcgagcgagcgntgtgtgtcggcncaatatgtatgcgtctctactacgataacgagtaagagatgtcgttcacacgtgcagttagcgtcgtgcgtgctgcgcgcagtgagtagtacttattatgaccagtctatcgtncgtntnctcgactncgcgntgatcactcttgctgnctacgccgcacgnaagtgtgctatnatgcgctatgcgtcgactctgcganagnagcgctgannccgatcgacatcganagatctcgagntgngttcgtctacgcgtttagctatactgtgcgccgacggtangtatntagtatatatcatcgagtgtcacgtacgccgtcgatacgnatnattgtctntncttnctgtactgcgtnt

SEQ ID NO: 8292 - DNA, 1219 bp, Homo sapiens
  misc_feature (1)...(1219): n = A,T,C or G
aggaagagagtggggnaaaaggggngnnagaacagnnaagaggcangcggaggnnaggnnnnnaaagnanagggggagccntcaggnaagagcntgactcannaataacgntacgaaaatngacagaacaaccgcaagcaatgagtaagaagatgcatatagggatagacggaagcaggcnctccttcacttctcacctcttcctctccaacactacacaacataccaaccagaccccccgctgcccccccgtctccctgtgccgctatacaggtcccacctgtccgaccgtcgccgtctcccccccccccccctctctcccctccgtcccccaccactccgcccccaccggtgtaccctgacaatctttaaccccagcacaggcccccccgcagttcagttttgtactgcgccgatcaccccgtctcaaactcacttgccttaatttctcaaacatccataatgtgtaaatatgatctctctaccccccccctttccccctcacccaccaccctccaacactgcagcancatcccattaagacatatctcatactccacatccnaccccacccaccggcgcgcacccacctcagcatatcacccagccactcacacatcgcccgcgagcggccgacgcggattcacattcgcctaccatcatccctctcatgctcatccggacatacctccactcgcgacactcactatgtatgattctataatcgagtttgttgtctctaatttgtatcctagaacattctaccatatnnactaatttaatttagtatcctcaataggtatctcatattagtagtagnactgtatcatgagctatttcgccggcacagtgataccaacaaataatagaacgagtccgcaccaccgcgagtgcagtcgcattaccttacccaccccagtctcaacactcaccgactcgactaccgacacgcatnaacacttgtatgaggtcatagtaagatttacaacacttcatacntctagcatagatgtcgtcatcgcaccaggagcctcctgaccagctcttcattagagagacncgggagagcatagttngccaacaacatacnnccgcgaccgaggatccngctggtaganantgatacgtacntccagacagcgactgacagacaaagacaacgacgcggctatagtgcatatcacantacccctatctccctctcactatctctcctagc

SEQ ID NO: 8293 - DNA, 1507 bp, Homo sapiens
  misc_feature (1)...(1507): n = A,T,C or G
ccgggcgcactgcgcgccagcgcgcaccagtcatgtaatacgtttcaggacaccgcggatgactgcgcgaaaacagccccgcttcctcaattagtcacacaaattgagtgtgagtatcgcacacagtcttataggatagcgagagacgcagccgccgcncacacatatacacgacgcagcagcgagcgatagaaggtgtgtatattatattaacgcgcaatctatcgtcgctaaccatcacgacaaaccagaacacagtacaatgagaaggggaggaacgtcggcgcagagcgcgtcggatgatcgtgatatgctatccacncaaccagcacacgtacatcgcagtataacacaacagcggagatccgagagctggcgcataatccgagtctgctcaactgatggagcgtcgatggcacacatcggaatatagaaattgaacgcataagtagagatctgcgatgcgagagcaatagcgttgcaggtgacactcatagtgaagaagtggtgaatgattatatcgcactctgtgacagcactaacaactttcgcaccggacgactcgatgtccagccacagacaatgacgttaggagcagatatacgacccacgacgcgagactacgacctgtcgccggccgtaagcgacaacaccttccgccacgatccgggtgaagcctagtcgacgatgccgcgatgacacggtatttgaggatattcgtgtgattgcactagtgctatagtagacacagtcgtactcgacagagtgctgcatgagagctctgacgccgttgtgagcgtagtaagctagcgatgaatacgttcgctatgtacatgagagtatgtagataatgatggagatcagatntaagacacggtgacacctgccgagcattatgtatgtagncggcgcgcgcgagtgtgacatgcgatgtagtatatcggatgtaggaggctatgagantatactacgatatgagactagacacgaaagagatatggtgcggtctaaggaaccgcagaggccgaaaatattgtaccgattcactcaacgctgatcggccgcgaagccagatacgagcgccagtaatcacctagctatagatgtgtcgcgctctccgcgtcctattgatagactacgacacagagacaagggcgcgcgcagtgagacgtgacgtaactagtacgcgatcggcactacgacgatgtncagagtgactagtatagagcacgataacatcgcgcgtgcgcctgcactcngagtaccgcgcgagatatatagtcatgaatagacatgacggtgagatgcgctactgagtgnatcagcggcgtgtgactgagntnagctagcgcatacagctgatacgctccgagatgaagacgtagacgtgtgagtatngngtatacgtgcancacagtatcatcacgtntgaagctataacactgcnatatggtatagtagttagatagcgacaccgtccgtaatgctatatacgactaagtcagct

SEQ ID NO: 8294 - DNA, 1913 bp, Homo sapiens
  misc_feature (1)...(1913): n = A,T,C or G
tggttgaatanaatggtataatagaggnntagagaanggnnagagagnnnnnangacgactggannagangacgaagnnnnanaggtggtgtatgganaganataaaannnnnnnnntgtgtgtnttttnnnnacacacacanaaccanannnntatgaagtgnnnaagttncnnctttacancgacgtannncnnanagactgatgtananaaacgatgtntgtgtgtnangcangnaatntaaacgacnaagatagtagagantataatatcatatntataaatatgagtgatatgcaacaagaatgataagaaatagagacacatanacacatcagatcccntattctcagtgttctctctgtctgctcggctgcgaccgaacgcancgcagcgcgcgcgcnncngcctcctaacgtacggtcggccaccacgcgcacggcgccggagacggacnacaacgcagcncagacgctacgcgcaacgntcgtccgatgtcgctcgcgctgnacacacagcgcatgtgcgctcctcacccgcatcacgtcnntctnctagcgtcgtcncgtcgctctcgctcacgtctcgtnctcttctcgctctngcgctctancgctgtnctcgcgcgcaccctncggacagcgtcgangtccgcgcacacgtatactgcctatgtancncacggctcccccgccctgcgctgcgcgctcntcaggtcgtagtgctagaatgtaagagtctcnnntgtngatcatgcgtcgcncgcacacgtgcgcnctggtgatgtgtagtagttctnttagcttcnttgtncgctcgctatttctcgcgtngcgcgatcttgttncgtagtgtgatgtgtnatacaccgacgatacttctcntctcccgtgcctaatagcaccnatgtaacgcgctgacgtattgtgtgctctacgatagtgaatatgtagtggtgtgactaaaccattcacgcanctccacatcgcgactcnctctcacacgagtgctaggtagngantacgcactaggcgcgtcgcgtcgcgcacncacacatgtgtcnctngtacttnaagcngatcntcacacactcctcgcgttcgttcgcgcgcgttctacgcgcagcgctgtttcacacagacgcgantctctctcgcactcgtnagtctgcgtngctnttatgtagattcacgtgactcgacacggcgtngagtgatagatagagaaataggtagagcncaccagagtnggcgtatagtgctgttganananatcatggcgaggaggnanagcagagcnnangaccgtagnagcagctatagagtgtagganatgttcnangatgcatantnatatagtgaggngtagtcagcgctantgagatgggtantngtnnngcacgntggcgtatgagtggagntcntaagcgtctcggatctctcacctctgtcagttagantgagtgatactactgtagcagctctctcncctatcaaagtatctccagcacgnatgctcngacatacacgtcatcagtcgcctccctctcgcgactctgccagcgtcatcagatgngacgtgtgaccgcagcgatgctgacgtncggcnctcgtctcgatgtagctgatcacncgaggtacgtcacgtaggtcganncgtgatacgtgtatntgngntgatgcgctgtgcgatatccccantcgcatgatatagacgcgcagcgacatatgactccgcgtcgcacaagatgcgagcctctatcatacgtnatcacatatacgaggcactanacgtcatgatggtatcacngatccagtcagatatagangaccactcatatcntctattcgtcaagcgtagcgtganatgtatagagatgcgcgacagatgagtntggagananagtgaatgg

SEQ ID NO: 8295 - DNA, 186 bp, Homo sapiens
agacaagaattatactttcaattacctttaaattcgccagtaaagacaaaagcaaaaaaaaaacacacacatgtctttaattaactggtatatattctagagtttagataacaaggcaattaaagcactgaaaaataagaaatacactaattgtaacataacaaacagaaaaaaaaaaaaaaaaaa

SEQ ID NO: 8296 - DNA, 1532 bp, Homo sapiens
  misc_feature (1)...(1532): n = A,T,C or G
tccgcagatcacctcccagccaccagtaaatggttcgtctgtttcgcgatgtgtcccctttattccccctctccaattgcgcagttatttgttgagctcacgcggttttgtgtaggagaatcgcacacactctcctatcctccgcccgagcggagagtacacgattggatcttgtaaacgcaattactagtcggtgtcggtacgctttatcagatatcttcaatctaacgatatttgcgcgctgtacacggtacgcgtgtttgaatggaataccacgcgccgcgcgagnatgtctgtaattgactatcattatatagcgccagcagaaagagaatcatattcccacgttcatctgtgggaagctgagagactgcgctgcggtcactacatataccagcccagatgcgttgcacatctcttaggccaccgctacaccagaccactcagcactcagacaacgcaacccggtgtactctgtaacacagtagcggtcgacgcgcagagtctcttattattgtagctgcatgacaagctgtctatatatcgacgctagtgtcagagactagttgtgtgatgtcgacgcgtctcgcacacacttctcgcgcctgtgatctcttcgtncnanctncgacgtctccgcatcggctcacccgtgtatgacgaccgcgnaatatccacatcaacgcacgcacgcataccgtctctaccgacgcgtaccatctcctcaacacttagtatcgagatggtcacttatctagatcactctgtatctatactcttctgtattcctgaatcggctacgataagcngaagtcgatctcgatgcagcttatttctaacgtgcgtgcgactgaccgcgtcgactattncatcttcgacgcgtgagtctgatgcacatacatctgaccgtggctatcactcacactanagtgatacactcgtgancacggtatgtatatncagagatacgagtacatatattntcacatacgagcagacaggtgtgcgatgatctgatagatattcactgacggaaagtgtgctcactagtctcctctcctgtcgccgatctagctggtcggatatcttatatgcacacctgcgatcaatacttaattacaacttagacgatgtattacggttcgtgccgacttaccataacctcaagcatatattctccggtctatgtacgcggctcacgcagcgaatgacacacatnttcacgcatcactcgagcggtacntatacagagagtgtcctactccggtgagacactcattcctctgtactcgataactgcacggtacctcaataccaccctctgcgcgcccacttgacgatataatagctgnctcatatcatattcgcggcacacgctcgctcgttatgcatacacacgaatgtctagtacgccgcgaccacgtactgacaaccgcctagattcaacaatctgcgcggccgtcgcccgccgcgacttgaaagtgtatcggagtcctagtagcgcacctcgcatggaacgtcatactccgacg

SEQ ID NO: 8297 - DNA, 1115 bp, Homo sapiens
  misc_feature (1)...(1115): n = A,T,C or G
aggaaatagtnngaaggannnngnannnnnnnaaagnnnnnagcnnnnaaaagggnnanagnnnnnnaagnnnnnacgtnnncnnnnnncgnnnaatttnnananatagnnnacattannnntatttattnnacgactcacagcaatttncaacattttnnattgtttaagactcgtatcgatgatactgtatgaagtctaaattttactttcatttcactttcgcttgcttctactatcaccgtatgaacgtccagccacgcccgcttccctgataaacgcaccgtcgtctatctcttgctccgattttttcttactcttttcccctctcctccttccctgcccgcgttcgccatattccgcttgccctcttgcatcgctgtttgcctntcactcctcccttcacaaaatttattttattcccctgttgattatcatagctaattgtattaattgttatgccagattctacgtctatcaaagggattaacatctgtgtttctcgcgcagcaacttaagctcactttgtcctagatttattgtcctacttccgctccccactgcaacttccataggtgtgagttaccagtgcgactcccgtcacccgttttcacacatttctcccactcatctcacttgttgtacgcgaagttcactcaannacctcatgtcgtaaggtatttgtatattttgctgtggtgtattaggtgaatctgtgaaccgagagagagtgaattattacatgagagtagtgataacgtggtatagtgtgggccgcgatggtacgtctctagatcgttggcnacgtcatttaaagcgccatgtctctctcagtgtgtgcgtatgtgatgctaatcatattccgtcgcttgtttaccgtagcacaccacgctgtctagtcggatgactgacggttggcgattccacgataatgtgttaagccagtgctgctcgatattgtccgatgattaagtnaatcccagagtcctccgtaaatttnccacaatgtgtcctatatattcncacgttaagttntantccgtgtgcgtccactgtgtgccaccatagagggaagcttatgtcttgatgctggtgcagatcgtggtctatatgcg

SEQ ID NO: 8298 - DNA, 693 bp, Homo sapiens
gtctcatgggccaagtaataagtccccatataggcgacaggtttgtactcaacacgacctttgccgtaatggaactgttcatatgccccaggaaagaattaacaatctcataaaagtgctaaaggagtgatataggggaagttccatgtatccagcctctgagctgatggtatgtgacatgcacagtacgttgatgctcatttccagaagatagcaagataacttctcagacttctcaaatctacgtgccttccctggcaacacatgttggatgggctgtctggatcgagattctataagcaggatcctcacggtttcaagtccctgctgttttggatgagacataggatatttcctgttcccatatacactcacttctagatgtgaagctttcttaggctgtttctgctaattctaacaaaattaattatgggtatatgatgacaagtattcgacctacaagcccatctttattaataaggcgatattcaatggagtgtagttgatggcctttcatttttcctatgcaccctatgcgccatataaaatctggctgtacagattctatagaggctataatccctattcagagggaataaatcatttccaaacataatagaaaatacggagttatgttcacatgctggcaaaggtaataaatctgattatggaatgtaaaaaaaaaaaaaaaaa

SEQ ID NO: 8299 - DNA, 1926 bp, Homo sapiens
  misc_feature (1)...(1926): n = A,T,C or G
cccaatccctngcctcgcgagcgcgcggctcttcacgtgtngtgttcgtgtcgtgtatncntactcgtaccgcgtatatcctgatgtagctgaccacgccnacctcctccatnatgtgtcgctgtgaatatngtatagtactctgcgccnctgcgcgtctctctacgagttagctgatgtactgcaggacagacgaggtgtcgtatgtatgtacgcgaccgcggtaggtgggngtgtagctgcantgcagctgattgttcagtgtactccagnatcacgcgtnatgtagcnaagngagcgcgnactccgacatgtatctctttatctcacataatcaantgtcgncacagctattcagacgcttagcgtcgtcgtgcntggngatcgtcgtcatantagttcagtagagcgtcccatcagacaanctatattgcagtatcgttacttcgataagttgcatgtagcgcgcgcgtcagcgcgcgtcgtgatcgtttgcagtggagtccagcgcngntcgtgtactgatcgtacgcctacattattcgtctctcgcatactactcngatatatcatctantcgtatcgagtacatctanatgatttgctatgactgttcgcatgataggtagagtggtgttcaggagtgaggcagganacgcaagtgatgagcacgcagcgttatagatatcgccgacgcttgtagcgctcgagcgtatgcgatangcgacttcaacagcgtctacagtangtcgtactgctatctncgcagcgtgcgcagctgcatccacatgtcgtgctntanccacagtagcgcagtacacgtgctcactgtctctatctggaacgaagagacgtatgcgtcgtgtattgcgcccgcacgctgtacacagccagcatcatctgtgtgtagtcatacgcgtncagcgttcctatacagtctcatcgcgtgttgcacttacgcattgagatgagctaggacggctcagatacanctgcggcganatgtatcatcgacgtcctcgntgttcagacangatgatcgcgatagngagtgagtcgcacgngagtacacagacacagtctagcagcgatgctgcacatatcgcgggctgaacgctagcatacgctcgcgcctgacatacnagnancgtgtgcactacgatcataggcggacgctcacgagtcacgcagtatatgntgatgtatgcgcagaatctgatctatcgtctagagtatacgacgtgcgaccgacagtntgtctgtgactcgtagcgatcgcgcactacgctgcanagtcacgcacgcantcgctgtacantangtctgatagctatcgtgcgcacatatacgcagacgatanctgntgnatgtagcgtcttacgctagactgtggcgactcgagcgactgnacgtcgtgcgtcggtgtactacncnagtcgatgcttattattcatcatgcggcgcagcagctgagcaatacacgacgcgaggtatccgccgcgtagtatatcagccgncactctcagcgcgactgtctcgctagtcacgtgccgatgcacgtccgaccacacagtacacagtaagaattcncncctcacgtgtcgcgtagtcccgacatatacgctgactgtcctctntatgtaagcgtatatgactcgccactctccatacatttgcgccctacatgtagcatcacagatactctatatacanatacgacgcgctgtgtcgatgtacgctctgaagacgtatntgagagantctgccgcacnantcgtctgttctctnctgcgcataggctctattgntcggtgcgagcnacagncgcgtcgtcgcnctgcgtagacgctgctcagatcagcgttactccgacagtcgagctgcttgctctcgtctcgctgatgntataccatcacgatgcgacat

SEQ ID NO: 8300 - DNA, 1108 bp, Homo sapiens
cgcgcctgccctcccgcccgcgccgtgggtatctgtgtgttgcccgcattgttccgtgtctcgccgccccgcgttcttcatgtgtttattggtgtcccgccagcgtcctgttctttgccccactcctcctattcgtcccccgcggtgggggtggcgtgttttgtgcagcaatcctcccccggcgctctcacttttttgcgcggctagttcgctcccttcgcgccttgcgttgggctccgtctcgcgcctcatttcgctagcgtggtcggcgcgcgggtgtgtgcgcgcttgcgttcgcccgattccgggtctggtggctggacgttggtctggcccccgcggggtgggtgggtggccgtggggccgtttgttttttctgctgtcggctcgtttggcggcggccctctgtcccctttcagtgttggccttttttttagcgcttgcctttgttgcgtggccgcggtgccctccgttcttgccctgtcggcgcccctgctatatcctcttgccgccgggggtttcaaagtgccggcgcggcctttcccgtaacacgcggtccctctctgcgtcccgccgtcgcgcgtctggttcggtccccgtcacactcgcccgcggccctcgtctccctttctcccccgtcctgtggcccccgccaccgttttctctcgcgccggcgcgccttggctccgtctcgcgtggcgggcgcgctcgctgcgcgccttcatcttgtgcctcgtcctcgggccgcgttcctccgttcgtctccctggccggcgtgcggtcggtgggttctcgttgtttcgcgcctccgctgttggcctttgggaccgcgccgcgcctcttctgtcacgtacgcgtcgcgcgccctctcccgcgccttgtatgttcgtcttccgttctgtagcgcgctgcgccccggctcgcgcgttgtgtctgttcctggtatggctgtcgtgacgcgcggcgagcctctgtcggtggagctgtgtgcgccgattaagtggcgtccccggcttgtcggctcgtcgtgcgctcgtcgcgcccacttcgccggagctctgtgtggcagtgggatgcatctcgtcgttccgtcagtcctacgtgtctg

SEQ ID NO: 8301 - DNA, 1263 bp, Homo sapiens
  misc_feature (1)...(1263): n = A,T,C or G
gcgacttctccgccccgctcttcgtatttctttgacgccaaacacccaattccacccgccattttcctgtattatattgtctcgcctgctctcgatatgaaatcgccactcctcaatatgaccccgataccgcgngagacagtggtatatatatcttctatttaacgacgtatctccgatgtatattgattatgagcgcatacctgtctacgcgcactcgcgggtataatattatatattgacacgtcnctgacgaatcacttgtggcatagctggcatgctgataatgtatgatcgcgcctagtctcctcctccgttaganagtaatgagactccagtatgattacggagtagagtagtcacgactttcggtcgtggtgtagctggcgtagtgattcgtatatatgtgcgatagatatgtggtgctgattttcactcacgtntgtcgcggttgttagctggactgctcctctactagcccacttcttcatatgatgcggcggttagttgtacggtagagaagagctgcagctttgcatctgcaaacgtagagcagcgcgctatgtacgctcgctaactatccttgtaccttaccgcattaccgattgtctgcagactccgtgcgtcgtaatcacgtttatcgatcgttttttgatctgcggccggttcggcgcgccgcaaaacgaatcgaggtcctcgtctcgttattctctagtcgtgacatcttctattgcgtgtgggctttgtatcacccttatcgtttttccgtttcacctgttttacggcatagtgatcgtggtgcgatcagtcggctgccatcttctgtctgccacatctcctttacgacgtacacttgtgtgtttgtctgttcccgccattttcgcaccatctatatatctactgcgctctcgatgtcgantgtgtacgtagtatagcactgcgtaacgagcgtcgccgttaactagcgatgttacgcgaagtcgaccgctgattggtttagtgtgtcggtgcggattcgcttgcgcatctctcgaatctcagtgtagtatgattattcgctagacacgcgcgtcgtcgttgtgtgtcttatataatgtgatatcgatccgcactgtgtgcttcttcacgactctatattatttatgcattgagacgtgtgtgactgccgcatagtagngtattgtaagccgatgccgttgacgtacgaacgtgacattagcacgtggacgtgaactaggtacgtatgatcgtagactgatcggt

SEQ ID NO: 8302 - DNA, 567 bp, Homo sapiens
  misc_feature (1)...(567): n = A,T,C or G
tcagtcaactaaaatgtaaatacatagatgtatatgcatacactacacacacacattgaaagctaaaaacttttaaccaagtatccttgattttttngagtccttgattaatgaaatatcctatacctgctgaattcaacttaatagttcatctatgcaaaaataattggttgatgctttctctaaatgttctgcaaagagctatgacaccagaggtctcagattctttacctgaggataaaaggatcctcagggagtctataattttactaccatataagacgaaaaaaaaacttgcattaacaagtaatgacattctttaaaattaataaatattttatcagtgttcaatacaacatttaatcctaaagaaattgtactacttccctgttttaaaaaattatatacaatatacatttagaatcttaaaatctcctccttatagataccttctttctatacctattgaaggccaattgataaatcattcaagaatcttctgttatccttttaaataaaaaaaatcagcacaataaatcaacatttaagacaaaaaaaaaaaaaaaa

SEQ ID NO: 8303 - DNA, 1244 bp, Homo sapiens
  misc_feature (1)...(1244): n = A,T,C or G
cgcgtctccctgccccgccggttttttttcttcttcacgatttctctcttcccccccccattgcccctgttttgtgtgatcgctacgcgcgtgatactagacgcgcagcacccacaccctcgcgcgggcgcgcgtcaggtgtgggaattttgtcaacagtggagtgcggggactcctggacatttagcgggtgggtgcgtgcgtcgctgcttcgccgtgacnagatatgtgatccgcacgccctattatgctcggtgatggtatgcggcacaagtctgttactcgctgttcacaccacgtgcggtagttttgttaaggaatattaatttgccagtggcccacgcagccgacgcaccgggaggtcccgaggagcggcgtatgtaagttagttatttcgccgatccgcgctcgcgcgtcattctcacgatctgatcctggagagagtacggggaagagttatcaacacgcttatccaccgtatgtcgagcggtgaaccgctcgtcggcttaagcaacagtatatctgaccgaggagtcgtcggagtgcgccgcgtcgtacgccagtactacgcggtgatatcagctatttcgggtgtgagcgcggccgctccgaggtcgacgccgacaacgcatatcgcgtctcgcggccggaatctgccatacgtagcatctactgtgccgtagcttctttctcatcttagtccgagttattgtgatcgctcgctcggcttgttatgatcttgaatatggatctacgcaacgattccgggggatgcgggcgatggcgcagttcgcggttagtgtaacgctattcgaccgactagcagtcgcgctatattcgatctggacactgacgagagagtcctcgaggtactgggcaggcatgtatatcgttcgtttgacgtgctctgtcgcctattcagccgtagctcggcgtgatccaactatactncggatgatatcgacgccgcgatgcaccatcgccctntgtcgcgtgtattggttatacataagtggtcgcggacgtaccctcgtgcaccacacgtataggtgtaggtagaatgtagacaccagcgcgagtctggcggtggccgcattcaactagagtcgtatgtggtattgtcgtcgagctcagcgcatatacactgcagtcgtcaggtagcgtatactgcgacatatatggtgtgtcatgtgttgcgccactatactgtgacatactcgatgtcagcacagtacactgctcgg

SEQ ID NO: 8304 - DNA, 1231 bp, Homo sapiens
  misc_feature (1)...(1231): n = A,T,C or G
aatgaaaagnngggagganaaaggagggnnacaaagtnnanaaggnnnatgaagtnaaagannnanntagnnnnnaagncnnnnnnngcggnaagtagcnaaagaggagaggacagggngatagaaattnaagagagagcgcacaggggtagaaagtggaaagaaggagcaccagagaaaagggtagaggaaacagagccatgtaggggcattatcacagatcgaacatgctagagcgtacctccttcggtgcttgctcctagacgctcgtctcctcctcgttgttctcgacgcgacagcgcgcaaagagccagcgctgtaacggaggagcaacgctcagtgatagtccgagtatacctccaccaccgtccgtaaggatgaacgggtacgcacgctcggtcgagtgcgccgacgcgtgattcagtgatcacgacacttaagcgtgcgtgcggaggtagtgatgtgcccncgagagatcgcgcgcacagacagatagagtgaggagacaagcacgaagggaggggaattgtagaactattcagaagattaagtgtgaccacgaatcgcccaccgtcacggtcatggcagaagtgagacgttgctcgaagatgtccccagcacgctccatgggcagagggctgntntaagaagacggattaanttcaatggcgttgacagagctctccttcgggatggctgtgtagcgcgttcgtcacacggtactgagatgtgtgatgcggcagaacgggattgtcgtataaagagatacgagtgttacgaagacaggaacgatgttattaaatatattagtggctgtatgtagtcatgatgagggggatgagtgaatagatactactagttgtcgtacgggagagatcattgatgattcacgcctcgagtcaagttggcaccacgagaatcgtctcgagtaggagcaaggagcgatctcttgatttgatacagatttgaagtgggcacgtcgaggagtatntntcaaagtgagagtaatatacaatagcgtgtcgaccttcctagtatcacacatacgtacgcgtatntccacgaagagacgtccacacagcattagctcntctgtgaggtgctgcgcgcggcgtgataccgcgtggtgagtccncgagatgcgagcgagtgcatccgtgangacacgcgatgagaatggctgtgagcgataattatgcagtcaacacaacacacgtataacgcctatatg

SEQ ID NO: 8305 - DNA, 617 bp, Homo sapiens
ctcaaactcttcctttaatcaatagattgaataaaactggaaccattagatatccctgcttcccaggattagtgatggatgactctggccagatgccatcaacactaacttgaccagtcatttcatcatgaaactttcaagctgttggtaaacttctctggcaaatcaactttattgcagttgtcagagcagagattctctgctgtcagcaaaagttatggtagattaataatcacaacattggcagctgaagagatgtaagatggtattactagaactatgtaacatatccctaaaaaaatctaaaggtgagccattcttgattttccaaaatgattaaaatgaatgacatatacttatcatttaatatgattcagcaaatatttaacgaggacacttcaggaaataagatgagtaggagctttatcctcaggtagcttacaatctcaactttgaaggaaatagaatgcaaacaattatgaggttgatgaatagtaattgccataattggtttttgcaattcttgtaatgaaagtcattccgagggtttataattaaaaatttgacaactagacagtcagaaaaaaaaaaaaaaagaaaagaaaaaaaaaaaaaaa

SEQ ID NO: 8306 - DNA, 786 bp, Homo sapiens
atgatgtttcatccagcctgagttcaggagtgaagtcaatgttgagaagagactccagctaacctgtggtgggcacgtaatgtgagctagaaatgacatttgattatatcattttaagattttatggttgtttatattgcaaattgattttaacttatatagaaattggactcaggaaaggagggaggggatagtgttaagaaaagcaaaaccctacagttgtggcatggattcagtggatcatgaaggtgtcaagtaccctttagaaaaggctgaaatgggaatgataacaatccatattaggccatgaggaaacagctgggaaactgttaccagcagtaactaggaaataatactgtatacccaacacactcagatgtcagaaaaaagaatgctagttcttttgctggtatctgtttatgccaaagtatggcaaggtattgcactctgtcatagtgacacatagctccagatgatggctgcaccgtgagcccccatcctgtagtgagaacacatagagaagatttcacaaccaatacacaacagacaagtgatatgaacaaagtgaacttcagtgtactcatccaaagataatatttcaaggtgtgcctctgtggaattacctatattacttgtctgacattcgacctcaaacttagaaaataattgctgaatttgacagcatgaataaaggagaattgagagactatgaatcaggtagagttaaaagaggcaactgcttctcaactgccagtaataaaattacgaactgaaaaaaaaaaaaaa

SEQ ID NO: 8307 - DNA, 778 bp, Homo sapiens
gcagatttttaaaaattttagtttcatttataaaattatgaaagttcccaattttgatagaaagagctggtggaggctgggttaaagttacggaagttagaagattttttgttccatgactctgatagctcatatgatctatctaggtttttgtcttaaaaagcctatagttaaaagttggtacctaaactttctattcatgcactatataaatgagttctgaaatttagcccttttacatccattcaaatgatggtcaaatctataattctagccctattatcaggctattttttttctgttagccttatagaggaacacttaacaaacaaaattcaacgatatttattataagtttgatactttttgacagatgtatacagtcatgtaatcatatcagcaaaattatgaaatagaatatttccactaccaaaagtgttcaggcctgtctcttggcattcaagtccctttcgtaataccttgaccacttattttcagtctctcactatagtttttcttctctagaataaaaatggaattatacagtatgtatgtctttttcaaatacctgtcctttttcatttagcattgtacttttgagatacattcatattgttgatatgtcagtaatccacttctttatattgcagagtttagttccattggttcgataaaacataatttaataatgcacaaatttacacacatttagtgtgtttccagttcatgcttattataaataaagttgatataattgtgtggaaaaaaaaaaaaaaaa

SEQ ID NO: 8308 - DNA, 780 bp, Homo sapiens
attatgttaatctgtaggtaggagttccgttagccaagataatctcttacagaccagtttgtggcaaaggctaattctgtctcaaaaaaaacgggacagaaaatttcgcatggcatattgtggaaagtcttcttatacagaagatgtttaatcaatggcagaaggaagaagaaaccaatcaatttctcgctagaaaatgtgtccaccataatttcagccaaggcgctactgatccttttgattgagtaccgtgtactttctcaccactttgaccattgcagtgataatttttccttcaagtttaactaaaggacatttattttataactcaaacacaatagtgaataagtgtttaatgtcatagctcagggaaagcctgatttttgagggtgtttctacaaatatccatgccaattcacactataaaagggggcttaagtttaattttgcaagatgagaaatttctggagatgtctttcacaacgttgtggatatacttaatactactaaactgtacatttaaaatcattaagatagtagtaattttatcttgtgttttttgccgcaacaaaaacagtggcaatctttaaaaaggtgggggcagtgctcaaggtccttgaactactacatggcttttattgaaaaaattgttgcaagaaaaattagccaatacttttgctaaacatatactaatttctgtaaaaagtatctttaatatatggttacaaataaaaatcctagtgtatacacctgtgaaacatcaaaaaaaaaaaaaaaaaa

SEQ ID NO: 8309 - DNA, 784 bp, Homo sapiens
agtctgtgagacagtttgtattctcatcaagaaagggtatcttttttggttttagataatggggaaggttttattataaattaatcagctctgaaggttttgcaccttgagcctcaactttaatgacctcatattatcccagttgctctttggcactgattaggcaccactggaaaaactggcatcatggtggaatatgatgttccataagaaaaaacttccaaatagtcatcattttgctgcacacattggcccactaattaacgccacagtgacaccagaatatgattgtcttgtactcaagttgtcaacataatgtttttgtgttatttttagggctatttcaaggctgtaaaagtaaccctgaaataatttcataatgtctacagtattacaattgcatagttttctatttttgttaaagaatattagtattttactgacccatattttagaccaattcctagattccttggattttaatacgatggtctttaatacaggatgattaaaataggtaaaataaatgcaaataagtatttttctttcccattattgatatgcgtagctcatgaaggattcacataagcatggaaaatatactgaaatattattaagattttgttgtctccatattgaaaatagcaacctgattgacaggatttaaggaggctttggcggtgaaatgtaggtttttcactggaatacagataaaatattatattgatatattattatttgtataataaaccacagaaaactgtaaaaaaaaaaaaaaaaaaaa

SEQ ID NO: 8310 - DNA, 898 bp, Homo sapiens
aacccgcaatttataaatactgaatgcctattccgataaaatggcccagactattatggagagcgttttaccacaagtaatgtctccggccgaatgccccgttatgggacacaaaagttaaaactacactatttctcaaaccaaaaacggttgccaaaatgactgaagtgagagaagcacgaaagtccgtggaaatgatccctcggtttcaataaacagtaaaatgacaaagtgtccaatgaaataccaacttgaaatatttgtccaacaatgacaaaatcagggaacttctcaataagaaatgatgaccctgtggtcagcaaattttattaataaaagagctaattttgcttaccaaaaattttgaataatacagagtgaataaattttaccatggaaaagtaagggtgaatttcaagctatgaaaccaaactcccttcaaatagccttaaaaacgaaataattatctgacatttgttgtaaatcaggctatagcctttagcttcacagcatggtattttaaggttcttaattagaaaaaataattaaatgaatctgtaaaacatggagatagaaactttagatatgccagagattcaaggatactttcaatatgttgccagatttcaactatatgactatttacaatgttaagtacaggattgaatatgcttgtctgggctgccttaacaaattaccataacgtgagtggcttaaacaacagacatttctcagttctggaggctgaggtccaggatcaaggtgctggcagatccagtggctggtgaggatctacttcctggtttgcagatggtaaggttagtgaatccgacacctggtcccttgttcccacaaaaagccaaaaaaccacactaaagtcaaacataacaaaacttta

SEQ ID NO: 8311 - DNA, 790 bp, Homo sapiens
cagggatcggacaaaacccagtattatggtggtgattctcccgtcaatttatctatagattcaagacaatccttatgttaaagggccttttctttgtttttgttttgcataaaaatttgcaagcaaattgacctttaaatgtatatgaacatttagagatctagaatagtctaaaaaacttgaaagaatacaaaatgtgaagcggtatgcttcccattttcaaacttattataaagccacggtgattgaggcaatgtggtattggcatagggatgggcatatagctttgtgaacagaattaaaaattcagaaacaaatcattatacttcatcataaacaattgactattgatcaaagtgccaaggcaattcaattgagaaagggcaatcttttcagcaaatgattataagataatttgatatccacatgcaaatgatgaatttagacccttactttatatcgcatcaaaaatgagctcaaaatggattataagtctgggtgctatggctcatgcctataatcccagcacttcaggaggccaaggtgggcagatcacttgaggccaggaattcaaaaccagcctggccaacacggcgaaacccaaagtctactaaaaatacaaaaattagctgggcgtgttggcatgcgcctgtcatcgcaggtactggggaggctgaggcaggagaattgcttgaacccaggaggaggaggttgcagtgagctgagattgtaccactacacttcagcctgggcaacagagcaagattccatcccagaaaaaaaaaaaaaa

SEQ ID NO: 8312 - DNA, 775 bp, Homo sapiens
cgggcgggtgcactatgagctatcaataccttagggagtaaatatattttttgggaggcgatggtgggatgggtgtaattagtagcatgcaatatgtttccgttaactatataagtttttttggtatgacaaggtctcggttagtaccccagtgttgtagtccagtggctcaatctctgcttaattgagctagggctttggaggatcggttcatttaggggaatatggtatgcacgctctatgggatccgattacactttacaagataacaaaattctgtcatttgtgttgacatcaatagacgtacaggccattatgttaattccaatgagccaggcgcagaaagccacatcctgcatgatctgacctacatgtgcaatctataaaacctgatttcaatggaaacagagagtaaaatgtagttaaacagtggctggggatcacgttggggatatgtttgtcaatagactcaaaattttagatagacagtagaaataagttcaagagatttattgtacaacatgatgactataattaaaaacaatgtattgtgttactggaaactagtaaaatagtggattataagggttctcataaaaaaataagtatgtaaggaaatgcatatgttaattagcttgatctagccattccacaatgtatacatatttcaaaattacatgttgtataggatgaatatatatgattttgtcaattaaataaatataagagctaaaatgtataataaaaagactgtgtataaaaaaaaaaaaaaaaa

SEQ ID NO: 8313 - DNA, 910 bp, Homo sapiens
attatgtaactttcactgcgatggagtgttgtgattatactaggggggtgggtatgctaagacttaagaagggtaggtggtcctccctcgcttttctatgatgtgggtaggctggggtaagatcaaattatcgaactacgagaagatcatagaagtagaagtggaaggggaatcaatgggggagaggtcgggggtaggggccttcagttggagtgtctatattccccattgcgccgggtttgtaagacgaagggcacgtaggataaaaaggctgagagtggtttaacaaaactatgataatgtattcaaaagcgaggacaggtgagataaaatttacaaggtgtataaaggcagcagcgaacgtagaagaagtagagtaaggtaaaagagcgtccgatatgaagtgggccatttgtgggaccgagccattgtcaagtggtaggaatgggcaattaaagaaccgaggtggtatggggccctcgcgagaatgattcataacatttgtgtgaggtacatggaatcgagaacatggcaggaaagtcagagatttattccccatggtcagggtattgagccatagtatggagggtcttagaatcgtcagatgagttgatcgaaaccatcactatgtacatcatgggtgtgcgagatggaagtgacagctctatttcaggcaagcatatcgagggtcagattatgcttggcagcagctatcattatgagattcaggctgaagcagcagcaacaccctagggcatgtctcctgttaatctaacttgagttgcttttcttatctcactctttatgggatgggctttgagtggaatagcctgcttgccaggatatcacctggtacctggtccccactaacgtcttctccatagttttaaattgacaatacctgtaatta

SEQ ID NO: 8314 - DNA, 269 bp, Homo sapiens
  misc_feature (1)...(269): n = A,T,C or G
acctgcaccagaatctttgagagaagtttctgatgcatttggcaacaaggggaagagcttcaactttatcagagggacaaactcttcagaaagaatgccttttgtatgaaattttatattcttaaaacttcatcatcaaatcaattaaaacttatttacaaaaggaaaaaaaagaaaaaaaatggcctcgtggactcnagcggtggaggttctgcgagcagcgccgctcttcttgtttcttgtatactagtatcttataagtagaggga

SEQ ID NO: 8315 - DNA, 892 bp, Homo sapiens
  misc_feature (1)...(892): n = A,T,C or G
atgtggttagatatagtttgtgtagtgattttgtagtgggggagtatatttatgtatatttatggggtggtttattggtgtgtggggttagatgagattggtttaattgatattgtgtttagggtattttgtatttagggttgtggatatttatttgatggatattgtgtgagtgggtgtgggtggttattgtatgtattttgattgtattttatatggatagtttgttttttgatgtcgagaggatatattgtggtggttatttgtagttatatatatgtttttaggatttgttttgaggtaaggggtgatgatgtggagtattttgaattgaaaggttggaggttgtagatgtttggtgaagatataagtgggggataagtggggagggagaagggggtgtgggtggatggtttgtgggagggtttttttgtgtgtaaaattgtggnaggatacagttggaggtttctggtggataataggtaatttgtttgtttgtgaatagtggatgttttttgtgggattgtttgtggttgctgagtaatataatgtgaatatgggttggagggatattgtgtggtgtgatgtgtattgtatggtcgtataaggaggtgtgcagtgagagatttgtcaagttttttttttaaacagggaaggactgtggtattgtttatgttctgtgtgtattggaaagaagatttcagcagtgatgtgaccagatggatatcattttagagttagtgagaccaggcaattattgttgacacgattgagtccccctgaatcagaggagcagagatccactcgcactttgagtaaagaccagtgtatctttggattttctcgtttgtaagccaataaactccattcactgtttaaaaaaaaaaaaaaa

SEQ ID NO: 8316 - DNA, 686 bp, Homo sapiens
  misc_feature (1)...(686): n = A,T,C or G
acttagggctgttgtgtaggaaaggaatcgaattacaaactcatgatagcgcgaccggagggaaatagtgatttataaaaaatagaatccaaccacacaacatagtagcggaaagtgttcacccagagggggtncgggtgaagaggacaggaagtatgtcgagctattgacagcctttataatacggtcattttagccgtggagcgttttaggaaggaaagacaaacgagggggggatatgtggttcgggcacccggactcggcgaggggggaaaacaacgaaaaaaaaaaaatagtactaagaagaatggagaaacaacaaggatggtgtaggcgattacgcacgtaattatgaaatattaaggaggcagcagaacatgtaggaaataaaataatatatgacaaagctgaggggacaggtgatttatggttaaagtaatttaatgcgacaagaagagacggtctatttccacgctataaagagatggtgaaatgagtcaataatatgtgtaaaattcaggagactggcgagtgtggatgaggcgattacagtcagacaaaggaggggaggaggaaaaacaaaccaaagaacaaggcaaaacaacaagatgccaagaagcatatgaggaaggtaggttgtacaatactattaacaggcgtgataacatattgttaggttaccgggt

SEQ ID NO: 8317 - DNA, 1133 bp, Homo sapiens
  misc_feature (1)...(1133): n = A,T,C or G
actgccgcttttcccttggggtggtccgcccggtgtccctctctccgctcgtgcgtcatcacactcttgttcctctgtgttgttgggtcgttgtgcccttgtttgtgcgttctgtgtttccccttcccacgtttggcccgtagctggggggcnggcgctggtcgtgtcgcgtctcgcccaccgtgcgcggggtcgtgcgtgcccggtgttgtgtgtgttcccttctgtgcgggtgttcccgctgtcgcgctctgtgcccccccccgcgcgcacgtgggggccgcccccgggccttccgggcgcccttgccggcccccccttgtgtccctcccaccgtctccggtttgtggttgtgtgtgctcccccgcggggcctctccatcgtggggccgggccagccggtggccccttgggccccctcccttgtctgttgtgttctcctctgtccaccccttggttggttcgtgtccatgtcctgtcgctcctcctgtccgggccgccccgtcgtgttggtggggcccttccccgccccccctggcgtggtcccgggtgctttgtccccatcggttcgtgtgtggggggtcggcccagctccgcccgggccgtgggcttgcttcccgtccgtggttcaggccctgcccatgggttttttgtgcccagcctctcccccgcctttgcgggccccccggtgttgttgttcccttccccggtcccgaaagcaccgcgcgtgttccccccgcgttccgcgttgcgccgcgcgcccgctctcccgtgcgtgcctccggcgcctcctcccggcggtcccccgttgtgtgcgccccctttggtcggcgccgccacccctcctgcctcctgcgcgcctgccgcggcgcttgtnttgcccggtgcctggccntggtggtgtgtgtggtgtgtttgtgccgccgccgcntctggtntcctccctcgtccccgccctcgccgccccgcgcctggtgtcccccccccccgcctgtgtcgccgtggtgcgctcngccctccntgggctgcntccctgttggttagcctcgtgcgcttcctcttgttcccccccttcgaggctcccccgcccctcgctgtcccgtttcctccacccagtctcctctgtcagcgtgc

SEQ ID NO: 8318 - DNA, 764 bp, Homo sapiens
tcattccactagcagccactctcttcaggctttaatttagcaggttctcacaagaaatagggaaaggcaacttgcaatatttccagtttcgagctctgttgaggtttattttattgtaaatcatcacacattttatttttttcatttactagctttgtgacctgggacaagttgcttaacctgagtgtgtcctggttttctcatccataagtaggaataatagtccctacctcaagtggctattgatagaatatggtaacatgtaatgtcctcatcagagtgactctcaatgaagatcaggtagtcttgtctgtgacatatatgagcctcggcagcaagcttgtcttactgcttactgtgaaaggatgccaacacctggatgtaaacgctgcagaagacagatccattagatagccatgaaagcagatctggactatagacaaaggattctccagaaactgcaaggagacagaacacagagatctgtaccttagctatcttaaaggttactgctgctgtgttaaaaaaaaatccttccggtggggccatatgaagtatccactctcaaggcatccttccccaacgaaagcatattcatagtcagggcttcttggcagtgagacgcacaccatgagtcacactgggaggtcagtgacgaaaccattattcccttcagtgtcatccccaccccaccacaattccacttttgatttgacacgttatatgcttaaaacatctggaagtaaatcatcatcgaagatact

SEQ ID NO: 8319 - DNA, 888 bp, Homo sapiens
  misc_feature (1)...(888): n = A,T,C or G
aagcgaaataccgatagcgtgtgcaacaaggggtaaaacagcgacctcttaacgcttacttacaatggaatcataaaggcgaagaccaaggttcaggtatagaggaagtagggtgcccttgagacgaggcgattaggatttaggttccgctctcggtataccttagtccctnatcagttaattgggtggttcccgccgaaagtgttgtggacaggatggtccggtaagagagccattctaactggagcattgtgaaatgtggaacagaacagcggggaccagtggttttaacagaaggtgtgaggaagtgagagccattggaggccctctttacaagtattattaacaagctagctggaatccagaagggtttttcgatcattagagagaagcccaggaaaattacaaggcctttggaagtgtgcttaaacttccgtaagttttcagggtgtcataaattgcgttctgggcaagaacctttcccagtattcacaatactgtactgcccaaaagactttagtgcatttgtgtttttcgcagttgagaagctgatatattcaaggaacagtactgactggccatccgggctcttaggtgtaactcatttattcacctaatatgtatcaaggctactccatccctggtattgtggagatacagcaatgagtcagacagtttgaagtccttgtcgtcagagagcttacagtctcatgaagaacaatcatgtcaatagttcaatccagtaggagaagtgctctgtcactactgaggagaagcaatagcagaagctctgctgagcgatcctttctccaattttacctggtaccagggggaccacaaagggcgagggaggacgatatgaaatctttttcctatcacaacttatgg

SEQ ID NO: 8320 - DNA, 351 bp, Homo sapiens
tcatttcagactcctgggttacccacacggatcgaaggtcgcagtgctctttgtttcacagccactgctcgagcaataaaagtgtgctagatatggttctatatatctccctaaatagtagaatatctaggcgccacaatgcatgagtattgctctagtgtatatcatggtattcataaagtagactttaaatattcaatgttctctatttagtagatagcaatagaatgcagtcatgtgttcgaataatccctggcttcatatgatcaatatgtcagcaatacgatcactgagttaactataacatatagtaaatgtgaaactctctgaaccccaaaaaaaaaaaaaaaa

SEQ ID NO: 8321 - DNA, 468 bp, Homo sapiens
caagcatctgaaatgtccaaacaaagggatgctcatatatgtgatccaagtgcagtgctggatgattaggcaatcaggtctctatagagtaagtagatgatcaagggcaaagaagtacaggccatgtagcccttgcaacgaggcataatgttgtctcacttagtatggagataagtctatttcacagactcggtaaccaacgatcaaggaaggaaacatgttagcctgtaaaatccagatgtcagaacagataggttttggagtgtattggtcatgaaggagtgatataacattgtcaaaagcattttgtgtatctagtgagataatcacatgaattttgccgtttatcctattaaacgcgtgagttgagagaagaaccacgctggttcttcatttgaggtaccttaggcacgataaagaaaaatgtgatataaagcagttcttatgtggcaaaaaaaaaaaaaaaaa

SEQ ID NO: 8322 - DNA, 1671 bp, Homo sapiens
  misc_feature (1)...(1671): n = A,T,C or G
attgatcgtaagagtaatancagtctatcgaccgttcatgcgaatagtaagtcagcgtgtattatacacatgtaanggcgagagacgcaagtcatattatctacgtactagcatctatngtctggacttctgatgtcatctctgcgtctccgttcgtcttatcnggcgcccgattgagtcgcgcgcgcacccagctgcgtgtctgntcggtntgtgctgtatgctgtctatgagagatacgaaangtattatatacgacacatncacgcacctgttcactgaatacgtgagctctcacgccgtgcnctgngcgggctgcgtcgttgatgcgatcgatnttgttatgtgagcgtagcgatgggtgcggagtgtatgttgtatagtatatgtctgtccgtcacgatgantggccggagggattgtagtgacacgccgctcgcgtgctaacgcagngtagttcaagtctacgacagttgctgtgcacaagagtaatacgagcagcacgcacacactatngtctgcagacatggcagcaggatactagtangcagcattcagtcgantatgtgagatagacgtaattaatagttaggacgatagtgtatgagactactacataagntgtcacacgtgcgcccagccgcgcggagagcgtaatctattgacgtcacactgatggaagtatgatagacggaccggtactgngacagagcgtgtatatacgagaagatatgagacacacacacataatacaagttatctatgagatatcgcacgccactgatcgaatcttanatgtagctatatagttaggtaatggagagtcacgaccccacatctcgtaacacagtagcttcggatagtggatgtgataacgtgtacgtcacgcagagacgtgttcacgaggtcatacacgaggatgccgattgagaatgtcttatgttgttgtggacgcgacaatgctactgtgtttcgcagcgcgatgtgaagtcatcgtaaccagagtagtataggcggtagggagatcagatatcgcgagcaggcgagatatggtggtgacgacacaagntggtgcagtagcgcaccggcgcgcagcagaatgtgtcaggaaaggagtgttctnaacggttgtttttgcgcggtgtntagcgccagagtagtactgtgtcgcagccaccgtagacaaatgtgtagcgtatgattaaactcacaaatgatgtaattgactatcatctgaagagcatcgatatgtgtatgntngtgctataggcaccttctcacttcacgcccacgaagtgtctcatagtgtcactggtagtacgcgtgctcggcaatcagtaatctgtagcagcgttcgtgtgttgtcattgtctatgatgatggttgctgcnangtgtgtgctcagtgcgtgtgntggtgtactgacacacattagatgtactcaacaaagtattgatgatacgacgtcaggtctgacgatcggagccacgttggatgcgnctgctcgcgtacctgatcacgcggtctggatggttgtctggtgaacnatgactcagtgagactacgccaccatggattcatccaccacacgtagtgagtgcgcgcngcgctcgcgcctcgtagtacatgtaatgatagagcacaacactatcactcagtatcatagtgaga

SEQ ID NO: 8323 - DNA, 209 bp, Homo sapiens
gccagcatgatactattattcccccatcttctaaactgacagtgagggagagtacatttgaaaggactgttcaactcaccgtcattcgaagattcgcaccacagccgcatttttccaatttcagggcatataatctgctttcctggacttttcaaaaacaaattgtaagtggatggataaatataatggctgaaaaaaaaaaaaaaaaa

SEQ ID NO: 8324 - DNA, 977 bp, Homo sapiens
  misc_feature (1)...(977): n = A,T,C or G
aattaacattatagcaatctacggcgagcaacactcatcgatccctaccaatagagtagatatgaggtgacagaacgagtacagacaagaagcaaaagnaatgctctaacggagacacgagtgggaggagacagggagacataggatatatttgaaacgactactacatatgggacactatgctacagaccgactaggatacacgaaggtgcaaggtgtaaagcaatcaccacgatatatactagtaagacacaccaaggcagcggaacgtgaatatagagcagtgtgatgcaatacacacacagcgagactgtaggatngtccaagatacgtacagagacggagagtacacgagatacgtccacatagtggaagcacacaccaccaaatccatcgcacataagatgtgggggcgtgaccgcgaaggataagaagaaacaacggcggagtctttgtagggtgagactcatgttcaccactgtgagcaagcaaaatagagtacatagctttgttaaaatcgctgacagaaggctcgcacggagtggccccaactcaatacctatataagtgctcaagcatctctctaataaaggagcaagtagacgcatattagggccccatatattaagcagacaacaagaacgagactcaaagatatgaaaagcagaaggaaaaaatgggtaaacgggtaggtgggaggaaggcacagacccaaaaccgaaggagcgtaaagcacgactgaaaacccagtaagacaaagggcaatgaggcggggcggcaggaactattccacaggcacaagataagaaactctaatcttcgccgggcaacatattttatacgaataacatgaaagtgggacactaagatcacaggatcctcttttgtaggtcggcccttcccaactatcgttattttatacgttataaatactggagccggatgagacgaatgtctgacaggtatcattactagca

SEQ ID NO: 8325 - DNA, 873 bp, Homo sapiens
tccaaggtagaaagcgagccaaaaattgttccatgttgcctgtatataaaaaaagtgggtgaccttccccttggttttgggttaaaacaaaccaagatattgctttatatagcccttataggttaaataaagccaggttttctgtcttttaaaacgcctccaatcttttaacatacatgagtcagaaagtgtctgaagaatcctgcacgcttattcgttgccaataccgaaaatcaaaaggttgcgtgtgggttactgttacaacgtgtgtacagaagggatgctcactatgcccaccattcaccgagtgtttcgtgtatgttttgtagctcatagggatattctagttgtgagcatatcactcacagtggtttaacaatgtgaataacagtccgcgaatagaacaggaagctgcatttttctaccacggtgcttaaataaagtgcatataaccatcataggtattccgcgtcatggcttatgaggatgcatgtaacgctatttgaactctaaaagacctgcataattgccctttcactgagctccagctgggagtatcatcacaccgccggtcatcatcaagtttattttagatggccaataaagcgccactatccatgtcattttgtccaagaaacagggtatccgagctatgaatcgaataatccccaaatagttctaaaactgactactagaggcacagtgttctttgcagaggtcatgctacaactccagcgtctatttaaagcactatgctccaacatgtggcgtttttcatgatattccatggcgagttagggagcgtcacactcgacttgtccaatttcttattgttagtgagttgtgataacatataatgagttgtgttttgtt

SEQ ID NO: 8326 - DNA, 1274 bp, Homo sapiens
  misc_feature (1)...(1274): n = A,T,C or G
ccactgcgcgtcanactatgcctgcctgtcgacacactgataacctgncctaacgataccgtcaggcagtgcgtcactctcacagcgctccctgctgttgcgctacactactctctatctcgtatatgcctgacatgggcgcagcctgagcataccacacctcctcatcgctgtgttagcccacctaacggagcgacactattgtagatggctgcagtagtctcactaatcgcctcccgacgcggctgaccagcgcgcggtgctgcttgtggcgtacgagcgtctctgcgcctcactgtcaatgcatctacagcgcggcggagcactgtacatctctgcgttaaggatgcacagcgtgctgccacctcgccgactaagcggcacatccacatccagcaatccggcagtggcctcacacccctggtggaagttaatatgatgggcctgggtgtgcagggctttcagcacaacgtctcacactcaagagaggctccaatactctctggcatacactcacgacggcggtgggcggccaggtcctgagtgcctcaaactccacccagagacacatggaacctcttctacggcgtgcaagagactatgtttcaggggccattctcaggtccctatgattaatctcgcaggggggaacccacataattcttgtgcataaagcggacacacaagcccgttctagtcaagtttgtaccggctcacacgaatgcgcgataagtactgcgtgtcatacaaagccaagtataacagaagtgatccagtgtatatcaatcgctctacacaatcaacagagacgaagcagagcgcgcagaataggttaccgccatcgtgctgacagagcctaacagagcangagcacaaagcataagattctacttctacgttacttgattatcgtttatggtatcaagcatactataggattctatctcgatcacacgaccacaaacttggtttcttgacatgagtaccgaggtatgatctagtatataagatgacacgagtagtatattccatacaatatgctatgcttgtgtgtgcgacaatgttcaggaactgacgtgctgcatgttgtatcgtacgtacacttatctaacagtaggctcatccacctccatctagtcgagtgatcagcaacgatagtggaggaatccaatagagacgaatagcaatgcttctgtggtaatagtcctcatcgaatgtcatactatacaacattagctataacactccaggatcactcacataacacacccgaa

SEQ ID NO: 8327 - DNA, 333 bp, Homo sapiens
acagcaacagacagaccattggaaatggctgtgccataagtaaggaaagcttcaaaggttcctgcacctttgcagcacctttaaagactgaagcacgatcttgggccagtttgtgaaggcagattgggtatgggggccaaggtggaccccgtggatggaaacactaagcataccctggggcagagcacctttcttcgacagaaggatgagaaagcagacggaccaagaaaatgacctctgggaatcaaacatgggctttataactaacttcaggctgaagttaaaataaacttaataaattctccaccttctctgccaaaaaaaaaaaaaaaa

SEQ ID NO: 8328 - DNA, 116 bp, Homo sapiens
cttgtcaggacgatgtgttctgtgtctgaagaaatactcccttatataaatcaagttggaaggatggagaaggaaggaacaaatgtgggaataaatgcgtggcctcgttggcctca

SEQ ID NO: 8329 - DNA, 457 bp, Homo sapiens
atgcattaataacaatagcctcacctgagcaccaacttctacacctgcctgatcatatttaaagaagcaaaaatatattgcgattgggggtgtccaataaataccaactaatggcatcaggcatgtgcatatctatataaatatcttactctgatataaactttctacactcgccactatatactcacaatgtagatctcacatgccttcttctctctttgatgtataccaacaaggagaggaggatctctacttatattctgtaccacatacacttctgagcacttttagctctctgcgggtggacttaataaggcatctctaaatgtggcaataacacaatcagactcattggcctcaaaggtggagctatggccacgatcccctttaatgacgggtaattgacgatcctccataactgactccctgctcatcagcattcagatgtcgatactga

SEQ ID NO: 8330 - DNA, 1852 bp, Homo sapiens; identical to SEQ ID NO: 7270
  misc_feature (1)...(1852): n = A,T,C or G

SEQ ID NO: 8331 - DNA, 103 bp, Homo sapiens
catgtcaggaggatgtgttctgtgcctgaagaatactcccttatataaatcaagctggaaggatggagatggaaggaataaaggtgtgggctcgttggcctca

SEQ ID NO: 8332 - DNA, 354 bp, Homo sapiens
cattaatcctgcaagggtgtggcttgatcttcccacccatggattacagtaaaaacttgactgcatgtgatcctttgtagttaataacatgatgattgtgttttcacactctcgtgtgagatatgcctccctcaaatcctggcacattacccatctgacattaaaaaaaaacaacaaaaaaaacttactttgctgatattattactgatgattacttataataaaataatcataattagagaaatagctgcaatacaatgagatatgtacttgatcataaacctacattaattaggtcgcagcttgagttgctctcacatagacccaaataaacatatggcctcgttggcctca

SEQ ID NO: 8333 - DNA, 1494 bp, Homo sapiens
  misc_feature (1)...(1494): n = A,T,C or G
catgccaagaacncatagcacgtggtngcaatatagatggtaaaaatggcgcntaccatncncgcagagcatcaanagacngcaacncctgagcatcntccctnggaaatntaacctggcntntggngcgaaaaaagaaacncntctntcaacantgcaagngcaaactcgcncnncgacngctgtggngcaccntctctcactngntngcacactagcaagncgacagtcacacaatgctaaccantngcntgtnggcnctaaaagtcgtcacacagacacacacacacacacacacacacacacacacacacacacacacacacacacacacacacacacacagananacacacacacacacacacacacacacacacacacacacacacacacacacacacacacacacacacacacacacacacacacacacagctcggcctgccccacgcgatngcgtgcccctcnanagcgcgngngtgggaangngagagtgtntngngggtcacgccgctntgtacaccctcttctacanccgcgnacgagngctccaaccagcgacaccgagacacagccacacgacgacaccaccntnatcactcccgactgtgaataacagaacgcgcgaacagatcagacatcgatcgcacgcgccgcagtccggcantcaggcgccgcaccacgcgcaaactgncnacccatatcacacacacacacccgacaagaagaccncgtcacacacaagcacaccanagaggcccgcgcccagaccagacgaacgcacccataccgagcggacctgcacccgccaaccagacaancaccacaaagcaaacaccacaccaaatccagcgcagcgagccctacaacctagagtagagctacctacccaggcgaccatgcacaaccacgcacaggcacaagcaaccgcacaagnacctacatagtctacagtccagccacgccactgcgcaccgcggacacgcgcaaacgcagaggacctcaacgctaccgacgccgacacgcacgtcccacggccaccgtacccagcacacacgcccacgcaacgcaacagagcacaccacgagaancccccacatagcgagccgacagcgacccatcaggacacccgtctcacgcgcgagcacacacacctacgagcgcacgccgagctagcacagnacctacgcccttagagcntcgtcgctccgtcngacgcgcagtgcgccacgcaagnggtgtgcagacncncaccacacggagcnacgcacgcgctcacgcgaccacagatagagcagcgaggatacacgacgccgacangcccacacgcgcgcactancngacgcggccaccacaccggacccagagccgacaccnacgacaccgttataacaaacaatagcacgagcagcgcacacgagcgtagcgctcgcgntacagcggagaagagtagagtagaagcgacgtcatatcagcatagcgtatcacant

SEQ ID NO: 8334 - DNA, 153 bp, Homo sapiens
  misc_feature (1)...(153): n = A,T,C or G
tccctcaaccggcgtgtcgtgtgcctcacgtggcgtcnnccacccactgcccgngctcagtggggtcggggggatgaccacaacancccccnacctactgtgtttctgcttctcccatccattcgccatggcaatcagagggattttttgcaa

SEQ ID NO: 8335 - DNA, 1196 bp, Homo sapiens; identical to SEQ ID NO: 6285
  misc_feature (1)...(1196): n = A,T,C or G

SEQ ID NO: 8336 - DNA, 300 bp, Homo sapiens
gagagggtgggggatagaggaaggggcgggggggggggggggactagtagagaggataccaaagcgggccagtcgagtttaaaactctttttgcgcagtaggaatgactccatgaagatttctcatcatgggggcgggggctagataagacccaaatctccaaactcccagctcttctgtgaaccccatcctgattctctggagtctctgaatcttttatcctcattttcttcccaactgtgcataatggggaatttaaataaaagactggcctcgttggcctcaacagtgggggggggg

SEQ ID NO: 8337 - DNA, 1706 bp, Homo sapiens
  misc_feature (1)...(1706): n = A,T,C or G
gaggctcagaatatcgtctcacacattatccactggctccatctgaactcattaattacatagatcgcgcaggcgcagcccggttctgacacacgcttataccatanatcatacanatattctgtttgtattattatattntttatcttcttctattcctgatggttgctccgacgtaatctagagatagatantgtagtctctggtcaagattgatgacacttaagagcactaaagtatgggctaagtagcncttcgtgtactagagagaagaatagcactcgtcttgatgcgtgtgcgcgtacagcgcgagtgtcacgctgactggacgtagngcacgatagcggcntgcgtgtgttatcatagcagtgacaagcagtggcagtgtngctcgagagagagacgcatatgtgtgcatggtgccgntgtcagtcttcgtcgtccggagcgtgagtggtgcnagtcgctggagtaggtgatcgtgagggcttctggcgtatatgaggttctctccnactctcgcgcgtgcgtccactgttgacgttctccgcagcgcgccaataggaggagctctatggtgtctaagcgtctcgtctgttgcgtgtgcgcgctgtatgttgcttctaccagtatgtatgcgatgtactcttatcgtgtgtgccgctgcggcgactacgtctgtcntaagacgaggagctgcacatgtagtgtgaaatatatagttaccaagtgatacctatgagcacggctcagcgacgagtgagtactngacagtgctgtagtgtgagagcaggtcattataatctatcaacataccatctatacataggacctatagagatgacgcgacgcaccaagtagatcgtagaggtacactgccnctagtcacaaatgttcttgctgctcgttgtgtgtcctcatctaagtgtatatctagatcgcacatacatagaatgggttatctagattcgtctcagttttcaggatgtgcattgtgactgctcgtaggagtgctgaacatacacgaactgatcactgatgacatctgtctatactctcacgattctggcacctcgttcgtgcgcgctccgccgcgtaggcttctgctctnacaacactacatattaccannatgactatcggtagngtcgacgctcnnnanacactgctggaaanagtctgggagcgcgctcnagcgcgaggagatttgcatatcacgactcgtgtacacagtacaaacacgacatatacatctgtatagtgagacatcatgttgcttagatggttgtacgagacatgtggtgaccacagtatactgatcacactctgcgccgcgctcgtcgctagccatgttcttgctcgcccgngcgacgacgccgctgcgctgtacgatgcgactagcgtcggctgtgcgtggctgcggctataggtaaantccgtgactctccgacctatgatgacactactcgcgctgcgcgcgatacagaagaatgtgtgtgcaacacgtgatctagtacgcgatgatgatcatgtgtatgtntacgatgtcgtgngcgnagcagngncggtatactntgcactcagtagtgcgttgtcgtcactcagatgtaggntggatagagagtntacatgtataacagatacantacgtagtacgacaataatacacgactgancntatatatattgtagagaatgcaaggatg

SEQ ID NO: 8338 - DNA, 1786 bp, Homo sapiens; identical to SEQ ID NO: 6288
  misc_feature (1)...(1786): n = A,T,C or G

SEQ ID NO: 8339 - DNA, 1495 bp, Homo sapiens
  misc_feature (1)...(1495): n = A,T,C or G
cacagcggtggacgaggcgcccgcggcgcatcggacgagaagaaaaaaaaccctgtatggtgnactgcnctgcgcaccactttacctgaggtgcgaccagagacgatgtatcgtgcacagctagtccatccttggagagggaagggactgacagtgtgggagcgaaggcgacacggcagctgaccccggagctcacgagtagaaatagtgcagttccgncgcccagtgcataacgctctcattattctagctaagtagtaacgcgcgactgctacattgtgcttcatcccgtcgagttccttctgccccatatagatgcgtataatgttactantacgtcatatccatgactgtacgagaatcaaacataacaacgtacgtagacagcacggcatatcacattagactagtacctcagccattcccagtgtgacgtactccgtacagtgagatataggttcgtgaggtcgttagtgcacacgagtgagcgaggagagagagatgaagacgaagtaagaacaanacgcaganactcactcgatacatgatcacatagacggcttcntcatgntgagtcactgacacgtcgaacaagacagagcnttaggatcgtagtagataatatctcgagcacggattannctagtgtgacttgacgagtaaatactatagacagtgttgaacgcnctctcagagtagatagagatggtggtacgtaagttgctgtagctatagcgacccctttcgccactaagttgtaggaattgacatcgtaagacgcacntcgcccgtgtgcggctgaactagtgtcgctagcgcgtgcganatcatcattcgacatacggcacttcgagtcncgcttatgattcagtgatagccgcntgcgcgtcaccgtcgacatatnctatcgctgcactacgctccgcatacgatgcggacagcaccactcatatacagntctgacacgcacacactcatagtatacacactatcaatatcattacctgatcaacacaggcataccggacggctcccgcagcgatcgtgctgtgtacatggcagtgagtgagaggtgagagcagagagagctccaatacgacaacatacagcgaacacgacgaccgtaatgcagctgtgccatgatcgctactacctaagactaacacagaggagtgcgtcgcgtaccgcgacgcgttctncgcatancgtacacatctgtcgtcgtaccgcatacgacgagagaaagcacaggaacgtgtcatactagggatgagaggtagtgcatgtagantcgctacgagcgacgantcgacgccgccatgagtagacctatacgcagtacttataacacgtatgtgtgagcgaggagtgcgaaggcgcgtgtacacatgtacggacgcactcatcagagcacgcataggatagggctacggagtgtgcaagcagcgctgcagcatcttgtcgccgacgagcgacacgagtgatgtgcgcgtgg

SEQ ID NO: 8340 - DNA, 190 bp, Homo sapiens
ccgctcccccccccacccgcccttaaaatgcgcacccacacaccgacaactgaagcggcatagactcgtagattaaccaccgctacaggcttttaaagaaagagctttttcaccgagccctaaaagtaatgagaatgacgtatgataaagacataaagaaagaaaaagataaaggaaaagctgaaagtgc

SEQ ID NO: 8341 - DNA, 1913 bp, Homo sapiens
  misc_feature (1)...(1913): n = A,T,C or G
aaaaaaatataatttaatattgaaaagagaagtataggaagaaggagacgtttttatgaaaaaaaagaaaaaaaaaagaagaagaaacatattataacatgacataacagaagaagaacaacagactcgaatgtcgagaaaggtatgacagagacgcttgacggctggagcagtagggagaggctattgaaagagaacgctacaactagcactacatatagatatcgacagtcatcgatatagtgccctactactgtgattgacgaacacactacgtatgtgtcacaagctgacatagaagttatacatatgcggtatatatgtgaatgaggatatacatcggcgtaacgtcgtgattatgtagagcacacaatacggacggaaccaaggcgatcggtggacgagacgtacgcgagcggataacaaacaaaacccgagtaagaaattagtggagcaccgacggaggaccacgccgcgcagctcataaggaggcaatcattattcgtgcacggcatcaggtcgtagtggatntctacgtatcgccgttactntacctacatacttnctcgtagatataatacatgatagcgagagagactatgtgataatatgaagcacaccgccacctaccaccacatactcaccccaccaggtacgtcatcacgcgagaatgggggaacagtcgtactagtngagaaacatcacagctacccagcccacaccgattcacagtacgcagtaccgatatacagcctcgacttctccatgcgtatccaacatccgttccgttacgacaccacacaccattcgaccgcaacgccgacgtgcggtcacgaacgcctaatgaatctccacaatcttgnatcacgcatacaaacgagcaccgctaaaccatcaagaatacagcgcgagcgcgcgattccgcctaacacgaagnatctactatccagcattacgcgcaactgagcacgaacagtttacacgccgncacacacgtcagacgttcgtagtacacccgaacggcgcacgcgaatagccgactcgcccgctcgccgcgtgccgcaatataagattatatacagccacaataaatctacacacgcgcgatgtgccacacatgttatgtagacacattatcgcaatgatccaatgactgaaattcaagaccgcgcagcgaaccgcgccgatatgccgacacacacccaanacacccgacaccagttaacccgcagcgcacgcgcgactcgcaacatttattgacaccaccccgcgcgcgcgtccaccctcccgcccattgtcgctcgctcgcgggacgaccacagtaattgaacgcccaccagcgcgttttctacgcgacgctaaaatatgaagctctcccccgattgatctagcagcgatgtcacagtcaccgtaccgcgccgcgtcacgccgcaccgcgntgttcagagacgcacgcgcgttgccgcgcacagcgacgaagacgtcgagtgtcgcatgcgcacgcagtagtccgctgtcacgcgcgccacgatanatctcgacgtatcaccacgtagacacgatatgtaacgctagancaagcaagccgcactatcgataatacaagntacgcgcacgcagtatgtagacgcacgcacagacngcacagagttatatacgacanancanaagacacgcgcgcacacactgtgatatacacttcacgcgccacgcgtgccctatataccgcgcagactcgcacgcgcgccgagntgntatgtcacatctgccgagcgtatcgtcacgtacagcagtctcgtatgacncgtancagcagcgaatgtncgccngtgcgnacgtgacgcagtcgcagcnctntggcantatgtgcagcagtatcncgagtcgcacngatcccaatagagtatactagt

SEQ ID NO: 8342 - DNA, 202 bp, Homo sapiens
  misc_feature (1)...(202): n = A,T,C or G
gtcgggggggggtgagtgggggggggagggaagagaagctactccttctctcggcctgtgaggcggctgctcccctttgcccttccgccatgattggaagtttcctgaggcctctccanggggcggggggggggtgtgtgtcctaaacanctccanaaatgtgagccaataaacccctgggcctcgtgtggcctcagcgggg

SEQ ID NO: 8343 - DNA, 1194 bp, Homo sapiens; identical to SEQ ID NO: 6302
  misc_feature (1)...(1194): n = A,T,C or G

SEQ ID NO: 8344 - DNA, 176 bp, Homo sapiens
cttctcctgcttcggccatgtgaggcggctgctcccctttcgccttccgccatgattggaagtttcctgaggcctctccagaggcagatgctgctatgtttcctgaacagctccaggaatgtgagccaataaaacctctgttctttatcaataaagcgatggcctcgttggcctca

SEQ ID NO: 8345 - DNA, 833 bp, Homo sapiens
  misc_feature (1)...(833): n = A,T,C or G
gtctcgtcttctctcgtctcctgtgcgcgcgttttcccgttctccttgtctttgtttgtcttcttcttcctcgttgtctccgtctgctcgtgttgctctcgcgtccgggctgtgggttcttcgcccctttgctgctgtttcccgccctgtttgcgtgtgggcccctgtttgtcctgctttctggcctgctccggttgctttttctccttcgcggtggtgcttctttcgtgcttttttccgtgtgtccttgtggctcgggggcgttggctgtgttctgtccttttcctttgggctgctccgtggtgtttctgcgcctccctgttgggctgtttcggttctccccgtcttttggtcggctccttcttgtctttggccttcgctttccttctgcctcttcccttccttttgcctgtttctttgtggctgttctctgggtcctcgttctttctctccgctcctgtcttttctgcccctttctggggttcgggtttgtctggggtctgtggccgctttttccttcttggcttttcttccctctgtcccgtgttgcttgtttttctaaaaaactggtcttctctctgggtggctcttgtcgtctttcctgcccgctgtgttttccctgctctgtgcccttcctgttctcccctgccgcgcgcggttttgctgctggtccttggccctggtttgtggtcttgtttntttccgtgtctttgtgtgccctagcctgccccgtgcttcgtccntnntnngttnntggtntcgccggccaaagcgtggngtgtttcggccaaatttttttttattctctcgcttgcatcctcgtccctctccct

SEQ ID NO: 8346 - DNA, 887 bp, Homo sapiens
tcctgtcccgcagaagataccaccctttagtaggatacaactccaaacgactctattccttatatatcattcctcgcgctgagacaactaaagcaggtggaattgtcatcgtggaagttataaatcgcctcgcaatgaaaggggatctctcgcatattctcaaaagccggtaaattaacaagcgggtgcgtcctaaggaacccatccggcaaataaaatgcaaaagttcgtaaacggtgccggtgtatatccacgcgagtaaacgactctatttctccagaaaaccggtcgtccaggggtgtctttatagaaatttccaggctcgcagtcattataagcgaacgtgaatgaagccagggccttgatttagccggcgggggtagaaacaaggccgggattagtgaagtgcctctctatagggcggctacacagaaagatcgtaagccccccctcatgtgtttgggaatagtacgggaaggcagccgggtggaaggcctgaggatggtataggcagtaagaattgaagatagcaccggtggatcaaccactgattaagtgacccaaataggcttccagaggtccagcgtcggtggcatatactcctttcccgtcagtagaacaatcaatgataatagccgaccgctcacgcttgaaaacgtgttacagcacagcagcacggtatgtattatgatgcgtcacgaaaggtcggctgtccttggttgataccagcgagtggggtgctcactttttcagtaggacgacgactagcagccatcgtcagtgctgttattctacctcaccccgccagtttccgtaacaagcagaggaattttaagccaataaaaccctggctctcgttggcctaagcggtggagctgtcgcccagc

SEQ ID NO: 8347 - DNA, 1028 bp, Homo sapiens
  misc_feature (1)...(1028): n = A,T,C or G
ccctctcctccctctgtttcctctctgctcggctcactctctgttgttcatgcctctcgttcctgctgcctcgcncttgggtgcgtcctggtttcgtctcgcctccagcgtggcttcgtggggtcgtgggtggtgtctcggcgcgcgcgcgctgtgcgcgcgtcgcgtgggcggtcggtctcgccgcccgctgcgccgctctctgtcgatattcgtggtcgtcgctcgctcggcgggtgcttcgtcgggtctcccgtgtcgcggccttgccggcgttcccgcggttcgttgagccgccgcgccgctccctgtctcgtgtgtctctcgcggctcttgtcgtgtcctttggtcttcgcgttgttctcagggcgctctccttttccccctttccttcttttgtgtggtgtgttcttgtttggccgcgcctgctgttctggtgcgctgttctcctgtctcgtttcgtttgctttctgctttgctctccccctcttctgatgtccctcctcgcttgctttttgcgcggtcctgcccttgcgttggttggttcccggtgctgcgccctcctgtcttggcggtgtcgccgtctccttgcctttcctgtgcctgcgtcgtcttccggtcggctggctccgctcggctcccggttcatgctggccgcgtccccctttcgcttctgttctctttcgtttgctgcgtttgtagaaaaaggcttcctgctccctggtctgcgcgtggcttggtgtgtgtggttcgggctcggtcgcgccggcgcggtctcgtccctgtgcttgcctgctcatggggtctcgtggcgtgcttccttctttctcgccttgggtgcgcacgacgtgctagctcttcctgtgcgtgctctgtctttgctgtcttctctctccgcctatgtcgcgtgttagcggccgggcagtttttttcttgccaatatataccctggtctctcgcggccaaagcggtggtgtgtgcccccgaccttttcttcctgctgggttcttttgccgttgctcgccttc

SEQ ID NO: 8348 - DNA, 837 bp, Homo sapiens
cttgtgcagcttcggtctgtgagtcggctgcttccctttctcctttcgttctgataggatgtttcctgaagcctttgcagaagcgacatgcttttatgtttcctggacatgtgctgacttgttagtcgttcgcagctggatgagtgtgggccctgtgttattatcattacaacggtaactcagatgtcttagacaccttatggcctggatgctagctatgccgctcctcaccatggctgaggatgcactctgctcagcatcacactgcccaaatgaatatgtgtctttgacctggagagaaatgcagcacatccactctttgataatttgatcacactctacaccttgttcacatgaagagataccatgcaggatgtataaagaaacctctcccaagtgcgggacagctttgacgacctatgcatcggaagagagatctcctctcctgacgctatagggaactataaccatggcccaagaaaataactcattaccccattctagggtggactgcggacgtggtccgactcttagcaaaacataactcgtgctcgggcccatcgactcaactcgataatcccatcgctttaggaggcctaggtagggccattgactaggtcgggcagatgagagcatcctgggtgacacagtgtttccctggggctacataaaagacaataatttattgaatcgttggcgcttggcaccttgtattccacatactgtgtaagctgaatcaaaggagttggtttgacccttcccaggagatctttataatcacccaatattgcgtcgctgctcttcgtgctgtggttgacaaggacatcttgtttgcag

SEQ ID NO: 8349 - DNA, 1867 bp, Homo sapiens
  misc_feature (1)...(1867): n = A,T,C or G
tcgttctctatctgtggcatctactcaataacactgagaaatatgtgtgcagacccctgggtccatgcgggngtaagncctcgtgtcgcttactcttanaccacgaacattcgaacgagacgaggatacaacgtgtgcaggcaggcgtgccttgtgcgacntanagatatccgacgatcgtcatctgaccacatgaataatngatcacgtcgcattcgtctcacttagctgtgngccactctccatctngntcaccctgtgtgtgttacaccgcacttngntactacagatgtgngcatctctatctnacagcgatancattcacatcactgntgatttcatantgagagagnngcgccgtacgtgagatctagagtagtacgagggtgcnagtcgtacttcattgcncctatcgtcgtcnanaatacatcgaatcacatatatcatatgtatnatcaaatacaanactagcgcgaactganactccattgactnttctgctatnatgctaatgngcacctgcgacgctggccgagacatgctcggacgcggcgaacggagacctacttgtatatgaaagnaagaagatggagcgcgtgtgggatatgaaatgcgttgtcgtgtgctcctggacctatcttgtngtgaaacacgcgngaaccatcctaccaagagacntncaatatctatttactcacatttatnaacttaaangaacttcctaacgccgagaaatatgatgagagatctctctactactatctagcagcgctcatgcgagagagggctgacnancactctagacaccatagacgtggcgacatcgagcgcnaaacgacntagagcgcgatctagaagaggagtgttgcgagagtnngaantanagatcgtanagtatggaaacgctcgccgtgacgtcgatgtatgaagcgatctgatgtanagagtgtgnagannnnnnatctgaccgcaacgagcgctancacaccgacgctngngcaccactnnancgatataagtacgnnnnannanagggagacgcgcacgngnnncangcantgcgtctcttanctatcatctacacaagtactgcattagcattggacagcgctgtggncgacgtcgtngntnncacgcnnttctttgtnnncacaccncgaatgnagntntcntcncctnncnctctactcgncaccttcgtctncgctcacgttgcgtangagctaagtctnccttcntnnnnncacctacccctcnacatcacatcactaacgtataaaactcnancnnnnacacntcannctcatacctgtnancanctcancancntntnnnncacacatttcnnctacnacnaccaacattannnatntncanannntattancntnctattacgatncacatctgcnctcttantanntnnnnaatactcntctcncacccttntctcttnnnnncttanttctctcntcctctctcctcnncnccttcncnnncntcncntcncccnnnnncnctncnnnccccctctcctcctctcccnccncctnnctcnancnntnnnnccnnnnnccctctctctcnncncnccctctcncnnnnctnctnnnnncnccatctcctnncnnnntnnctncntnnnnactatcntncnncacttcttnnnnnnnnnnctctntnctnnttnnnnnnnnnacatnttttatnntntnntnnnnnatttnnannncacccatatnntntnannnttanaatttnanaannnnnnnnnnnnnntnnacacgntnntnanatatntntnancnnnnnnnnnanaanananacaatacaccacccatcgtctagnctctacncgactcgtcta

SEQ ID NO: 8350 - DNA, 748 bp, Homo sapiens
  misc_feature (1)...(748): n = A,T,C or G
attaatagaacaataatatacgaattaaaggaaaaatagagacaaacgaaatatggaaaaatatgaaaaactgaatggaaacattggaagatatcgagtgagattaagggatataaataagtggcggagttgtggaggaatattntggaactaaaagtcgagaaagtaatattatactgatggacgaataaactagaaagagaataaaatatataggtggataaaaaagaaagatcgtatcttaaacaataaattggcaatatcatttaaaaaaattataagaaaattaaattataataggtgaaaatagtatttaacaaataaaatggagtaaaagagacttnatataaaaaataattgaaaataagtaatcctcaagtaaaagcacatatagtagaacaatgaaatagatgggtgtgtggggggagaataggttgttgtgcagtgtttgtttattggatgatacaggaattctagcttggaaggnaattatatagagtggtaagggaggatgttataatagaaagagctaagtgagttagtgtgtctgttatggaatatatggaaattggccaatataaggaatcatntaatggatttttatattaaaatataaccaagcatgtaggcccctcctctaaaacatcattatttaaaataatcattgataaatcacaattccatacaagggcccttgaattgtataatacattttaatatnattgtttgtgtaaaaaaaaaaaaaaaa

SEQ ID NO: 8351 - DNA, 180 bp, Homo sapiens
tttttgttcatcgacggctgtctgtcctcactggctcccacccactggccggctcatacgtgtacgcaggatgaccacgacagcccccgacctactgtctttctgcttctcccatccattcgccatggtaatcagagggattttttgcacataataataacctgacctcgttggcctgat

SEQ ID NO: 8352 - DNA, 436 bp, Homo sapiens
atgggaggaagagctactgaaatattccgaggcatggagagtaaaaggcctgtccacaaatccaaggactgacggaggtatagagagtagtaatcttggctcgcaccagttctttcaaggtgggtaaaggtatgccactcgatttcattaggtggtgcatggagcatgtttacaaggcacagtacaatcaggaatcttgtattataaaatatgtaaaatatggttatgtgtaatacatacaagctatgatttcaagatcagggatggtcagaaatatgaaaatctgggagaaaaatgcattgttatcttggccagaggattaatattgctgctctattaaaaacaatgaaaatcatccagtctttatgcaaaaggccagtgcatgtattaggaagcaggaaataagagaaataataccatggcctcgttggcctca

SEQ ID NO: 8353 - DNA, 437 bp, Homo sapiens
atgggcacagaaatattctctgcaccatgctgctgcttccgggaaatggaaggggggtggcatgggccatccaagactatttgttctacctcttcagtgcctcttccagtgatatagagttaaaaccaggttataagatctccattccagtgtgggtcctgccccatacccagaaggaatgcatgctcagagaggacaagaagaatctgaacacacaggccttgctgggtcccattctccacaacctcagtctattactattagatcgtaccatttttgtccaatcacatctctacacgctcttcttgcttcatcagatctaaagcacccatgcataaaatcagactgctttccctctatctatgggtcactcaatctgaaggctcccatgtcatgtaaaactttgattaaataaatgttatgcttttgtcagtcaa

SEQ ID NO: 8354 - DNA, 470 bp, Homo sapiens
  misc_feature (1)...(470): n = A,T,C or G
aaatcccgtcttggggacaacctggtaacatttacagacgangtgggcctgatgtttacacttatnacaacccngtctccttcagcctggcctgccctctgcactccagatctaagtgtctgggcctgctggacaaccctacttggctgtaacacagactcctcccgttggtccacagacaaaactcancctgcttgcttgtcctggttctcttttgctattttaagtctaccttgactcctcactcccttttgcgaccagaccagcacacaagtgtctttttgctccatcgacggctgtctgtcttcactggctcccacccactgtccggctcagtctctcaccaggatgaccacgacagcccccgacctactggctttctgcttctcccatccattcgccatggaatcagagggatttttttcaaaaaaatcctggccctctttggcctcaacggtgggacctttccc

SEQ ID NO: 8355 - DNA, 866 bp, Homo sapiens
  misc_feature (1)...(866): n = A,T,C or G
atacacacacatatacagnnncaaaangaagnnacctccctttttttccaaaatgggatttcttcaaattttttatccttctaataacacattagaacataacacacttccagggtgtttgggattcttaaacaatcatctnaaaaaaaattcatcanttttctccttaactctatatcttatgtgattctcatattacaataaaaatatggcctcctttccctcaaccataaaaactcttcccccctctttcctttttaataagggttaattcataaggcggcggtcacctnaactccccttgccctccnnccaaataacaaattcccccccaacctttttcaacctcacttcaaagcccttattcccttttccccaaatccgggataaccccaaaaaaaacttttaaccaaaacccccccaatattccctcaaccctaaaaacccccctttccttccttttttcactacctccccccccctaaaaaaatccaaaattcaccctctcatcaaatctccccaaccccacactccttaaaaatcccctcctttcccctttaaacatcctcatcccttccttttcacacctcttcctttccctacccccttcccctttctcctctaaaaaacccacacctctcctactccccccttaattatctcaaatctaactccccaccctcccccctcccctatccaccaaccccctaatattccccccttcaccccaccacaactcacaactcgaaccccaccaccactacctcccattcatccttcaataccacacccatcctctcctcctccctctatctaatcctctcccccctccaccattcctctttcccccacctcttaaaataaat

SEQ ID NO: 8356 - DNA, 778 bp, Homo sapiens; identical to SEQ ID NO: 6343
  misc_feature (1)...(778): n = A,T,C or G

SEQ ID NO: 8357 - DNA, 128 bp, Homo sapiens
  misc_feature (1)...(128): n = A,T,C or G
gggaggggganantaaaaaaaaaacattttttggcttgagggtgtccttcttccctaggagtttggccttcaggcgggggtttttctaacactcaaattgaccataaccctggctcttggcctagggg

SEQ ID NO: 8358 - DNA, 1132 bp, Homo sapiens
  misc_feature (1)...(1132): n = A,T,C or G
atattctgtatatatgttttcgttggatgggactttttaggtgtctcgatcggggtctgttgtgttggtctagatttaggcnggggaccagggggggcggggctctggaggtacgcgagccatgatcccccgcgccattgcctcggcgcacggtcggccataaactaaaaaaacaacctcaccttgtactaaatcatttaagtgaagaagccacttggagggtgtgaggggaggtgtgaataaggaggcagaaagcagcgaactgagactgaaaatataaaataggatgctcctatctattacactgacaaaaatggatacacttttcactatatcactcctttcctccgcgccccaccccccacctcccccccgcgggacgttggacattttcgagagacatttgataactttatcctctacagcttgcacacctgcgcactccaggagtttattttagtaaaggtctgtacacataatcctgcgttatagcaattatggcgatcgcgtgatgtcgcgctctcccactgtaaacccccttccccccactccccactcctcaacttcgcctcctctgagacgccagtctcgttcccaccgctcatccaacgagtgctgaacccacaccgccacaaacacacaagataacacacattcggtgcagctgccgctcgactgtctagcccgtacttaagatataaccacccagcactccgctcaatggcccgcctcattacttacgatctngccctattacttgtgccgctttctcgtcctccctcgctatacgccgccgctatctcttacaattgttccacctatacatactntaagaatctttccagctacgctttctntgctagtgtaaatcgtttcactcttatccgtcttcacccactctctactctcgggccgcgtcagtgagatgtatggtaactcctcgacaacacacatcaaccncatccaccacctcaatacgtgcatctatgcgccacgtatccnctccacatattactctcatacagtattatgagaacatgtcgatnnacttataacgttattcacagttgctatcacgaagtatctactagactgagcgcgacggcatcctacgttccacatttatcgcgac

SEQ ID NO: 8359 - DNA, 174 bp, Homo sapiens
ctcctgcttcggccatgtgaggcggctgctcccctttcgccttccgccatgattggaagtttcctggggcctctccagaagcacccgctcctatgtttcctgaacagctccagaaatgtgagccaataaacccctggcctcgttggcctcagcggtggagctctgctgtccgga

SEQ ID NO: 8360 - DNA, 185 bp, Homo sapiens
ggagtaggggagggaggggggggaggagagagggaggtctggtgcctttccaataggatgactgacaaactgtctggcctgatacaatatacagatgaaggagaacatgatgatgtaagggggagggggtggacacaagaaaaacattatctttcatttcataataaaatactaaaaagcaaaag

SEQ ID NO: 8361 - DNA, 1038 bp, Homo sapiens
  misc_feature (1)...(1038): n = A,T,C or G
ggtgagtgggtgttnggtgggtgaattaaagtaagaaaaaaaaacaaaaataaaataaaggagaagcttgtgagcggacgactggaagacacttgagagcgatgacaagggcgtgtgtagatatgagagacaaaagacaactgatgcaatgccggaggacaaaaagagcacgtgaagaggacggcccncctaagagggccacccgagcccaccagagcaagtgatctcattgccccaaaactccgccctacggccgagacgaacaacacaagcccaccagacgcaacgcntcctaggccaacacacaacccctcccacgccaccccaacaccaacacaccccccgtgcagaggagtagtgggaggaagagggataaacgtcagaaaatggtatgattaagatcacggtgcgagtttggcgaataaagacgctgagttacaaggagggaaaagtgggccacgcggcggccgcgccatcacagatcccgctggcctacgcgcggggtcctacagcgcgaggccgccaagttacgacgagccaagtggaaaagtgatatacacaacaccagaacaacagcataaagaacagtagaaaaggtacaacagggcggacgagagctggagtatctcaccacacgccacgacggccccaacccggcaacagtgagatgtagaaacgcagcgagcggaagcgcaagccaacaataagtacctcatgacgagatgcggaaatgagaagtgcaggtaagaagtaagcggaagcctctccatagacacgcacaacaccgcaccagcgtgactacacggcgcagtcgtccaagcaaaaataaaaaaaaagaagcatgaaggcagatacaactggcagagcgaccaacgcacgagcagaaccaacaagccacaccactcccaaccagaaacggtagatataaacaaccaatacaccaaaggatgnggaagctaaaggggagcgantctgtagagaagcatataagagaaaaggattgaaggtagaagaagcacgaagggagcacaaaaaagc

SEQ ID NO: 8362 - DNA, 921 bp, Homo sapiens
  misc_feature (1)...(921): n = A,T,C or G
cgtctccttgggttgtttgggttcgttgtcgctcccggctcgctccgtccgcttccttcttgtgatattttcgcgcgtgccgccgccacgccgctggctgctgcgtctcctgcttctgtcagctgccgccgtccttgtgttgcttgtcgctttcttctggctttcttttctccctctctcgtgtggtcacttcgctgtggggtcgtggctgtccccgtcttccttcgtttccgctctttttcgtcttccgtcctttctttgtctgtcgttcttgccgcgtggggctggttattgtccttcattgttttggtgtgttggggcgtgctgtcttcctggtcgtctgtgttggtctttttctttttgttggtcggtcctgatcgttcctcggggttcgcttcgttctcttgtccgcccgcgggcgcggctccccgtggtggtgttggtggtgtgcgccggccccggctgttctcggtggtctgggccttttgcgggggtcttgttcctcttttgtggttggagcttgccctctcctcctttccctgggtggcacgggtgtcgctcgtgggggtgtttttctggggcggcggtgccctgctgtgcttcttttggttttgctctccctcgcaaaagattcgcttgcctcggtggtggggggtgggtgcctttgggttgtcctttcgggggggtggtgtggggttgtcgcgtttttccctcggtcctcccttgccgcgtagtttttgttgtgtgtcggggtcctttcattttatggttggttgtgtggcgcttggctcgtgctgttggcgcgctctaattatgtatgggatcggtctannatancgcctctggctctcgccggccaaacggtggtgtgttgcgccgactttctttgttttttgtgcggggcctttcggggtttccttt

SEQ ID NO: 8363 - DNA, 912 bp, Homo sapiens
  misc_feature (1)...(912): n = A,T,C or G
gggggagggaaggtaagtggaggaagagagaggagatcttcttaaaaagaacactgcctctgccgtccccacatgggatcccaggatgagaaaccgtctcaagggagaataacaaagggggggtggggggtcaaagtaaataaancctcccaaacacacccatcaggagtcaccaagaagcaactgggaagaggctggacacccaccaccaatgagaccaccaggagctgctgctcccggaaggagtctggtgacatcctccactaactaaaanttgggggggggggtntcctttttacacacttcttccatgaatctatagcttggtccagagatgacttcaacaaaacagangtgcctcttgcttacttgaaacacagaggcattggacctggggctgtggatctggattgggtttatacttaagaagaaaacaagtgtgggaactggcccccgtgagtggaaggggaggtgcagcccacaggtggggaggggagccctcttggatatgaactggaatgggcctgaggcctgtcccgtgaggcggggggggagtggtaggggcgggtccggaggggcgggggtggggggacagaaagcaggggggtgagccggcttgagagagggtgagccgcgggcggacgagagggagccaattacgagtatgattggggggttggggccgaggggcgtggtcgaggtcgctaggaagcgttatatcgatgatgaagcggccggcgccgggagcaggctggggcggctgagggaggtggagtgaggggcttagagagagagaagagagtgaccgggtgactataaatagtgcgccggcaggggagcgaggggggagaagggttcgatggagagtgaggaggggggtgagtgtagggctagagtaagcgaaaaggagcg

SEQ ID NO: 8364 - DNA, 908 bp, Homo sapiens
  misc_feature (1)...(908): n = A,T,C or G
caccacccccgtacaagctgcactctctcggctgacgctcactcaaaccgccctcatctcacatcccattttactcacactactaacccatatcttgaccaaatatcgtctcattttattatcagtgcgcatgtnccccctcgtcccgcggctggtgcacagttaacgtgagtgctagaagatataccagcctcaactaatatctagatcgatgtaccgaggcttccgacaaggagtgcacgcgtccctccccacccgcggaatggatacctctctacctggcctctgttcaacacgatatccccagctaaaagccttatctccacaagaatcttctaccgctcaccgtggtttccttcttacgcttacaccccatcatcccctgtaccactcggctctgggccttgccttgtagttttcgcctcacacgacacacccaagggtgtattcttagccccctagtacgcagaatacaaggccccacccccgtatcgtgcgcgtctccctcttgttttttcccttgaatttccctcaggcctctaccctcatcctgcatacttccctaagcttcgctcccaggtcccaagcttaatgctctcgcaatccagtcattttcgcccctctttcagaggtaagagtttaccaggggccaaaggacgaattttccatcatggcatttcaaacatcagtaaaatgtccccccccctttcaagcactcgtgatattatatctgagtagctcttgtagaaattaatgcaagctgtgttttcactgcaatgtgcccttactgtattcacatgcagcgagaggttatgctgatggaacttggccatgatttgtgatattgtttatttacatgtattcccataaaataaaatgcaacgtgttaagtaaaaaaaaaaaaaaaa

SEQ ID NO: 8365 - DNA, 293 bp, Homo sapiens
  misc_feature (1)...(293): n = A,T,C or G
agaattataaaccattcaaaangaggcaaaggngnggnnnncctacatctgcctacgggctccaaacatctggtaactgagccgtgaattcatttctcccngtcttctnaggtgttnnagcgggtggggtggaagcaacattaactccatttnatatcannaatgnaactgaggaagatttttctttatatgtagaaatctgtgcactgcgtggaaagcatttaaataaaaaacatgcattaaaattgacaaaaaacaaaagaaaaatcnnccttcttngcctggggggggaa

SEQ ID NO: 8366 - DNA, 1496 bp, Homo sapiens; identical to SEQ ID NO: 6425
  misc_feature (1)...(1496): n = A,T,C or G

SEQ ID NO: 8367 - DNA, 314 bp, Homo sapiens
  misc_feature (1)...(314): n = A,T,C or G
caatattaatgaataagggggttgtnnngngggnnnggcctagtttaaaaaaaaacaacgaagacaagaaggtgatccgggaggctggagaacttgtcaaggtcacaaacccacngttttgcgcccgctaaggtccatactctttcctgaacatctgcaaacaatatccacccccctccatttctttacagacaaagatgtntttccacccccaaaacttcccatcctttgctaaaaggtccctaacccttttcctaaaaaaccccaaggcctgtggggggggggaacttttttttctcttaaaaaaaaaaaaa

SEQ ID NO: 8368 - DNA, 1093 bp, Homo sapiens
  misc_feature (1)...(1093): n = A,T,C or G
ggtgaggggatggagggagggtttttatagattttgntattaattttagtagggtgttatgctaaacttgaatagaatactgatagcggtgtgttttccgctgagaacttctttccgtgcgagggtggggcggtataagaattatattaataacttctctcgtctctcacggccttgggagtaagcggccatccacagacccagaagaagccccccggccgacggccgcgcccggccccaacggagggacgggccgaggcgcactgtgtgtcgttgtgtagtggatatgtcctttttgtattctatagggactttctcatcatgtgttgtcctggctacgtccgattatcgcgtcaggccccggcggcggccggtgggaagactggagaaaggagtagcgggcgtcaagaaagggagccgcggttcggtttttttcagttaacagtctcaggcgcgacggagtcagcgtggcgcaacgacagcaagacccgccagcattgatgagggttgtcccagctggcgctatgccccagaggaggggtgcgccggtgtccgtctggacgacacagtaggtgcttgttgtgatatacgagagaganaagagaagtagtgtaagagaacgtagccctatgccacgcgatgtgtaacagtgntcacggaccgaccagcctatnccctcgcggcaacaagatatatgttacatggtctggggcacgctatggtaactttacttaggtgtagtgngntgcgggtgagggatgcgcgtttgtaagtggtgtgtgtgttgccggatcacgtcgcacgtcgattggccgatgtaatatggagcgagtttatccgcggcgtagatctcttatgtgcctacgtgactacgacacccctacgggcagctagcgcgacgcagtgaaatgcgagacgagaacttgacgcgcgcgtcgccgcgtcgtccaccagtcccagcatgatcagacgcaacaagtacctcaacaaacaaccaatatatgaacacaacgagcgaccctcgcgatgaggcgtgccctaccagcgctcgcatcggttgtgcggcgcatgaggggcgttgagcgcgtagcgc

SEQ ID NO: 8369 - DNA, 155 bp, Homo sapiens
  misc_feature (1)...(155): n = A,T,C or G
gtgtgtagatgggggggaggaggggagaaanggggaagctttagctgggttatttcttttctttacaatgagcatcagcattcttgaaatggaagaaataaaaaggcttcggactcanattgggagggtgtgagtgggtcanatgcanaataaac

SEQ ID NO: 8370 - DNA, 1294 bp, Homo sapiens
  misc_feature (1)...(1294): n = A,T,C or G
cgttccccaatgtatccccggcgtagctcatacgcgaagccgggtgcttcccgggcatacaccgcgtttaaatagtgcaccttgactactgccatgtggggatatcataaacagcgtggctttcatccaggagatttgtttctgtggcatagcaggctctaccacacagtaaagtgtgtttcggcgcggctgtggttgtttatcacaaaacaatttccgtaacatttaagtttggcaacagggactactcccgctatatataacatcacccgttataacgaaatgtctaaatgtcgcaaggaagaagagggggcttgtcgcggaaaggctctcacgtaggactcaaactctgacaagagagggccttagtgatagataggggattcatgagcgcacgtttattcttggccacagcatagcgtgccctcgtaggaaaacaatgagccgagggcgtagagaatcatcatggatgagaacacgatattctcatnttctctgtgatatatctatcatccctccacgcgtatgtgtggctcctcaccagatgtatttcgtattcgacaccgctgtggctaccacgtgactggtgcttcttgtctacattcgtgtcaaaagttttttatgcgtgggaggagaaaggggttgtatcgaggacaaaatggttgttacttcctagtgtaccatcagaacgacgcgatgcctcaacgaagtaaacaatgtgagacgcaatacttctattaggggcggatatcntcacgagaattacacacccacgagtgcatctgtagaagatattgagtgttgtgtggtgagcaagatatagcaacacacaacacacgatacagtgataagtctacatcgagcttttgtcactcctctacatcctcccagttgtggcatcgtgcagagaatggttgacagagatgtgtcacngtgtaatgcgttgtagtgacagtctattgagcgtgtggtttagtagtgaacgacatgtgtgctctagagtctgtcctagttagcgnatagtgngtgcaacgagtgctccgcaatgcgtctcggatctatatgtagcatagtggatcagacggtttgntgttggcgctgtgtctctatgcgtcaccagattgagtctcctcccacattgagagttgtattagcgattgatatgagatcgccgctcgtcattcacccattatgttccacaccgactctctcacctcgcgtgttgtggtgtagcaccatgagtggttgtgcacgccactgatctaatgacatttatatctatagctccacctcc

SEQ ID NO: 8371 - DNA, 1943 bp, Homo sapiens
  misc_feature (1)...(1943): n = A,T,C or G
gcagtcgagtcagataagtcggctgatacangatcagtgacgcgtcgagtgttnccacgagacgagcggcggntncgagtctgtgatgtgcagagcctcgagttggagagagtgggtgagtacaccatgttattgtctgatagttagtgatcgtaatgagtanaatgtctctgtgcgtcnaattggtctagtcgcgccgcgctcgacggcgatgntgacgacgtacgtgtcgcccgtatgtacgagtatgcgtagtcagcgcgtgtgctanacgtgtntctcatgtagtaccantantngtatcatatctcacgctcatancgctcgactacatcgtcttgtcgcgtgtacagcgcgtcancagcggctcgcgctgtctgcctagatatgtcagtctgcgcatcgagatggctacgacatcagctcgactgnataggngatgctgtgnagattgnagtagtngctggcagacagctgcaatgacgtcgcgtagcgtgatngttctatgtgtgtntgcgcatgagatgtgtantctngtagatagtattgngtcatctntcgctcgttatgtatcaggcgtgagatcgcgtcgctntantagtancatcgataagagtcntcgacatggcgtgcgcagtcacgtnantctgtcgagcgatgcgcgtataantgatcagcgcgtnaccgtcntacgtatctgcgactngtcngcgtntgtacagtacgtgtatacactctacancgacgcaatgatctcntggatgtacagtgtgcggtagcatctgtcgtgctcgtcgatgcgcagacgcatgtgcgagacgctcggtgtgtcgacgtagtgagntgctgcagttctccgctcanactcacgtgcncagcacnanatacgctgcattatcacgacgttaagancagcgccngtctcacgcaattgaggctgcgtatcacagtccattctgtcgtactacggtctcggcgcgaggtagtgtgtgacagccgtcgnacacanttaccngaacgacgtgtgaagagagcgcgccgcgatagcggtacgtgganacatgatatactcatcggcgtagtnaacgcgcgcacgttatctctgactatggtcttctggtagtgactcgtgacgtgaggtacgcgtgctggtatgtcgcggttcnnccctgcatcgagtgctaggtgcaagtccgaggctacgcggagagataggatgtgtgaaantagtagcaacgcgttacacgctgcatcgacgagctagagacgtgatgcgcatatanaacagacgagacgtgctantgcttgcanctactgagaccgtgatgtcgtatcgacataggntgtgctcgctcgtgtccgtctncatgctcnantatcgcgttgatcgtcgctcagtcgatctctgctagacgatnctgcgacatgacgatgctgcgcagtgagcgacgtgantcagtcgntggtcgtgancgagcgtctacgtcgcatcacatctcactctgctgccgtacgtctctgatggntcgtgngctgtcagtntgcgctgcgcgcgctcattntctccgctgggacatagtcggcgcgctccgcnggcgngcgtgcacgtcctgccgacgtccgctngcgtcgtatgcacctgcgcggtcancncgctgttactaggctcgcgaatatgagtcggcgccccgccgctgactcttnanagatcgcgatctatctcgatgccgngtgagttcgtgatgtagtatagcattatcgatgacgtgaatcactcgctgactttcacgctctgtcactatacgncttggtatngtangctactatccgtcacgcgaagtgtgtctagcgctatatacacgccnactctcacgacctgtctagatcgaatgcgtcgactgagtctgactgtctnacatgagcgtggagctgtgtcatcgctg

SEQ ID NO: 8372 - DNA, 2017 bp, Homo sapiens
  misc_feature (1)...(2017): n = A,T,C or G
actcctgtaaaatagcatgagagatgnctgctgtcggccgctgangncgncgcagncnggcncagctatcactttgncacntcgcatcacacgcacaacaccacccatacccacagacgaagcanacgctacaccgccagccgaccgagtcagctatnacgcaatnatactagaggcgaggactcacacaaatagatgctatgctgtncatagcatctcgatagcaagcacaacaagagcagcagtcggctgcggcgctcnagtcgtcgtacaccagataactataccgccacatcgcnacntcatactcctcgtctactatcacatntgacctctagcgagtgcncgcgcgtgcatgcagatctgtcatattnagctcctcatcatctttntctgctctatnactgagcaatgcctcacactgtcgagcgagagcaggacggtgctgcgcagtctcgatcgagtcgcatcgtcagaccaggaagtcccgcagcgcctgtgtngttctcatacgctacttcatgcntccagcgctgcgtgactagancggcagtcgacgacagcgcgcgcgctcgcagcaccgncagatcagccgatgtacagagcagtcggtacnagacatcaatacagaacgcttagcggcatcgcacgtagtccatataggataacagcataatgctgacgcgctctcgagtcgtgacatgtgatactggtcgcttatggtctactgagcatgtagtgtatcagacagagacgacgtaacctggccagcagngncagtgacgtgcacagcgcgatacagtacanacacgcgtgccagcgagactgtagtgcgatgtgcgtgtgctatctatcacgtccctacactcttcttctcctcctagcttctagatccgtacaaacgtgcacaatganagtcanagctgcgatgcgcgtgtacgcttgntatgcagctgtcagtgcaacctatcgtggtactctcactgcgttctcgattacgatcgaatggaccacgntacatctcactcatgtcggtagtccacatgtatanagtatatatcgatgcactaagtgatagcgagtagccgatgagtatgtcgctctcatacgcgtatctacatcacgctgattatctcatgtgtagtntaannagtagcgatcgcagtgcacgtatgcagacgacgatagatctcgcatcgccgtggacacggtcgtctagcagcgatacgcctatgatacgatcagacaccgacgtagccgaggagagtccgtgagctaggcgcagatagagcaaagtccgacgtacgagtagcaacaccatccacnagtccgacggaaggagatcatacgtcgatcagcgncacgtctgtcgtgcctgcgtcgcactaggatcaacgcgctctcncgactgcagtcgttcgntgtacntactnctcgcatcatcgcgagatcgnccgntcaagtcgaataacgtctacggacngntagacgtatgacctcacncacgtctgtatcggagtgacaanttacaagcangacgtcgacacaatatgcanatcactgactccgaagtgaaactcactangataccatgtatagtatnttactacctcttgctagcacagcgtctgtccgcntgtgtcgccgacgacgcacccngngttcatgtgtatctagtaccgatcatacatccngacgantagatcgnaacgcagagtgtccaatgacatagtacnagcgcgatcgtacttgctaacagacgccgcanatgcacatgatatgcaagtggtgcanantggacccgnggntaacgntacacancagcagcgtgattgcgtgcgannggcttntaantcgcgcgacggngagngtcctagctgcgtcgnangngccaacgccgtncgtgactcacgcnacnatnccntgtcgacatnacgccatntatcagctntgctgactgtcntntnagctcacatacacatntgatnacacatagacacgcnaggcacagcatgtc

SEQ ID NO: 8373 - DNA, 1609 bp, Homo sapiens
  misc_feature (1)...(1609): n = A,T,C or G
cacccgtactctggctggtagcaagcaggcttagacntgtctactgaaaagaatgtaggactagagcccatatacctgacagagacttagagcatgaaaaagccttgtaacggaagagatatgaagagagccgttatgaaatggccgaaggtgatgccgtgtgaggaacttacgttgttagcagcatagcactagactattgcagccacacgtgtgtggcatctgcggtgatggagacagatggcgggcggtcgcggggtggacggcggatgtgagtggtaagtgcgatgacaggctcagcgtgcggcgcggtatactggagcaagggtagcggggtcgcgcgtgaggtgagggagtggtggtgaggagtggtgacgacgtcgaggtggcgggcgggagtcacgatcgcggagcgaagtggtgtagactggacgatgaggcgaggcgcggcgtggcgtactacagagtgagtgaggcgtcagcactcacggacgtcgaaggcacatgagatacgctacacctgacgtcgtgatcatgagagacgtgcacagcgcgacgcgagtgactacacgcgagacgacgcgtgagtcgngagcatccacggtgtatgagccctagtggacgctgtgcgatagtggacagcgtcgacgcgtacgagnagacgcgtgagtcacgcngtgangagnagtgtactagagcgacttgagcgagnacgagcactttacggaagtgtaccgatgcanacgtcgnagacacgtaagagaccgtgactcagtcacgtgaggtcgcacatagacagcaggtacagacncgtgtcgtcgacgtaacgaagngaggcgagcgagagacttccaatgccngagatgacgtacggnacggtcnacagagtcgagcgcgagtcgcgcgagagtaggactcggccgtacgagatagtcncgccagacgtaacgttcgtacgcacggtcatcacgtatacgtgacgctgncgcgagcntgcagcggaccgcgacgtatacagactgcgctgcgtntgcgccacagcacgtctacgtcgcggactcgacctcggagacgtcatcacagcgtcacgaagatctgatgagacgnactnatcatcatgcgacgagaggangtggcgnagtccanacatgggtctacgcacgcntacacgcttgcatcacccactcaacggctgtgcacgcgcttgtgtcnacgcgtggtntgcctgatcgatntacgacgcaggttcatcgtcatctaatcgacgtncgcggtcacgcgctgccnagcatcgatgcgtcgacgntatgncacccagnaatgctcgttactagcacgtatgncacgctggacgacgacnatatgaagattcgacagtagcacgtagagtaacatacgtcagagaatancagtacgaggatgtacanacatctnactgtcgtcaataggtgttcacagaagtgaacgctacgtagcatgncccagtggncggnttangccgagccggnancgagctcacgacactcgacagcacatcanccacngtttcactgngcgcagtgtcgtnggcacaggcacntgatgngcgtgacgacgacgcacacgagcg

SEQ ID NO: 8374 - DNA, 831 bp, Homo sapiens
  misc_feature (1)...(831): n = A,T,C or G
tttgcgttctaacagttcaaacntacactctaatgctgctccaacacgccttactggttcactcaacggcggagtggacgagatcctgctgacttacctttgcggctgacattgagagagaaaacataaaactggatgttacctctctccccatagccatcatgagttttggataaggtgggaatattcacttctttttttctcttccctactttatgacctttgtgacgtggggagtacccaaccaactctccaccatcactggaactccatggacattgatgatcttggtggtgttatctaatctatgtgatacgaaaacatattcttttaaataagagtacatctccacccaataaatgtgtattgggccttanaccttgagtttgagtggaaaaaccccatttctccaataaaaattgtcttttgtgagttgaaaaagataaataagtaagtgatttcagccaagtgccccatatataccccaaggaaagcttcctttctacactgtggcncgttgacctattccgctcctcctgttcctctgcgggagacgttcgcgcgacctcttttttaagggggggagatccgagagtcctctcgcgtaccggctaaacccgcggtagttgggggggggcgaggctttcaccaacctgatacgggtttacctctgtttacccggggggggagcaccgagagaaaaatttgagccaagcgccagccccgcgcaaccattttacggcccattgtggtaggtttcttaaatgctcaccccccccaacactataaaataactggtctagaaaggcgctaaacccccgtcctttaaat

SEQ ID NO: 8375 - DNA, 1718 bp, Homo sapiens
  misc_feature (1)...(1718): n = A,T,C or G
ctgtggacggggtanaaagcagaaagacggggngggcgnnggtgggcggtggagggagcaacgcggggggaggagaagggagagagagaagaagagagaagaagacccttaataggaggaaaggaacaaagaganagaagaagaaggctttagaagagagcgngcggggcgaacagncangcccancncncgnggcgnnggcggcgcgncgccgggcgccgcgggcggcncgcgaggncgcgcgagcgagccgcgggnncccgncgccgcggcccacgagggngcgggnncgcggncnnccncgcgcccccccccccgcgagcgcccgcccccgacccaggcgcgcaaccaccgcgggcgcggcccggccgagngagncgagcggcgcggcgcgcncgagccgncaagcggcgnnngcggagacgcagacgcgcgcggcgacccgaggcccncgacacagcgggcgccgcgaggcgcgcggccccgcgcgcccgncgcgcgcgacgcgcgcgccncggcgcgcaccgcgcggccagaccancaacaccacnacgcccccggcgcgcgagcgccgcagggcccnanccgagnannnncgcggcgagcggcgngnagggngngnacggncgggcgagacganancncggngaaagagcaagcggcgngagngnncngcgcgngcncggggacgnccggcgccgagcccgcgagnngcggagcacagcgccncgcagagacgcggcgcgcgcgcgcgcagagcgangacgggcgcaggggngcgacgggggncgcggcgcgacgcggccgcnccccgcgngcgccgacgcgcgngagcgcgggggggcnnccacgccgcgncaagccggcncgagcgacgcgccgcgngcgacacgagccgacccccgcagcgcgcgcgagcacacgagcgagcggccgcgcgcacgacgnacgacgagacgcgnacgaccggagacagangcgcggagcagcancncagcgaccgcggcagggcnccgccgcacgcgcgacgcaganccgagggagcacggcgcgcccgcgacgcgccnggcgcggccgcagcggcgacgcacgcgctcgcggcgtgngcccacccgcgacgcacacgacacgcgcgananaggntggntncacgcgagatgtgagacggacgccaacggcgacgccaccngccgtcacgcgcggaggcgagacgagcacntntgtacagcagagagcgcacggtcngcacggcgcggcgggcacgcggagcgtgtgaggagaccgccgacacgcgngagnacaacacacgtgggcgaccncgacgacgaacgacgcgagcgcgaagggacgangntgggcgcgcagcggcgcatcgaccggcgaccgcgcagcgcgcgccgcgccgcgaccgcgcccgcgaccgcgggcgcgcagcacgcgcgcncccgacaggancgcggcacgcgacgcgcgacgagaggcgagagcgcgcgtgcgcagagagatcgcgcgccgcgcgcgcgcgccgcacggagagagagcgacgcgacggcgaccgcgcacacgcagcgacgcacgcgctctnccgacccacncgacggccgcgcgcgcgcggcgnncgagcgagcgcggcggcgaagcggccgcgcngagaggagggngcgacacggngggagcgcagcgagcgccacgcggggcagacgagcacagacggagca

SEQ ID NO: 8376 - DNA, 616 bp, Homo sapiens
  misc_feature (1)...(616): n = A,T,C or G
ctgatggacttttgctcctgttgctcatgcgtggatacaatgatgcaatctcggctcactgcaaacctccgcctccannnttgggggggggggggtgcctcancctcccnagtagctggaaatacaggcatgaaccaccatgcctggctaatttttctatttttagtggagacggggtttctccgtgttagtcaggctggtctcgaactcccaaactcaggtgatctgcccactttggcctgcgggagggctgggattacaggtatgagccaccacacccagccaaaatgacacacttttaagtggaatatccatgtctaaagcaactagctcctgatataaaatgggaacgtccatgcctacttattttatccttaatacaagccagccatttgttcacaggggaagcacaacttcctcatactatgaccagggctttatgcaatgggtcctatgggacgacactattatacagaaatatactaaatggaagccttggaaaagaagaagnnaggggggagaagaaggggnnggagagagnagaggagggtggcctcgttggcctcaaggggggggcttttggggccgttccctttaggggggggaaattaaggaa

SEQ ID NO: 8377 - DNA, 1548 bp, Homo sapiens
  misc_feature (1)...(1548): n = A,T,C or G
atcgtattgcactttttatattattattgggggtggcggcggggccctcggactgggttctacggaccagacagaaacctctatatatgcgcttcgctctgttaacattagtcggcggggagagaatgtggcgacgcgaggcggggcgggctgcggccgtgcgcggcttcagccgagcgtgcgccgccgccgcgcgcccagccggagggataacgcgcgaatgggcagcccagactctgtcttacaatttgttgtaataaatgtgtagtgggaggcgtggggggcagtcgtgggagtcgaagaaccatatttaagccactcgggcggttgcactctccccactggtcgattatatagtggcgtagcttggtttgctctttgctgaacgtggtgtgcgtattttcatccgagtgaattatgatgtaaagatatatagtttagagacatattctcttcttacaacaatatttccatttatacagttaccacttttaaaataagacaaaaacatatcacaatatgacacgtcccacgttatttcgcgcccccactcagagtggcgtttccatctcccgttgtctctattccacattcccatattcggtcgcataatgaagagctacaagcatcgtcggataggcacgcgcgtggcgagcatacgggcaccattttgattgacgagattatatttcgcattcgcgcaatatcattatgccgagctcgcgggttacgcgcgccgcgctatttgagtcttgacgcgtcataatattcgcagtattcccggcggacccactatccgtattttttgttttcactgatctctgacacgaatattgcgtcagatatacagcagagaccaccgaatactgctactcacacntcgttataggtgttctatattacgacacgcactttcaacattcctacacgacactcatcatntctcatgacatgacgcgcatcgacacatcgtgattatctcgtgacggttatagatagttcgacgtagtcacgagtctacacggtctatacctcgcacgtctctggttttaattcaacatctctgtatatttcatcgtttcgttatgtattctgtattgtagatgtgtgcgtctcgctggtgcgcctagttagatacggcgtatgttattgatcgttgtaatactacacaaagctctaataggtcgagtgttcacagacatactacacaagtgtatagatacagggcgcgagtcagtatggtacgcgcgccgccgtcgngtgtaggtatntgcgctcgttcactccgtacgatcgcgcgcagattgaacggtaatgccagacgcatacgcacngttaccagacatgtatatgtaggaatctatagactagcgctccacactctnagcagtgtcgctgaatatacgaggtgcgactatcgacgctcngacgtctgtcgcggactcgttgcnattgtatttcgtcgagtgtnagacgaagaggcgatgaagtctgtgcagcacagcgcgcgatagacgcgaattgtaccagtatggatgtgttggcgcg

SEQ ID NO: 8378 - DNA, 1640 bp, Homo sapiens
  misc_feature (1)...(1640): n = A,T,C or G
taataaaattaatagattaccgccacaaacaaccacaccagtttttgcgggggggagaggggggggaggggttttcgnacaactgccaacatatctgcacatcaagcataccngcacggtgggtagccgtgctgtgtttgtgacacggaaggaagtgtggttgtacaagttacgtgcataggcgaacatacatggtgtccggtactcgcgatccgtccgtacgcgtgtaagacccgataccacattaccaatccactcaccctacctcgtctttcccattacgcacgcacggtgcaccctcatgcattaattgcactcgccgccctgcgacgtgttgcgacatgtcaaccacgtatgancacacctccgccagttccttacactgttggccgcgcgtggcaggccatattttccatcgtagttgtcccgtgtttcaccctccggatccccacgccgttctcatatgctctggtccgagaccgtctgcgccgctgtgacatgctggagcgtttaacacacaccgacccctcgttattccacccacttcacatgtttataacagacatcacaactgaccccagatggtccatggtgggcgggaggcacctgtaccctagtagaggacatacgccagtacgtgtgctacacacccaggacgaagtgtgcggggtacgtcgtggcgcgcttacaccgtcatggtatggtcacacccacttttgacgtcaaacatgcaaatcgtaatatgacacaccatatagccccgatgttcattgccgcgtctcacccagcaagcacccggtatcgctgtcgaaagaccgaacacgtgcgcagagacgctctcgaagacgacaaccggccgaggttatatagatacgcacactagtttatccgacggacagaccaaaagtgatgattttacaccacagcccncgtctccaccgtcacatttaacgacacacctatgttatacacggatctacgtagcattcaccgcatgtgtctcatcanaacagcgcgcgacgcgcatagactactcagnagccanagtcgcgcagtgaccgacgcacgcagagatcagcgntcactngtatgcanatgatagcacaagcacgtgtacgttacagtcgtgtgcagcaagacngcgtgnatcgtgtccggtcgcgtatcctggagcgtacagcagcatcgagctcacagcgcacatgtcacgcgcgttactnattcgcgcgcgcgacagctaacgtcatgcgnacacagccgcgagatgcagcgncagcacaggaagacgcgatatgtttcgcagcgcagacgtcagtgtatgcacgtgtcgcgcgcataggtaatcgatgngcnggagtatgangagacagcagcgtagcgatgcgantntgcgncgcgagntgtnanatctcggctgcatcgagacagagctcagggtgacgcaanancgcacgcgtggntgtganacaacacactcagtcgcgangnacngcagtgtctgtcatactnatnatntangtaatacagcacgacaccgnaccgacgacgtcgtctggtcntcacggacaggcncgcngccgagttcgcgatacatctcaccaggctatgngttactcagaaaactactagctaccacantg

SEQ ID NO: 8379 - DNA, 330 bp, Homo sapiens
  misc_feature (1)...(330): n = A,T,C or G
gggaaggaaagagggagaggaagaggcgggggagaaaagggctatntattccttcagtcctgcatatctgatgaaagtactgacatcagctggtcaaaatgatcctgcaagaagccacctcaccggggaggggggggtctgtatcctgatgatttcaccctccttacactgacaatcaatgactccaattgtccagcccctgacattccatgatctccttaaaaaacccaacctagaactttttggggagatgaatttgaggagctcctcctctctcctcatggatgggggggcaatcattaaactctttctctggtaaaaaaaaaaaaa

SEQ ID NO: 8380 - DNA, 537 bp, Homo sapiens
  misc_feature (1)...(537): n = A,T,C or G
agctcgtcgcataacaacntttcccanaactctacaagacggtcacggggtcaaaattttcaaaaaaataaaccttangtgaaattatgctgcctcgaattacgtaccactaaacctagtaactatcttacactctaaaattcaatactcacttaccttttggcattacatttaacaattaacggtaaaactatagtggttctataactaccaaataaaaattatccttaattcatctctatttatcaaacaacattttaatgatgtacatcataaatgattttatacaccttaccacactttaattactaaaaactcaacctcccaaccaattccccaaaatcctgtcctttttgggttctccaccctcacttttacctgcaaccttctttaaaattctcacaaacaaaatcccaaactcattctcaccccttgtaaaaaaaacccttttttcataaaagctacctccaaacaccatttaaaagtacaatggcctaaatttcccatttctatacctccttccaacaatactgaatt

SEQ ID NO: 8381 - DNA, 1327 bp, Homo sapiens
  misc_feature (1)...(1327): n = A,T,C or G
tctggggggggtcgccggcgggctgccggtagncgtggggtctgcggcngtggccgcggcgggttcccggggcgcgtacgggtcgtcccttctcgtcacggcgcggtggggatagtatcgtgtngtatataggtgaaccgttggcgttaanatgatggagtgtagctgttttggtgagtttgtggcgcgtagggtggtatgatggattactgtagatcggtatagttgtgatatttgatatagtcttcggcgacattgtatgtcgtctatagacagacgcgaggtgcgactacgcgagtggcgcgcaggccgacagccagctatcagccttcccacgctgacatcctgtgccgatgagccgcgntcgtgcgcgcgngtgncgattctgtcgtggtgtgcctctgtgttcactctctcactttccacttcgttctgtccgactagtctctgcggcgctattgacattcacgagcgtttctttgatattctcgtcggcagtcactcaggacgtntgcgtcgatccggcgattatgtgtcgtacgtcgacgtcgagttgagagggcgcagtcgaactcgcacacgacaacagcgagcgcccgcacggcaccgccgcgccgcccncgacacacatacgcacaatagctcagtacatancacacgcacntacggacnacgcgctcaccgcaagcagtatacacgcatcacaatgatttnagcaacaacatacntagaagtagaagnttattatgataggaatacaggataccgaacggttcgcagtgatgagantgggtatcaggagatagcgaaacgcagattccgttcgatttcgcgcgtttccgcgattcgcagtcggcgcgtgtcactcgtatccgcacactacaaccactgttgatacaatgctagttccccccaatcgtctgtagcccccggtttgtgcccgacgatgttccgcgcagattattttttacgccagtccggtttatcgccgcgagtcgatcaggagggtcgcntggtcgcgcgaagagattgcgcgtctagggtaactaatcgcgccaacaaagaacgacaatccacccgtcggttcgctagcataacgtgtgtgatgatcggcagccgagcagcagatgtacacaggagccgagttacgagaacacaatgatcataatttaatccgctattcccctaccgataatcgatatattcgcgtcaataattacatactcgcaacgcgcgatcgacacaggataacnaagatccgagatcataataattcgcgcaagctacattctagcagagagataatgcgccagactactcgctaaca

SEQ ID NO: 8382 - DNA, 1092 bp, Homo sapiens
  misc_feature (1)...(1092): n = A,T,C or G
acacggccatacganccgcacccccaacccctccgcattcaagccangnggngatnaaacacctatccttaacagnccacgttacgcacgcaacacaatacgcaaagtaccctttcacgccatacgtcaacgcccggtcaaacaacctcaacgccaatcaaagtagtacgttgggcggggccgtcgataagggagaataaaacagacgagaaaccaaaaaaaaaaacgctaccccgtataaacactatacaagaaagacacataaatccagcaacgataaccgcataaccctcccccccccccgccgtcgcgcgccccgcccacttgtacggaagtggcaacagacaatacactgcgagcaaacatcacaattcacgagcatagcaacagtagaagaggacctgggggtcgggtctgctgctcgctcacctccccctcccgcccgctggaccgggccctgcaacacaacacccccgcccgaccggcgggcccggacaccgtttcctcgttttccccagggattattaacacgggccttcctggcgtagtgttccgggttcttcggtgtttctagattgtgtgctacgcgaatgcaatacaccccgctccacagtaccgcgccaaacctcgtcccccattcccgagcccgtcccccatatctcatacgccgccaacaacccgcgggtacctacgcatacccgcgcgttcgcacttgcgggccgggatatgtccgcgcccatccgcgcgccgagtttctattcgcagaccccaattatcgtcgcgatgacatcgcaacgatacctgtccgcagcaatgtattgcttattcaaagttagtgatatcgtcctattatgtcccgcgtttcacccctcgttcggcacacaaacataattatttccgctccgccgccgttcccgctcctcgtacacgtccggcgtattacgctatccgcgttcccgttcgtggacgcatttttcgacccgtaggattagattttcaacgttcagaacgcacgagataatattacccgatatgtagattgcgcgagactagttcgtcgaatgtgttatatagaatattattcgccatcaa

SEQ ID NO: 8383 - DNA, 1480 bp, Homo sapiens
  misc_feature (1)...(1480): n = A,T,C or G
ttgtggggtgtgtggtcgtggcgccgggacagcggggacgggggttttctgaccgccaggcgagcggcgggcgcgacgtttttctctctcatttcctcgccgctgtcctcggtcagtcgggtgtcgtcctttacaaaaagacgtttatcgttagattgtacgtatttcacacgttacctttaatttactttcatacttatccgtcccggagtcgtttctcctttgcttccgttccgcgttgtccctgaccgtacgcttaatgtcccccatcccactttcacgggcccgcgccggtcccgtcttttatccttatccctcccccgttgcgacacacgtccctttgttccctgtcccttccgtccctttgtttcacccttccccgccccttttgttctccgcccgttgggtgtgtttggtcgttccccgattcttctgtccgttttccacctcgattgcccggtgaaaccgtcgcgacacctcaccgttatgttttcttttcgcttcgcttcttccttttttcgatttcacattgttcacaccccgccccgttcggtctcccaccctacccccttttttcacagcagctcatgtgacccagaggaggcccatgtcccgtcacaccctcctccctacggtgcgtccccgcccgacgtcccacccccccaccccccgtccctttcccgtttcacgctattcctcttcgcttcatcgtccctcgtgctcggccgctcaccgcggcggctccgtgtccacgttccctcttgtcgtatcccgccgtcgcccgcacttcgcggtgctttatgtatctcacacgtgcggcgcgcgcgcggccggccaccccacgttgctatgaccgccatctatctccgtgcccgcaccattggatttattgccgagaccacgagacgatccaattacggcacccgcttttaaatactcgccctatagccgcgcggctgatgttttaccccgcgcaccgcgccgcgtcgcgcgcgtccgcgcccatccaccccgcgctgcgccgccccttctcgccctctctcccagcgcatgtgcgtggtgcgcggagcggctgagccgagcgccgtgggcagtgttgtagctccatccactaacgttgccgcgtgttaatcacaaccgaacttcagttgcacactgtcgcgcgatctaccgccacctgcgcccactcaattngcgccacgcagcagttgatatacgaagagcctgatcattnatgagcgagtctctatggtgtgcgccgaatagcgtgcgcgagtctcaccactgttntcagcccacacgcgctatgtcagtcgcatanttcggttcacacaccgctgatntcacacgcgccgttcccactaccacgtctgttntgcgttcctgttcgcgccgaccnccgcacgtgtgttttcgtgtgctcgctcaccagcgctcctgctcccttcagtgtagtgcataaagtcatccatactcgcgt

SEQ ID NO: 8384 - DNA, 293 bp, Homo sapiens
aaaatcccactgacgggttgtgtatagggcctatacccactccttaaatgccccaaaattttttttttcaacccccgtgggaataaacaccggtgggtaaccaccatatttttttggcccaaaaggcccccccccaacatttttttatgtgaccatattcttttcccccccttttacaagcccgttttatttttttccagcttctgcaatggtctccgggggcaaaaaaaaccctgggttgggtaaaaagactccctataggggggaagggtcccccccccctccggggtttt

SEQ ID NO: 8385 - DNA, 1561 bp, Homo sapiens
  misc_feature (1)...(1561): n = A,T,C or G
aaagggaaaaggggnngnnangngnnnnnnnnnnnnnnnngnganngnnnnnangnnnagtgggacgggnnantagtagnnngaggggagaagngntnnnncnnnnngagnnnnnnnnngnngngnnnnagagngnnnnnnnnnnnnnnnnnnnaaggngacnnacagggnnnnnnncacccgaaggccnacagagnagangnnnnnngnccnnagcaganaccgnngcnnacgcgaagacggnnnncccgcgacatggcnnnnngcatcgagagagcatagccnaacncggcgangnacgacnnngacgagcggaggagcnncnnnaanagagagtgtagatcgacacagaacagcctgtgccagtgctattacaagagtaggagtagtgttaggtacatgtncttcgtcatatgtctatgttgnntatgattaggctnnntcactagaggccnctccagntgaatagatctacatcgatgtcgaaatagctgtcatntgcatttatttgttatagtatgtattnnntataatagagatagttatatggtgaaaagatgttggttattggaagtagngtgtcagtatgntcgggtatgagtggagtagtggntgtggcggatagatgataataagaatcnatatgagaagtatcagatgtactagatgtagnatcggcaacttntagtggacgacatagagaatgagtaaatccataggagatagagaatgagtaatatggtcggcgataggtaatatgcgccccacagagtagcagtacatgatgattagaacgactcagaatactagcacccacgcacgtgagcgacactggtccagaccagtcacgcagtcgtgagncgtcttcgccgccggcagtgatagtcntacgtgcgatactgccgactgaggcnagacgnngnagccacaccgacacctgacaagcccacgtcagctccacagcgtctccttttattagtttcttctttatatcatgtaagttactaaccaagtatgatttaangagagttatatatattgntaanatatcgtggtagagtgagtagtagcaggagagagattagtatgtgagttgtagagagaggtgatgtagagtggtaagagagtaggaagtattatataagcgagaataangagngaagaaatgtgagatgattagttgaatgaattgtcgatntacagagtgataattgactagcttcaccactcgatcgcatatgactgtgaccatagtcattggcagtgtacttgagcagacgcggccagcagaggtgattagaccccgacgcgtcacacatatacaccctacagctcaggctgatttcgccncctaggcgcataacatgcaggagcccagtccccaagcatnattcgctgtgtagtaccttcacataatcggcagcagtactgccgtcggtaaagtgngtgaagagtagcagagtatacagattcgcattggtagtagtccattagtatgtgtcctgtctagctctcctttcatccacacctacgtgaggctcctccgaagtagtaaccgtaa

SEQ ID NO: 8386 - DNA, 1771 bp, Homo sapiens
  misc_feature (1)...(1771): n = A,T,C or G
gggggggnnngggnagggnnnnnngggnnnnnnnnnnnnnnnnnnnnnnngnnnggnnnnnnnnnntannnnngngganncagagaggnnnnancagcgggnnnngggcnggnnntgnnnnannnnnnnnnnnnnnnnnngnnnnnnnngnnnnnannnnnnnnnnnngnncnnnnnnnnnnnannnnnncccnnnnnggnnnnnccccatggcnnnnnnnnnnnccccncnnacccgnncnncacccgtacaagnnncncnnnncccncnnngaccgnnnccagccgcagnnntcnccagngagcgcgnnnncnnnnnggcnctcgnnncnncncnacagngtgcccngngcagacgcncnangcgncnangcagcgcgcnncccgnnncggatncgnccgcgcnnnnacgccgacggtacaggtcgncngcctgcnnccgaggatgnagtatgggacgcgcgtctnnctnctcaatgtacgcacgccgctcaatgtntcganactctgtatcacacagataagcgataatagacgtgagctanangatagcaaggagctcnnncagcagtcacaccgcacncntcggtgagcgagctagagactcgaggcgngccgcagggngcgctgcgcggtgctgctgttatatgtggantgtnagtaanaacacagaaggagagagtgtaatacagatcgcnagatatgataanagcacganagtgttagacagtacngagtatgtttagatnatatgtgtagtatatgcatgttggntntagtgagtgngctttggaaccactacgcntcacttgagtcacacatattacgnaatacgacggccngccgacatcacgccgtcacagattcgngacgtcccccaacagtagtcaatgatattggngtcaatngcaagagcncagacgacatcgtagatacgnccacgacaggagcgctcgacacacatagtactgaggcgcgancgacagcacgcccacaacgcgacgcgacgagcgccggtacccgtncacagaggcacgctcccgcgtgggcgcgcggtggtcgcgcaccagcgccacacgacactcgagcgcgcagcgctcggacgcgctantacgcacgtgnagagcaggcacagtcgcgagcgcgcagccgctcgcgtacgatctgctctgagcatcgagccggtagagtagtacatcttaccactcgcaaaggtgctcagtgtcggcaccgtggtagcggagtacagttncnacacggatggatctgntagtcgaacatnatananatantganagtagatagatgacatgatctaaataagtggtacgttntcnagtatgcactagncgagagaatgagntcagagttgtagatcgtgtactcatctnatcattgatcgttgtatagtctgnattgttgagagtatgacttatgtttgcagcataattagacacccgcncagtataagcaccggagcaccagagcgcactatcacggacaaaacacgcgagaccggcggcaggaggacgtacccggagagcagatgctgtcgctcatataatcgtctcaaatacgtatcacataatgccacaccatcggtatacacgccagccgccagaccgccggaggtcaacacgccatgatgtaataaanagacagcacgaacccaagaaatacgtacgggaggagcagaaccgacatgagactacctgcgtcattcagatcacgctcgttattgtaaaggaaatgattaatgtgtgccgataag

SEQ ID NO: 8387 - DNA, 226 bp, Homo sapiens
  misc_feature (1)...(226): n = A,T,C or G
cgccagcccgcccgcaagcccagcgagcaagagacccgcacacgaagaacccngaagacttaagcgcgcaccggacgctccccacttaaccacgcgcaacaggcccccaggcaagcacgacgcggggcaaagcccgcccacaaacaccaagaggggagggggaggcaggnccccgcgcacgcacccccggcacggaacgaggcccggcacagcggaccggacaagc

SEQ ID NO: 8388 - DNA, 1238 bp, Homo sapiens
  misc_feature (1)...(1238): n = A,T,C or G
acaggcaaaggcaccacccagagaagcacgcgcggaagaggaggcccctcgggcgaaggacggggggggagggccctgagagggggagaaacccggagcagagcaccccagagagcaagcacaaggaagcagaccgggaaacgagggaggacgagaacggccgagagacaccgccagcagaggaagcgcgggcgacagaaaacacagaaacggaggcaaagacaaagaaagaagagcgaaaacgagaggcggggaacgaagccccaaacgacgagaagacacagccgacgcggagcagcgccgagcaagagggaaggcagaagaaggagagagagcgaccgcgaccgacacaacaccaccagacacgcgcgcgggagacgacagagagacgcgaacgcaggcccacgacagccgcagcaacagcggcaccccgccgcgggagagaggcacgcagggcacgggaagccaagccacaagccgaacagcgcggccgcgggaccaggagaagccgaggcaccgaaacggccgaccacagagaccgcacagaccggcaagcggagccggaaaacaagaacacgagcgcacgacgcagccgaaccggcacgaacacaagcacgacacaacagaaaacagcgagcacgggacgcggaagaacggcgaacaggccgcaccgaggcgcaaccgcgcagcgcaccgaaccagccagggcacggcgcgaagacggcagacacgcaaccacaacgcaaacagacaaccggcgcgcgccaggcaaaggaccagaccgcgccgccgccgcaccgaacggagagcagagcgccgcagcaggacagacacagccagcaaccacgcacacggaacaccgaaagaacacagcagcaccaagcaccgcgcgcancaccagacgccgggcggacacaaccgcgacccgacccaacaggcaacgacggaacaaaacaacacgagcagccacgagaacaagaagccgagaccgacacgagcgancgagcacagcacacaccagagaccccccgcacaccaagcagaccacaggagagcagacgcagcgcgcaaagcgcgcaggcgcagccgcgaagccgcgcaacacgagaaaccgagcgccccagagacgcgggcgcggacggagacggaggacgcgcagagaacacggcgcacgagacagaaaaagccgagggangagaaccggacgcggagcgcaacgagcgacgaggaagacagcg

SEQ ID NO: 8389 - DNA, 1095 bp, Homo sapiens
  misc_feature (1)...(1095): n = A,T,C or G
agggacggagaagacccaaaggacagacgaggaagcggggcggcctcgnaagangactggaccgcgnggcctgcgngggaggacaacggcacgcgcanccaggaagagacgcgcgcgcccggccngctcgccccgacgcggcgcgaacaccggagcgagacccgagagcgcgggagccaccgcccaaccgcgcgagcagcgaaggccacagagcggcacgcgaggcgagcgagaccagagaccagagccgcacgcgagcacgcggcgacggcgaccacgcgccgccggcgcgcgcgcggccacgacgaacaaacgaagagaaaagcaagcgaggcccttttttttgcaaacgcgaggggcgccagaggcgcgcgacagcggaccccaccgccccccggcgccagcgcgccgcacccccccgacgaagcaagggcaagcacgaccgaaagagagcgcagcgcagggacgcccccacacaacccccgcccggcgcccaacacggccgcgacgcgccggacggacgcgaacgcgcgcgcccacccgcaccgccgccgcaacacgcagccccgcagccaaaggcagcagccgaaaaacacaccagcgcacatgcgcagcgacgaccacccacgcagaagcgagccgaccgaaacgcacacgcgcggcgggccgaagaggggacgacccacgccgcgcgcgccgccggcacgccgccccaccacccaaagccaaccccgccccgcaccaagaaaaacgccgcggacgggacgggaaaccgaaacacgaatgaaccacgacaccgaagcgcacgcgagccgccacacagacccccgcaacgccatggcggaccgccgcaccggagggaggggacaaaaggcagacgcgaaagacgacagccgccccgcggcgcgacaccgcacacgcggcagcaacgagaacgcccgcgaacgcagaagaggccgtcggacacggccagcgcgcaccgccagcgccgcactccgcgcaagccaacgaagacgcacgcgagcgcacacagacaggacgaaaaagcaggaaggagggaggacacccgccacagacgcggccctcgcacgagcc

SEQ ID NO: 8390 - DNA, 1260 bp, Homo sapiens
  misc_feature (1)...(1260): n = A,T,C or G
gcacccggcagaaccaccacaaacgacaagacacgcccaaacacgaaccctgaaaaggaaaacaaaaaagaaagggccttcacgatgcaaggaaaccgggacccacagcgcaaatagaacggaaagcaaaaacagagcagagggccaaatcaggaagaggaagcgagcagtgctcaagggacggccacaggagacgtaagcgcgcggcacaccaaaatacaaggtcaagccacaccacgccaacacacagacgacattacgcgactacagaccagtatcagcagacacgaatcgcaaccccgtccacacgaaacgcatgaagtgcacgacagccacggcgttgaggtcgaagacaggcgggacggccgcggatagcgacgagataggccgagaggngacgaggagattcagatacagagagtacacacgtcactcacgcgataaagcgcttcaagaaccgcgcgcaacgatagcacaaaacgccagcccgcgagacagagaaagcacgcgacggcctaccagcaaaccgacgcacggccgcgctaccgcgacacacacccaccaccacctgacagagacggcatcgacatcacacgcaggtcatagtgatcggcgatcagctgcggacgacccgcaccgcgcacgcaacacagggcgtcacgacgaccacacgcgccagccgcgactcgcgacgacaggagaagcagaggaggctctaccgatgcgcgggccngaccgcggacagacgcgtgcacggcgcacagtcgccgcgaggctatgaacgctaaccangacgaggcgantgcgacgctgcagagcagccctcgcaccgcaagacgacacgcacgacgcgacacacgcagcacccaccacacgacgcgtccaccgaacagagaccacagacgntccgcaccnagccgcgccacacgaatcacgcagacaaccagagaaacgntcgaccgacggtcgactgcacaggaagcgcncgcaacgaagtatcgacacacgagantcactctccgatgcagcgcgacgcganccggacgcgccngacgacgtacatcgtgaggtagacgtatactcgctgtgatggcgcagacaccgacgcagaacagaccgcgtcgcgcnaggagccgccacgctcagagcgacgagcgncgcgcgagccngacagcgacggagagaggacgcgagcatcacagcggcgcgagacaccgaaacgcagcgcgcgagcagtcgacgagcactaacgcgacgtgc

SEQ ID NO: 8391 - DNA, 1678 bp, Homo sapiens
  misc_feature (1)...(1678): n = A,T,C or G
agctatctcgatgagtgccacatctctncccctctcactcagactataatcagagaggagaagaaaagagaggcggnngggnggcccctcagcagtnagcggngaccnagcggagccncaagagnggtnctttatnatgagcgatatganaaaccagcgaacatcaacatcggtaacgacgagaccgacacgcggctntagactacacagtgcgatnaggagcgcgactcactnactacgtgtcactcggagtgcagcggagagggacgtcatgctcncncggcactcgatatctactcggcgctcagcaccacatatncatcagtatcagaatgctgatgcactactctcactcaacnatacgtcncctctcggacacgtagctagactacgatatctcgcagtataccttgtgtagacgagcattccactcgatagcgtcacgcgcacacggtcgtgccatatgaccgtcaacaccgacctatgntgctataagtacaatgcgtcatctcactacctatccgatacgcagtatcgagaggctgccgcagacgcagtctccgtcataatacaatatactcatagcactatgagtgctgaagagcacgacgacactatcttttcaccactctgtgtctcatcgatatcntacacaantancgtgacatctcaatataacatagtctnctaacaaatatgctatctcatgatcactttcaactctacgcacacatacatagagaccgacacatctcctcgtaacgacacaccaccacgtacgtgcgtcattcgtgaatgagtcacaatcactcactccatgcggtgctaccatctactcactgcactcatactaatctcacccactgtatctctctcatggtgtacagaacagtaccgaccggcggctctagcagctagctacctcaagacgccgctctacgtgtgtcagcacgcgacgacgcgagttgttcacgaccgcacgtcaccagtactacgtgcacatcatcgtactcaagacagagtcatacaacacccctacgcgtactgtcatacacgagcacagaaagctactgccgcagccgncgtcctctcgagcccntgtcgcagctanagtctcgctcctaagttactacancgtacgtgccacttcacctacccgcacacacactcagtgctnaatcgaacctcagatcgacgtctcacncatcatatcngtacatatagntactgcctacatacagtatcgcgtcaactctctacgcaccacctgacncacaatacatcattcagatgatgactcgatacgtacggtgcgatatctcctctcgctccgacgcatacatcagcgcgacacatcgatactatgaagnctacaaacgtcacgcangcatacatctcagcgacgcacgtcagctatattacatagcacgcacagacagctagtgcagcgcgnacagctcntactatcagagnacgcgtccgcacgagtctatatcgagtagatagccagactctaacgcagcgtcanantgcgcagatatgatctagatacgagcaccgtcgcgattagcgagcacagatcccagagacgctgtcgccgcctcgancgtacccgcatctatgatattagcgtacactcgcgctcgtcatatgatcagcatactacgngtcaccacat

SEQ ID NO: 8392 - DNA, 415 bp, Homo sapiens
  misc_feature (1)...(415): n = A,T,C or G
aaggtgtcagggcgagggagggacggacgagagacgaaaaaaaagnaagaaaaattttgaagggtggtctgttgggcgcggggtagggcacagaagacccccaaaacctttcggcaccttccctttggtccgtgggccccctcttttncaaaagtttaaaggggggtgtttattcaaaaaaacctttncccctnnncccctccttccccctcccgctgngntgnggtgggcgccccccaanaatttaaccagatgcttattgccacccgtgggggagggagtgctatcccaacctccaatnaagaggggttttcctctccctttacacacattaacaaccctttngtgttttcctctgcgggggggggggggggtncacnccncacacggggggggtgccataaaaaaaaaaaaa

SEQ ID NO: 8393 - DNA, 1658 bp, Homo sapiens
  misc_feature (1)...(1658): n = A,T,C or G
cgtctctgctcttctcggtcctcgtactatcgctcgtgtctctgtctatgctctcgctcccatcgntgctagctgccttcgtctagtcctccacatcaccgtccantgtcgagtcgcgtgtcgctgnctgatctgtggagcgtcgtgttcgcgattctctctgtctttgtctgggcgcgtgcgctactcgtcgtctcagctaccgtnctgctgcatatcgtgtcttgatctattgttactgtctcagtcantctgcnacacgcctctcctcgctctcgcgtgcgtcttctctcgcgcgctccgncgtgctcgtcgacttggtctctgctctctancgcgctgtcggtgtatactcggcggatcgcgcgcgggtgtggtggtatgtatagtaacngnctntccggtgtgagtatgtcacgtgtgatgccntgccgtgctcgcngtctccgcttgtagcgtacctcgaactgtgcgtattactcgnagctctcaccgctctctcgcgcactactctgcgctagatgtntatctatatanaatgatcggtgtcgtangtgtgtgtntgatatatattntcgtctgatcgcgncttcntacnaccactcatacagatgaccgctgngtgtgtgtgcgtcatgtttgcttatcagatctgctcttgttgcctctatcgtactctcttacctgctctgaataatgcgtctgcgtctctcttctcttctcctgtctgcgtcgtgacgcccgcgcgacgagtctctcctctacactgtagactctttgatcactgtgcgtcgactgngaagtgactgccgacatcgtagagtgtggagtcgctcaccatggtatgtggtcgtccgttactgacacagcggactcttcgagatactcnagacaccgatcgtctgtcgtcgcgcgtcttccgctcgcgtncgcgatacgtcagatactttgtnttgtgtctctgcgtctctatcgcgcgcgcgcggcagcgcttacgtcctgtcgtcgntggttcttacgactagctcttctgtntgtgtctcttagctncgtcgtgggtgactgggtgtcgtctattcatactcgcgcgcgtcgccatatcactctctgtgtgtgtcagtgtcgtaggtccctttctnatgagagagacatgctgcgctncgcgcacgctctgcggcgtgtgtctgagcganaagctcttgtctccgcacgcgaccgtattcctattagtcgttgctcctgtctcttagacatagtttggtcacacggcgagtgcggcgtctctcttcctctctctggtatcggatacagantaattgtcttcctgttctctcgtacacgatatggcgtatagacatacgtaacgtacacagcaccacacacgactcnacaagtcagaatatacgcggcgctcacataagatcacgcacgcaacagacaagacagaatagaacagatacaacagaatataacatacananaanaanatagananagatggtgtctcttcngtctcgcgtctntaaccaagtctgngtcgngtagnttcggtttntcntgcgctactgcaccgtctnttgtcatgtcttcctcttcgtgtgtgccggcgcgcgtcgctctgtgttctccttgtcgccgntctcacgcctcgcttctat

SEQ ID NO: 8394 - DNA, 1537 bp, Homo sapiens
  misc_feature (1)...(1537): n = A,T,C or G
tttttattaacccatccatccccaacccaccccacggttttgggcgagaggagggacgggaggagttttggtggtggctgccgtgtccgagagctggtttctggcgggaaatgtacttactagcttgtgtggcagtgcgttacgttggaggaagagacacgcagcgagaacgcctctcaataggcagtcacatctcgcacggtcgcaaagcggtactgtaccgctgtctaccacgccgatggcgatcgattgactcggacggctcggcatctagcaggtctgtctctgatatacctacgtcatgctaacagctgctacgcgtcacgtgtccangcaggagatgtggctgtgtgggtgaagaggctccacgtgttgggcgcgagccgcggcacattgatgtacagtagaacaagaatgtgcgttgctgttgttcggcatctatataccaggatgtacagacgtacttagaatgcaacagtgtaaaacactgtatgaaacagatggggctctagtcttatcgtagatgctcttctggttacactaccatctcactgtatttgtctcacacttcgcgttattacttactccgctcatcctccccgtcccccactttgcttgcgcttgcgcggtcgcgtattatctgtttcgccgcccaattctcaccgcgcgcacagaatggtggcgatagcttgtactcgcagatgcactgtctgtgtcgtccccccctgttcctcccactccctcctttctcgagcgtatgccagttcgcccacttttgtataacgattgtacgagacgctgacacagtattcgctaatattttgcatggcgcgggtagtgggtcgtacagcagcagactccgtttatttgtatatctcgcagaattntctctcgcttatgtcacacacatttttgtatattatcaccaccaaccgctcgcatccgttttttttcgcacacccatatgttttcctggctcggtgccgtgtcccactgtgtcactctccccagcccgccgcacctttcgtccgatcaccgtctccctctctaacccatccttctcccctcgtcttgctcactttatacaccaccacttactcgtcgtcgcctcttacatacatattctncgtcgtctgtctgttgtgtatacgtgtgcgtcgacattcantgtccgcgtgtctattaacttgagtgtcgaaactatttcgtgtcaacctggttggctantctgttccaccgcgnatcgatattgccccacctcccgtgtatacccatcttctgcggtgataacgcatcacagcgtgcaacgccaccnagacatacgacaaattctactagtaatgcaccagagcgatggattgattcgcgattcccaacacacgaccgcgttttaactctccacattccgcatcaccgatagttacgatcagttctttattacccacngcgcactgctcgactgtntaattgctacgtctcacaacatnatccaccatccgcccgctgatntntntatagctgcactctgtacgcgtcg

SEQ ID NO: 8395 - DNA, 892 bp, Homo sapiens
  misc_feature (1)...(892): n = A,T,C or G
ggaaggggaggggcgcgggaagggcacggtantggagaggtctggatacccaagaggagccactttgatcttgatgtgctgcgggagccattaagagaaccatttatccaacatagtccattttttgggagcggggggagnanatttctcaacctattcttaatttcacaaacccaaaaaatgggtttgaaagggccaaaacctggaaatcaaagattgggaactangggaaaccgaggagagcaggtcttgatgtgtcctagaattttaccatttctgagattcggggggggggggccattccatttctaaaacttattataaccggggcttttaaagaagtccacactagcgggataacatgggttttgtaacaatggatgggggagattttgctgggcgcatgcgaataaactaattattggttctttaaagaagaaaaaaaaaggtggctgggtgcgctcgcgggggggcgtctacgggcgggtgcgtttnnagggggggtaattgatggggctggcgtcactgactgagtgcgctcggagcagggagtggggaggagcngagtcaaatcactcaaggggtgagataggggtatgccagaaaccaggggaggcaccggggagagacatggggggcgaggggcaaggattaggccgagatcgggggaggggcagtgtggagacgtttcggataagggaggggccgcgtacgaggaggcgagagagggccgtgggtgggaggggggaaagcgcgcgggagtgaagaaacgggggttgggcgagggagatccaggggcgcaggggtaggagagctatggggccggagacaggggagggttgttaagagagggaggcgatggtgagggagcgaggggagctctagagagggt

SEQ ID NO: 8396 - DNA, 1668 bp, Homo sapiens
  misc_feature (1)...(1668): n = A,T,C or G
ggaggagtgagannnagaagggtaaggagggganagaangnagnagngagagttgttangtgagatgagagagtggggaggngnanggaaaggagaangcgtagagaagataggtagantcttaaganagcacngacaacacaannaccgcgnnacacaggtgattattagccagccggagcaagagacagcntagacatcnacacaacggtgnagncgtgcncggcancgccgcgtgtncgagctgaggtcnaggtggtcgtggctgctgagngcggccaggcaagtagccgcanagagacgagatangacngcagagagactgcgacgtcnacgcgctanctacatcacaagtccngtctangtctcagtgtgtgttatngtntntagtagngcattcactggtgntgtcgtngtatgttcgctagtatagattcttntgtaatngtagagatttatcaacgtagcanattctcgcccgacgtatcgaccagcacatcaagagcgactctgcgcgccgactcgccgcancaccgacacgcacacgaacaccacggcagagcacaccaactcancacgcacacgtgaggtacagacgcacgacgagaaggaaagtnaacaacgacaatgagtntagaccaangacacattgaaggtagtatgatggggtacgtgtgacacacgantatgcgannntggtgcagatatggatgatgtgagtataataagttatgtagtctgaaganttgttgcaagacagtattgtgctanatgtanataattagtactcaattgacgcacacagagcatattcatcatgaaantaaantngaanaactagatataagattaatcacagctatatatatgatatgttgtatactgttcgcggcgttgtgtctcgttcgctgctccttncgtctnatctctntcttcatgagtctccactttatgccgtctagcgcgctctgctgtacacgacagtagctgctctgtgtatcaccaggtctcacgtatnatatagtacacggtatctgttactagcgantagtattcatagcacaggcgcgaccagtcactatctgagagtcacgtactatccgtacggtatcgcgcgagngtattgttcgtgntacattgcgcgcgtgtacactacatggcctnctctgagatgtnatgcgcgagtgggctgncgtctntcntcacattgtgagtatntgcattctcgtaagtatctgttacagatacatctgttgtccgtgtacacaactattatccgtactcacgctcattactatagttacgtagatgcgctgtgtttgtagtctacaagtgattgtaggtgagtaacagccgttacgtgtatacagcatagcgctctactatttgttgctgagtcggtaaattagttcacgtttgtcatcacgtgnattagtgcaatgtactctngttctgatgtacgtatccgacgactcgacgtagcgtgtgtntgttatgcaatgcgaatacgtattgtcgatgatagtcgcgcagtgttcatgtcatcattgtctgttgtgtatgagtggagatagactactatcatcagtgatatattagttgatgtgtgacatcctacggacacagatattacgttactatatgtatactattctacgcaccagtgcg

SEQ ID NO: 8397 - DNA, 1124 bp, Homo sapiens
cgccggccaaagagcaccaccgcaaaaaatttagggaaaagaaaaaccagaaagcttttagagaggggggaaaggacccaacaggacgccgcgccacgccgcctgcggctgatgcgacagagctaaagcattacaaacacgaaacgagacaaacacgaaacaccggaccccacgcggccggaccggaccgccccgtcgccgcgacgcaacgcaccgtcccgccgaccctggcgcgccgcaaccacccacgaggtacccgcgccaccgcgcagagggggcggccgccccgaagggcccaccccggagggaaggggcgcccgcggaccatccgcaggcccaagaggccggagacccgcccgagcccggctaaaggcgccccaccaccgaccaagcgacgacagcgcagtgtgcggcacaccccatgggggccgccgcgggcgaaggggaacgaaaggatagaaaagacggaagggagcgagaccgcccgcgggcgggggccccagaggagaaccacgaacgaggggaggcggcataaaccgggtacaaaccgggcgggcgagcgggcgccccgaacccaacccgaacaagaccaagggccccggaaggaaaaccaggaacgcaaaaacggagaaaggcaaaagaccgggcgagagagccacaggcacgggcccggggcggcgcccatgggggagccacgcagaacacgttaaccagcgacacgggagcgagtgggcgcggggaggtgtgggcgccgcgaaccgcagagggagacaccacccaccagcgcgacgcgcaagacaagcacccgcgggaccagggaggcagataaagcaggccagcaagccgaaaaacgagccacacggcggggggacatggcccagagaggcgcgcgggcaaagccgccgaaagcgcgagggggacaaagagccccggcaaagcgccacggggggcaccgcgcagagaacacgacaaccgaggaccgggcacgaatacgcggcgaacaaccgggaggcccgggcaaaccccgcgggaaacccactaccacccgagcagagcgttgagcagcgcgacgagccgaacaaacgcggcgcatacacaaacaccgcgggacagggaaaacgccg

SEQ ID NO: 8398 - DNA, 1678 bp, Homo sapiens
  misc_feature (1)...(1678): n = A,T,C or G
ttggccgccatttccccgtgcnnatgccgtcggcgtgcggnggcggcggacgccggngagcaaaacgnnnttttnntacgtacaaacacanagagagaaacaaagaaaggaaaggctgttttttttagcacgtagcggagcagagcagaagtagaagaccccgagcagagggggggccgatgtgtgatncntcagctcatcgcgcgtccgctaccgatagatgcggtgtgttgcgcagcagtcacctngtagaaatatgttacantataaangccctgtgtcgccgtgtgcagcgtgtntccangcgcgccgtcgttanaaggcaccgtgtaaaggaccgcagcaccgtccaacgatgtaaccgaaatatctaacgccgcgtgtaccgctcgttgacaacggatacggagggaccggtatcggtctgtgtgttcggggtgtcggtgtgccgcggttgcgacaagagttcgcttttgtttccgcgtccgctatcggtacccgttgtgtttacccgtacgccccccttgtttggtcccactcccgtcgtgctctatttcagccgacccgccctctggacantacctatttttgcacagtcgaaatccgccgagtctggcgcacgttacacccataccagtgagaggaggggcggttagaggtgccgtgtgtgtggtagtgggcgaatggttacgtgttatacatccacagacggcgtgtattttgtgcccgcggtgcaccgtttgttcgcgcgtggagatgcggctgccccaccgcagagcgtggtggttggttggacgtgttagccttataatggcgtcgcaccagccatttcgaagcgaaaccagagaacatgtatgcaggagcgattgagggacgcagcgtcgaagtgatgtatgacgtcgacaccgtgggtgcaagcggcgacgtgacgagtaggtgcgtgtgacaacacgatgtcaaacgaggttctgttctcgatcgtcggccagagaaacgcggtcgtggtctaactatacataccgctgtcgggtcgtggtaggtggcgttagagatcgacctggttaggtggataaccaatttgtatcgcacgaccccacacgttccgttttatcaccacgaccacgcctcgctgacgttacgcaccgcgtctatgaaggcagactgagagctgtgacgctaataattaacagccgagcgccaccaataataacctacattgcgttggtagaccgacagtgtgtcggagtcgtgccgaattaacagcccatatttagtattgcgatgctacagatgagctattgctagtctgttatctatggctccgcatagacttctcggttgtttaccaccgtggtaacgtatcggacaccgcgggtagctcaatgatccgcggaagagtgtcgcgcgcatcggaggctcatactgacgcgtgttgtatattacgcagcacatgtttcgtgcgtcgccgtatgctatgcatntngacagggttgctatacagtagcgatggaggttgacacgattgcaccgagaccgtcggtgtatatacagcgaggttacgagccgcgtcgtctttcaactcatcttgtacnaccagacacgcgtgcgtggtgttagagcggtagttgtcgacattccattctagactgctatctatcacagttcactatacatatgt

SEQ ID NO: 8399 - DNA, 257 bp, Homo sapiens
  misc_feature (1)...(257): n = A,T,C or G
caaaaaagaacgagtgtgtgggagaggaaaaaaanaaaaaaaaacttaggttctccctcgttgcccaggctgngatgcaatggcacaatctcggctcactgcaacttctgcctccntnttcanncgagggtcctggctcagcctccaaantanctnaaactacangcgcccgccaccatacccgaccagttgtcttgtattttaaattttgtttctaaaaagaaattaaaaagctgtcttgtggaaaaaaaaaaaaa

SEQ ID NO: 8400 - DNA, 958 bp, Homo sapiens
  misc_feature (1)...(958): n = A,T,C or G
gggaaggaaaagggagttagcagggcgagaggagganggtctgcgactggcatcaagaccgcttttctgtgtcaaagccccaggtagatccgccagcatgagctgcttcatgattcatgatggggggggggggcaaccattcaaaaancacgctgtgtcttcatttttaccctattaacttaaatgccgggggttctttggcacattacagggtgctaaaattcaatctgaccaaccacatgggagaaaaaaagactggaaatttagtcaaatatctcttgggggggggggtccatcacattacttatgaaaggaggctggtccaaaatacagggtttgcgctctgtgggaataaatctaaggggaaactgcacatgggtgacctgggatcatgctaaaaagcaaacacacgtttggatatggccttactggggggtggaaagggttgaccacccccgaagctttttgagaaattgcccaggggtaggtggcccctgcgtccataaaaaatagtaagagatggcaaactttatggggtaaaaaaagaaagaaggtggggccgctggagcccgaggggagaggggttggagggcggttccgtttagggaggggggagttagagtgatccagggntcgttgggctggcgtaggctagagggtagggggtggtgagggggcggagtcgaggggggcggagggggagggcgaggcgggcgcgctgatgaaaggggcgtgcaggagcgaggggactggggggtgtcgggaggaggactgagggaggaggctgtgtcgcccaggaggtgtgggtaatgtgggattgttggtgtgcgcgcgggagggaacggggtggcgacggcgggcgagaaagagagacgtagaagcgggaggacgccgcgagagcacggtgcgtgatgagtattcgcagtgggcgaggacagggaagggacagagagcgagg

SEQ ID NO: 8401 - DNA, 445 bp, Homo sapiens
ctgttttctctagcctgcatgttgtctggaattgtagcaactatcataaaatcatcagaataaaagccacataccaaaagggggaaggggggggaagactaaaatatggatgttctcattggactgccatcttagacctggactacttgcctcaaaaaattcttacattatgcaaaaataaattcctttttgtttaatccactgtagctagaattttgtaacatcatgctaaatgataaggggggggcatccctcatgtaactcaaaaaactataacaaacaccttgaatgtggacaactgctcatgcagacatccatcatgcatcttacatcctggtggtggaagaaaaatctttatataaaaatattatgaacttctgaaatggtactatgctctgatttttgtggaaaatcttataaaatcctttatctaaaaaaaaaaaaa

SEQ ID NO: 8402 - DNA, 136 bp, Homo sapiens
  misc_feature (1)...(136): n = A,T,C or G
ctaacacctgatagactaccttttaccataccatgaactccagaggggacatgacaacacacacctgtcggggagagaaaaaatatactnagaacatgccaaagtgaatttcttacctcgttcacctcaacaaggc

SEQ ID NO: 8403 - DNA, 745 bp, Homo sapiens
  misc_feature (1)...(745): n = A,T,C or G
gggagtagttcttttttgaagtagaataaataaaaataaaaaaaactggggggaacgggggggggtgggaggaaaacacccaaaacccaaccccccgcggactaagaagggcgtccacctacacgnngtgngggttgtttgatttttttttgtgtatattataaatttgggtagaagagatgagacatggagtgggcagcatcggccgccacccgccccgcccgcctagtaccatttacaagtatttataatttgtcaatatcaaggcaagcgacgttgggcttctgtcgttgtaaataattcaaatcccttctttatgtatttttgtaattttccatctcgttgtgccccgcggtgaagataaaagatccccgtacgattgcgcgctccatagggaaactctacaaaattaaacaaaaatgcccctagagctggtgatgtattttgcacgtcgagggacctagcgtttttaaacttttcaggcatattttagcgtaagtttagttttggttggcggttggtggtgaagctgctgtggttgatggggtgacgtggtaggtgcttaaacactagttaataaggtggaagtaaacaaacaaataaccaggaagatggtggccaatcaaatacgcataaaggctgtagaacgctacatttgtatcgagtggctaagtatgatagtatgggggtcagactctgatgaatattataaacagctgaaaattagatggtagaagtaaaaaat

SEQ ID NO: 8404 - DNA, 1196 bp, Homo sapiens
  misc_feature (1)...(1196): n = A,T,C or G
attatatatatattaacacaacacaacgcgacagcgcaccacaaccaacagcataagcgacgtttttattcgagcgagcgagcagacaaacagagtagcggggacgttttcgtngtttatagtggagacggtgagcagagcagcgccgccagaggatgagcggangcagagcgacagaagcaagaacagctgtggagagaggtagctgtgtatgactcggtggaaagagagagtgaagactngatgcaacacgtgcgtgggccgctatgacatgagtcggctgatgagaatgtcacgcgatgacacgtacggagactgaacatcatcgcctctaaccgcaggtaggcatcggtcgccggttcgcttgtttagaggaaccagggcaggtcgttcgggcgttttccctccacccgtcggttgaccatccccactatggtcccccctggtggtttgtgttcgccgtgtctgccttttcggttgtacgcgtcagaattgacaaaagaatagtccgttcactgtcacaattccttgcacaggccgggggtcacgcactcccctttttttcccccagccactttgacgccggggggggcagagccgacgtgtggggcgaaggatcgcagggggtttccacacggcggggacaaaaaggggacgacagagcacaggaatattgtagagcaagcggtcactacggaccgcgcgctgggaaagtcgcaatttgtaccacgtggcgcctacaccggggactgaacttacaatcacgagacggccaaaacagacccgtatttgtaaccaattctgcgatgacccaccaatacttattgccacgcacctagcgaatcatgtgccccaaattctatgcacgaccgggccacgttgtgtacccagggacccccaatccaaacatccccgaagacgagaccactaaacatgaagacgggaggtgcgtcggcgtcactcgccacccgataacgccccccatccccctgaaccaggcgacaacgccacccgtgtagcggcgcagatatgctcccggggacgctggcggaaaccacgcggaaagcacggggcggacgagcagtgaaagatgacgaggcgtgccaaccccgtgttaaaggatgccccccggatacgatgagaaacacacgggatgggatggaacggagtgcacccatgtgttacgggcctccgct

SEQ ID NO: 8405 - DNA, 1587 bp, Homo sapiens
  misc_feature (1)...(1587): n = A,T,C or G
aagtttggntttttntnagngnacagnnnnannnnnnnnnnnnnnaatgtnnnatagttgntnnnnnanntnnannncnannancannnangnatnncaanantttctnncttnnnannnncnnnnnanantnnncnnnnatctctttntnnncnnnccacacccatcctncacgtnnctaccaccgcgacattcncactatgtgctccactacncacaaaaccacccacgtacacctgcgacgtgcacngctaggaccacagtcnacatccganncacaccntacaccaccacgcacaggtatagatgatganattgantgaatcactaggagatgagagcggagtataatgcagagttataaatgtggaatataggtagatatgagtagtcccctgatctaatagtgtgccaacgagcgtcattccctcatagtatgacactctcgattccgcgagtacctacctcgcctacaccctataccctcctcgaacctgccancccatcttcatcctaccccacaacacacacccaatcccagttcnantacgattgcaaccttactgtgtgggctgcccttggtggtggctgtgtatgtgtttagttccgtgtgttccagtttatatgtttatatagaatttttaatctagtgatccatatgacgacggtcgtaatatgtagagagaaccatanggccgcgcgcaatccaagccatacaattagtgtgctacatggtcgcagtgtgtgctttatcatctcccctcttcgcttctgtcgttatcgtcgatacgttccgattacgtctgtatctcctatgtgtgtcgtcagtatacttagnctgctactccgcgtgcatcgtagggtctattcacagtgatgtatgtggacgaccgtcgcgctctcgacaatcataacaatctcntncatctnctccgacaccaaactcatcggctctacatacatccgtgtgtaggtgaagcgtgtcncatcgtgtgcgtccgcgcgcgtacgtgagatcgattgaggtgagtctgcgcangactccggatcatgagtattccntgtatgtgtantgaatatagataattcatgattcgtatgtgagcggtcgtacaatgtaacgttatagttatcnacacgtgctgatgcgtgaggcgcgttgagggtcgtgtcaganagtgacagtgtacgtgtgggccgtctgctgcatgttagtctcacgctgcggtatcgncgacgctgcntactagtgtctagcgtgatngtgtcactgcntctcncactcactatgtctacgncgcgtatcncantgcatctatgtcgtgtcacctcagttcatatttcacgtctatcgactgtagncgcgtntcatactgtgtgtgaggcgtcgggttgtgangncgtcgtgtcgtacgtagtctgttctacgntcacagcatgacggaatcagtgacncgtacttgngnntatncngagaacgacntcgtatagagagcgtagtagctactcatacgtgtcgcaacgacgatcgncacgacactactnctgatattctgacgacgttcgantngttgtgtcgcaccgncg

SEQ ID NO: 8406 - DNA, 1511 bp, Homo sapiens
  misc_feature (1)...(1511): n = A,T,C or G
atttaataaaagancaacacgccaacaccgccacaagggggtttatcgagaaacagagaaagagagagaagggtttgagatgaaggagacggggtgagcgggaggaggagganggagtctatgtttgatataaagaacgtgttcgttgttanttagtttcattcaaatgaacgtgatgaggtcgataaacggggtgtacgtgtaaggtgatcagtcacttagaattagtgtcccgttcccgtcttgtctggagctcaccaaaactctgttttcgcatctcctccccttatatcacaacactccattttgtcaccatcaccatggcgtcatattgtcttacacacgatactaccaccatcttttgtgaacactccgccctgattatgtttataagattttacacacatagtttcagtgtcaattattacatatttaaaatcaccgatcattaacacaacactacaaaccgcacaatcacacgtttcattttgaacagtaagaccacaaaatatatataccatactcacgtcctctacgtcccacgaccaagtttttgtttgacccgcgttccacgttttggcacccgcgaaggagtgatcgcgatccgcaacagtagcgagcgtgtacgggagccggtgttcagtggttcaccgcacctctctttccaaccacgactcatatttctcgttacattttatcacctagtcactattatgtttcttcacacacagtgtgcgagcatatcccacgtgactgtgtgacgtacatattccaacatctgttagtacagactccacgctaatcaagcgtgtacggtgaatataaagcaaagtccgcgggacggcgcgccacaaccaactacattctttgtaacacctcgttgttctctttacaaccaccatatgcatgttttacgcgccacagatcctgatcagtattggatcacacacatcgtgttgtctgacgatgtattcgtcgcccactattctgttcacacgcacgcacgagcaanttacaacactgacactcgctcgttataccagtacngcgttcacattgttgttacagttatccagtcggtgtaattggtgcagtcgcgccacacactgccgcgccagcggtggcgcggcgtatactctgccgagagaaattcccactcctgtactcacaccacacactaatcacaacacaccgtagtctcaccactcaccnacacacattnttcaccacacccgtgtataacaacgcttgcccgttatatcacaccctatcgacattcgctgatcaccaagcatctatgaattgtcgacgcgtgagcacacacacagctagtatcagtcgcctntccacacaacccnagctgtattatacaaagcacttacaaacagccgctgtattatacattatgtcntganctagagcatcacgtccgtgagtcgtgcgttgctgctgtgagatcacntctcnactctagcgactgctgtgagtnatcgatcagagtcacacacgtg

SEQ ID NO: 8407 - DNA, 1423 bp, Homo sapiens
  misc_feature (1)...(1423): n = A,T,C or G
ctaagcgtgagatgtggttctgataattgtactagattactatcgttcatccgccgatcgtctgtgatcatcacgcgtattatattcacatctctgcgctncgttagcctnaatacgacttcntgntcatcatctgtctactcgtagatcaccaagcccacaccgagacccacagtatcgcgtcttcttctgtcacgttgcgctgntcagttgtagatacccgagttatagcaccagtccacacgatagtgacgccgtcgcgacgcgggcngctctatctacgcgtcgtgtcgtcgtttagaatttcgtgtggctttgctggaatgctgcagtctntatgctgagtagtatacaactccactcgctgcccgcgtagaatttggttctgatcgacgtacatcacgtattgtgtatgagcgtagcgtctcaatgtattgtcacaccgcaccgtgactcgcgttacgattnacggatgctgtataaacatttcgctttctacttctgcgcgcttcngtgtatttgtacctcattgtgttgctgtgtgctgcgtattgcgtctcctctagcgcctgtgtgagtcgtgctctgattatcctataattgcggatccgtaaagtgatctacgcactcttgctacgtgtgacctgtgaggtgtataagtgcaggtctgcaatgtcttgtgtaacgctagcgttctgtagtatatgcgtcttctatagtatgatagtcgtagtaatactcttctaccgcggtcatcacagtcagcagcantgcgtagctgttatattcgacgacgctgcggcgcctgggcgatcacaacgacatnctctccgacgtactgtcaacactgggtatcatcccacgctncctgattaagcggtcttctattcttcgttgtcgccgttatatatggttcgatcggtagctatgtgacgcatgcgtgtatgtgtctcgaatagtacagtacgcgtatgcatgtgattgtcagtgtattctcgttcatatcttctgtctcgaacagtancgcgcgatatggctgagcgtgactggtgagcgagacagcgactcatgttaattgtgactcttcaggccgcgcgctnctatgcttggtgtagtgcgcgacagtgagaggcagactatgcagccgcgacggttcatctgtcgtgcagttgtgtgcgcgtcngttgctctctactaataatactatgtgatccgacgctgccacgtcgacacatctctgtttatcacagtgtcgtatatatattgttattgcgatggcatgtattctgctgcgtcatataacancgcgcggagcatgtagctgtcatcgttactactacccgtggacgctagtctctgtcggctcgcactnactcatatgatacacatgcacagagtacatctcggccttctcttctatgtt

SEQ ID NO: 8408 - DNA, 1876 bp, Homo sapiens
  misc_feature (1)...(1876): n = A,T,C or G
tgtaacatgcactagcgtcacactacgtagtatatatacgtcattatcttgatacacanataacactcaactccccacatgatctcttatatgatacactcgaaacatcacaccagatttctaagagtagtgcgttatatatcgcagtatgattacatacaactagcgtgtggactacatgccatcatcgtagtcgtctatactagttattcttgcataggtatctctncatatcgcattatgtatcgctattaatcttgagtgtcacgtangctgcacagtacatctcgacatcgtcaatccntctcgtgattgagccatcgctcgntacccagcatgatactcctcaccttgtcctgatatcacgcgctcacacgagtncangacactctactagcgcatacccacacaatcnaactatactcntcgcgacgacgagcggatcagctctaacgacgtctgaagagagctacatgttagcctcagcgactgcgccgacgccacatcgatatgagctcacgcgcgagtctatacctcatttaagacctctcacagtcgatgacactnctaccagctgacgactcatccgacaagngttgaacgctgccaacagcttactgcacgacctactcatcatagcagcatgacngcgctctcacatgcgtagacgacgctgtatacgtgccatgacgtcatcgncatgtgtcgaagcatgcatttacgtagtgagcagtnttgttgctgtagtttgactcgctcgcgattncgacgcacgccttatatggatncggtcgtgtacagctgctnnctcagctagagctacgtccactgtgttcagctcattacactacgcactcgcttntcaaactcgataaagcatcgtgcatgctcatatatgactggcngcacagtagctgtacgtcttgctactgcaancagacacacatatactagccatctatactacttgctacactactccagtctgcactcgctatctcagtgtgagtgctgtagtgtgtctacgatgcgactctgagcatctgacgcgctcgctatgncactctatcagtcgtgatgtacgtcacgtccgagtgcacacagcgtcagccgaccacgtcgatcgcgaacncgtcatgntattaccgacacacacncgcacatgctgagcgactctgtatctcactactcgtcgcgcagcggtattccactcangtgtnctcgagatacgatctccgctcatccaatgatatcatacactctantttgcntgtacgcgcgcgtgcacctctatgntgtantgtacgatcatttgngagcgtcccgtgctctacngccgantcacgctagatctctaacanttcgtctggactgagtgtagctnanctgntcttatacactagtcnacagatcacattagcncgctactatgagttaacgagacatcctatcactcgtagtatcggctagctagactcacagtcgactgtcgngcgcagtaagcaatgtgctgaagntctggatatacaccgactcacgctcaccgccgtcactaccgagcacgtaggaacgtgtgtagacgtagatagtagatngactgcaactcgtatgtagtcaagcgtacataaatatctctaaacgtctaactcctagatagtantattatgtctcacgcgtatagctgtgatgataaggcgtgatctgacagatcactgcgcagtatacttgatatgcacataacacgtattcacatatgatatctacttaatacgacgcgtatatgtcggtagttcgcatgatntgctactgaagcttctatatacgaantcatgatgtagcatctcgcgatgacagcagtacggcgcacagctgacag

SEQ ID NO: 8409 - DNA, 165 bp, Homo sapiens
catggtggtgttatgaaaaaaagaaaagcaccctgggatttggatcattaagttatactgattcttcaactaaaactttcctgggactggtaagacgaagtatcgtaaacaaggtcatgcaccactaataaaagaaatattattcgcttattaaaaaaaaaaaaa

SEQ ID NO: 8410 - DNA, 1738 bp, Homo sapiens
  misc_feature (1)...(1738): n = A,T,C or G
aagacagaagagacaagagacacaaccgacagaacgcgacaaaaccacagaaaaaagaaanggcttgcaagggaanaaccnanaagggagggagcgcccctgncanggggaacgncaaaccnggagagngccaacgaacgagcagcgagcagcggagaggagacaagcgacgggctcacagccaacgaggcgaaggagaccacgcggcacacgaacgcgaggcaacaccccaacgagcgccgagcgccgccacgcagcacggacggccaggcgaccgcaggggcgcgcgagcagagcacgagaggcgcacagcggccagagacgcaggcgcagcaagcgaaagcaccaacaggaacgagacaagagcggaacggcggacaaccaaacaccggaangacgacacaaggaacagaagagaggcacggcncggaagaatctttttcctgaaaagcacggaagagaagccgaccacacagaccaacaccccggagcaaagaagagacacagcaaggcagaggaagagaggacagaggagagagagaaagagagaaggaagagggcgacgaggcncacagagcgacgacgccnaccacaaggagagcagggatgaagaacacagacaggcggcagggagagacgagcgcacagccaacgagaagagcgacacgcaggagagcgaggcgcgagagagcgcggcacgcggacagcagagaacggagagagagggcgcgagacagcgaggagaaaacgacgacgacggcancnagacacacgcaggagccgtgcacacgcacgacacaaagacagggccagacggcgnatggcgcgngcnaccgagcgagcacgccacagacacggacagcgcagagacgacgcaanagacacagacacgaccacgaagtgagcacccagttgccgcacagcagcacgcagcncgcgatgcgacgcgaggagcacaggcactgaaggagacgaagcgcncggcagacgaagagagcgaagacgcgacagagcgagagacggacgaggatgngagagactccgagaagtcgagcgagagacgnagnacgtgacgacgagancgcagcgcgacagagcgcgagacgacaggccgcgcagacactacagaccggctagcagcgacagtgacagagcaagntgntgcgcagagcgagggagagngagacaagacagagagtaagacgcncangcggncgcgcagcgcgcaagctgacgcgcacagagggacacaagactagcagcgacagacacngagagcagacgacagtcacgcgngacgagcagtcngctacgnagaggancgagaacgaagaangacgcganacagngangngagactancgctgagcacagcgcacgacaatgcagcggacgacgaagactcagcgacncagangngacggcagatagccagagnacgacagatgatcacgngcactagcgnanccagacagagagaatgtcgncanannacntagcgagacgaancnagncgacgacgcgncgncacaggacaggnagtacatcataggancgnagcagncacgacatacgcagnncagcgacgacgagcgtgacgacgaacgacgcatcgacagtacgatgncnagtgcantaactacgaangagtgcgcagcggagnacgacaagataagcagcgcnacgcagcngaagncaagcantgacgacncncagacgacagacgacggacgtcgac

SEQ ID NO: 8411 - DNA, 858 bp, Homo sapiens
  misc_feature (1)...(858): n = A,T,C or G
acaaaaaatccaaggtagttcaagggggagggctgggagctttagatcccgggagtttgccaccttcctttaactaatattttaagcaatttaggggccgtgactaaggaagatcacagtcacaggccttttttggattcacgccttgtaaagacatgttcaaaatgttctttcagcccatttcccctaatcttgtgaataaccgcatccctacttctcaagtaaaatcacatgcttttctctatccaatagcactgacctaagcaagtcaagtgagcgaggatcatgaaataacccgtcactagaggttacagtctgcagagatccacctttgaggccactctgaccaaacaattgtgtgtcatagtaataaaccatgtctattagagcacgagtgttcataaaatgtctgctctgtatactggtcagcgcaatcctataggcagagtatctcagtacagcatatgtagatagcaggccagctcagctaaggctaactctcattgccatgctatataatggcacggtcaaggttactcattgtccagggatgcagagttcctgtaatcgccccaggtaagtcctgaatcaaggagccagcatttgtcaactgtcaaagttctgatggcagcatataaggcacatgcagattagcagtgagggtatctggagatagctatcatagccatgtctggttcgagcacattctctttggcacacccctgtcttgatcaccagcagtgatattaaggctcagaatacaagtctacctgatctcaaacctcaatcccatgaaagcatcagtgcttctgttgtgttttgtcataataatctgtggatccnnagttncccccaagc

SEQ ID NO: 8412 - DNA, 621 bp, Homo sapiens
caagcttttaatttttttttcagccttataatgcactgagctcagtctgcaggttaagtgaccatagaatttgttggcaactttaagcaaatccattttaggtagtctgctgagacatttccaagtaaagagtctggagatgacagctgttatcttgtacagagcgagaataaagtcctcatcatgttagcattcagggactttctacttacttaactataatttagtggccagcatgcaattaacagcgcagaattttaagtcaagtggtttgaatccaagctttgaccctgcactagaagtttaaccttgagggaggagcttaatttattcaagggtaatgttcttcagttggcacatagtaagaaatcatgtatagcagcaaggttaagattaagttagataaaatatgtacaatgttcagccgactgtctgactcagagtaagctctctgaatttgcagctgttattaaaacctttcccatacacgagcaatactctttttaataaaactttagaggtctagctggtcgcatcactgatatgaataaaactcaatgagtggtaaaagaaaaaaaaaaaatggcctcgttgacctcagcggtggagctctgcgtcaag

SEQ ID NO: 8413 - DNA, 900 bp, Homo sapiens
caaagcactccgcagggcgcggtccgaaggtcatacacaaagggggccgttcgccgaggggcacgcgcctgggcgcgggcaccggcgtctcggcggcaacgctcccactgcggaaacccggcccacggcctgaatctacaaatcccgccggcgctacccagtcccgatggaggccgaactattgaagcgggatcgagccggggcgcctctaataagcgaagcgacacgcggaggccctctccaaggcccccgccaggccagcgcccttgctcaacccgccctccccggaggtttaccccgatctagtggggatcccgggtttcccccctaggggttgaataaaaggagtacctcctagcggagtggcaaaggttttaaatacacctgtacacagtgtgagagggtagacccgtgccagaaagggagctggcccagtgggcacactctatcgagcctaatcgtccccaaagctgatatagaagattaataggaagtttgagaagggagaggattactcttcaatccaatagctgcattttcaaggttagtctttgagtccagggacgacgcttggattgtcccgtcttaacttcgcagttcgtgctaggaaatgcaagggcggcgtgaactacaggcagttgtataaggtcctgtaggccaacacacagaggcttctattcctgttctggaacgtcctccagtggtcatctccagactctgtactagccaatctttcaacaagcatcgtagaaatcatctgcaggcagctgcaaacaagtggtggggtcacctaccctgcaggtgcgctgcagtgatacaaggttaaacaaagaattataatggtcccgccgcccccccccgccccgcctcgcaaccatccgaccctaatccactccagaa

SEQ ID NO: 8414 - DNA, 340 bp, Homo sapiens
attatgttttttgacgaattgtggatttatgggtatatacttttagtatggacttaagattaaattatatggtaatgcacaaaggaataagatgatggattatttattacgaaatagtagatgtgtattaaagtggtaaataaggatttaaaattggaggtggtaatggtaaaagattgacattgaggatgtcagtatatagagattatcgtgatggataagaatcatgagaaatgatgatataattgagggtggttatatgagtaaggtggggtttaggaagaatcttaaaatctagaggaaccagtcaggaaatggggtacatggggagaaaaatgta

SEQ ID NO: 8415 - DNA, 807 bp, Homo sapiens
actcgcgacttgtcgcacggctggctccggcgaggtacccacgtacggccgatcggcgcagcaatatctcaggataatacccattgtaccgctctacactaaagtcccgaagcagcaacaacagcacggtcaaacagggtggttttgacgcaacagagccagggttcaagcaaagttggagagaccggaatccagacactgtagaagatagcgtgggtgattaatgcccatgtactctccctagaggaaaaagtgcgggaaggcgagatggtaagctttaaggtgtggagttcgaaatgcatgtttaatgtagttattatggggggcacgagtggggtgctgtaagagtcctagcatagttgtacggacattctaaattacggtaggagttttgggaagattgttcggaggcgagggaaccctacttaatagagtctaacacaacatgagccttgtgacaggatcatggacctcatgctggacagtatgctcacaggatttattccttgcgttatcacccggagtatagtggataccggatagagcgggccttggaagtaagatgagtacgcaaaacagcaagcgggatggacctagtcccaacgaagtcagtgaacaaaggatccaggacttacccctcgctgaagggtagcggcgacaaagctccaccgctgaaacaaataaggccagttattcttgtgttttatttgtcgggggaaagggataacattaagtatgtttccatagtaaaaccactaaatgaattatttactgaagttagttcagcctggctttcggggaaggatc

SEQ ID NO: 8416 - DNA, 1135 bp, Homo sapiens
  misc_feature (1)...(1135): n = A,T,C or G
atcgtacgtaggcagcgcccgccagctacacgccgagcatacgtnccggcctgcgcgcgcggctcagtcgatcgcccgtcgtcgcttcagcgtgtcccgctacaccacgacgcgctagtaggcctgtagcgcttacggagatgcccgagcggtganggcgtgtcgtccgcgcttctgctccgattatctcatcaacgcggtgtgtgcggtggacgcatctacgcatcccacgaggatagtctgtcgaagatgcgtgtcgaccgtgtgtccggtcgcgtccgccagcgctcgttgatatgaggggctccgtgggatganatgcgccgattgctatctcagtcgcatatgtcggcgtatcgcgcgcagcggtgggtcatctcgtctcggcgggcgccgcggttcctcgtatcgttactcccgctcccagctgcaggcctttcgcgttacacaccggagccgtcgtccacaatagatagtcgcacggggaccgccgacccgcatccgccactcactccaactcccgaggtatggccgagatcgacatagacctatcccacggctgacaattgctgtagcatcgctctcggatccaggggccctgttcccccgcgcctcgcccggttcggcgggacattcacaggggccctgtacgcgcagacagggttaactctctccgacctacgccccgccctcccccaccatcttccactccgggcatctgccatacctacacctcccgttgattcgcacaccacctgctgcctacacgcgtcacaccggtagtcgcaactattttcttacctgccttccttccgcgggagaacctcccccccccccctcatagggctaaactactgccgtcccacgactttccatacgctttccccccccgcacaagactagtattttctctcacctcacgcggtagcaggatccccttatcaaccagtagtacactctatttcgatatcacttctgtgaatagaaatgtaatgttcacacacccatcccccagattttatgtttatagcgtatgagcttttccgcngaactggtgaggcataatgctaaaaatagaaccctgtactcgagcaaccctcgttccctcgcgtctctcgcgtgctgttcatgggat

SEQ ID NO: 8417 - DNA, 1844 bp, Homo sapiens
  misc_feature (1)...(1844): n = A,T,C or G
tcagttttgtacattagctttagaacgacacgctataancagtccgcacactactaaaatagttaagaccagaatagatgtattagctctatgctagacaatgtaatccactactcagtcatgacaggacctggcagatcacagnatgacacgcacattgaactctgagttaaagatcgtcacatgtcattacattcgagtaatcgcacctattcactccatcncacaagagcacgtctatcctccagtcatcattctcatgatatgagcgcgaacgttatagacgagcagcgctcccgctaactgacgacatgtaacctcagatattgaatatctcaatctgcacacatagtactgagaagacgnctgcagcttcagtataggtctgtgatgagacattctgtactcnagatagcactcagtagacgtatacgcgcgagctatagattncgtcttgtatgccgctgcgtgtgtcncgatatatgaccgactgcggctgattatgagaagtctcgagatgagcnctaggcagaattgatggcatgaatagagcatacgtgctgtcgnatcgtctatgacttggctagcagtcagtacncagtagagagagnaggatgtaagagatcgcgccacgactagccgagcagtgctacagtaggcacagctccacgcggncgtcgccagcttgacgagttatgcgtagtagtgcaatgatgtaagcgagagagtacgcgcacgttaccgctgacactactgcctctcgtgatgcttcacatcgtcgtactgcttgatacgtcatgagtcagataggtagtagagtatganatcctacgcgatatatgatggagtgacgacttatcgatgtctatcgtcatntagccatatgtcagaagacgaccacagacgaaggcaggaggnatcaggtatgagcgagtacaggtggacgaacgattgaacgtggcncgaatagactgatcgcgtgcagtagtatcacgagagntatgnctgtcatagtactcattcgagtgtgctatgagtgccgtcacgcgtcgacgcatcgcttatctcacacntatctcagtctatggtctaggatactcgtatcgagactgnagacaacgtcgagacgagacgctgtngntcgcgtgacacattgtagntctacttnctcgcaccacgctagtcatngcgtatctcacgttcatatctctnantagcgncatcgccgtagttatagcatactagtgtatctcgtagcaatggtcagatgtgtcacggtactatagcagtcgagagcgagtacacacgatgcatacgnacgtgacagcgngatggcgagcatcgtctgtcaatntgctgctagcatgatagtngtcacgacgncatcagagacactgtagaatggatatttnatgtatantcgtatatgtgagtagatgcgatgatagtgtatgcgatattatcacatgatggtataaaatatatgcgctgtagagtaggcgagagtcatacacgacacatantcgactcaacgacatgcactatanctatatctnagtgcacgagctacgcgcggngccaancgctagcgtcatgactcgctctgaagcgactatcacttcagatcatacgcactagatgtacacggtgctatctctgtgtgacacactgctacanagtatcagagactatctatacacctgacaacatcatacagcactacagcggaacatatgntcgtcagctactccacaccacctcgtcctctgcgtgcgacantacctctctgcagccgagccatactcgtaaatatatcgagatatagcctgcacgtatcgtacaac

SEQ ID NO: 8418 - DNA, 676 bp, Homo sapiens
  misc_feature (1)...(676): n = A,T,C or G
acggattcttgctgtgtggcagggctggagtacagtggcacaatctcggctcactgcacctcccacttcncaaattcaagtattctcntgcntcagcctcntgagtagctgggaccacaggcgcccgccaccacacccggctaatttttttgatttttagtagagacggggtttcaccaacttggccaagaaggtctcaatctcttgacctcgtgatccacctgcttcggcctcccaaagtactgggataggttgtttactctttatcactattataagcaaaactgctgtagtcatctttgccaactatcccattacttccttgggaagaatttatggaaatggaattactgggggaaagcacatgcattttattaaggcttttactcagacatttccgaatgtgtgtaccttttacaggcttcttcccacctatgagtgagaacatgtggtgtttggtttttttgtccttgcaatagtttgctgagaatgatggtttccagcttcatccatgtccctacaaaggacgtgaactcatcatttttttatggctgcatagtattccatggtgtatatgtgccacattttcttaatccggtctatcattgttggacatttgggttggttccaagtctttgctattgtgaatagtgccacaataaacccgtatcggcag

SEQ ID NO: 8419 - DNA, 1626 bp, Homo sapiens
  misc_feature (1)...(1626): n = A,T,C or G
ccactctataatgangtcgaggggagagagagngntatgcgaggcccggnacctggngggagaggacgttaggggcgggatgtctgcgttaaattgagcccaacgcgtcgtacagggaagatgacacgattagcatagacagtagaattgagggaaggtcgatctttacgcaatagtgttgtcacgtatcgtgtcacgccggatgagtgtgtactcatcgccgcgcgcatatacatcagatgacactacctagcacaatcctctccaccctacgcacacgagcagctggaggtgcggagtatgttaagcgcagacanctgaatatcatatctgtagtgtctgatcagctagcgagacagagattattacgtcagtcnttatatacgtattacacgcgcatcctcaactggagtctcacacctaatagtcacatgagatagtagagatcatgaagctcgctcatancagtgacgctgcgctgcgtatcgcactcagatgcgccgctcgagttagagcgacggaggctgggagagaganggagcgtgntggtgtgtcagctagacgaaggcgntgccagcagagacgaggagtatgacatacgaggagcacagccgcgcaagtaccatcactacanacgcagccacntgtcagcgcgtacgatgagatgngatcgcgagacggagtgaacgagcagagatcgcggccggacagtgacgtagtcatgacgnacgccgttcactgtcctatcgacacgaacgtgcatcgcgtgacgacatacgctccggactgatacgacatagatactgcgcagcactacgatcgtatacacacnangctcatcgtgcagtgcatcagtgtgcagtacgcgcgctagacgatgtagcatgagtagagcntagacgtgcgatacacgtaacacacaagagcgtcagcgtagaatgcggcgtcgattcacgtgtcctgcagtcgctgtatatgagactacgtccattcactntncgcgcactgcgcctgagtnccgcatgtgttagtgagttgcagtcagngctaacatatagtgagagtacctatnangacgccgtcaggaggtactagaggagctggcatattgggcgcataggtagctaggtggangaatagctgaatatgtataaggacangcagctaagctatcaagcanatgctgacgttgctatctancgtgcgtagcnatctactgtgccgtgtgcctgtgatgtgtgctacgatcgtacgcgtatctctatccagtctaccacgcacgcaatcagnttgcacagcgtantgtgcagacaagagtgagncgattgctagtcatcatcactataatctcgacttcactcagcacccttagagcggttgtgcgagcgntgatagtcgcacgacncacctcacncatcaacncacacacgatgtgcatccaactagtctacccgnanaacaacacggcaagtacntgctatcgagancgctctgatggcttctgcgcgacgtatctcgaatccatctactcgatgtatgatgaagtgtgttgcattatcatgagacgatcacgatcgcgacagcacatagagtgnaggtacctagacgcataccatncncgtctcg

SEQ ID NO: 8420 - DNA, 1522 bp, Homo sapiens
  misc_feature (1)...(1522): n = A,T,C or G
cggtcgcggngaccagcctgccgggccgccgcagcgcgtgcgtgcgcggctcgcggtggcacgacgcggcggctggaggacaggagagcagctgtggtcntnaactccgcacaccgcctgcgctgcgacggcncggccagtgtggggctgtgtcgcgttgaggtgcggcggcacgcgaatgtgaagcagacggccgcggagtcgcactgggcgcgtgcccgtcacagctcggaagtgtggcgagaagatgaagcgatgggtgtgactgcatatgatatcagcgctaatacgccgccgctcagcagccgccgtgtgcctgtaccacgacatatgtagtagctgggactcgccgtagtanattagtcgctgagtggtgcattgctggacgtagagtccngtggtcgcgatagtgcgtatgtgtgtaccgtcgcataagtggaggcatcactccccagcgcacgccatcgcgtgagcgtgctggaggtgctgcgtgatgagcgcagctagcgctgctagcgtgcgatagaccccgtccacggcgcggccgctgtgccgcgcacgtatatagtgcgtgcggcgtaatcgacgatgagacgtctgatgcaacggatccgactactacagacgagaccgctgagccgcgacagcctaacgaacgtatacgccctccgtccagcacgcttaccgcctatcgcagccgcganctcgccgacacgctggcgctggctgatgaatggctgtgcatgtctgctatgagtgagatatatggaactgcgcgcagtgctcgctgacgccggtagcccatagtaaacacaaatgtgtgatgcggtactgtgaaggatagtcgaacatcgagtcgggtcgcgacagccgcacgtcagcggcggttacggtacatacaattgacgcgggcgcgccgctttcgtctgatcacatgcagctaagatggtacccgcgcgcacgccagatcctgatctgttgtgatgtcggactgaggtccagcacgagtgcantgagtggagngaggcacgctcacctaccgactatggagtgggtatggcggcgttgcgcttaacgtattctgtntgtaatgcagctctcctactctgcgcatgactgccgcgcacgtgcgtgtagacggaagctgtacccatcactagacatatgacgcgtctaggaccactcaggagcgtaatatagagtgtggagcggagagtgacgatgtatcagcaccgtacaataggcgctgcactccactacatctggcgtnctgtgtcatacgctctcactatgtgtcacgcaacgcgcctcgtataccacgcccgtggcacgncacctngagaccgcgtgtggtatngcgagatgtagtagctggctacactacagcgcggtnantagtgtatctcgcgcgcngttgacagctgacctagtcctcgtggtgnttgtggcgcggcngcgtggtatgcgggataagtagcggagctagtcctgaatcgtgcgtgacgcaccgccacgaatcctg

SEQ ID NO: 8421 - DNA, 1691 bp, Homo sapiens
  misc_feature (1)...(1691): n = A,T,C or G
gttcgactactgtntngtcantgcagngactantangcatagnacagcgcgcgatacatcacagaaactcagtagtagtnacgtatgtacggtcacgcagcgcatacagcatgtgangtgacgcgatctacgtagctagtctcgcgtccgngcagagctacgcagacgtgtgatcagcactgttgtcgcgcgtagcgtgagtgtntagcgtatangcgatgagctcnacgaggctagtcgtntggcgagcatggcggcntgtgccgacgcggcgtgtgagctcacgtctaagnagtcnattgantangtactacctgaggatgctgatcgtgtattcagctactgtatnctagntagcatgcgtactagcagaggagaggtggctgtgtgtactccagacnctantcatgagtctgcgtcatgctcgcgacgtagtctanctatgacggtacgcgtccgtaccagtncgatgctctcagtcgccgtgcgcacatcacntcatctagagtaagcgcatccatagtatgctcacgatgacatcggtcgtcagacatatcgaatagtaccagctcagtcagtatgcactagcgtagtcacctatacgacgctgctgcgtgctggctagtgacgctcaagtcatctagcgcggnactgacgtcgcgaacttctactngtcaacgttatgtcgatgtgtcgtgatatgccgatggcctanatcgntngtatgatgtatacttctaagtagtatatacgatcacaatctacatcgtatgatgctgctcgcgcatgtctaccgaacgatacgantactaccaacgctcagcgccgcgtcgctaccggcattatctatctcacgtcactgatgtttgtagtctcagtactttatccacgcatacgtcctcgtctangactacgnacttagcttatgagacgacctcatatactgtcgnagcagtatcgatcgaatagcttcgccatcgtcgcgctctcagtgtnactcatagatgaggctacactgcgcagacgtcgattctcagatagtctgatgcacgcgcgctacccggctgagacttcgtagtaagagcatgntatacgagtgctaagagcgtgtagtggacataccacgactactgacatactacagctcgatcncccgacggnacacacgtagtatgcgcagatagatatggctactggatctctaagtatnatctgtatgtagatgtcgnagcgtcatctcctcagtcgttgagaataccatgctgcctacgacgaagcgtaactcaccatatcactcgatcgctctcactgatctctgaacaagtcagatgacccatgcctagctcacgtcgcgcgaagtgtatcgttacgtgtcaggcgcagacggtgtggatgatgatgatggacagagtactatgaaatgtaagacgggtcgacgtgtactagngncgagcgtagcgtcgacagntgaccgacagacgtcagtcacagagcgtatacgcacatcgcggcgtacagtgcacatgtacagtgaaactctnatctgatgtaatncacgctctatagtactactacatgcgagacacatgatcacgcgcactcacatacgtcagtgtgcgtctcagcataacacgttgcnatagtgtcactntgtagtggactttgacggtgcgtacgcataactacgtacg

SEQ ID NO: 8422 - DNA, 1436 bp, Homo sapiens
  misc_feature (1)...(1436): n = A,T,C or G
ctggggcctaagtagcgaaacggacgaagagaggaaaagaaaagaangcgtccggccgagataactcgnagtacgagattcgctttcccagcggcgncagacagagaacagcgagacggagaccgaccgcgtcgcgacggcggggcggtcctccccgcgacgtgaaagatacataccagccgcgccgggtgggtcccacaacacagaggagcccacccggaacgggtgagcgggggcggagcgagaggaaagaagcatgagggagggcgggggacggcacggcaaacctgagactagacatacatgcagccgagcagagaaataatgtgggataaagagaggagaaaccagagacgaggaagactcttatagccgaacggtagagcangcgcggcacgaaagcacacgcgcgcacggaatgtgtctaggaagggacaatgcggcggtgagccggtgaccgcccggcgatttaaaccagcgcgagcccgaccggcgggggcagngggggcaacgccacatgggccggcgaggcgcgcacgagacgttaagccatgttataaccacaccacagcgcaagccgtgccatgatcgcgtgtagcgaagcggcgcggcgcaagagaaaacaaatgaaaggcgtcaggaagggccagaagacgaactgggcggacggggcacaacaatatgacaacgcagacgaatcgcagtgctgttatcgctgtgtcgagaggaatggcggagatggnatgcagagggaacacactacacatgagcggacatagagttgagggagggngacacgaggaacatantgacgaggagagcgaagcgtgcggcgcgcgcgacgcgaacgcgacggaatcaaacaagcctggagctccacaacgacgtagtcgacgcgagtaagtggcgagcgccagcagcgcccgcgccgcgantcgcgtgcgggtngcggcgtctaattcgtactcaccaccactaccaatcgcgcgtctgcgcggatgncggacgcaatacagatacgacgtacatgtgaggtgcaccgcatacgnatgtgancgtggctgcccggagctcagnaccgtctgcgcnacgcgactgaacgcacgatggcgacgcacgnagatgtagtgcagcgaggagcacgcgcatagtccacacggcncgagcgagtcgcagtagcgcgtagcaacgcgnagcagaacgcacacgcgcgaataccaacgcagcantcaccacgcacgantcttcgtacgcacacgagacacacgnagcgcgtaccgagtctagtgagacncgacgntgatgcgcgatacgnatntatagtgaanatnacaganaaagcgntgagatggaggcgcgcgcgacgcgacacangactatacgtgtgacgacggagagtcggatataggactacgtagnagcgagcgcattagcat

SEQ ID NO: 8423 - DNA, 718 bp, Homo sapiens
cttggcgcctaacatcctggcctcgaagaagatgactctaagatgcctgttgtggaggcacggaagtactgtaaatagaccccagggaagagactctcaggcctacatagaccctatcctcataatgacacgttctggtcatctctggttacaatagaaccacttccctgactgccagaaagttatgaaaagaagaatggctaccatcacccatgatcctaaacatgtgctgtcactaacttatgacccacaatggaggatataaagagtaatgtttttataacctttacttggcaactattgcgaccatttttgataagccgaaatgcggtactctaccatgccccgacgtttaaattttgatactccctcactcactcctcccggatcgattcagccggctactcccttcagcaccaatatactacaagacgctcatattagattacccaccatattagtggaccgaagaaagacatcgtaaaatacagcataatagcagtccgcatctagacactgcatatcctagcatatataactttggctgacatccaagaagaaactctaagaaacgcggcaccaactcgatgtgataattccccgccgcactttagacgcttgcgcgccccctttgaagacactaaagcagaaatttattccatacttacgttacatacccacgacctatcggacaatagtagtttaagaacttaacacg

SEQ ID NO: 8424 - DNA, 2389 bp, Homo sapiens
  misc_feature (1)...(2389): n = A,T,C or G
tagtatctgctgcgctctactgtgcacacgactctcctatatgattaactgcgaccgcgacgcccgaccggaagnaagccctcagntctaagacgagatcgagagtggctaggtntcgaatctcatttcacacgncagcntngacaagagcatagtgttatgangtaaacggtagacatctatcataagcagaccagcgaagacgcacatacatngngtttgtanctctcactattgttacctccactcgtgtgcacacatgccgcccgaacgcacgtcgatatacgttcgacgttgatcatacgcagcagcgtccaccagtcgatcagtatacttatatcatgtatacgtcgtatcgtctgggagctgtggcgtcacgctagcaagtcgcgacgcacatctagtagtagtacgaagataccaatcaagatncatcctacgccacgtgtctacacangagagcgacacgctatacatagtgcacgtgcgtgtctcgtcactcgcgannatctagaagcagatcatctaganacgatacgatagactctgtnanatattatcacatgtcncctctcacgcgcacgcatatatcatntgtatgtgtgtgcgtncgtatctgtgacagatgcaangagtccgagctgccggcgtcagcngctcgaatgnacgcgcgtgcgacgaacgcagtagcagactgctacagctcttatgagtctcgatctcgtcacgccatagatgtctatctcantgtagtacgtcagnagtgatgactcccggcagacatatagtacgtactcaggtgagagcgcgtgcgtgcntagngcgagatcacatgagagantccgngctacagtcgtctcnagacnantanataataaganagtagcgcactacntgcgcagncgcacgcgagcgagcatactcgnagatacgcactntatcatgaccgccatcacgcgacggattcatgatgtancagtngntgctgacgancngagcaganatgtgaactangactgtgnctgtacntgtcngncagccacgncatgactagtcagcacgatccgcncgcgacgcncgcgtacgacagtatcgatgattagtagacatataangnatagtatatgacncgncangcnacgcnactgcactcggancnnctgcnatananntctcngcatcgcngcnncgataacnantcgtcgtattgcnacngcgtcgntcgnanngcgctacgcgtcgagncagtcgcaatgaccgtcacgcgtcgacnactggcntgnagcnacntacgtatacntagtactncgtcgtgtngaccncgccaaacgtcngacgatccgtagcccntcggtactactantagatntaagtatgaccgtaannngtgtaagtnnatcganagcatgcagcgcagcccgatcatatnagnttnggtccagtactcangcnatgacnactgctncggtngcagctagctgcnagtcaggancagtacgcgatcagtnantcagganctncatcgancatgcgacgnatcgccatcgtcntgncanctagctcgcanncgncagaacntgcnntagtgatnctattcatngtngatngacnntactgcgtcngatgctacttnncatccngctagtnncgtangcancgnnagtcngtnactactcnnagntanctttgactgacgactcggntagcttnacnannagnacgtngnatggacgnacgaactantcattggncnantganntncatananntcgtancggntgaagctagntggctgtctgctagcnagntgganatncagtncgtgnannctnaggncgatngntacgncatgcgnangcagnntgccnganntcnngatcgccgcatgcagtcngtcggcctgnncanntagatcggtcgnttaanccggatcacgntantcgntannntanttaatgnatagcctgtcagcngacgnacgctngncangtcgatgacctgcngaccngatcnnagttncgaangtnacgnatccagaacgnacntannanntaangntcgctnacngcgtagcccagcangangnntcagtcttaccgtcagccactgancgnntcctagcacgtacgcntcntnntnngccactagcnntactgnntcgtacagcatcntanntngtcnactgcagccngnngcatagtcagttctnagtntcntacngtctgactaatcgaacngnnanactgactgggncagctntnacgtcnacgncngcncgatnnacgtacgacgtcagacnctgntacgatggtcagtctatcaagcagtcgtactcangaacgacgttgcagactgaatcatacgtagtnctngtagtcatgacgtcgt

SEQ ID NO: 8425 - DNA, 791 bp, Homo sapiens
atggttctcagtgcctcatgagcgcaggattctggtgaccccatgagtcatgggaactcgtgagactcaaagcaagtacaagaatgacaaagcaagtaaaaatcaccataggaagtcaagaaaaagacaccaacagaagaaagaaaaaaccctttaagggaacttcttcctgctttttgaactagggacttcatatattatcttgtgcattgggccccacaaataacaggccacaatgatgctatgttagtttagaagactagattataaaaataatactctggcatccaccttttctacccccaccccccacgtacattctttacttaccattatttatattagggtttggtggaagggagggaattaaagcctttgtggaaaagaccaccttaggtcaacaaccacaaagagctcgtagcttagtgcacttaccgcatgacagatatttgtaagacgatcttacgtagtgtataatcatgtgaggagccgtttccatagatgaaattataattgtatgtgatcggtggacctcaaattagattattcttatctatccacatccaaattttcgaaaacatgtcggtattttagtttgttaccggtgctgcagtacgcttattataacgagccatttattacaatatatgttgatgaagatgtgtttagagaaatgtctgcgtgataaacttgttttttgatagttctatttgatgaattggtaagttttctaattttcggagaaggttgttcgatgatatatattgcgtagattaacggtgagcatttgt

SEQ ID NO: 8426 - DNA, 857 bp, Homo sapiens
ggcgggggccgcaaagagttcttatcgatatggcccccgccaacacaggtcagaatggaaggaggaggctttcagagttaaaaataaaaatatagaattggtgatcaatctttttgtccccgctcccgcagaggtgcaattttgacgcgaccatgtcttttttaagggttggggggagggaaggggaattcaaccccattttgtcaaaacaccttgggccaccaacccacaagaggcctaggtattgccagctaaaggcattaagtaggctggcaagtggatcttccccctgcttaacctttaagagaacttgaagcactggctgacatcttgattgcagttgtaggaggacccttaagtcagaagcacagctaagccacacccagattcccaacccacataaactctgaggtataaacattgttgttttaagctgctaaattgtaggatgatttgtaatgcagcaatagaaaaggaatacattgagattcagtggaatgacagcttcctcccaaggactgaggaagagtcctctgacctaaatcttttaggatgagcatttcgtgatggaggaagtggcatcacaggtagaagatgctacgtaatctaggccaggacaatatttcccaaaccactttctcacagaaccccatcataatcttaaaaattattggaagaccccaaagagcttttatttatgcattctatacatattgatatttatcatattagaaaatgcaattgaggcatttaaaatttgtatttatcgatggatttagaaacaataacatacccattgcatgttgagatagataacatttttaaaaaaatgaatatgctttataaaaataaatccg

SEQ ID NO: 8427 - DNA, 1714 bp, Homo sapiens
  misc_feature (1)...(1714): n = A,T,C or G
tgattagatacacgttgataaaagagccgagattaccagactgagagttagcccatctaacacataacccgtaacacagatttatccctagacacgcatttcaccacccttgaagacgatcgacaatgtacagcataatagttgttacgtcgcaccgctccacatctaatatatatatataccgtatgagagtgcgtatctgagtaaagcgcactagcggcgcatgttgtcgcttgttgtgtgtatatgcgctcccgtggtctcgcatacgattagcaattctaatatgattaaacacccgacgctcaagatactattcctacgtctgagtcagtatagagatgacttgtgttcttgactacacgacgtgtctcctactacatcgcaccgtgaaacaccgtgacagtagtaattaataatacatcttataagaancgatttaactcagagcactcgccgatctaataatcatgtacgctcattctatatttattagtgaatacagccctagtcgcaatcctataaccgcgattccgtcgtagttataaggtgacgnattatgcagtagtcataacanctcattatgattgtgttatgccaccgcggctctacgagtcgtttggatgagtatatagatntgcagccctcgtatatatactgtaagagtctaggagctatgacgtggttgacacgtacatgcgtctgcgctcgaacgcattatgatatcatgaatctcacctcacgcgctgcctcgaccctcccacatcatacaaccacacatatgacgcgacnacgccagtatgactatctcatcgacagtcccgtcgcactctgncatgagatataaggntagtacacgcgaacaacanacacgcgtaagctacacgcgtgcgtctaccaaggcgatactgttatgataagtaacagcggcgcgcgcgccgcgcagtgttattgtantatccgagacgctgcgagtatatactataatcgatgtacacgacagagtgnangagagcgtcgntcgtcatgcgtctgcagcacgcgagtcattgacctatgacgcacctcacacgcctcgtantcagcgatgatatgtagcagaacattctgctctctcgccccgacganttantatcttacgtcgcggagtcgcgtcagcgtcacgcgtaccagtatgctacacacgcatatcacgctaacgatncatgctaccganagcagagtatttagtctcatgtaactaaatatataactcgtgatngcgttagagaagtctgaccgcgcgtgatcgatgcagtagacatacagtgactagtcacaactagcgatagcatcaccttatgcactcagancagtgtcaccgcatcgcgcncagcgtgcagctntgtgcaaacgcacgcacgcatctacatanctnagtaccatacaagntntntatgaancatngacgacagacncgcncgtgnagtacgttatctcgtncntgtactagacacgagacgacgctgcgcgagtaactaactgctcgncggccgcgcgctaatgcgactgcncgnatatatcaatgatcgagcgctcccgacagtacacgatcngcatacgagcatgtaataatcagntagtagaatatgacangctgtagagacnagcactgctatcatcgcttcgtgatgtanacgtcacgatgatatgtgcacgatntgatatatatatg

SEQ ID NO: 8428 - DNA, 833 bp, Homo sapiens
cgagtcgcccgcgagattctccccaaagaaaaaggggcggaagtgggcggtccccaattttcatatatcaggtacatcactaaggtaaggaactgcctttgaataaaaagttggaactgcccgcgcttcggtttgaattgggatagtcattaacctcttaagctccggccttttaattaataaaatgattatagcaaaggtccgtgattgatatgttgctctaataatatattagataaagcatcttaagcactcagcttatgatcctttgggggcaaaaataaagatgtttcactcccatctgaacatttatcttatatcagatcatttatcaatccagaattaggacttttgggactcaataaataaacttcgctcagtagcctgtatctttaattttattatgagatattataaaaataggtttttgtttcaataacaaaagtttacatttaaaactgaaaaaaagcctcaagtattaaaatagttttatggagagggacacactcttaagcttctctgacacaccttctctgaagatggacttgtgtcatctactcatagaaaacagggtggaattggcacctagcagccccaggatggcctgcgaccagaggagcatcaaagtcctgactgtgctttgctgaaagtggcctgaattgtcatgaaaaaacagaacctttaatgaaatcacttagtggcaattattatttcatgctaatagttgcccaactctcaccatattgtaaaatagcacttgcgcgttttcagtgttaaagagctaaattaaagctgcttgtaagattagtaaaataaacagcggatgccgcaag

SEQ ID NO: 8429 - DNA, 1043 bp, Homo sapiens
  misc_feature (1)...(1043): n = A,T,C or G
cgcgcgtgcgcccgcgccgcggcgcgctccgtctcggtcgctccgcaccgctcctgaggcttgggagcagcttaacgtgcattgctcacggaggcgtgtatagtggctatgtggcgggctccgctatgcgcctttgagcgctcgggtgagggccgcggcggcgcgccgcttgggcggcggacgcggcggcgtgactccaccagcgcgccgcgctccgtcgacccgccgcgggtcgcgggctggcaggccgaggcgtagttctgcgtctccgcaccggcgtgcttggcgcggacgagcccttccgtctatcggggaacatggtgtcgccgcggggtggggatgtgcgtcggcgctggcgcgaagccgcgggctgcgccggtgcgtccttattcgcgcgtgcgcggggtccacgagtggtggcggcggcgttcggtgggggggcggaggcggggggccggttggcttgctggggatgcggtggggggggttgtgctggccgccggcgcgccgcggcgcgcgcggcggccaggtgggggggggggggggaggtaccaaaagagagccactacgtcttaatttcaaagagtgcgggcgcgcaaccactgggggggggggtgggggctggtgttgcgggggatacgggggtgtcgggggggctggtatcgtggggggatagcgagccggtggtacggaggggcgggtgcccccatgtccctataacaaangcccgggggacggcgatcaatgcccaggcaaggcgccattggagtgccttggatcctccgtgtccttgattagccgcggccgatcactctcatgcaggcgccctcacgcccctacgcatcactcccgatcagcatccagacggccctccgagcctttatgtgagtgtttcagtgctctttccccctcattcttctcggtatagtggagtcaaagtccgcagctctggtcctcccccgagcccctcccccccccccctttgacttncctccttcctcctctcttatnttatataanttacatctctaaccacaccatca

SEQ ID NO: 8430 - DNA, 883 bp, Homo sapiens
cacaggatatggtagatgggcgtgccgcgatgtgtgttaacactggagacattggtgggtgattgctatggtcgcctgcacgctgttaagtgtgggttgtatcggggtctgaatctccagagagtggtggcatgtttgtgtttgtttgttttttatcgatggagcgttttgataggaatacaggtttcaggggaagggggtaggcacgtttcagtggtttcgcgtgggtgctcggtccctcgagaaagagccattgagctaatctacaccaatagctctttgtaacccagtcctttgaggggttttgggagatttcataactatcagcggtcctttgtctctggtaaagggcaggatactctttgggaggggtcttacaccctcaatcagaaaagtgaggcaagatcagagtcctgccttggggcaggtgaaagtatggcagcagaaggtcagagagattgtgtttcataactccaaggcttattggagttataaaccaagaatcatggatgaaaaccaatatatctctatctagatatgtttataataacaccacagtagtgtatccattaaaaagaatacctaattgtagctgcaggttttctgttgattctacatatcagaatgaggttgttctcttatattgcaagtttttatttgatgataattttcaaaattatatatgaatattgaaatttgttaagtgcttttttgacacaagagcatacagtttctgctgccttaatcagtcactatggtacatggccccgataaataataaatgctaaatcagtcactatggtacatggccccgataaataataaaagataaataaacctgttgcgaccacgtttcttttttgtatgcgaaataaaaaaatgg

SEQ ID NO: 8431 - DNA, 1311 bp, Homo sapiens
  misc_feature (1)...(1311): n = A,T,C or G
ccgtctctccgctcgtgcggtgtctcttcctctccttttagtcgatncccctaccgtagtgtgccntgcgcgctttctgtatcatatggactgcaggaggtacagggattcgtttcgggtgccctactcgcctcaaccatctgttagtgcttgtcatgcaccgacgtcggcgaacgtaagtgatgcagactctttcgtcgtccggtcgtgcggactacaccgcgcactcagnccgcgcgcgaacaaccacanttccgtgacgtctagtgctactaccagcactgcgactgataatctagtcgagcaacccncgcgcttcgctgtcgagcgaacagggctctgcggtcgcggcatcgctctcatccggttcacgactcaggtcatggcgtgcgctcctctccgccatctacggttgttccagtgtgttgttggttgggttgttgcccgttgttcgctattgtgtttagctcgnggggctctnacgtcatactgatcggcgcctcttgtctcgagatgttctgcattacggctctcgcaagcgctgcgcgactcgggctctgtggtggtgagtaaggggataataggaagantgggagatgactgaaatgagacggttcgtctgccgacggtcggcgcgggcggtgcgcattattacatcacgcctccatacattctcactacaacactgcttcgcacattcgcaaattctacgtggtctcggtgcggcggcgtgtatatattgatggcggtgtgatagtttgtgggtgttgtgttagtttatgcnttttttttccttgtcttcgttgcttatcgtctctttgtcgtcgtttngtnttgtccggggccgcgcgcattgtcgcgcgcggcgcggcancctcagcccgtccccggcgtgagcgtcactgcgtcgtccgcggacgtgcctcctntctgcatgcctcccttcgttgcatctgtttgcgccgccgccngcgcgtgtccgttggttcgccgttaggctgcgccgctgcatagtgtgggaacgcgatgcagagcgtatggtgtgggtgcaggcgtcgtatcagtgtggtgcgcgtggcggcgtacggccgccggctgcgtagtatactcacgcggcgggnggtagtgntggcgcgcaccggccccgcacgacaagcggcaactcttgcaaaggaaactcatcacaaaccgaagacaccctcacccacggctctccaataaaaaaggtnnaaacataaactncaacatccacatccccaataatcacacactttatnaanctcctacccctttaatctatcttttcttact

SEQ ID NO: 8432 - DNA, 845 bp, Homo sapiens
aatgaccctttgtagttagcccaaaccttcatgtaaagaaaggaaatttcaattaaacccattgcagctcaagttcaggagggctgcgtagccaccaaatcctgaacagggggtccaaggaaaaggaaaacatgtgtttcataggcaggtatcaaaataatcttttctcctatagctttggaaatgaggataatgaaatatcagttggtctttgaggatgatgaaaggaatattttttgtaagttataaaacaatagcgtctgcctttagcaagtaatctcaagagagtcactttcagagtccagactggaagaacacttaacttcaaaatagctctttacaaatactaatcagatggtccacaaaactctctaccatatgaaagttatcttaacccaagtagggaagtcacagatagctgtaaatatctgtgtgcctagctctgtgttagaagcaatggtgaatgtgtgtgtgtgggatggggtggagtcagtgggtatgtgtaggtgtgttggtgggtggagaaaggctgcattcatttaggtgcaggaaaaggcttttttttttctgaccaattaggtttttgactgaatggaccaaactgactgttgtggtgtcatggaaacctagccatggaaaccttatagaaatatcaggagctgaagggagggagtgttgaagaaagcatcacagagagattgctaccaactgattcccatagatactataaaaataactccttttatcttcccattttcagtgagagaatctcgctatttggaaaatcatgcttgctattctgcagcttttctgtacagataactaataaacatgtatcggcaagg

SEQ ID NO: 8433 - DNA, 851 bp, Homo sapiens
cattaaccggaagccccggtcgccggttcaggttttcaccataaccagccgccggaagggcgaacccagaagttcctgccctttagccgcccccatccattttattaatgtttccggcaacgtaagaaatttctgggcaagcctcccgccaggcgcattgaaggcaggccaaggcggcccagtggcctccattctccggggtggcacagtaaccgggttctcacccattcctcttaggttccctggcacggtagatgccatccttccctcctgtttgggaggaggtttatttttaaggtttaacaggtggtctaaagggcagggcccgccagaggatggtggccttgcagtcagtgtgtcctgttgggaaatgaactccagccccccctatccagtggtgaatacaaggactccacaaccaccaaaagatgatgctgactgagcaatgcaacaacaacaacaacaaacagctgctaaaaataaggctgcattcaagactcaaacgtcaccttttgtgtgtgagtggggaaagggacattgcttctgaacattttgttagtaatgttaaacatctcatatggtttggttgtgtccccacccaaatctcaccttgagttttactcccataattcccacgtgttgtgggagggacccggtgggagataattgaatcatgggggtggtttccttcatactgttctcttggtagtgaataagtctcatgagatctgatggtttgataaggggaaaccccttttgcttggttctcattctctctcttgctgctgcctttcaccttccacctccccagccacatggaacagtaagtccaataaacccgtatcggcaag

SEQ ID NO: 8434 - DNA, 126 bp, Homo sapiens
  misc_feature (1)...(126): n = A,T,C or G
ccttgacggttttggttatggcacattgaccanctccttaaatccctccacaatgttcttgtcggaccccttgggataatcccccgggggaaatcccagtcatttttggccccaaaaggccctatc

SEQ ID NO: 8435 - DNA, 816 bp, Homo sapiens
catcacagtctttctgcacttaggatcgctagacagcacttcagccgtgcacgtggggaccattttacacagcaccatccccaagaaaaaggacaaaaatatgaaaaacctggcactaaatggactgtgaagaggacatttctttcacaaatgacagttgaaacaggaagtccaaccgttgccttgttcagcctatgctaaaaatgcgctagtcggatgactcaaattttttgccgatcatgggattgtgggcgaaaatctgccaaacgactgtgtggccggccccagtaatctatgcctataccttgaaacactctgagaagcccggagctgaaagggtatgtattgcggcaaggggttcaacacctgtttctgcaacggtgaaggaatacctaccccccgcattatcaccgggaacgcgtgtgtttgtctttaaaggaggggtatgactgagccttcatcaacgaacagcgatacagttagacatgaggtggaagatgggctcccttcccgcaccgccgcgcgcttcgcccgatcgacagaaggatggcaatccaagattataagtgagagagaagggtagtactgttcaacgctagatccgtccccccggccttctcacactccggtgcaacgctgatatgtcctgaaccagatatagatgcacctagcggcttagggcgagtcacgctcccggaacacagaaggcacacgtgcaaataggacataacattaggccttttgcaacacaggacgaccacactcccgttttggatacagagaggtgaaatgacaacgcgcagacattacacgtct

SEQ ID NO: 8436 - DNA, 1170 bp, Homo sapiens
  misc_feature (1)...(1170): n = A,T,C or G
cggctcgtacttctctcaccggagtctcctgcgatgtgtgtgtcgtggatgcgagttatatcagcttattagggttgtgtggcgtaatgagttggtgttgtctagtagatagctgcactgtacacggtaatcagctgtcgctcagcctactcagtggtggtacaactcatccgccctttagttctctccgatgtgccgctccgctacttcccgcagctcactctagtactcccacagatgcacgcgactcgatcgtatctgtgcgctcattgtctatcagtccgcgcgagcgttgtgaagacacgacgagcagaccgtcgtactacactatgtttgggatacaccgatagtgtgcgagccggtgtggtctacaatcgctccgcgtgatgggtgggtaggcggtattccgagaggcaggtagtatctttgtggctgtgctgccgagctaaaaacttgtctaggtgcagcagagtggcaaaaaatacaacgttgctctacgcctggtttcctccataaaacattagagttcagcttgtgtaggggactgctaaaccgtgcagctatacatgtgtggtcgtctcacacacccccactcgtggccgagtgccggtatggggtcagaggcagccagacaccaccgccatcttcggtgttctcttcatcagatacctaaacacgtcatccctcacagcgctcgtcatatatgttnttggactaaagtatgcgtattgaagctgcggaggttcccgattgtgtaacggttcgtgcaaagtggtgttcaatgggaacaaatcgcccaacttgcatgtggacattggggtgtggggtggcaaccagcgaagagggggggcgaacggcggtccggggtaggttgagagccgcttcgttagtgatgaccgtctagtactaacactgtggcagacctgtccatttgtgcatggtcgctctatccattactcttcgttgtacagggggggtccaattaaatagtctgtgatcagaagatattaactttaacatgtggcagaggttggtgtgggcacaaaggaggggtgtggggaccctggccaatggcaatctaaatagaatctcaaagggaaacgctggcgcccccactctgtgtgggtgctcacgcggggcgaaccgccgcacgcgctgcgtgtgtcgcct

SEQ ID NO: 8437 - DNA, 1247 bp, Homo sapiens
  misc_feature (1)...(1247): n = A,T,C or G
atgtttgtactctctctctttccgcggtggcagagcatgcatggtctctcagttgtgatctcctgctgagattccatgtccgtcccgcctcagcgtcggggcgaccgttcgtggcggcgatcggaatacagtcgccaatatgcggggaccacagccgctcgcataagtgtagttatgcacagacgacctcacatcatctcactacacgagctccgatctacacaaaggaattgtcgcagtactctcgttccatttccgaccctcacctccgtcgtatataagtcactcgagcgatgattctggcgtcgcgtccaccacgtagtcttcttccatatattactcaccgtcctgtatagcttcctacgctagcgtttactgcatagcggtctttaactcagaggacgttcgccacaccaatgctatgtatactaaattatatccagtattagcgctaaactaggaatccagataatacagtagtcgctctatcctgcagcgacacaccacccgagatccctgggcccgagactgcgatgcacgctaccactcgagcgcgcgaggacgaaacaagcggatgatggatgtacgagggcatgaggtgaggccgctcgtggactgcagtcgcgcgcgtgggttccttttagtgatctagcctcatcacagccgatctcgccgcaccccacaaacaccgcgcccgagaaagctccccccgcatccgccgctgtctgtgttgttttgcgttcgtattcgttctgtgtgtgtgctatgggcaggcgtggacgcgcgcgaggcgtgggctgacgcgctcaccgtcctcggcgcgagcatcacgcgatagttatagtatgnacacatacgtcgncgtgcgcgcagcancgctcggcctcacacctcgcagcggtacgtcgcagcggtgaccggcatacataccacgaggaaggagtggngacggtatgcacgcgcgcgagagaatactataccaagacgatcgtcgttgccgaccatcacccgtgtgtgtgttacacaacaacacaaataaaggagaaacgtcgatacccacggcctcgcttgcaccnacgctccacccaccgcanncgtccctcccactcccctaacacaaccctcctctccctnntgctcccactttaaaaaataacaatcccatatattnattatataactcaatctacatatacaccaatacccatatatataataaatancnnctccccccnttcaccctcatc

SEQ ID NO: 8438 - DNA, 1435 bp, Homo sapiens
  misc_feature (1)...(1435): n = A,T,C or G
tataagagagtcagcaagagaccatgtcgtcgcgctgtttctgcacgttgtagtacaggcgtacgggctgcgtctgcctagtgcgactgtctcggtcgcatggaggctcattcgaatgcttattatacttaactctcttagagttcgttcatccttccagcgagctatggatagatgcgccgagtctgttgacgtagctgaagtattggactagcgcgcgccatctctgcatcactcatcagacaatccgtaagtgaggatcaactcagatcttaccgcctagcgcaggtcctcgcaagtggagatgattcgagtcgcgtacttaggctaaggtcatgctaaacacgatgataagcaggtactatgtcgtagtaggagagacganacagcatctactacttgatgatctgtgtgagccctgagtggatcgcacagccaattnagtatcgacagtggacagtagtagaagtactataagacgtgtgatggtgagtcgtcgctcagcaatctgtgctgcgtagatcgtgatgtgcgtccagacgaccactagcgatcacagatnagccgctcgaggtcgccantgttgatgcgaagtaacatctgaacactcactagctctagctgtgantgtatacgaatacagtgtcgcatagcgagtgtactaagtatgagcctcgagctgtctacatgcacgcgctgacgcacgataatgcgcaacgcacacgtggctctactcgncgagnttgtcgtcgtatcagatagcgctagcngcgacgcgactgcacatccantgacgcaattatacgtatatgagagtgttcacgcaacatcantccgcacgcactaagtcagaagacgtcctcagcaccagcggacccagaggcagttaagtaacttatgtacgtcaatgcttctcggtagcttctcgttgtctcgcgttatgtagtaatgtgggaacagcgtacgcgantgagacggtctagcacacgtcacagtactgctattctatcacactaatatgacttattgatctattagtttatgaatgtgctgntcgaaatctaatgtacctatgtgtcacctcgacacacattccgacgtcgatgtctncatcgtctcagccacatctctgtgtgtcaacagccgtgcgcgatacgcatacagctctatgcncgcgccatcgagcgtgtcnatgtgcgacgctagcatctgtacgttacagtctcgtgnctgagttcgcgatcatctcgacattgtgatatgtaatgcgtttgatactatagcatttcgtgatancactctcgagttgatccatgtcagctttgagtaacgcgatctagatgagtcaagcttcataccctccgagatatatgcaactcgtatggtctcgtcttcactctagtagcagtcgacgtagtcatcgtccttagtcaac

SEQ ID NO: 8439 - DNA, 1070 bp, Homo sapiens
  misc_feature (1)...(1070): n = A,T,C or G
gatcatggacttataggaataaagcctacaccaaaagaaaacttcctggggaaaaaacgcctcaaaatttaatttaaacaggccagcgggaaacaacacccggggcgtacccagtgatttgttcggggcataataagcccaccccacacttaaagggatcccggcccgaaagtgttttttgtttcacaaattcctctgaacattatagcctctaaatgagattgttctagattgtcacaacagcttcttaccggtgcaagtgttccaacacgtcttctagttacatgtattataaactcttatgaggggaattttttttgtcgtgctgtgtgctttacaagaatacccttgtaaacaccattgtcggacgtagcctcgaaacctcggagaaataattatatacccaccccaccaacgagaatagcatgcttctcgataatatcgtgttcagccccaaatcttaccatcnccccacatcgcaacttctataatctttcccggcgcgagcacttataatatatatggcttcggacacgagcggttatatagtgagctgcgaaccaacttcatgtagaatttcgctcttgtccttgcatcggcgcgcgtggatatcacctccacattaatcgacctcgtcccaactctttgttgtcaccctaccttttttggttcctaataacggaaacaaatggtaggcgtctcttgggacagaaaagaacatacacaagattctgataacgagggctgtcgcgaccggttggccagaaacgataataaaatcagtccgactaatttttaattatgatcgaacgcagaaattcatgatgtgcggatgtcttattaacaggcgaaggggcatccattctccgtcaactccaaccgcctagtagctctgtggtcgtcgtcgcacgcagccacatacaccacaattatatgagtattgacacgatattcacatcccacacgccaagcgccatactataccatcagctccactacctcatataccaatgcattttttgaaattcaagctcttccagccaccatgcttattatacagatgttaatat

SEQ ID NO: 8440 - DNA, 1331 bp, Homo sapiens
  misc_feature (1)...(1331): n = A,T,C or G
ggttgttaaaggcgaacagcattgagccaatgcttaacatccgtcatacagagaactaaggatagctagtatgacacgtcttataagttgaccccagaccagcctgaaaacaatgcttcgaactatgttttcgaactatcaaaagagagatagatcaactctatgcatatatacacgtctcgaggtcaccactaggtcaaataaagatattaagtgagtatgtgatatagagatgggatagcaaacagtccaagaggtcgtcgtagttgaatgacaaagaagtaattgcaagagagatattacaacatatatcagatagacttaggtcaactacaggcaaccagatagttatacaacgagctccaaaatacaaaccacatcattcggtgcgctggatggcgaagttcatacaaaggtagtagaggatccgacctcgaatgatgggagtatgatgataaaatataaagtgatatggagacttggtctaagccatcgtgctactatagtgagccacgtcaatttgagtacagaatcctagccggcgctgcaggtggtatatgcgtacggaactgcgcgcaccatctcactgtgaagaatgatgtgatacgctactactacgcagacagagtcgagcggagtcgtacgctctgttagcgcccaatttgtaattgtgttcctcctcgcatatatagtgcgatgtgtaatcttgtattatgcgatatagtcatacgagaatctaagtcggtgtgcaaaatgacgatgcccagccgtggcagcccgcatccggatacgncacgctactctcaatatctgtcgcacctcttcgtctacactacatgtctgngtggtatggaagacagggcggagcagcaagagagcagctcagcctgcntntatacttcaccccgaataatactagtgatgagtggaggcgctgcctgcttgagtgatggtgaagttagcatgaagacatacctcacgacatgtatgagatcagcaagcaagagtacagaaacagagagaagatagctgaagtcacatcagatgcggcggagcagctgcgtattaggtatatggtgangagttatgtttcgtgaactggcatagaatgaagaatgttcgcacttcgatataattcgtactcactcataacttacgagcaatataacgaacgcgatgtgccaccgttgagtcctgattcatgttttacacgagcaatactctcttactctatatcgcacgcacaacacagccgaactaggatgttgttgtcttacatctacagtctacttacatcatcgattctaaccacaataagaaacaagtcggag

SEQ ID NO: 8441 - DNA, 810 bp, Homo sapiens
tttctgcatcccatccccttcccaccccgccttgttattcctaccccccagtttatatctttgttaccctacgccctacatcccccccaggggttttaatatccccgcaccccttcccccatttttgcccctctccccccaacctctctccctctcccatctatcccttccctacttcccattctgcccccccccacctatttgtcactcttcctaatactatcatgcccccatttcatgcgccccgcccccccttttcttcacaaacctccccatggtgtttttcttatgggccacattcacaccctcacaaaatcccttccccctacacctctctcactttacacccctgttattttccaccccccaagttctgccaccgcatctgtaagttccccccgtccattgccaataacaaggcatccacagcacccagtccctatggtcaaccatagcatgtgttcgggtgtctttctctccatcatccttcagaatttggtcttttttcaaggttttctcaatcctatttttccctgatcacccctgaaacaagtgagtcttgacctttagaatatccccataatatgttaaaataaaactttaaaatctcaaattaaagtatagatattcttctttcaaaacaatagcataaatgtctggctgttgttgtagatgttgggctcatgggcaagttcaatttgtgaaaatccaataagtgatgtaaatctgtgtacttttctatatgtatcttgaacatcaattaagaacataccgtcacttgtgaagaaaggcacattaagaagtaataaa

SEQ ID NO: 8442 - DNA, 1091 bp, Homo sapiens
  misc_feature (1)...(1091): n = A,T,C or G
gtttcgtgttctcatcccgactcgcgcccactcccctagccatccactcccgcgacggattgaatcgtgtgcatcccttggacacatacaacctattcgcccatgcacaatcgtcgccgacaacacgcacgtatcgtgatcacatccttttttactcctattacacacttagtgatcgtgacgtgctcttcacggacccgttttacatcacgttctattatgtatcatgtttggcagcgccgtcactcacacgtcccacaccgggtcacggaccactccttattcttggtccggatgaataatcgataatctggggcacacctacccaccgctacgatacagnacgactgcgggaactgacgagcgggtctgctgcattgaatctataatagagtgtatttaggcacaatggtagggagtattgcgcggtgtgaatatcanctgacacgcaccgtaattctgtgtgtgtcgcacccgacacttacactgtgggcgcgcgtggtgtgggggaaacacaaaccgtggcgcgcacaccgggggcgggggggtgcaccggcataagtggaaaaccgcaccgtagtggggcaccgccaaccacaaacacgcagaatgcagggtcggggtggatccattggtggtaacaacatagtacttggtatgtggctgcagtaatatgcggtgttgttcgtgggggtggaaatatatgacctggggtggaaaaacaacgaactggggggacaatggtggtaacaagtacaaacataccaattgcatggacgttgggggggggtcaccgggggggggcggttcggtccatcccgtaaggatgcgggggaacacgtgacggggacgcaacaaaacggggaaaggaaatggttatgcctctttcgcaagggggaaagggggctacgaactaaaagggcacaaaacaacactgtactttggcttctgggccgcgctcaacaaggggggggggggtaggggccgtggttcaccaaccgtgccacccggtaagtgacgtacccacccaccgtggggggtggggacactcgttgggtgaacaacaaaatgtacggggcgggtgttaccag

SEQ ID NO: 8443 - DNA, 1221 bp, Homo sapiens
  misc_feature (1)...(1221): n = A,T,C or G
ccgggacatacctcaggagcccgccgccgcctacggttcgttcaccaggagtcgaaaacacgttacatccacgaatcccgcatcttggcttctggaatcctaccagtacactagtttcactgcacgtacgactggccgcccgaactctactagcgacagcgacacatactgcgacgcaagcgaaccgaagatcctgagaccactgtgtctcggtgactaacgggccgtgagacgtggcgggcagagcgtgtggcgacgnacgcgagcagcgcacagcgaccagatgagcgcgacttagtcataagagatgaactcatgccagataagatntcgcccgttgcatctgtcctcgttatagtacatcagatgcagtcgagacacatatcttacggcgcacgcacatctgctgcgccgcgccagctgcaattcgagatgcagtagtgaaccgatcaggtacgttcccatcatgtatataccaccgcatacaccatctacagtgtaacacgacattagtccagcctcatatagcgtcaccggcgatgatagtccactgctctgatgcattagttaagacatgcgacgccgtccctcgcgctaagtcatactcacgccagtccaccagcggctcagtggactgaaacaggcactacgcgtaagacgacaatatctttgatatacgtcgccaaagatcgctagaaaaacgcaccccctcccttggtatctcacacggcgacactaacatcctcaccgcactccataccctctcgtccctgcctttgtctccccccaccacgcctccccctcggcgcccggtgaaagcctcccacagcgccatagccctaacacatgccaccagacacactgactcgcgggcccggtccatcggagagcgacatctacgcgtctgcccacttctatacccctcctacgcgagctgcgtaagcccgagccaaaccgttggtatattatcgttacgcgttgtcactcgtgtattacagtggcgtcagctctgtgctctattatggcgtgtcaggtacagctgacaatggtggtcagggtgagagcatgcatcgtgacgcatgaacatgtataatagttcactcaacacctctcatatctactcgttccagaacagcaccacccacagcctgggactgatgaaaatcagcgaccgtacaacacaacatataacataagagccggtgctacaacaagacaccg

SEQ ID NO: 8444 - DNA, 1038 bp, Homo sapiens
cgccgtcctcctggcgatcccctctcattcctgctttatcctttcactgctctatccacgagttactcacaactacacacctacgccttttaacacagctcttatttgtgttcctagatccatctatctactccttctccatcatacaatgggcgattggctaatatttactatttttggtgtggtagttattcaatctagcggtgtgtatgactgatctacacctcatggcacaacatccatatatggtatactagcgcgcgggtaccgaacacacgtccgtgctctgtgcgcccgtgggtggatgacataataaacacagacatatcaacatcgcatggggaggctcacgctcgacaccacggaactccggtggcctggccgccacccacacaaacacttgttgtctcagggtgcagacattgcacaacggtcagcctaccggggattgtggtccaccacacaacacatgggaacaatgtgatactgctgtcgctatgatattactgacattgacatgctggtggctgtgtacattctctgcacacacaagatgtggtaaggcgggccgtcgcatatacttgtgctgtgggtgtgggccaaacaactacactgggggcaatatcgtaatccgggggtcacggtgcgaaaatggatcatccactgatctaacagactgggggggccgtgtcaccactgagacgaggtgcgggctgcacacctcatggctcgtgtggttttgggaaatcctcgcacctggaactcgcactaaactggctgacacggcaaatcggcgaaccgtccacccaatcgggcaactgtgggacaacagggggcaaaaacttccataaggaacacagtttagcacttacatgggggagggggtgggggtgacaaacctgagcggtcgggggacacctggaccagataacacatagaatgcacttatactgggtacgtactggcaccaccacacagggcggtcgggcacccacagtgggaggccacaacacactgggctgtggagaggtgtaaaca

SEQ ID NO: 8445 - DNA, 1710 bp, Homo sapiens
  misc_feature (1)...(1710): n = A,T,C or G
actgtcagtaatagtcatgctgctgcgtgcagcacgcgcgcctactgtctctgagatctgcacatagctcgtgcacgcgaacanagctgtgcactatcgcatacgtgactacctgtcgcgctctacgcgtcttgtcactgtcgcgcacccgacgccgagcgcggtagcgaccgnggagggcgaacacgcaaccgcgggtgctcctcgagacacgcgaccgcatcgcactgcagtnttgtgatacttgcagcactgatatgcacgatagcgttgtcacacaacgcgctcatgttctgttagctgtgctcctagctaatcgcagatcaacactgcggcagcgtatgacgtgaactcatgcgtcnggaggatctgggtaacacataggtagtcatgtcgcgcgatccttcatcgcgccctgcgtccactacactctccncgaccntcacaacnacgctgcgcgcccggcgatgcgcagtccacaccttcaaactgatatcacatgcacncaacactanggcactgatacacacgtgccctantcgtgcactcaantacaaataccggnccgtacatgtagtntgtgtntgagaactcctgaacacntacatgagtcaggtgtgccggcacgacggcgaggcgcacgacaacaacagatggtgtacatacagacgancgtgggagtggcgagatgtcatagcgatagaaacaaataacacaaataaatgacgtgtgttgtggacgcagactaatacgaaatacatccatacatgcagggagcgntgtgtgctgcgaacgcgcgcacacgtgcacactcgcgagctgtgtgatgctgcagcgcaccgtcacactcagnactctggtgcgatctctgacagcatcagcactcgttgcgcgactcantgactgagtactatgacagcgacgcatcangttccacgactccttgcgcgancagcntgngtgcgcgcatcacagagtcgtcatactagtataatgntctatcgcattgcgacgtacagngttgtgtgatntaggatacgctctcatgtgcatcactacagnacagcgttgntacactatacctcngantcaagtcgctcacgatctcagcncgactgcgtacgtgngcgnctacacgatctcagctatcataatagtacaccacgtacantgcgtctgcgacatgctagatgtantcctgttngtacatatctcactgtnatgaacgactgcagtgcgacattcatgctatcgatctgtcttgcantntagccggagtgtgtgagacacccagagcgcatggtgacaagtcgacactacgcaaggctgccagctatgacacacanactatgcaccccgagactcactctcacntgagcgntacgtactacgtgactagtactatgtatcgtgatactgcgncggtgcgaccagnagtcatnagccgtacgctcgctagtgcatagtgcacagcacgtgcgtcagcacgtcgtcgacacgatcctagaccaacgtctgcntgcncacacgtcatactacngatggntgacatctnacgtagtacatactactacgcatacgaccatcatctactntcctgntgcgagtcatgtggactnacacatactgacgtgtctgtcgcgtgcacagcatcagaccntcnacanantcgtagtcgtgagngctgagcgtcgcgcgacgtcactcgag

SEQ ID NO: 8446 - DNA, 1122 bp, Homo sapiens
  misc_feature (1)...(1122): n = A,T,C or G
ctcttactcgcaccgataccttctttgctctatcgtctgcaatatcttgctctctttttcgtttcttattatttgatcctgcctctcatttcgtcacctccgccactttgctgtcgtgttacaccttatgttcaccaacaccactgcgtgacctggttaccactctccccctccatctcgtgatcgtcatacactgacaccatgtggtactacctcgtgtgtngtcttggcttgtgggtccttgcgtggtactactacatcaacaacactntggacctggcacatacacactactcctgcctgtggtcaatcacttcttcttgctcttcaccacatggtgggtggtgtcaccacacatcttgccatgtcatgtgtgcgtgtgccctgcacctgtacgcggnggaccacttgaccacgccaccggtgtgtccacctgcaaacctgtgctcagcttcgtctttcgttcatcgacattgacaattcggctccatgagccttctggaccctctgctctcccacgtcttcctggcttgctacgtcaccgcacacatggtgcgcaatgtgctcacatgtgtttactcctcacaccatacaacacgtggaccgagttggcgggtggaccacatgtgagacctcctgggaatggtctggtgcgcggcaatctcggacgtggggacacggtgggaccacacggcgctgccggcaccaccttatccctttacaactcgtgttgaaacatgcacacaccacacctctacatgcacctttcgtgggtgcacacacttggaagtgtgtggattactgttaccgccggccacacccctgtgtggtgcgcactggtgcaatgtggactgaatctaaatcggacagcaagggaaaacaggaactgtgcagacacacccggacacggttggtcacatgggtgaccccaactactataccctgcctacacatcttctcccattctccttgggtacaatggtgtggtgggcaaaccaggtgggggtggccccttgttcattctctactctcatttccccctcctcgtgcaccactgaaccaccccacaatggacagtgccccacgtggtgggcacaccccccgtgacggggagagacaacc

SEQ ID NO: 8447 - DNA, 2119 bp, Homo sapiens
  misc_feature (1)...(2119): n = A,T,C or G
ctcgattgtattagatgtaatgcgtcgtaaaactacgantgccgtcttgtctgttgttcgctgtnatccgatggcctacctcgggttcggcgagccgacgacgctactgatgttctgctacgtaatgcaacccacgcggcgtgcgaccgcacatgtgtagccgatctcgtgtcaatacgcttacgtagtgctcagatctactccctccactccgcacacttgcagtttgctgtattccgcactactcatgcacatatacctctcatatgaaatctaactctcgagtnagcangatcagngtcagaggctctcactgtgcggnagacgtagaacgcagtggagtctnagaagcgggtacaatactctgtatacatctcaggtacgcgagcgttacctgtgttacgcgttcgcagatgtgtgagttgtgactgacgagcactctgagtagangaagttgcttcatcgctgattgagctgganggcgtgtgtacactacgactacgatcgcctcaacaggacatnttcacgagtcantatntctcctcgtcgtacagcatgcgtcgatatgatgtgacactgtctcgacgnttcgtaggagcgattgcgcttgcgtcgggnacgtacgtctggtgntgcgtgcatacacacactngntagcgcgacgtgatctgaaaatacgtatacatcgtgtgtgatatgcatnnttgatgctncactncatcacgtagtcgttatgnctnaagtctagtgtngngaggtggcagcgtgtatgtgngtatatgcatataacatatacatacgcagactcnttacgacactcagnacgncagntntcgtgncgtgctacgtctgctgcacgttancntcgacnactacaacntcagcactatancaaagcacgatactgcgtagtgtcacgtgntggtatgtatcttanacgcatacatngctacgcangaaaccatcacataccggtcagtgtatncgctgtactattctgctgctgagacntcagatcatacgtgctncatgtagcattnatcagcgacgnttcactgcatctcagcatcgactatactcgcctnacctacactgtagacatggagatgagggaggtgcgcactgtagctgacgaaggtcgtcacgacgtggtcagtgctgctcgacagatctgcagcatacnacggaagacgtgggncgntntagcatagcacgtgcganacgtacgataatacancatagatgaatacagctctgggacacgacatctatgtntctcactgagtgcgtgtgtgcggctacagctgtgagtcgcgagcgcntcanatngnacgagcgacgtcactcagntgcgctcgattactacactcacgantcaacgagagctcgtgtgctgctgatacacactanacnctacatctacatccaactcgcttcactagacgacgcgcaactctggtgtagcacngcactcgtatgtacggtgtcatgctgntgcagcactcacgcgatgggatnantcatgncactcacgtgcccactcacagctcgaggtacgagtgatgtcacgcatcnnantagtntntcgtacgtagctgatgcgtcgtagatncgntatgntgcantacgtgtcgtgtgccgaaccacagctatngctatgatntcatgatgctgcgtcatgcngagntcgtatgctacttgagcttgntntnctgactangtnntcgtacgntgcagntncntcgacngcgtncggctagcgtntcaccncgacnacaccatcgacncngtantnggtacgcgccagctgntgggaagcatgtcnngatnngtcgtcacngatcgatgtagtccagcagtacgcgtacgtgncngtngtcngtcagactgcgttangatgcatcntancnttggnngtngtgntacnatcacagtcgtcgntgcgctgaacatcagatgncatgcgcgtactattnngtcgtagatgatgattagtggnacgcaccagcagatcantcngtcgntacgtantancaaatgtgatcgantncgntcgtngtatcgactagtagtcgntgctcnntaacgcnatcgancaacaangacgtngtacgacgtg

SEQ ID NO: 8448 - DNA, 1465 bp, Homo sapiens
  misc_feature (1)...(1465): n = A,T,C or G
tgttgcaacggagtaacagcgatacgacgtgagtgaacaacggggggattatactccggccaacgtatttcctctaccattttcaatcgcgggaccattcggacattcgcgttagggtcgccacgcgccgatgaatattttatatagtgttagcgaagtgctcgccgccgccgctattctgggcataaaaaacccgcgcgacaccaagaaagcgaggaatcagagtgtcacgcgacacgcccacaacgagagtgtggatccgaagtggatagccgatcaatctccatactactatcttccaacgacgataaaccgacaacatttacgatgacaggagatcagaagctcttagtattaagacctctaccacgtcatttacttatatatcgacggtcacgcttaatccacccgcagccaatcttgtaccctatgagtgtgtgacaatgataaccacataaataggcatatancgcgcgcggtgaatgtcgtatgaatgcagtttcgcgcgcccggtaataatcgtcgaaacacgngatgtctcgccactanctaccgtctcgcttcgtgatatacgtcattatgtatatagtgtcagtcacacgttgacggacaccgcgatccacgctatacataganatnatgcgagcctacagactgagtgattatgatctcagcgcgtgcgagnantaatcaatgttgaacgtagtaacgtgntganagtcaggtgaatgcacgcaggcgtcgctttgtgattcgattgtatgttgaagattaatatagcgccgcgcgcgcgcggagaggtgcgattgtcgccgcactcagccggcctgatattnatgactcacaagcgacatagcatacagcgacgagcgnatgcggtgtcgcgtgcgtgttaatcgctcaccgcagcacgcgcaccnacntgtccgatgtcagagttcagcgatagcagcgctgtcgacgcgctcgnatgtttgtgtcctggacgcgcgtaagcnacgagncnanatagtagcgatncgactagatgaccgaagacgccacgcncgaaggcgacgacggnagcgtagtatgcgtcgtgagcgntgatatagcgaggcagcacgcacagctacgatagagagcttggcgagtcgatcgnagaggattaatctgtcgatcgtnatcgtcgaaggtatgcggtgcgcggtatagcgatgagatgcgcgtgtgagtctgacgacataccgagacgatgcgcatacagcattagtttagtatagttcaccgtccatcagagttatacatatgcacgatataggactgacgagggacgatcaatngantgaacggcgagtcntacacagcgcatacacttatctcgctctcacgttagatcgaactgcatatagtatcgtacggcagntgacnggctcacagcctgttgacggcgagtgcnagcgcgatggatgtgtacgtcgtggag

SEQ ID NO: 8449 - DNA, 1378 bp, Homo sapiens
  misc_feature (1)...(1378): n = A,T,C or G
ccgcgctggtttgtccggttgcgctccgtcgtgtgatgaatccattcgagtgccgtgcacaccgtcactttatattacggatgtcancagatctgccgcaccacttgaagcaatagcgtgagccgtctcgcgatacatatgtcatcgcacaaccccgcacgtacacatacctagtatctcttacatagatacctggacatttaagtatcatccaaccggcgcatagctgtgactcatcgctcataaacgtctagctcagtgtcacacagcagcgcgcgtcngacttccgtagctcgacaggacccaagataacaccgactcgttcttangacactattctgttgtgcagaacagtgtcatctatgctgatatcgactatcaggcatgacagagacatagccacatgtgaagagcgagagcctcatgagttcacgatagactagatatcagtactctacctccaattcataaataagctccccacatacatgcaagattatcaccatttgtgtatcgctatattatcgacacgtagtaaactgctgttgttgatgtgagcagcgttgtcgaggtgcgcacgcgtgaatgtcaagatacgtcaattcaatgcatgcacatccagtagatgtcgcgttagtatatagtcgagacttcagacctaacatacgcgcagcggcaacaggatgatctaattgtgtagacagccgcatcgcgccgatcagcgcgccgctcacgcactatataacgccgatcttgtccatcgtacttttaggaaaggctcataaaataaacattccatcgccgtcatacctcacacctatactcgagagtagtccacattcttcttcctctccgcccactccttcacgatctattatgctacagaccgccttgtatagtgagatgatattaaccgatctctgtctgcggtcgccgatccggcgccgtgcttgtaccagcgcccgctcatatgctaatncccgtcgaccatccctcgcgcaacgcgtctactattattgctcctggtagcgcggagatactctttctttgcgcttctcatatttgaccgttcaatagtatgaattatctcagttcaaatataccagacgctgatcatcgancaccacacaccactccacctcgcatatgcctcgagagtagtgctaaccggagtatcacgctgctcgtagtcatcgcaatgnacatatcgtctctcgcgccgaccataagtatcactctacgcgtactatgagcgtaatgatcgaagatcgtagtatcgaatatttatatacatatacaccttctcgagcgagagaggctccgtccgtccctgcgttaatctccgtgactattaacgcaccggacaaatcaagaagtt

SEQ ID NO: 8450 - DNA, 1040 bp, Homo sapiens
  misc_feature (1)...(1040): n = A,T,C or G
ctgcgctgcttctgcgttcgtctgcaccaccacacccgcagtactctacagctcttccttgcagtcacgctaagcagacgagacgttgcgcgcnaaacgtaagctgttgatcacgcatacaccttcacggacggagccgtgatgcacgctctttttgtgggtcggcctactacgtcgctataataatctgtgttgatggtcattgacaagttggtatgttcnaactcaaccagtgttctggtctcattatgtactacttaattcaatgtgcggtctgtcgctcgactctcgtcccgcaatgacggggaaaggatatagtacattctccacgtgatcaggtgacacaaaaggtagaaacagggatgacacaaagtgaacggtcaggtaccaaccacccgggcactgggtggaagtgggtgtaaggtcacaccaaccgcgtggcctcaacgccacgcgcaccgggtaggagatcatgcaacaaatgaacgcctctgtgatagaatatagccacacaaaacacggagagccgggggggggaagcaaaagggcgcaaaagggtggggggcacgaacgacaagggaactgacaccggggaactgaacacaaaatgaatcgtgtaggggctaatggcaaaaagaaaggccggtgccgcaaccaggggagggggggtgacaacgcaggggaaaaataaacagggggatatggggatccctgattaaacgaaacgtaaaggacgggggtgcgtgggacagggagggggggggagaaaaaacggaggaggcagggaacagaaagggaagaaacaaaggggaatggaacagggaaagggaagaaaagtggaaaagggggcacagggggaaatgagcacaacatggcaatacgcctttaatggctgggtggccgggtgggggggggaaacgagggggaggggggacacgggtaatgtcaatactaagtgaaaaacaaatggaagggaggggacaccacacagggggggggggcaaagggggggcacacaccagagacgtggaggacataaa

SEQ ID NO: 8451 - DNA, 813 bp, Homo sapiens
  misc_feature (1)...(813): n = A,T,C or G
ctggtctttcaattccagaagttcaaaggttacaaaccctttaaatctttggcattgagtatttaaagttaactctgaaaggggtcctcttaacggccaaattttaaatcctcgtttaaaggcctttctcttatttccaaaaatcaataactatttctaattgaatgttatggtgaagaaagtgattttatcacctaccacaaagcttggttagtagtgggccaagaagaaccaccaaagcattcccaaagacaagttggcatcccccaacacccaaaagttcatggtcactgttggtgggtctgctgcaggtctgatccattacagctttctgaatctcatcanaaccattacatctgagaagtatgctcagcaatctatgagatgcaacaaaaactgcaacccctgtagccggcatttgtcaacagaaagagctcaattcttcacagcaatggccatcacacaaccaacacttcagaagttgagtgaattgaattcaaaagttgttgaatgaattcattcaaaagttgaatgaatccattcaaaagttgaatgaattgggctatgaagttttgtctcatccaccatattcaccttacctctcaccaaccaccacttcgtcaaacatctcaacaactttttgcagggaaaatgtttccacaaccagcaggatgcagaaaatgctttccaagaattcttcaaatcccaaagcatgaatttctatgctacaggaataaacaaacttatttctcattggcaaaaatgtgttgattgtaatggttcctattttgattaataaagttagatcggcca

SEQ ID NO: 8452 - DNA, 1043 bp, Homo sapiens
atattcccattactgcgtctgtattctttaacacaaaccgggggcttctctggcaacaaacgcgtgtaaatgtgtctttgatcaagccctcagggaatattcacacgggtggcgatatccagggatttatttagggcctaagggcctcatccacgtaaagggctatcgcgcccctgtagttttgtcccagcgagcctcgaacttatttggtccggagtcttccttaaatataccctccttcagggggcataaattcccccccgtggagaggggggtgtgaacccccaccaaaacaaaaaatttgattggagggagaacccgaagaaataccacacatgcttctaaaaaaaaataggctgcccctgtgggaaatgtgagggaaccatccctggggggtggcttattgtgggatatcttttgtcacaggaaaaagccccccgcaatgaggttgtgttcgcacctcttcctgcgagagattttgtcagtactcaaagaggaggggggggtgttgtacatacactcgcccgagtaaaacaaccacgacttttataccacttgcggtgctacgtacgataatgccgcgggccccatagtatgatatactaatctacgtgatgagggggagggagaacagcgtttcccgtggctcgatatcaatgggtggtgttggcgacatgcggcacatcttactataaggtgagatggcgcacgactggcgggcaggagtagaagcacatatgccagtagacccagacgctcgtatagtagttattgcagcccaggcgaatgcgttatccataacggtatacgttggtagcactatggttaaagtacaagagttcaacaatgtggtgaaatcacatcaccgacactacatgggagacggaaaagaatagagccgcagatagatagacataattacatatagtgtatggtttggggcgcctggacaggacatttattacgcacgcatcgtgatggattttctgtcagacacaagagagtaccactacatagcgccgcagtgatagtcatcccccctc

SEQ ID NO: 8453 - DNA, 1213 bp, Homo sapiens
  misc_feature (1)...(1213): n = A,T,C or G
acacgggacggccaaaacggggggccatttggcggaaaagtatatttgtcctcgtacccgattttacggaaaacgccaacgcgagcactgctagtgaccaccagacttcatctaacgctggtgtggtgtcttattaacaacggtaccggcctcctcgagtgtaacagcgacgtgcgaaaaggagttattgctaaaatctcaatacccagcagttctcgaacacaataattgcggaaatatcatcgacttcgccccatagtttacgataaacatagactcgcgagcgtacattaacctccatactcagacatgtgggtaagatgggacgcgttgacctcttcttggtatatatgcagttagacatggggcagagccatgatataaatgtcatctacatatgtgagttggaatgttccgcctcgctcatagcggtaatattatgtgcttttcgtctgtgtgcatatgtggtgatcacatcatcggtccgtctccggcgcacatcctaatgcgtaactcatgcgtgtatgcggcggccgcggagacgagaatgtgngnagtataatgtgatcgctcttagacgattcnggttagcctangtcggaagccagcatggccggcgtaaaggaatataacctgagtgattgttacacacctcgatctcctgtntagtaagagaatatgattggtgcagccactaatatactgtgtgaggacgcgatagtcatatcaatatttggtgggtgcagccgattatcagagtgacaaaccgtaatgggcggtttatgttgtgaatgtgaggtctgccacctcggtgtgtgtgtgttagggtgtatgctggcatttccgcacggcggcgcgatctaatatagtagagacttagcggcgctggtacatattactggaatcattcgcccaattacccgggtggcgtgagtgagcccggcgaccggggtgacgctgtggatctgtagaggatggaaaaggggtcgacctgggcggaacgtttgtggcaatgagaaataacggcagcgggatataggtctatgggtggtggggcagggagatggcgtggatataaatatatcgtcacggattaagtgggggtgacagtgcgtctggactacatgtttggtgtaatcacgccgggtagaaacttcgagtatatatgatgtactaggcgtctggtacgggcgagttggcgtacacgccacag

SEQ ID NO: 8454 - DNA, 1952 bp, Homo sapiens
  misc_feature (1)...(1952): n = A,T,C or G
aactattctcaccctattagtagattgctacaagatacttntggtgccgctatgcgcagcgcacgatgagncggcgagagcgtcagattgaggngngtataacatgatgcgncagcagtagggatcgtatgttttncngcatgcggagacgttgtgtnctctcgtgagctcgatagngtgggtngtacgatatcagnagagtatgcgatgcggncgatgtaactcgccctcgcngcacatgattagtctgacatatgttatcacgcagatgtnctgtgtgtcgntggtgcgtatcagtatgtcgccagctgttgcagttgtatatctcacngcanagacatntgattattgagcggcgcacattcgcgccataccatccgctaacgccgcgtatggtgtcgtctactcgcagttattatccgccagttcaatgttatgttcgcatcctatgtatacttcggagacgcagtctggtgagtcgcaatgacgacagaactagacggagacgtgagtataggtgtccgttatatncatcggacgacggtgagcgcgcgcatggagtagtgagctttngcgtacggngtgatcagttacgtggtatagtggtacacgttatgtatcacgcggcacgaatcagtcgctagaggagcagatcgatcntgtacatggtggtgtcatgcagagacgagtgtagagactcgtatcgcaagtaatagtcgtggtgagtacgtagcgagcanttgttcacgatagtcgattagttgatgatcgctcggcgcacacgctgagtgccgcactgctcggtgtgtagatggtggtggtagtctcacacagcatttatgcgtgcgacgntctgtgatcgtcttcgctctctgttacaacatgtatatatcacgtgacgcgcgcattctgtgttcgaccgctctcagcgtacatagtctggttgcgaggtgagacgtatcgtgtatgatgttagagtcgtattcgttcattacacactacgtatatccncgctcaaactccacagncgacgnagcancagcgagatggatcgctantagtgatgactgcgtgncatagnacgacgtcggtacagcggngtcgctgtnagtgtcgactgcatcgnaccantggntcngctcgcgcaacgagttgtgncgtagcgtntcgcgatgctcagtaactagctacttcacgnagtaggtgcatctcatcncntctgagtacgcacgaaatcgaactacagctagtcatgtatgcagctgcggcgtncgctgagnacgncacatgatgagcactacagcgcagcgactgagctgctcgtcgttcatngnatgagtgcgtactagatgantncgtnctgtcgnatcgcatcgatgctctgtcatcgaactgttgtagcgatacggtatagatcacatctgccagctatgcagatcatgactgtgtntgttcagatgatagatcagagacgtcgtantantnattagatatcagnttngnacgncagagnagtcatcgnctgtaacagacgtngagtcancacaacgntgacgagggntcgtgacgagcacgtagacgntcgncagacagtacgtangagctagagcctgagtactgagagcantagtagtntcgatacgagcgtgcgatncgcnagtaacgtatttctacgactatntaatttgcatatgcatacgancgacgtagtgtcagantgcatcagtgtgatcantgagtatntgtggatcaggtcgatcatcgcgcacagagctaganatgcgncatagtgatgtgatagtcgntcagagatgctcntcncntcacagtcgtantgatgtgtgtgcgtatanctatccagnatcgcatgtgtnttatcganctcntacgncagcgatgcantgtcntgntcagatcgtgtgtgntgatctagtncgcgacgatactgtcgg

SEQ ID NO: 8455 - DNA, 1394 bp, Homo sapiens
  misc_feature (1)...(1394): n = A,T,C or G
acggcggcggctcgtgcgagattggcnnntcccannnnnanaaaaggccaggggttttttgttcaaaccaaccccgtggacactattcttccntcgcgtcttaccttgctccggggatccatgggggccacgcgccacaaaaccccggtatttcacccacccggcggcgggggagggttctctcaacatatatagatccgactagagtgcccaacaaagtccagaggattcatcacacaaacacacaccctctgtgctttatttattcatagtggctctatgagagaagcttccgtngattatataagcacggaagagatacaacaccgaccacgtncgtgcgtcgtatatcgcatagatctggtctgtgggggtcattccttagtgtcggcagatacctcgccgatttaacatcatactggtgagcgggcgcggtcgtgatccacaccagtctctgcgatcgcagcaaaagtatccctctgtccgcgacagccgtatttgctaattgtcagagataaatcggtggcaggtgttgcgcatcagtaaaattgaagcctacgggagaggagacgctnctgcgttatcatcattatcgactcttatcgcgcattagtaacctaacacaattctacancgtcacttcaagagtaatacgacggatgatgatccgacgtaattgcaagtgctattacattatatgtcgtgtatacactcgttatccgcatacccaaaggcatatacctcgccctgagacatcctcgcgtcagagccagtgccccgctgttaaatgtacagaacgaagactgagactaatccataacacgttgagaccctctacccgtcgtaccgcgtaccacacgctctcacatttcgaatcatctgcgctttcgcacattattcaaggacactcttcatgacacacagacatacatatttatcttaccacgcccgccgccacacatatacatataagtaggtatcgcctataccgtcatatgctaagtaccattgtcattacggcacgtccgtcgatgcgacagtatccctcccaccgctgccgcgctaaagcaacaggatctaagaattgaagagtgagttcaaccacataataatatctcatattactcatttctcagtgccgtcgcctagcaagaggccgacacactcagctccagctctatgaccacgccccgatngttacgctgttgcagagtcgctgccttcacctgatagctacgagccactcacgccgtgcacagttcagttctagccaccgctacatagcatacccacattaccaagtgatactctacgagtcaganggacacgacgagtcatgatcagtgcaacgactatctatgcccgctccatgccatccactcagcacactacag

SEQ ID NO: 8456 - DNA, 1775 bp, Homo sapiens
  misc_feature (1)...(1775): n = A,T,C or G
gcttgtcgtacagatgacactattcttccatacgtatcagcggcgtctatactatctagcatgtataatgtgatgagcatgcatctagtagcgtatgtcacatantgtccagancaatcccagatcacactctctatgtgacatcgatcgctatctgtcgactttatatgtacgtagcacgatctgcgcgcatcacttacacactcgcntgtntcatatcatcgtccgtcccatccctgctccgtcggcctagcactcatgttacgtgtgcttcctatgaacgtgcgtgagcgatatgcattcgcggagctcgagtgatgatccagagntaggctgcgcgaacgcaattcactgatcaacgcacgtctgtgtacgacgacgcactgactggtcatacagcactgccatacgagtactcagatacatcgtgacgcgngntatgtatgtcggattatgatatacatncctacaacgtccgtgcgttatgatcgatatgtatgcagtctgtgtatcttcttcgngtacttgtgtgagtggagcgtgtaggatcaanagatcgttctcaanatctagcgactaacagactgtcgcgctggtacgaagcgtcgcgtggacgactgaataacataaatatgcgnatgatctggtgtcgtctgtgtattctgtttactaatccacaacanantgggtgagtgttgaggttgntctgcgagatgagtntagatatatcggcacgtcagcgtaacatcgctgaactcagatgtagttcgattgcgctatctctcgacgtcaagtcatatcacgcganacatacaccagtagtgtagtagctcgtgacgatgcatgtgagctagcactatagacactctggcgntgtgcgacggcgtgggctctagttgcgcaccanacgacgagcactngagctactcgacgtacacggnctgctactttcgttactacatatttatgtatctgcttggtgtacantatacatgtgctatattacgtactcgaagtgttgagtgctaaagtgtnatgataactgtcgtcgagagngagatcgtctcgctgcgtgctactcatcaggagatattgtggagctatnactctcgctacttctatagtatgctagcgcgctgcgtgggcgtcgcaatcagtatgtagagtagtgtagcagtgacgtactcgagaancagatctcgcgtcacagcacagcgtacagcgngcgatgcgagaggtgtgccgacgcgcatctcgacaggcatcgtcacgtcgtgactcgctattgcgtgcatttatgnatcagataactgtcgattatgtgcnanctatcgtgtgacgatgctcgcctgtnagactctattctacgtagcgatgtctctactcacattaatacaattacgtancatcgctattgcttcatgtntcatgttctcactagttcatgaagtaaagtatgcacagtgatcgtagaatcatgctctctcgtatatagatgttgtcatntagtagtcatatcgtnattgacactcacacacacactgcgacacacacatcgagcgacatgtcnctggctntatgttatcgnaagttantgaccgngatnagaatagtcgtgtacgtaccgtgcgctcggcgcacgtgcgcgcatgctgcgacgcctatacngacatcgcnntgatgctngatattatgagtgcancagnacgcggcacgctctactatgcccntcgatgtcgtcgngcgtgcgagccggtcaggcgtgcgtcatcagg

SEQ ID NO: 8457 - DNA, 1096 bp, Homo sapiens
  misc_feature (1)...(1096): n = A,T,C or G
ctttgttgatagagaaccacccctccccgcctcctcgtcttttgaatctgcagtcgaactctcttcaattaaaccacgcgtttacagtttgccctgaactccccctgtcgttgttatataacctacagatcccggggatgggcttcaccattctgggccctaagtgctgtgaatgattcccgcgaagatcttacgcttaatgtgctgacagtatttaaccttcctatcttacgcatccgctgcgcggcaattcggcctctcgctcccttcaaacttcgcatctctggatcttatatatcccccgagtccatccctcttgcaatgtagcctgccgtgccgtgagtacttctcttactaccctctcctccctcgcacgcccattgtgtgcgtgactcacgcaatctcataggttgtccgctggggacgcgggcgcgggcgctagcatacgtgttatgcggggggggggggcaggacacgcggcgcgaacccgcggggtggtgtgagctccgcttattggcaaccgaactccggtggggctccactccaaaaatggaccggggggggggggtacaagcggacataagacattggagggtggaatgaacaacgggtgtggggtggggtggcgaaccaacggagcgtggggggaaacacaacaacggggggggacgaactggggcgcacggattacacgacgagcggaacataaactgtcgggggggtgtgcggcgtgcaacacacggggagtgggcgagggcctgaaaaacaccgggcgcgtggcggaccggggtcaaaatgtgaaaacagggagtagaaaaaataagtgggacaggtgtaatagtaatagtggacgatataggggaaacggggggaacaaggggggacgagtataccacatgggaaaaacaaacaacaaatgtatactggtgggtaccgggggcggtgggcaacactagatgtgaggtggtgaacacgggaattgnggtcaatgaaatggggtaaacattatataacattgtaagacacaacaccaacagggggcggtgggggcaagaggtgggcaacaaacacgaaggaagtggaacaacaacacaag

SEQ ID NO: 8458 - DNA, 795 bp, Homo sapiens
tttttgtctatgaggcctttcacatttaattttaaccagtctgtgcttttaacgaacattctggaattaagattcaaggactctttaaataaaccacaggtacaaggaagtcaaccctacaaaacaaaccgtcatgtaaagactagtgttctacaacatgggaaaaactgctaaagtatgtaatgattaaagcaccataatgaagaagccggacccattgaacacaaacccagccaaccacaaaacacaagcagcatggagcatagagtctggggaccaactgcatggtgctgaggaatgcagcagttacaaacaaactcaccaaagaaaacaccagacaaacatacatccaatagtattgtgtccggaattggtgggttcttggtctcactgacttcaagaatgaagccacggacccttgcgctgaaggcaattgagaaaaagaagatgcgagaagagctgtttacccttcctttatctgcttaaaagcaaggaataaatttccattgtaaaggtgtccccttgttctcataccaagaagaggagacagcatcaagattactctacataaagaaacccaactaaataacccttatctataatagtttctcccatatatttaccttcctacaatttaatgcccctagaagcccaagccccttttctttggttgcttccccacaatttatcgtactttgttaaaatggtaggtaagctcctaagtgtaaccacttctttggatttttttagttctttctctgcagttcccatgcatataaaaatataacaacaaaa

SEQ ID NO: 8459 - DNA, 1959 bp, Homo sapiens
  misc_feature (1)...(1959): n = A,T,C or G
gtctctgcgcgtgtagtacnatacacaggcgagtcntggcgcgacncgcgatctcgcgtgancgtcgccctgacngacactcagcacgagcacaggtgaccaggctgactagtgcagcgcctcattanctgatcacgactatcagcaacacaccgtccgctgcatagtctctgangacgtactacagnctccatgcactagngcgacgtacgagagacaatgctaccatcncnagaantcagcagacagacgcagtctcgtgctatgtnagctgactgtcatataacagatnactcnagctagagtcatagatatgacgcntatacgacgagcgtcatagcgtcggagtatacgcgnacacacgagtgatgtagtcgncaganccntgcgcgtgatcggtgcgttacgcgagagagactgatgcaagagccgtcgacgacatcagcatgacgcagtcactgatacacgatcaggtctagtggctatgnctcgatgcgcgtctcagcagcagaagagtcgtctatcagctcgtgagacggtngtcacgcaaggtatgnagagagaaggtanagacagtcgaatagacgagtcactatggacgagtcccagtgtcacacgngatgtagagtatgatgacagagtgatatagangaaccgantactacatactgcacagagagacacggcctgaatctacttatccanatggtggtcctactgaatcatgtgtatnacacatagccatgaatgtgccataccagacggacaccatgacgtcgatctcacgtcagcatctatctagataatacantcgagtcatcgcgacgnaggantcgtacgacacacactagctgctaatctatcgtantcgtacacagcagagacaccgcatataattgtgctgcgcgtgtagtacgcgaccgaacgaagagtgatatanagacgatcagtacgatgcgcatatgagtacgtgcgtncggagtgcgtcgcagcggagctagtacacttcagcgctgcggagagcttacgagtgtggtgcaacncgagatacantcnatgagtagagcgcagcgcgtcagtnacgcacgacacagacgacgcgtntacgtatctcgtcgantgggtatnatgcagtgtgcactggtagtaganacacatgagcgacagancacatgcgagactcgatgntggaccatctcgtcactcatgatctcacgagcgacgtgctgcatgacgctcatgtcagtacgacagcggcgcgtatgaatgcactgtagctcagncacagccncgataatactgacacactgacgcggnctgttgatatactcntcgctctantagacgtagatcgcagtgcacgcatactaactaatacncggacactcantacacacagcacaagcgtatctgcgtgcgcgctcgcaccagatntacgcatgcacacacgctcntggacacgcgtacaccgcagcatgcagcganaccgcggtgtagagtgacacagtacggagctcgctaatgccacactgacagcaggcagcaacgcagcagagcatcngtgtccacgcgatcacgagcngtgatagatcgagtatagatcaagagcacagtcgcgagtgtanagacgcgcacgcgacagcgcgtatgcacgacactctacagtgcgcacntgctgactantgtcgtngacacgcgacacactgtagtgagacatcacacagctcatgtgagcacacgantagatacgcgttatatcaagacagtgcgngactaccggtcgtgactatacagacgcgatatacacnagntgacacgtcagacgcacactgcgatgcgcgccacacacgagtcagagcagatgacgtgtgcgtcggcgtgacactactgcnacacactnactgacgctcgcngcagagacatgacagagtgncacgacacaantcagcgcaacngatg

SEQ ID NO: 8460 - DNA, 2302 bp, Homo sapiens
  misc_feature (1)...(2302): n = A,T,C or G
agtgcataatatattgtcagtacgtattcttagaccgcgagcgtctacctatgagtggcagctatctcatagcagnaggangtcgaggcagacgcgagcgtcagcgacgtgctcgtcacacagctgcnattatcgtgctcatgcacacagtgtcnctgnacgctanacngantatacatcgcagntcgcagtnactatactacagactggatacgactggngtatgtagtngccgncagttgcatctacgagtcatacggctgngtcacgaggtatgatgcgtagtatcaacaagttagatgtanctagatgatactgnaagtgagtcaaggatcnaanatgtacgtctagatcagtgatcacgcagactngcggtcagctacgntactgacanctntactggtgncacgtctgatgntctgcagataancagncatcactagcatctncgctatcgcgatgcaggacntctgagattctgcgtcgtatgtcctgcngagatgtnactcgcgtcgtgaacgctgcgtcgagtctatgcgcgctgtganctgattatgcagtgntaagctgtgatgtgacgtgactgatagcgtacacatacgtatctcagcacgctanctcgantancgctncagtatgatgtcgcagnatggatcagcgactctgatgctcgatagantacagcgacagataactgatagcagtgctagacgancatatgttatacgctctcgtgacncgatgtcgcgagtcgattcgctntncncgctgatgngagtaatngtgtgagcgntctgacttatagtatagtgagtgtacagagtaatcagtctgcgagcatcacgtcgtgtacttcagantgtgaganatacagtgnanatatgcagtatntgattcataactnagtctacgtggngngcactnacgctagttacgctacgtgtatcgtgagactgagnctncatcagnctatcgatgcgagctagcgacgatagtgtgcncgctanacgtcgtttgntgagacgcgcgagggactatattcacatagcgacacgtactngcnctgtactnagatgtaggtcacgtgtcacgagctgcacacacagatcancgactgancnctatagtcacatacgtgtagtagtatgtnctgnatagtgatgctnanctatgcanctcctactgagatgncgtngtgcatctcagntatctcgntttgctacacgcgtagacgggccgctactgcagtgcatgacgaaacgatatgnagagcgcagcgnacgcgtctgagtgacagcgantngatctccncgagatcacacatatcgactgcacgtngtactcagcgatgcncgatgagctgagtctgtcatcgcgacgtcgtagtagcgcgactcntcatatcgtcgngtatgtattgctgcactatcagatgngtgtcatgattcctcntcntggcgagtttctgntgcgntacatntcgncacngctgagatcctcgctcactgatgatgtggtgagcgcgncgtntcgtcgtgntgtntgacgttcgagacacagcgtntcgcanatgagtcgtcacagncatgagacgactggtntcgntagtatacgtagtagtaagctgatngatgtgntgcgnagcaggnacgagtacgaagtgatngtntcagtctgncgcngttcagtcacgactgntcgtgncntgtgctgatgctgcngncactgctgacggctntggcagactncagtcgacgcacggnatcgctcagcgngagcagtgtcatcgtatcatactctcgcacagagntgcctatgnagagacnacgcacatgtactcatagtgcagtgcggctgacgcgatcatcatctgctnatcgctctgcgatcngccagctacgtgatcngacgtgatgantaactccgnnncgcccgtcactattggncactaaccacnacgatatgatancangtcagttngngatgtcanctagtngagcatcagcggtntggcatgcatattaggacggctgtagangtngantgcagcgtntgtcgcgcttggntgatgtcagtgcttcagacgtcatcnctctctncgcgnatagcttgcgacangcngcnacgcngcggcgtcgtnctgcgctgtgcgnncagacgcgtacgacgtcagcgtgacgnagtatgagagngagatgtgtcgtncagcagcatcatctagatagtagtactgancatngaggggnctactacgcacagttctgtctagtgctactcgtacgatnatcacnncatccgacat

SEQ ID NO: 8461 - DNA, 2294 bp, Homo sapiens
  misc_feature (1)...(2294): n = A,T,C or G
tctgagctgtgcaactccagcaccactactaacactgcgtctctcgcgtgtaccgcatacattcgtcgctgcgactcatgagtcgcgccngtatacacagncactcacctcgcgtagcatagatcatcatctatatntgaccgatcacgncgcacagagancgtcacgcagacaacgccaagcnacagacattatctttgttantnagtgccgtctcgttagcgtagtcagatgcatagagctgtacgtagatgtctgtntccgacgctcngtcgagcgcncgcacacgctgtgcacatcatgactgtctatactcctatgacggctgacgagtcccngcgtcnctcgctgcgtacttgtgtgagatgtgtcntcgctngtgagttcggagtacgagagtgcgcgactcaagatagagatcangacagaggagtcgcnctcacntacnctcatcgatcagcncgacgtacgtatctacntgcgtcgcangtagccagtanctatagagcatcactgtctgatctatacgagacacgacattatctgcacatccgctccntacgangcctcgcagccacagctgctatnatgtatactgtgcgaagtctattggacgcacgccgtatagatnagcggcgtggacggnatcgcagcagacaacacgcancncgacaacgcgagactctgacattatgtcgcgtgatcgcgcgtacacgtcagtgcgcgcggnctagatcnactcgcaggaacatggtcgaccgcgtctagtgacgacgcgaggatgcagctacgtantgaggcagncagagtatcntatancgatatgttctcacagtgcggacattcagtagtaagaaccggangcacacgttatatccgtgcagatcgactcgctgcactttgagcgtcacatgtccncgcatctccgtagtcctgacgtgattccagtcacatatagcnagctatgtgcatcgtgtgtcgtngacgaacatcagcttagcttatcgtcatgaagacantcatctagtcgcatgctagtgagctgatcgatgcaatacacgtagncnacgagtgtgagagagcagtcgcgtgtatgcactcgtatcacgccngncgacgncnatctggtcgtgcgtgtgtgatctcgacagagagaangatgagagcagactccnagagngcgatacgacatgacgctanagntgcgtgtcgtacctgcnanacnacacgacacgacncgncgtangcgatgtgtatatgnatgcagctctgtgcagccagatngcgcacgtcgcanactcgtangatctaccctacgcgangancgtgcngagcagcatngatcagtcgtcgagctagtngccacgtgtaccatcataatagcagcntcacantcactacntgatgaggctgctntagctgantgagtcagntangtnctgaatgcagcgnccctcgancgacatagcantagnagctgaccagtngtgnagctctgctcgtaatctcgtcgatcgatgcatatacgatntaaggtcgatccgncgccnctagactgctcancanctcagtcagcatcactatcatactcgctgngngtccactactngnactngtantnacgtganctncaggctcattcgntnntncgacctgtgtcagctantggccgcgtctgcacatnacancatcgtcgtagctctcgatactgagcgcancgancgcacnaggtgacgacgacaagtganctantagactaaagtanntanatctanccngtatgagcnacgcatcgtagtcatgncgctnatntgccgatcgactcacgagcgnangcnnagcagnancgactactgatgtgattagtcgctgtgatcgntagggantttccngtnccgngcagccactagtctgcgtgcttcctgctctaacgatgcccacgantgntacgcnatnagnnagtagntgntgcagccatgcancantgngtcgccncntccgangtntcgtacagccgatgngctnactgactgcnngacgtacgtatgangcagtcntacnngcncnntcntcntctacgntgngtcntnaacngaccactactatgccgcctccntaanncantgtngaanganngacganntgngatcgtagatgncagcagcatcaggcagnanctgaccangatgcagncgnacngacagtcantnaangaccanncngtantcagtagctgactntagtcagnagctaagtacgtctgactncatcncgtgatcagcacctaccgacng

SEQ ID NO: 8462 - DNA, 1204 bp, Homo sapiens
ctacgtcgaatatactcaggcgaatcgagcgctcgactgatgtgaagacatagagatagcggctaagacactgcgtctacaatacgcgtcctcctctcaccgcgctgaatctgatacctcccgttcttcttgcgaccagccggtcgcaccaacttctctatcgactggtagtatcacacctctgcatcttcgcttcggtcgaaatagagatatggtggcgaagcagtcgtgctgtcgttcaacgcgcgcagatgagtggtatcatatctacgctgtcatcacttggcatcgtgataatgaatgttactcctgtgtatcggtatgatgatcttcacatagtgcgtacagtaatatagtagcgtgtccggtaaagaattataggggcgtaacgtgatgcaagagtggagcacgtgaaacgaaaaaagatgtaaaaaaccaatgggattatgtcagtcggcaggccaacaacagtctcgcttgagcggtgagtcaggggcgccaatccacatttgtggtggctggttggcgtgcagaacgacagggcgtgcgaccgcgatcgctgagtgtgcgttgattgatctacaatgttaaaagaaacgccggagggcgatgcgaaccgccaaaacacacacgggggtggggggggggcaaaagggcacacatatgctatcgcgagtcgcaagaggctatatgactgtgagatttgtagacgcgccacttctccgctcccgggtggcgatcacgaaccctccacgtgtgcaataaggtcgtacactctcgattaccctgccactatgatcttgtagtgttggggctgggtggccccgctggcgctgaccaggttgcggcacaacacacacggcaatgtcgccaccaggtggaaagcgggatacagggagcagaatacacaccgggctgccacgccccacacacgccaaggcgacgcccatcccagcaaacgtgagggcaccatctggcggacaatactcaagtcgaattatgtgatcaaacaacaaccccactagaaagtgagggcagatgatctacgtttatgccactatctagccccacctgccgcacacgggggcacctctcgccctaatagagtaaagacatccatgctcgcgacaagcatccgaacaatggggtgttgtgtggacagagaggcgtgaacctacaatagcgggtggggacataggaccca

SEQ ID NO: 8463 - DNA, 1538 bp, Homo sapiens
  misc_feature (1)...(1538): n = A,T,C or G
atattaacatcgcgacggatgaccacgctgccgtcagatgcgacgggtaaagcgcgcgagaaatattttattcggcggtgatatatatctacgcaaccggcttgagagatgtcctacgcgataggctccgagagcgagttgtgtcgtacccgcccctcctgcgataagtctttatcttgntatcttgctcttaggagctacacaagcgcgtccgtccgcgcgatctatccattattgatctcagcgctgacatcatcgggtatataacgtcgttattaatgcagttgtaagctgcgcgcgcataatgtagagagagtaggagatgaggaaggacgcgatgaatcgctctatgcggatgtattatgttcatgaatcactgcagactgttacgtgtgtgtctggagaagatatgtatgatttaaatcaggagatactaatagtgacgtatttttcgcatatatattgtgatntgcatgcataacgtgtttgaatctcgtatgcgacgcccaacatcacttacgatctcgacgcgcgccntcataatatgaacgtgtcgcgtgagcgactgtcgacacatgtctaacgaatcgtcgctgagacgcggcagataatcgcgatccgagatagcgtcataacccgcgttcccttatagtttacgtactgctggtgatatacatgctgggatgttacgatgatagtacactgtaatatatatcatatattgactcgcngtaatgagtcgacacgcgtcgcagtatgccatgatattttcagccgcctatttgagattatgtagcacaggcgacggtagtcgtgtatatataagtcgcgtatagcatgaatgcgtagcggccggtgcaccgactgtgcgtnattataagaagatattatgagtcacgctccgcgcagttgtataaatctcgccgctgcgttgcagttatattgcacgagagtacagttatatgtcgtgtgatagacgacgcggcggaagtgacgacgtatcctcaatacgattagagacgcgcgctgtgtatattaccgatgtaatnccgatcgcgctgacgtgtttnatagtcgaaccggagtaatactcgcagtgcagtaggtgcgtagctgatgacgcatgcgaggtatgtgcagcgctgtctgtattcgtacgtcgagactgttcgagaagatagagctagagtatatgcagangtgatctcgtcgtaatatagagcactgncagcgatgcagcgccgcagacgctcgtagtgcttacgcggtctgctagactgtcaggggatacgtcgcgcacgaggagantcgtatacgactatgtaatatgttatagtcgaccccctactactattatatactctatagttcantagtagtgttagcatgatgtgacacaccgcactacgtccggacatgatgcgattattagcgccgcactatcatcgcgctncgaccgattttgcgtctcgagctgcggtgtcgagctctggcacatggagtacgatcgtgcagaataatacccgaactattacatt

SEQ ID NO: 8464 - DNA, 595 bp, Homo sapiens
  misc_feature (1)...(595): n = A,T,C or G
ccataaattcatcaattctttgcactactatttagaagaagcagagtgaagattcaagagcatgctaatttgagtctttcgtgatgcccagaaacatctagtgacattaattatttaatagaaaaattctttatatcatgttaagataattttgggaatgatgcttctgcaccccacaggattttgcagtagttagcttacgtggccttgacctacggttttctgcctagtagcgataatcaacaaaggtatgttctgtaatactttctttttatgtaaactctttccccaaattgtcaatttcccaaactgtggcctcattcttgtaagccctnctatgancaaggagcatggttcgggaggagaaaagtttccactcactcctgaaaagtggaacatgaaaggtatttggtaagatattttggatatgatgtcaaaagtatacctaccattagactagcctagctaaaggaatatgttgactaaatcactgagatattatccaaggaactggagcttataaatatctagtcattgcctcattttaccctacnngtttgtacttttagggtcccatccccgatgatctataatg

SEQ ID NO: 8465 - DNA, 829 bp, Homo sapiens
  misc_feature (1)...(829): n = A,T,C or G
tggcttcatccttgggatgcaaggtggttcaacatacacaaatcaattaatgtaatccagcttataacagaaccaccgacaaaaaccacacgattatctcaatagatgcagaaaaggcctttgacaaaattcaacaacccttcgtgctaaaaactctcaataaattaggtatcgatgggacgtatctcaaaataatgagagctatttatgacaaacccacagccaatatcatactgaatgggcaaaaactgnaagcattccctttganaactggcacaagacagggatgccctctctcaccactcctattctacatagtgttggaagttctggccagggcaatcaggcaagagaaagaaataaagagtattcaattaggaaaagaggaagtcaaattgttcctatttgcagatgacatgattgtatatctagaaaacccccatcgttttctagcttcctaagctagaaatcttcttaagctgataagcaacttcagcaaagtctcaggatacaaaatcaatgtgcaaaaatcacaagcattcttatacaccaataagagacaaacagagagccaaatcatgagtgaactcccattcacaattgcttcaaagagaataaaatacctaggaatccaacttacaagggatgtgaaggacatgtactaatttatcatagaaatgtcttgtagtttttggtgtacaaatcttgccctacttcagttagtgttttcttaaaattttattctttttaatgctattatgaatagattcttttcaaattttcatcttttagattatttattacaaaaaataaaagcatgatctgtaag

SEQ ID NO: 8466 - DNA, 873 bp, Homo sapiens
ttgtgggattgttatggttattatatacttattatgttatactctataaagatcatttaataaaggtataggagaaaaaatgtgtgggaaaacccggtcagttattttgccttaaactctttatgcgaggtcataatttattacaatgagctgttcttaaacgggcagtcgtgcaacttaaaaaaaaaggctatttgtttattaagccgctgtgtctgtattatagagaaaagctcttttttagttcgcgaatgacaggaatataaatcaagaggattctctttctgcccgtggaaaatttttggaatacccttgcggatatattatacttccattccgtgtcctttggcagtttattctccccgcggcagccaaaaagatccttttaatcacgaaaagaattatgtaatttctttgatgaaaggctctgaatgtttccctgtctcccatgaagaaaaaacttaactatactattggtggaaatagtgcagccattatggaaaacaatatggaggttcttcaatgaaatagaactaccaggtgatacagcaattctacttctgggtatttatccaaaagaactgaaattaggatcttgaaaagatattagcactcccatgttcattgtggaaccattcacaataaccatgatgtggaaatggcttaaatgtacatcaatagatgaatggatttttaaaaatgtggtatagatgtacaacaaaatattgctcagacttcaaaaggaggaaattctgtgatatgagccaacatggatggaccttgaagacattatgctaggtgaaataaaaccgtgtaccgccaagctctttttctttttttttttatttgtttgtgaagaattaatgacggcgc

SEQ ID NO: 8467 - DNA, 1712 bp, Homo sapiens
  misc_feature (1)...(1712): n = A,T,C or G
tatattcgatatactgcntatacttctccnactgcgcctctccacactgaacagtcgctcggctcacttgcagcgcactggaagatatgtcatattgccagacagatgacagagcatatgcgcgcgagtcggacacggaggagatatcgctgatctagtcatgtcgcgctntaatcagcggtgangnttacgtcatctggttntactcacgatctctggactctcgctgcgcacctgtgtctctgatatatttatatctcggtaatcataganagtgactaagtacgtacacgctctgtcatctctcgccgcgtatacatattatcactgattatatacgnctcatgctctcaaccgcacccgtactactaatgcantagtattactttctagtacgtgacncgcactctggtgcattacctctcgncaccaccatgtcatactaactcatcctttcgtaatcttcatatgtatcagcgatgtctgtctgtgccgcgaaacgacattattgtaccgacaagtatccatcgctcactcgacagtcaagtacgantacgtcgcgagaactatgcgctattgtatttcatgatcttcctgtctctctagtattcattatgagtccctgcccgatatccgcataatgacgtcgcagtgtcgtgtcacatacacacatctctaatcacgagatgattacattagcagtatagtcatgttaagatgtcgcgcactactgtaccgcatgtgagatattntttgtaacacacgtcgactgtgacatcgaatctgaaggtatccatagtatattgatcagcacggcgacagatacggcgagagttttatcntatatcgtacggctcacnactacacgcgcgctagtccgttgcatgaatataccactcgcgctagtatttattgtcgacgaggcgccggcagttcatgtatattgcacttatcgtcaatcaagtcagccggacgcactgacgcacccgcatgcctgactattctttctgaatnataagcgcgcacgcgcgctnctctcctatacatcgtccacgcgtgttgtcantcgatctatacaatcgacatatacaagttcgatattgtctgagagacactctcagtctcttatatagacgcacgatgctgcgcagacggctcgagtgacgcttcattatataccagtatgatcgacatacgcgcgcacgggatatgtganagcgtgatcatagncaacatcgtagcgctacatacgtaccgagagagctgacacaataatagncacgcangccactacccattaccacanacagcgtcgnactagacgcgcgatctcgacctacactacgttcagtctataaagacactgatgcatgtagtatactagcgantgaagatatatatggatgtataccagtagcatgagacatgcggcgttaacgacagactgtgatacgtgtacacgatcatattattgtctggatcgctcacatcctgcnactataatagtctcgcgagatagcgtcagcgagtcgtcgtgcagactnagcnacgtacgacgccgcgtatgtcgcatacttatagatcgatcagctgctcgcacttntcacgctcgacatgatgagattatctgctnatatggcttcgcaggagctacncacgtggaagagctggcgttcncatntcacagcgtactccctgcttatactaacacg

SEQ ID NO: 8468 - DNA, 818 bp, Homo sapiens
tgttttagctggaatttaatagccggccccaaataaccggtaattctttataaagggctgtcatgcttagaacagttttatccacggttgatcctagctccccaagagccgggttaagctacacttacccagtagcaggtcacattccagagcccactggattcttgttgacacaataagtacgcttccaggtggggccaagaacaatctggactcaggcagagtgtgaattacagtgaagagctaccaccctcctaaccacagccaatcaacagaaaataaacacaggtaggagaaggaatgaactcctttccacaacatgagtacatcactttttctctgttacagttttgtggaggaaatcatccccttgggatcttcagcgttgtctcatttacctccgctctctctagaactgggtggtgcaaaaatgcctaagccttcttgggaaaggaaactgagtgccacatgcataggaggcgtggctatgggtcagctggtgtacctctaatgcaagtacctcacatgcttaaaatggttcttcctcctatccctcctttccgtaaactgcaccctctgtttcacccaaaaccaaaatggtaaaatcactgagaaaacacaagagttattgaaatcaaagtgttaacaattcctttcaagtgtatcttgcgttttaaatggatgtggtatcttaatatcatattgtgattatatttttaatttttcaaagccacaacttgacttaaaagaggtcaatattcttttcctcctttaataaaattgcactgacaagttttaataaaaacttatgcggcaag

SEQ ID NO: 8469 - DNA, 1593 bp, Homo sapiens
  misc_feature (1)...(1593): n = A,T,C or G
tcatctcttgatgtttcggctggacagcaacgcgttctcacgctatctgctagttcgtcgatatctagccgctctgtatgntatacacctgagtgcctcggagtnttcggcagatgtaactacgtacatactgttattatatgatgctatgaggctgtatgtgtgtnacgcattgtcanctatattagatgcacagtctgcaccgactgtggtaggctcctgctactcagcggagcacgtcatgcgtaatgacagtcgcacgacacgttacagtgtgngcagaggtgcngcagcgcttgtgccgctcggcactgtgctcgcctgttgctggtgcggtctctccatagtacacacgtctcagcatcgtgacttgtctntatacgcaagacacagtgtctgtcgatcctgttccgtataanctcgcgaatcgtgcgctctcactactaccgccctcgtgacaccatactacctactcgcgggtcagctcgcgtgagcngtggcgcttgaatgtggtgatatcatactcttatgtactttgacattacattgtcgctgtcgtgtaagtgcgcttcggatacacaccttggaccgtctggatgatgttggtgtgtcgcgcagctcgaatncacacgtgtgtggtactggtgggggagatgtggacggtactatatgcgccgtgatcaccatgtgtgtgttgtgtttcacccccactgtacacagcgttgctcaacggcgtagcctcgcgtggcctatacgttcactctagtaatactgtagcgctggtggcggggtgggtctatcaatgcgccatgtcctgcgcataccgtactccgcggtcgtcgctacactatcnggtgggtagtgcgtgggtggagggcacaacaatgagaaggtgtgcaggcacagacacccatgaatacgtgtcgggactcacatgtgtggcgctacttatatgtcttaatctccgacaccntactcacacacgtctctcggtgtggtggtcccgtggtcgcaccacctcggcgttggctgcgtncggtggtgccgtgaacgtacacagtccggnagcacgaggagcgcgcgtcacgcggngcgtcatcactcgcgccacaccnatgcgtccagctgtanccaccacactatcggggagtgtacgcacgcgtacagactatcggagttaaagatgtacacatagtcncagaccgngtgtgaaacaggtcntgtgtgagcacnacacacgtgtggggcgactanatatgagaantgcatatctactgtgagtatcganacagagtgtatcacttctatctgtgncaacaattgggcgcgtcgcatgcgtgtggtgtggcgtgcgcggngtgtaaacacatcacgntcgcgcgcacgtgcggctgggcncacacgggctggcaacgctggtgcacgatngatacgactgtgcgcgactatancgtgaccatggcgcattngcggcacgtcggaaaccacacnacgacacacgnggtgcgcagtggggngcgnaaacacacgtgggnggcaccgaactactacacaacatagagggcngtgagagcacctgacgcgacaacacca

SEQ ID NO: 8470 - DNA, 1081 bp, Homo sapiens
  misc_feature (1)...(1081): n = A,T,C or G
atcacttctgtgtggtttgtcataacacttcgattatgtgtccgtgtggtttctacgtggggttaattcgggtacgttttactggngcacgtttcttgcggattgagggttagagctctgactagacatatnaggtcttctgggccctcgcgtctangctctcgcgctttactgagtgtcggcncgcactacgtaccttggtatgcgtcgaagtggcggtactgtcgaatgcgggaacatgcggccagtacgaccgcccgccgactcaccatatatagtgncgcggatgcacttnctgcgtcgtgcaagcgcccaggangnggggtagtgggtgttaacataactgctgacctcgcgcctnnactcaccactgcactcgaccgtacctctgacgntattctcccgcctattataagctgcggctcctcgtggacgtcgtgctctctcgtgtagtgcgtagtgcgcgtggagtagacggtctgtgacccggcatctcgagtacagactagaacgagtgttgcctgttacggttcgtggtagaggtaggaaggatgacgagtagnaacaagctatgtggcgcgggcgaggaggtgggtgaccagctccccggtcacttggnagcgctcctgcaaccttgccggtngtccgcgcgccggtgtggacgccggccacgtcaanggctgcgcctcctgtgccctctcagtggcntctatgttctcaatgtcatncttttgttnnatttggtctcatgctttagtttttatnttcattttnnccttccttgcatttacctatatnnaggctcatgctacgggatgtgcggaggtatgcgccgacatttgttgtatgtgcgcttctaggcctagtggctacgtgatctactagacgtnaacacggcacgttattaacgcaccaattagctccctcctggtacactcccatgnatacttgtgagctttctataattatacataggattttttagaacccaaaaatcctgtgcccgataattcccatatctttcttgcaannnnnnnnttccttnnnnctnnnnncnccnnnncntccnccttccccaccc

SEQ ID NO: 8471 - DNA, 845 bp, Homo sapiens
ctcacacaccccacacttctctccacccctgttgtttgtcgttgcccctttctcattttccccccccagtaattactttcaacgtttttttctcctccccattatgcccattcgtcgcgtgcgtcaacagaggagattatttagctcccccccccgaccttccccccatatttttgcgcccccaaacgctcttttatcgcccggtattttctcccccgattacaccccccccatagggtccccttgcacaagtttccccattccttttccccccgcccccacacacaaaaatttttgcattgagccgtccctgctcacaagataatggccttcccattttccccccccaaaccccagtttaggtgggttgttttgcacaaatgttttaaggtgttttctaaaaccaacttgtctcctaaaaaaggtcaaggcaccgcttgggggtgtttgttggtctgaacccatacatctttttgaatcccggtcaacccattatatttcacaagaatgctcagcaaatcaatgagttgccccgaatagtacaacacctgcagctggcattaatcaacagaaaaagcccaattgtccatgacagcacctaaccacatgtcacacaaccaatgcttcaaaagttggaataaattgggctacgaacttttgcctcatctgccatattcacctgacctctcatcaaccgactaccacttcttcaatcatcttaacaactttttgcagggaaaatccttccacaaccagcaggatgcagaaaatgctttccaagagttcatcgaatcttgaagcatgaatgtgtatgctacagaaataaacaaacgtggatcggccag

SEQ ID NO: 8472 - DNA, 933 bp, Homo sapiens
  misc_feature (1)...(933): n = A,T,C or G
ctcgccccctcaccacctccatcctaatccccaccctcacccacancgccncccatcacacgccccccaccccccattcgccgctctccctcctccccctcgccatcacggcacagtacgcgttatccctatttcgttaatcatcctggcccccttttggtcccgctccttcagttctccccccaactcgttcccgctaantttctcaaactcggcatggaccccgcggtagaattctcaatagggtcatttgtccgagccccccctcagtgcccggtctcatacgttatatgccaaaagcgggagggaaacaattggcccacagttctgtttcccgcgacacgtctgtacttggctccagtttttagcaattcccccccggccgaaagcccctgggtatgagaggctcagcaatatgacatcccaagatccatgttattggaagacccgtgtagatccacccctgataggtttagctatcttatctctggtcaagcggacccgtgacatctgtcccagtctatggagataatgttagcgaataagcatattcaaccgatcttgtaaggtccatttaataagggtggtgcaataacaaagacgccttgctatatcaaaaatgaatgtggcccaggaatagttaatgaacaaatgaacagttcactggtggttataaagattattcagaggagaacacccccctgcagatgagtagcatagtggctagccatcaagagttgttcacatcccactgagagttttcatgaaagctgatcagtcatgagtaaaacataggaagtagcccatgaacacaaggtctcccattgaagggttgttcctcaccccacccccatggaaaggaaaagaagcttgtatagatggagtgcctcgagaggtaagcaaatataaaataaaagcatgatgtggccggaa

SEQ ID NO: 8473 - DNA, 801 bp, Homo sapiens
tctctaattatcaccgctacagtttccaaggatgaaactttacctccaccaggtctttcttcgcacattgagaataccccgagactggtgagtgagagaggaatttgaagatgtgatgctgttggtctgaatatggaagaaggccatgagccccagtttgtgagtggcctctagaagcctgccacacgcctccccacaagcatggaaataaaggaaaaattgtctcagttctttatgaagcttccaaagatgatcaagggctgaaacggaaagtaacaaccttcaattagaactttcacaggaatattcagatgcttggaggtactttcgacgtttttttactacccattataccctgagaggctaaatggcagagaagtagcaaagtagatgataatgacgtaggaaagacataaaaccacaaagccaaagaggctatctttgcgtccattcataccagtaatgagagggcagaacctcgagtacagtaaagctttttcactgtttgcaaaatgaagcacagcccaactttaccattgtaatgaaaaaaatacatttttgaaaaataacaaagacccagttttttccattaatgttctgaactcttactctcaatttgaaagcaaaaatttttacccaaaggggaaaccccgatcatcccagaaaaaaccccccttgtgcagtttaaattgtggctacaggagaaaaaccactttaattgtcccaattcttagataaaccggggtttttaaaagaatttaatttcctctctccagtgccatcattagatgggatatatga

SEQ ID NO: 8474 - DNA, 825 bp, Homo sapiens
  misc_feature (1)...(825): n = A,T,C or G
tttacgggnaaccnttgggactgggggcaaaatgaagcacagagccttctctaccatgnggcatgtcgaaaaatacatggnngaaaaatancagagagccaagtnctngncatcngggnntctgaactctgacgctcagtntgaaagcggaagatgggnagcccncaggggaancagnngatcacccagnagagaanccaaaaagtgctttntnaaantgcggcctacggggcgaanagcccactganatggcccanctnnnncaggacccggtggccgcgaccccnnccctactngtcctcctccccngctctnnctncgctggnnccgatgcnggagacaaggcggggcngcggcggggngggnngggtcngngngctcnccccgccannggggcggncnnctgngncnngtgggcntnnngngcgcgncncccgggcgcngcccngcgcgcgnggtgggggngccgtggcngttgnngngcngngnccgnggcgcnnnagccgcnnggggcnggggtggcgagncncnngccgnggcgggggcgagnagccccngccgncccgtgccgncnnntgcgcnctcgccgccgcnnncnccnntccnntnngcanacngcganannnnggcgnnacgcgnngtcgngctncgcgcncggnngcncggacnnggncngnggnacngncacgcggcannngangagcggaggngntancgangcagcngcngnngngcgaggagggagncgcgncnatgttncaggtccgnngncgggnngncnncngnccggcncgcgnnnnnnaagaggaaaagnaaacagaaaag

SEQ ID NO: 8475 - DNA, 840 bp, Homo sapiens
  misc_feature (1)...(840): n = A,T,C or G
ccatttgatttcaatgttaaccttaaatatttccaaagattttaggcaaatcaatccggggccaataggctttcaagtatagttcagattttttaaaaattggccgaaaaatgcctttttaccctacattaatatgttaaccacctgaaatcatttttctaatattcaaattccaaatcttggcagggcaaggtattcatttatatcccggctcttgggaggccaaggtggaagaattgctggaggccaaagagtccaagatcagcctgaatgacatagttagaaccctaatctctacaaaaaaattaaaaagttaatttactacatgtggtgcacctgcctgtagtgccagctactcaggaggcagaggtgggagaaacatttgaggttacagcaagccatgatcacatcactgcactccagcntgagcaacagagtgagaccctgtctcaaaaaaactttttttaatcttcccaggtttaataaaaatagcgttttgcttcaatttatgcattttgctccctcacctaagaaaacagtatgttgtattatacatagataattagctttaattagagaccaacatatatttcattaattattgtatctaaatcacacacttatcaagtctaatactctttccctctgatattaaaaaaatttttgaatagtatctttggtctacaacttccaagaaaaaaagaaaacggtttttactctctctcatccaacatacagcttatttattactttgaactgacataaaaaaatgcttgttaatttttaatatacaagctacaaaatatattaaaatgatatgaaataaaccacgatcggcag

SEQ ID NO: 8476 - DNA, 1424 bp, Homo sapiens
  misc_feature (1)...(1424): n = A,T,C or G
ctctctctcttgtctgtcgtttcttgtcacgtcgtgctntactcaccgcgcagnccagtgcgcgccgcctcgtgccgcnccacacagagcgggtagcgaccacgtggcacaccgcggcgcgcggcgcgcgtccgcgtccgctcgcgcgaccgcacncgcggaccgcgcccgtgcggtctccgacacgcgtcgccgccatcgcgcctgtccgtcgcacagccgtgcacccgccgcgcgccgcgcggctccacgtcgcagccgcncagcacgnacgacgcgcgacgccgccgctactcccncgcgcgtccccgcgccacacgtccacatacgcgcnctcgtcgaccggcacggcgcgcagaccgcgcggccacgcngccgcgcgcagnccgccgccgcgcgagacagcgccggaggcgagcagcngcgcgcacgcgacncgacgnngccctngctcacgcgcgccccaacncgcccagcacgcgcgccgcgcgcgcgcgctctgccacacgccacgcggcgcgcacgcgccacgcacgngcagtcacgcgcgcgngcggcatgngcagcgcacncgcgctacgcacgaccannagcgcccgncacancngcancgacaccgcncccancgcggcncgcagacacacgcacgcgcgcgcgcggcgcccagcagagcgncgcancgcgcgcgcaccacggcngcacgcgcaacnccgcgtcccacacgcgcgcncncacgcacgccgccgtcggacacgcgcggccgagagcgtaccaccgcgnagccgccaancgcgcacacgcgacacggtcacgcccgccgccgcgcgcngctgtcgtcgcnacaacacaccactacgcgccgcaccaggcngnaacggcgcaggcngcacgcgccgcgtaggngagccgcacagagctcacggagaacgcgagaggtccagcagcgccaccacacgggagctgcgcgttcgcccaaccagcgcnctgggcngcgcggatgcgcgccaccggcgcagcgtgcgtgtgcncgcggcccnggcacggcncgcncganctctactagtgtgcacgtggcagagccttccttcgctgcttgtacttgcttccgccttgcggcgtcgcatgcccaccgntcgtctgtgccccctcgaccgcgcgcctccacgcatcccttcacagcctctctccaccacctcgccgccggtccacgcacgtctccacgccgacccccggcgcactgcgaccacgcacaccctcgggctccctcctcgcctactctcctctccacgccccactggcacttcttctacggaccantgcccccactcgcgctcacgcangagagcgcctcctgtcgctctccactcttctcgcncnccnccnagtcgccgcccanagacttncntaccgtgntncntaggggg

SEQ ID NO: 8477 - DNA, 735 bp, Homo sapiens
tttcaaaaaggaaatgaatcaaaattattatggctccccctcctgggccccacacatttaaagggggggcgccccaaaaaaaaaatttttaacccccgggggcctagaggggtccccccaactaccttttttttagcggggaattcaaaaaaaaatctttaacccccacacacccgggggtgtttttttggaaaggttccacaaccctttatagaggggccattctgggttaaccgccctcccttaaaagcaatttgaatgggtccccttctaaaacacttgagccgctaggcgcccatatatttaagtggggggctctttccatatgcgagtaattgccgtcgattacccaaataatgcccctctaaaacaggataggtttcacttacgaaagaagaacgatgtggtgggatagggttagaggaagactttttagtaccaaaagcttcaaaaaaagggaccggaggcgcgcccctccatctaaaccccgatatttgatactcgtgccgtctccccggggaagaccctatttagtatttttgagctccccgaccccacgcaaatacattgtcgaagttctccttcgccatcgagagagcgcccgtgataaagaacaatctttttcctcgtacaacaaaggatttgaaaagagcgctacgggcgcctccgctcacatcgcgggatcgctatgtacgcgacccagaatagagttttctctgtgctaacattagagat

SEQ ID NO: 8478 - DNA, 845 bp, Homo sapiens
attcccccacccgcccacggaaaggcccctccgccccccacccaacgccccaatgttctcccgatcgcccccggaataccacccggggaacaccactcattctttggcctacagcgcctccacagacccccgctcacgcagcaagggtttccgcccaccagttcggcctacaccgaagtgccttcctacatacccacccgccccacattggcaatcacctcaagacacaccagtcgctcttcaaccaaaccaggttcccctgcagggtccacttaccccacgcccttctttgctttgccctcccctaagacagcaagaccctcatcactctctgcctactcaacctgaagatcccgaggatcaggacctttatatcatgatccacttctactcaataaataagctctgatggtattgatacagacaggagatggaaattctggggagaagagggcagttcccggcaaaggctccaccctcaagcctgaagatctgtggccctaaatgaggactggcattcttgttttcatgccaaaaagttgccttttggtccaccatgccccctttcctgcatccatataaaccccaaacgctaagctccagaagcagaccagcaagccagccgaccagccgatggacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccaccattcaataaaaccagatcggcag

SEQ ID NO: 8479 - DNA, 1420 bp, Homo sapiens
  misc_feature (1)...(1420): n = A,T,C or G
aagaatattagcatgcactaagtacgagctgcgactgagtgctgacgacgagncgccagcgcaagcggagagcccccttaaggctagtcgaagactngactagctnnctcangaatacatacngcacgcagcgtagacaagcccattgatttacagatatatagaacgctagncgccacggccatctgtagagagcgtattatctatcatacactcctatcgaaaacacgtcgcgtcgcaagngcacgtaggtctcgtagtggaatatcatctgagagaacncgattcactgttatcaatacaagtctatatgtaggcagctcgccgaaacgaagcaccgccacagtataggctggcgctctaacttaatgcactgtgaactctataggacaatcanccgcggaacacacatacgagactgtgtatctacaacaaaccatagattaggtgttagcatccgtgttatttgtttcactctctacctcagttactcacatacatacgtgcgggctattgtgagatatctcctgtcgaactgccgttacgcactctaggtgcgccatacaatacgttgcgctctctacacgaattcctatgctacccgtctgtcttggtacagcacgactcatagtgtgcgaataagctgacatgccgctnctctcgttatctacctgtagtaccaagtcacaattatattacacgacgcacttagtcgcctctgcgcgctagcagcttatttgcgtcatcataagtattacatacgcatcagctaatatcgatctatcatcgcgcccgcaccccgtagccgacgcgcgcgaccgcgtcataataccactacatattacattatctgatgcgatnctgcagtcgtcataattcctcaccgattatgaagattgaggagcagatgtagtcgtactacacactgcgctccgctcgtactatattcaccctacacacttcgcgctctcctcggagtatagtattcgcgattacacgcacacgaagcatctaatctcgacgactccacctgccagcgcgcgatgggnacaagcatgcgttctcgtcaacaatgggtncggatagcggtatacgccattctctgagatgtagttcatggacgagcccattaatactatactcctaatgatacggtctcaggacagctctcacgatattacgcgccgtcgatctggattgccgatccaacattattaatatagtcctgntntatatatgagcgcgcccgtagctgtagtgtaaatcgttgttagatgactgcacgcgcctgtagaanaggcgcagatagcgccgtttaatattactcccacgctttaccgccgtctaagctgtatgaaactgtgaagtgtactccacatctataaataacattcagctcagatgcactgagatcgataag

SEQ ID NO: 8480 - DNA, 647 bp, Homo sapiens
cctgggcaaccaagtgagactccatctcaaaaaaaaagaaaagagaaaaaaaataaataaaatccaagtataaatttgtaagaaacagaaacccataaaaagttatctagcagatttgaaaacagaatcaaatcttacttccagaaattaataagaatgcaaagtactgaaatggatgggcttactagcattgataaaacatttctgaataaagaatggataagcacatatatttaaatctgaggagtaaccactaaaataatagaaacagagttcataacttccaagctagtagaaggggaaaaaatggaaagaaaaaaagcaccagtttgggatttcaatttatagtaatggtttgaaccctccaaatgaaaacaacaagaaaagttggacaaaatatgttttaaaatatccatttaaagtcattagagacctatcaagggatcaaaaaccagaagagccaagatcctagagaaaaaggaagtggagggaaataagcccagctaaactgaaatttcacagttttatgggaatagatgaacaaaaaaatgagttgagaacccctaatatccccggctttcagctggaatccccgaagggctatacctaggagtaagaataaacctgaaataaaccaggatcggcag

SEQ ID NO: 8481 - DNA, 851 bp, Homo sapiens
ttaaaagcggaatgcaggatggctggtatggtcattaagcacgtgttatcccgaagtttttcgtaccatgggaatcacggtggaaatccgtaattttggccaaagggctatccagtaattgctaaccagtcagtgctgtcccggcatttgactttaaggcaaggctttcttattagcgccggtccagaatgccaatccttgagagagaacggtgactctcaagaaaccaaggttgaactgcatgggtccacttcaccctggctttctctgcctctgcctcccgtgagacagcaagcccctcatcactttgtgcctactcaacgtgaagatgacgagtatgaggacctttatatcatgatccacttctactcaataaataaatttttgttttctacctattgaaagagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagatggacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccacacattcaatcccccagtaaagggaag

SEQ ID NO: 8482 - DNA, 2022 bp, Homo sapiens
  misc_feature (1)...(2022): n = A,T,C or G
tagtaacgaatggcagaagagattgtagttaacaatacaagcacaacgaagaagaagnggagagagncccctaacttgtggcgngggaccaagaggaggagagaaggagacgcccttaacggcgggngcgggangagacaccagagaggcgcagaggagagaggagatgagcaggggacgnanggcgaggtgacgctatacacgatttttatagaagcaatgcaaagaagatgtgaagacgcgagcacgagtacacagagaaattagacacatgaacatgtaacgtgatgacagtgcgagacactgcatgagctgananatgatgntagaggtnacgcatagtgcagtttcgctcagcgaagagaagtagtggcagtaatgacacacgcagggtanacgtctcaccgacgtaggtacagncgcgatagagntatcgcgacagantcacacgagaacatggtacgtgnancagcgatcatagnagtagtccacgcacagatgatattacgaatacgacgactgctacatccgtcctacacgagtgtactctcttagtgtcgtatactactcatgacnagctagttncnatgtgacagagcgcgctctagacgcgntgtgctcagctcacgacacaatctacagcgtcgcatgagtgagcgtgctacatatattcctccataatcacgacacctaaccactactgangacacgatcgtagactatggntatatgcgatatgacagcgnactcgtctcatacggtacgagctgtatatataaacctaacgacntgattactcagantnacganganatgcactgctatcgatccagcgacgacagtatcgacctcacgcactacgcatctatcgcgtctgctacatctgcactcaacgacgctgcgctctantacgcgactgacatcactcagtgcgctctcacatacgtcgcngcactacagtgcgctcaggatagtgtgagacactgaagngtctgggntcacacgatagatatagtaggtacgcgacactcttacaagaatatntgacatnatgctgcttcggctncacgtgcgccagagatacgtcgcagcgacgtggcgacaactatatgcctgtcgcacgtcacgcgcgntagngtgtcagcagcatcatcactagagtgtcntanagcagcagangaagatcgattcantctagatagcagtacacagagtagacgtgnacngtgctcacatcgacgacacacaacacgattacgcgaagtantcgangtncctagcgcgtactgcgcgcgtnangntantantcatcgtanactgcatatcagatacagtactacgcacnatcatncaatagtatanatcagactacccaacgtacgctatcgaangacgcatggcagacgagangcngtnctgtatgagtagtactcgtcgncgcgagtcgacagcagacgacagancangccacgcacacgactgcgacgcacgtgcgctctaagatacacgctgaagctgtgacgtcatgntgcgtcgcacgtgacatgtanntggtanactantcatnacgagtgcanatnacagaggngnagtagtcggagctngatgaagaagaagacgnaggccgtacgagtacgtacgacgacgacgacanctgcgacggatcgacgtngaaccacgaancntgncgantcnacaggcatctagcgaagcacgtactgtcgantggcgcatntcnatctacgagtaacatgggcgtcgangacagcgtangatcgacngacatacntacgacgtgcactcgctgatcgtcgagcagcgactcactgcgcggtagtagcgtaagangngatcgatagcgctagctgacagctgcagcnagatgtagagagagcgnagngnatgatnacagagatagagangtcatcatantaccactggacgacacacgtgnacncacgcatngagcagcgncgctgctgcgtantangctcatagacgcagcnntngacagcgacgacg

SEQ ID NO: 8483 - DNA, 900 bp, Homo sapiens
atatttggccaaaaggcccttacggggtaagtggtacgcaggcaggtgttgggccgagcgagttgggggtgaggttggagtgggtgtgtgaggaagccgccgggaagggtccgtaaaaaatgggtttgtggagaaccctctatccatgcctcaacaagttggaagagaagaaaggattcgtcgttcgagggttaccaagagagataatgggttaggtggtatccgtaaaagtcccctcccttccgacagattaaaacaggtcagctttgtgtgggaagctcaggagaaagagggcatttaagagcatgagatttggtggcagactgacctaatagtagatggtcccagtgagatcttgaccaccgtaaatgtttcaactgaaaaacgaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaataaagatagatcggcag

SEQ ID NO: 8484 - DNA, 803 bp, Homo sapiens
gtattctgcaacgactctcttaatctccacggctacacgctctgtgttttcaaggtggtggtgcattccagtttgagggcccaagcactgatctaccaatgatcttcacacccttatcaccactataccagcatgagaagaaaattcgggatggtccaaatgacagactccaaaatgattctggatattatgggctaaatctgtaacaataacacacaacaaactgaggatcgctaatatagctaataaagaactatacttattaatccaatcatctgctgtgtcaagactgggttagaataaggagtggatctgaaaggaaaatgaaaatacccaggacatcagaaaatcaagtgtgagaaagcacaagaaggcagctgtctgcaagaagccaggaagaggtcccccagcagaaaccgaatctgccatcaccttgatcattgacatcccagcttctagaatttaagaaaataaatttctaactttgaagccacagatggggttacacattaaaattctggaagcggggattgcgggatttgttctgttggccgatctgactaacgcaaaaccagaaacattcaactttatattccaaggaaggtaaaaaataaaaaaaaaacaaaagttgagagaaataaaaaagacccaaaaacccttacgtaaattcggatcagataaaatatcccgaatataggaacccttctaaaaaagaatagccatatgttaaagtataaaaaagttcatttagaaaagataaaataagtcagcctcgaacatggcgctgacaaaactacgttcat

SEQ ID NO: 8485 - DNA, 907 bp, Homo sapiens
agcccgttatttttttgttggaaatttcccaactttgttttgatttttattttcaaaaataagtggggcaaggtttccaaaatgggtttttttacacagaaacaaatagcctccaggttttttaagggtcaaccaaccaaaaatgttttatattttatttaaaggaagggcccttcttcaaccaatggtgtgtttatttttttttttaaaaataaagtaaatatttaccagttttttagtatgtaagaaacgcatttgccatttttagatcctggcatttgagagatttaaaaaataccgcttggtcaggcaacagtcaggatgcaggtgtcatttcctcagaaagcctaaaattagtcatagttgttcatatggtcttaaaatcaattgagttatgtgcattattaatactacatgtgttatgctttattgatccttaaaatatcttcaaaaagatgaccctgattcagcatggaaacaaaaatgtatatgaacataaaagtatggcaaaaaagcagattgatatttgattaaaataaattcatggcaagatagcagaaaagttcctttgtaatgggtgaataaaagtttcaaaacatgtattaactaaccaaatcatttaactattaattttctgattttaaaataattgctgattttatatgtctattttggcagcatcagaattgtattataatatagacatatggttagggtcattttctgtgtttttttttttaagagcaattacgtatagtaagatccattttctaagtttcaaacatggtctcagaacactgtaacattgacaatatttcttgggtttgcatgaagaaacaatgcaagcgatgagatgatagtttaacctgtggatcatgatggtaaataaaacaggtatgcgggcagg

SEQ ID NO: 8486 - DNA, 1186 bp, Homo sapiens
  misc_feature (1)...(1186): n = A,T,C or G
ccacattcgagttctagcgtgtcgtcgtctgtcgaacgtttgccgtcacctccgcttgctagtagtccgcgcggacactcgctcgcgtgtgtggggcctcgttgcgatgtgccgctcgcggaggctccacatcntngacaatcttcgtatgcgcgtgattggtcacgcgcggtctccactcgtgtgtggccgcgtcttccgctggcaccgtccgtcgcgcgtggccgggcgttgacgcgctatctcccgcggcgctcgcgtcgcgttgctccgatctccgccgctcttgtccgttatctctcgtgttgggagttattattgtacttcctcacgttatctccaagtcgctaattacttttctcatcggacaacggtcgataatctcgtcgttgtctgngatgagtgcgttacggtatagacaacagtgtatatgccacatcacaatatatgactccatcgttcgttcacttatcgcactctcgtgtgggtaaagtcaatataactgtctcctctgaccgtgcgctcggcgatgcccagcagcgcggaaagcgatcacgtcaacgtgcgagggtagtgtcttgaggttgagtggggtgctcgtaggtgtttgtggcggttgtgcttcttgtgttgtgtcgatacgtagtcgggccgtgtgtgaagggatgtgcgctggccgtcctcccataatacggcgcgacgggcggttcggggtcgggtgttatctgtgggttccctgtctccttctctcgggcgccatattactcatgagggtgagagaagagtatgggggaccagccgattactgaggtaactcacctcgatttgatctgtcactcgtgctggtggtggcttcattcaagtgggtcgagcgggccccgtggtgcgcagtggccgtccgctccatctctnctgtgttcctgtgccgtaatgtactactctctctgtcaaggcagggtgcgccagtccccgccgccgctcccacaagactacctaacaagtatgaatatagggtggcgtgcgcggtgcggcgcggcgtgccgtgagagcgcggcnccctccgcagtagagtgaacgtccccccgtgcctgtccntcaggagtaaggctttatacttctctcctctcttacatacgcactattaatttatttnnngtgcggncctccgcgtgcgcccccgccgcgg

SEQ ID NO: 8487 - DNA, 873 bp, Homo sapiens
agtgctttttgttgaccatcgtacaaaacgactgtttgttcaagaaacaaattagggatcccataattttccatatgcaagtaataacagttttcaaggacacccttcagtctcaaggacaagagggtttccatgaaggaaccctcacaggcctgtctgctgaaaaccttgcaactctttggagagggcagctctggcagaaactcagacagagcaaaccctacaggggagttaattgatataattttagcacagatttcacagcccaggatcccccactgtttgttgcaggataggaagtccagactgttttttatctgcctattcgcaggttatcaaaatgattcattatggccaattcctgagagattgatctagaaaccagaatgccaatatgtgagtggataatgtgacctagagctgaagaaatactggtatctgttgtacaatcaatactacactttcctagaagtcaggccttttgaaaaatttattttttggacaacattcttaatttttctaaattcatctattataatatgttcttaggtcatttctccaggaattaaaggccctgaaattatttggcatgtttctgtgatataaagttactattggcaagatcaaagacagtgttaattaagcacagggtttactagtctctataaagttagtagaccattagttgaaattgcaggctaatccagccagtagagtaaaaacaaataaaaattagtttattgttgatgtaaattaaaaaatgttctagtcaatataaatgtttattctttcccacaaaaaaccttttttttctgattcatgaaaatgttttgatagtaatgatttcattttaaataaatcacgatgcggcag

SEQ ID NO: 8488 - DNA, 774 bp, Homo sapiens
  misc_feature (1)...(774): n = A,T,C or G
aacttccaagatggtggctagcagcttccaagatggtggtgggccgcttccaagatggtggcaagcctcgtgttctctgacctggggttcttggcctcacggatcccaaggaatggaatcctgggccatgccaggtcggagtcggattgtcggtgaggaggcaaaggtggaggtgggcagaagcgacctcagattctgccacttggagacaacatgtgataaaagaagagaatgggaagaagtgactcttttcatcttcatttattagcagcacctttggcagcaaaacagcatctacagtacacaatgatgacaacactggtggaggtgccagccctggttaagaaaatcaagatttctggaaaccttcagcaaatctggaaccaatggctatagagtctctaatagggtagcaatacatgtggacacatggactccagccagtaacactagctgcccccaatctcggagcatcatctttgatttgtgttttctcttccagttcctttcttcccctcttttgcacatccaagtaatccattagttccatagtctagttctctatattaagttctttctctttgaaatgccaatagaggcttctngtttcctgactaaactcagtgtgatataccactgtagcttctggaaacctgacagcccttttgagtataactttactaattaatagtcaaaggttcacatttttcccaggtgacctgaccttggctttgaagttctagacttgtagaaaaagcanaagaggtgaagctg

SEQ ID NO: 8489 - DNA, 893 bp, Homo sapiens
  misc_feature (1)...(893): n = A,T,C or G
ccctttttccccttttgtccaccagaaaaccctttgtcccaagggtggttttataaaaaaatctctttccttgaaaaccacaaaaaaggtttgtttttccgtaaaccccaggtgtaaaacccctggagttttgggaacccccccccccttctggggaaacccttctaattaaagttcaaagggttccttttttccccagggacctgccttgggtttaaaggttttaacttgtaaaaaaaacaaaagaaggttgagctggttcctcctcccaagtcttttttttggaaaaagttatatgttctatttaattgggccccaggaatttcttcttctgaactttcacttccttatttcccaaacccctctctcttctctttttttacaatttttttaaactaacttcatttcccactaatattttcttaattcaaaagtgatacctattnttgtagaaacacacaaatggggaaaaaaagccccctcaataccaatgatactaaaaactttcatataactcatccaggtagtcatctatgtatctttctatcttgagtgggtcatactggatatggataggagtgaggacgccaaactcaggtctcagtttgaaccctagctctacggtcttagagaaattaacttctctaagactcaatttctctatctgtataaggaggctaataaacctgcatatctcataaagttgtatctaaagaaggtaatgaatgtaaaacaattagcacagtgcctggtaggtgcccttaaatgttctttaacatcatgtttaatggctgcatagtagcctctcccattgtatagtaccaagacccctattgttggatatttggtttgtttacatatttttttaattaaataaatcacgatgcgggcag

SEQ ID NO: 8490 - DNA, 1166 bp, Homo sapiens
  misc_feature (1)...(1166): n = A,T,C or G
ccctcctatangcccacatggttactcatccggacactaccttcgggcacgctgccgtcgtggggctagccgacatcagctacaccctcttccnnccctcacattcggacccacctctganatctggnaccttggaccgcggcgggctgaaacagcctgcgtcggggcacctgtaaaaagcccactcacgagacccgatcctaactttatactcagggtgtggacgtgcgcagatgtgagtacagaaataagcacacgagtnngctatatattctctactatnatcttacacctacaaataacaatantaaatacaacttttatacaaaaataaaaaaatggtagaaaataaagaatataattataataattacaacaaatgacaacccacacctcatacctacntccgacgcatcactgaggagactgaactatctacactagggacactcgtagaacagggcatccagatctagtccgccgtcgacgttggtgcgatgagagagtaataacatacgaattcttagcatccaattatgtagtcaacaaaacacaaggncctcctataccttcatcgacggcgagggangggggaagaggcactctcatttttgagctaggactagtgatatatattagcgctcgtcgnnnttatgcgcccgatcctttgacatcactggacagacacaatactaatanangatcgatcattccatgtatatttcttnctcaccatctcacttttactaccaccaactanccttctactagtgcaacgaatttcaatgtaatacaganaatacaaaannatacgcgccagatcaactccatgngaagatttcataaaccacacaaannacaaagtngagatttcttgatggcatcctcttcggggggtggtgactcgccgggagatattctgcttttacctacttctctcgctttcggtccgtggcgangaatggatcttttcttcaaacacacacatgtgactcctcccgcgtgggaagtgtgnggagggcaggtggatactcactagtcaaagtcgtgacaaggtgcagaggccgtaggagaaactctgccaccgtcttcgcctggaccntnccccttcggcggcacacgcccatacgtaactcactacnncncagtcacgcgatcggtcgcgg

SEQ ID NO: 8491 - DNA, 946 bp, Homo sapiens
gtcacccacatgggatcacagtgagggtttgcaagggagtacaatgtgtcaatattgttcggaccccaccagtggtggtcgcatgaccccagaggataacgcccttcagttggggtgggggcggggcccaggtggccaatatttgtgtggtgcagtcccggtatcgtcaatgttcatacgattgggagggccgcgttgctcagccggcccgagggtggaaataggccagttaaagtttccatccgcttcctcaaggtgtgtaagacgacgcgaaactcgaagtagtagggcggtttgggtccggtccggctcgctgcggaacgctgaaaagttgtgacgggtgccatgggaatagacccccgggagtatagccaagggtctgtttggcaaaagaggcataccccggtcagctgcggcgcagtaagtgtgttcggacccacgagtgtcgccgttggcctgcagtgatggttgtaatacccaccggtccagatggggtttagaaacggtatcttaaaacaaaggcagacctacggaagggaatttttaaaaatcaagaggtctcatcagccatggagcaaaataagaagatggcaatagtgcgatctctactcctgtcttgattgatgatcattgtactcttagcaccagatgacaaagttggaaatgagcagcaaaagaagcaaagtacaagattttttttaaactaatcggttcagattcttgaatgctgacatattagatgactaaaataactgcgtgccccgcattgttctgccatatcctaagctggatactttttttttctacattcacagtaattataaaatgtaaaaatcttcttccagaaactaaaatgaggatttattttcaggcacgtgtacattttaaataaaaactaaagccagatgcggcagccccttgtccactcatcctaacacctttctcc

SEQ ID NO: 8492 - DNA, 933 bp, Homo sapiens
  misc_feature (1)...(933): n = A,T,C or G
atcctcctcatttatttatagtaaccgggtggtcggtgtgtgggcgcgatgggaaaatatgaaagtagatcggtgaaagaaacgattaagaatggataatggttgttaatgcgtcgctactgtgcggggtccgcggtggaggtggcagggagataagtaaacgatgatagggagactcgcagagaggggggaggagtctgacgggcatactgcagttagtggttgggggtcgttagtgcgtaaactggtagtagggaatcgctaggaattcttgtcgtgcctgttaatagttaccagttgagctaccgtngattagcggtctgagctgtaagggaataggtacttccccgtttgagatgtcactgccggggtgctgcagatacgtcggtttgagggcgtttacggatgaggagaaggcggggcctgtggagagcagaaagtggagaacgagagaaaggacaggaaaaactagaagaaatgtgtggtgaagaggtgcgcgggggggggggggagggaggggagggtgggagggcctgaatcggcgcagggccatccttgacgatctagtgagtaagaaggaaacacggggggcgtggcggtccggtaattgttggtaattttgngcgttatttctntggctttnttttncccaacttcatcacatattttaataatncttttcagttttcttatggagagtgaagttgagatgtccccgggcagataagatcttttataaaaatacatattcttttttnttttgacattctctagtaactatatatatataaaaatcttataaccanaaactaaaatnagtnantattatcaacaatgnacaattaaaataaaaaataaaaccagatncggccaaattnnnnnnnnnnttttnnnnnnnnntactnnnnnnnnnnccccnnccccccccccttt

SEQ ID NO: 8493 - DNA, 130 bp, Homo sapiens
gactgctggaacactctcttaatctccaccgctacacatggcagtcagcagagtttggaactaaatgcttttgtttctactccagaagaaatgagagggaaaacaaatgagcaagacaaaaaaaaaaaaa

SEQ ID NO: 8494 - DNA, 887 bp, Homo sapiens
  misc_feature (1)...(887): n = A,T,C or G
aaattttccacccttccttgaaaccattggtaaaaaaaaaattatatggggggggtttattcttggatttcgccccaaccattttattctcaagaaaactttcctaccaggggtgcgttgttgggccccccccaatatctccacccccaaaaagctttgtggccaaatagggtgggattttccctgccccaacaggggatccaggtgnggtcctccaattcaattgtaaacagtttacttggaattgggtcagagcccccgtgttgggggctcggtccctaaaattgcctctgccacctcaagagagcaaagtccaaccccaggcctctggaacatctgactgaagggtttcaaggtggggttcccattattcagggtagctagactggcatcagtgaagcaggagagggctccctgccaccccactaggaaccttgggtgatggttcagtaattattacactgactctctaaaagtgataaatttgcagctggtgccgggaagaggccatttcctgatggtccacacctgttaagattaaagtgttaattaaaggcaagccccagggagaagcaacttcctgggcatacgccttaagagaaaaaatggcgaactatgatcttccaggtgtactccactggaaaaaggaagaaagcctcagatgggaatgcgtacaacttcctaaacacactgctcttgctcaattcccaagggtaagcccaccctaaaggaagaatcatgagaaagaggcgagcctacaaagtcccagtatcaaggttaaaggcccttcttttctctcgtttaccttcaggtgcccatggatctcttccaaggattctttcctttctttcctgttctaaagctttttaataaacctcgatcggccg

SEQ ID NO: 8495 - DNA, 1401 bp, Homo sapiens
  misc_feature (1)...(1401): n = A,T,C or G
ctcgctttatcttggaccttcctctcttcacacgacagagaactcatctcacatgnnccgcatctgtattatgtgtgaggcgtggaactcacacccttcatctctcctagtnnnntccttcttctctatggagcactcttacgtngctctctncaattatganacacggacagggctgaaactctagtcgactacctgcgacatcgctgctattagtactctcgcactgnggcttgtgctcactcttcattctggatggcttgagggtgacacgtgattctctgggtgtgtggtgctgagcgagattgtcgtnannnntctacctctatcatatgantgatcttatcatctacctcacatctattgtgngagctcaagacgcttgagactcgttgcacgtagactcgcgtatgtgtcgtgtatgagtcaaccgtgtcttctatcgagatcttactcgtggatccatgtatgtgtctgctgccctgagtggggcccgttagaaatcgatgnagctcgcgcgntgcctactcgcacgctgatagacacttctctgtggactgagtcgcggtcgacgtggagcggtcggcgtgtgagcgcggcgatcgtgaggctgtggngaagagaactgtgtgtatatgtgtgcctatacacctgtctgactcgctgagtatcgagngaagcgcccatccctctctagtccctcactcggcggtgggncctccggcacactctatactcctcatataacgtgtatatctaatcaacaacccactnnancctatctctccctccagacatctctgnaactccatagacagcagangnacgcatcaactaagaactgatacacgnncccactctctactcttatnttatatcttcctcntnncccactagcgcgtcgccgtcgcatcctctgcnantacgtagtgttgagtcagaatntatcctccgtatatttatattctannaacacaactaagagatgatgncaggtctatctctctctaactcaatatattnatcactgcgtgtcacattgnnntantganccatcttcatcaacaagacaacagagtagagtcacgcgtgccgaacatcacgctgcgactgctctgtactcnnacctatcnaccttggctatatatcacattgaacacacgatactcctcgtcgtgtactatgtttntcttctcntnnctntntcatgattgagaataggtgagaggtcatagagactgaagcagtggancggtgtcgcgggcggctcgtgcggggngctngtaccttctcgagcgtgcgcngtggcgtgttgctntggtctccctctgtcttccgcgctagatactactatggtctaganatgtgnnnactaacacgaacggatgtaagacagtgata

SEQ ID NO: 8496 - DNA, 775 bp, Homo sapiens
  misc_feature (1)...(775): n = A,T,C or G
ctgagattgagaagaagcatcatcagggaactgtacctaagaaacagcattcaaggtgcctcatccacatccagatctgatttacctgatgggatcctggactttgagttgacgccataacaggaacaactctgggagtctcaagaaaggacagagtgcatttcggatgtgggaggggttgtgaactgtcgtggccagacagtggactgaggcagcctgccttttctaaagttgaatataacactatctctcaccccatacgctttcctgaaaggtgatgctctctttccttcatcaatagggaccatctagttcccctccttttgaacttgggctgacctgtgtgattctgttgtaaccaataggatgcagcggatgtgatgctgtgtgacttcccaggttaggtcagaagaagccttgcagcttctccttggtctccaggaacacttggtctcgaaatgctctctcctggggtgctgcctctcagcagccatctgccacactgtgagaagctaagctgcatggggagaccacaccgaagtgctctgctccacagtccaactgaggccagcctctgaagcctccaaatgattccagcccccaggtgctcagatcaactccagccattcaagtctccccagctgaggccaagacagtgtggagcacggacaaggcatncctttgtgccctttcagattcctcaaggaatccatacgtataatagaatgggggntgcttcatgacactacatttgggggtgtttggtagacaatag

SEQ ID NO: 8497 - DNA, 867 bp, Homo sapiens
ctcattcccaccgcccgtggctccccccctcgccattactttgtcctccgtggctggacctaccccggcccctcagtctttccccctcgcccggtacacttttgggtgccgcgccaagtctgctcctgttcccccccttgtaatcttttcagggttcctatacggcacaacagaagcgggccgcctcccaccccactgcacttcgggtgcacggtccccccatagatcaaagcgaatagtaccgccctcgcttatccactgtgcagatccggccttctcaatccaataacaaggcttgtaagatacccttcccactcaatcagcgccatcccccaagcaagtttagagttcatagccttcaaagtggtggccaccccctatttgtgttcatgggctgcaatggacaacccgtcttacaggttattggacagcattgcggcataggcattctaggttttcaaggtggccactgctaaaccagatggcaccatgtctatgtggcctaaaatacatgagagccaatggtacaattttgggagcccaagcctgaagcgctctttgctgagcaaacactgaggccatggaatcacccaatgtgtctgtctggcaaggggctggactgatggggctggtctgcagccaaatcacagagcacgcatggcacctggcagcaagggtcatgcccacagtggcatgagcagacagtcctctctctttgattatcccatgcagcggtggggtaattcccttccgctgtaaaatcctcctgaggtagagggatttggggagttagacactgggcagtcttctagtaggccttattggtgtttagctgatgaattgaaaaaaataaaagatgatcggcca

SEQ ID NO: 8498 - DNA, 1244 bp, Homo sapiens
  misc_feature (1)...(1244): n = A,T,C or G
tcccaacatccatttcggccgtatttgccgctcatgttccaatgtcatccgcgcagtccataattatgtgaatccncccccttgccggaagcttctcatgcggtnatatagccccgccacgttcacccaagcggcaccgcgcgatgggcgcggtgcncagtttgtcgatgaccgattattagccaatccgttgtgtttcctagcattgctcgataaactacacccaagcgctacccacccgaaatgtgtatgacgggatatcaaactagtcagtcacaaagacccgtatgatgggacggaggagaccgaggaagggatggagaccaaaagagaaaattaaattatctcacgatatattcaatactgtaaaccggcgtgctcctgcggtcagatatcgtgattatcccgcctccccctatcctgagtagcgtagtatgtatgcacaccaagtgggcggggggttgtgtgctattgcgacgttcatgcaatatagtacgagtcagcggtcgtggacgtcatagancggtgctctctcagatggctttgctattctcgcctattaatatcagggtccggtcgcacgcccgggtcgcgtatattattgcggtgactctgcgagccctctgaacgatatcgctacgcgctacctgactgaattgccccccctggcgtctccccttgagatctatcatatcgcgcaccctccatcgcccgctttacacatgaacaccgagcctccgcacttcctcgagatatacatcaagaaaggactagacccagcgggagatattcccaataagattgttagtgggactgcggcgctacccagagttgttcgtatccgcccagtatatatcttatcagcctctgctcggcgatagattaggtcgacagcagcgttgtagagcgccggatgcgcctatgcgtagacacggtggggaggcaagcgggtgatgaccgggcgggcgtaggtcatttcgggtaggcaagtataagagtgagtgtatcgtgtggtaaggtagtaacgtacacgaggacgagacgatgatgactagatggccgtattacatagtgcgcctgattctgtgctagcgtagcatgatctaagtatacggggtgagcaacataccacagagtcatacaacgaggcggatagatgagcctctccagataatcgtcgcttcacgactgcacgaccgagcccgtgtacctcgatgctaccgagaggagagttggtggatggg

SEQ ID NO: 8499 - DNA, 780 bp, Homo sapiens
  misc_feature (1)...(780): n = A,T,C or G
ccccctctccccccttgtttctcccacctttttccccatcccattgtttttatttttttttttccccctcccccccttttatctgtttcgcaccattgttatatatccccccatccattttttgttttccctttttccgcctctaaaacccctgtcaattcaagttgaggtgttggttcctgccccttttttttttttcccctatttttttccagtctcccgggtgtccctgtccccttttctgttgtttcctgttctcctttggccctcatgttttcttcagtttcccccccctcgtttaccctttttcctttcagttttgttccctccctcagcctttcttttaccccccccgctccaggtaatggttttcccccctctcagctccatgtggttgaggtggcctcccactccgcccgaaggcaaaggaggagaaaagtcatgtcttacttggcagcaggacccttgtaagtcctaacccgtcatggaagacnccctagctgaagtgatccccccggagagaccatgcggagagacaacatggagacagagcaacatgtgggaggatcctcaggtgctgtggccaccagacgcctcagtctctttgggcccagaggagaagtatggtattttatgagaagacatgctatgaatgacgaaaggctctatttcagcaagtcacaggcagaaaagtccaaaacaattgaatagaactgcagcactgttgaaaggtctactcacgtcgcccaggtgcagagcagcggcgcaccattgtaaccg

SEQ ID NO: 8500 - DNA, 832 bp, Homo sapiens
ctcaacggcgggttaaggcacctcgcaccgctgaatccccaaaaggtgtttgcgagccctggggcactccccgggggatacccaggattttttgccataagccccttcccggttattgccaccgcaggcggggttttgccccccagtctcgacttaagcgccaggcctttctaatttaccccccgtcccagatcgcaaattcattgaaaagagactagttgcctttcaagaaataaagtttgactggcaggggcccgttacccaccggctttttttgctttgccctcccctgagacagcaagaccctcatcactctctgcctactcaacctgaagatgacgaggatgaggccctttatatcatgatccacttctactcaataaataagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagattgacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccaccattcaataaaacccggatgcgtcca

SEQ ID NO: 8501 - DNA, 643 bp, Homo sapiens
  misc_feature (1)...(643): n = A,T,C or G
tccaccagccctggcctcccaaagtgctgggattacagacgtgagccaccacacccggctgttctaattttaacaaatatgctatatgtgcaaaatgaaaaaggaagaatctaggaggactcttaaattgggagctgatcaaatatgctccattcaatgagtgaggaaacagaaaaggtaaattgcattcattaagaaacaaatcactggcacgccagtaatccaggcactttgagaggccaaggcaggaggatcccttgagcccaggagttcaagaccagcctgggtaacatggtgaaaccctgtctctacaaaaaaatacaaaaaccaaccactaaccaagcatggtggcacacacttgtagtcctagctactcaggaggctgaggtaggaggatcacttgaacccgggagatcggggctgcaatgagccatgattgtgccactgtactccagcctggacaacacgatgagaccctgtctcanatnaataanttnnnnnngntngtagggaacattttaccatttctagcgagcataaggcagtgtctatgaggataacataatagctataataacggctccataatcaagcttattataatctaatgtaagatatgtttatcaataataataaaaggaga

SEQ ID NO: 8502 - DNA, 757 bp, Homo sapiens
atatcaccactcatcacagtttccaaacttcctatagtgttttttgttctataacgacatatgtatgcttcaccccctcccgctcccttgtccatctacgccttgcagttcgtgcagccaccaccattttgttccttcctcccctccctcgcttgccgtttgcagtagttaatatgatcaccgatatacacacacaccacaaatcaacaattattcaaaacatccgtttcaccaatagtgatataccgatgtttggacccgactacaccaagtaaggaagagacccaccagataacaagacccttatttccccattttgttttatagttacaccccacatactattgttcccacccacattgttttttttttgatcacttcagcttgtccacccccacccaaccgatctcccattccaccattagtgaattggagtgccacatataaccacatagtctgttctccacattaatcccccccccctgtgtttatgtgtggtttttttcgctcgccacctcgccccacccaccccgagctacaccttatggctctcttactctatttgtcaggtccacccattcgctttccccgattaatatccccgcggacagccacttgtatgttcattcccggtgctggctccacgaggtagttctacttgttttcggccagatatggcccgctaatcaaccatgattggtcatggcaccccagtctgtacaacacaagaacaccctgtctcaaaaaaaaaaaaaaa

SEQ ID NO: 8503 - DNA, 1278 bp, Homo sapiens
  misc_feature (1)...(1278): n = A,T,C or G
aagaagacacaacaaagaaaanaaggaaaagaaaaacaacaacccaaagagaanaaaaacagaaaaaagagcgacaagcttaacaagaaaccaaaaaagagaggctggggccagggggaaacccgccccccccaccacaaccaaaacccccccgcacgtttccaccaaaccaggaaaacccccgccccacccccgcgccgcccccgccccccaccgcagccccgccaaagaagaaaaacaaggaagctcacaggagagaaaacagccagcaaacacncacaagagcaaaaggaggaacannataggaanaaaagaaaaaacagaggaaaggaagagggaggagaggnntagagggagtnnaagaagagaggggaggaaggnnagggaagaaataacagacgacgagagggngaggagaggagaggaaggcncaggaagagtacaggaaggaagaaaggcnnnanagaagaggacagcgagagaggagcagncaaagagcaagaaaggaagaaacccaggagnccaccctccgacacgcagccacagaacaaaacagacacacnncaagaacacgagcgcgcacaccacgccgcccgcccaccaccaacgccagacacagtccgaaccnnacaagagacaagaagaaggaagacactttgaagccaagaaagnncagcagacaacgggagggtnncacgacggaggaagaggntagagagagggagagagggacggaaggnagagaaagagagagaagaaagggagagacgaagagagnanagagagaaaagagagagggaagtaaanaaagagagagaaagagagaaaaagcaagcaagaggngagaggggcggagaggnnnngagagagaggagagaggagngaggaagggnnnagagcgggagggaagaggaggcgntnnaacgatcaaccgagccagcgcacacgcagccgcgcgccgagcgaagaggcgagcgtnagctagacattaacncagtcacggcgactcgagagacgacgacancncacgacgaacgagnagagcagaaagcgagaagccctcacacaccaccgcacgccgagggcccagacaccgcgcagcgcnncgacacaggagagagggcacacaacaaacgagccccacagaggacaacaaccnnccccgaaacggaggagaccgcgcagcacgagccacgcccccgccagcggaacgagcggccncacaagacgcgagcgccccaacaaggcgagacagagcaggancnaagaggagagaag

SEQ ID NO: 8504 - DNA, 879 bp, Homo sapiens
  misc_feature (1)...(879): n = A,T,C or G
cattagttccagccaataaacttaagggaagtaaaattaaatctttgtggcgggcctttaaaagataagggaaatcccttcttgttaatctttttctcttcgggctgccttgaaatatacccaaaatgccaaaggttccagctttttctgtatcccccgagcaacccttggaaaatggaaaccatgccagggcaggtatgaagagttttattattacccaagtattaagcctggaaagccatatctttgttcaanatgcttgataaaggccagcacacggtggttcacgcctgtattccaagcactttggagcgcaagcaggcggattgccctaagttcaggagttcagaccagcctggccaacatggtgaacccctgtctctactaaaatttctaaaaaattagccaagtgtggtggtgcatgcctgtaatcccagctactagggaggctgaggcaggagaattgcttgaacctggaaggcagaggtgcaagtgagccaagatcgtgccactgcactccagcctaggcaacagagcgagactctgtctcggaaataaaaataaaaaataaaaaaaaaagtttgacgctttatctgccatgtgattttaatgatagaatgcattttttccatccttttaattttgggctaggcctgtggtccactttggccaacagaatgtggttgggagtgagagtgtgccagtgtggttcattcttcttgaaatccttccactggcatgaaaagaatatgacccagctgcccctttgtgccaaggcagttgagaggcacatggagcataactagacaaacccgtagcttgaagacccattcagtgagtcaacaaacaaataagaaaaaataaataaagatcggccag

SEQ ID NO: 8505 - DNA, 1225 bp, Homo sapiens
  misc_feature (1)...(1225): n = A,T,C or G
cgccacccgccgagccccgcgagcgatccgaccgagagcgcgttggcggggggagggggncctaaggctgtcntgacgnactgctgcggggaagtncttcncaggcngngtgacagaccagagngagnanggnngnnnagnnaggggggnngggagaggaaaaaagggttttgaggaaggaggagagggggaaagnaggggagagggagaagagaagggggggagaaagagagagggggaggggagaaggaggagngaaagagggaaggagngggaagggggaggagagagaagagggagagaaaggagagagggaagggattgtggaggaggagagagagaaaaaaaggagaagtagagtggagaggagggagaggagaggagaggagagaggggnggggttttccccttctttaacgagcgagcacggaagagaccgcggcgacggcgcgaaccgcgcgagcgccgcaggcgagcgcgagcggcgccgagagggccgggcgggcgcagcagcgagaggggacccagcagcagaagagaggaagaaacaaaacagcgccgccgccgccgcagacggacgaggcgcggagagggaggcgcgagagcgggccaacgcccgaagaccgggcggccanaaagccgccgaacgacgagacagccgagcagaaaagcaacgcgaagacacagaggacccggcgccgaccggccaccaacagaaaagccgaagcgcgcgcgacgcggaccgccaagaaggacgagaggcgcgcaccggggcaccggcgcgcaacaggagcgccgacgacaagagagaggcgcggggagaagcgcgcgaaggagcggccggaggacccccgcccacgcacagaacgaaggcgacccgaaagggacggaaacgcggggagcgacggagagacggagaggcaggcgagcgggagaggacgcgccangagacagaaggacgagaacgacacgagaanacagccgaccagcgaaanncgggacgaagaggaggaacgacagcgcgaacagcaccgacagcgaagaggcgnaggagggcgcagaacgggcgaacgagagnagagcaccgcagacacacagccaggacgacgacgaagcgcagagcagngacacaacagaaaanaccgcagcgagnagggacgaccgcggngcacgcacggcgaggcagcgacgacacgcggagggcgagacaggaggaggaggcggg

SEQ ID NO: 8506 - DNA, 1028 bp, Homo sapiens
  misc_feature (1)...(1028): n = A,T,C or G
gtgtgggcgtgtgcgcggcggagcgagangagagcaggagatagacaacagtgcgtgttaatagcgtacgcgtcgaatagttggagggtcggaggagaatgccggtgcacgaatgcgtaggagccgcaggcgagggagagacgggagagggagggtgcgtgagaggatgacaagcggacaacacgccagaaacggtgacggaaggaggtgagacaacgagtccacgaaggcatacgcacgagcgtccgcgtggcgcgcgagaggtgcgagaggagtgggatgcgggacgagagtgtgggccggtgagggagggcgagagtgaggagggacggaggggcataggggtatggagggagcgactgcatgtgggacgggagatggaggggagaaatacaacgagatacaacatatacatgaccagtggatcgagcagctaagaacagacaggaaagatacgtggagagaggaggcgagcatgaggtgaggacgaggatacacggaggtggcggggagggaggagggtagggagcagggcgagaacgagtgaaaggaaagaggaggggggaaggaacgcgaagaaggggaggaaaagtgggataaaaagtcagagggaaagaagagcgggaggaaagggaggggagtaggaacagggggagcggacgggaaggaggaggggagccagcgagcggggtgtacgtgaagggaacgggcgcaggggggtggacaagatagaaggagaaggaggtgacaggaaccaacgcgacaatcaataggaagagaaggactgtgaaaggaggagcgggggggggggcagtgtcagagaaacgcgacggaatgtgggagtgaagggggcgtcggcggaggcggaccctccctttttttctttctgattcctttgttgttttaatccatcatgagaaagccagaagtcatgaaatgacagtatgtaaagtgacctttacaatcagggtcactggcctggaaggcatggactcagaacacctgggctgtaaaaacgagatcggcag

SEQ ID NO: 8507 - DNA, 1333 bp, Homo sapiens
  misc_feature (1)...(1333): n = A,T,C or G
agccactctacctctcctaatancacanacagtcataccctatntcaatactctacccgnnaccagttatctatatntgcaatcttctccactacaaccngacactttggnaaccgctattaattaatttcatatgaacggcttacactgcctctctacctcatcatncnccaacttctcgtctatcatcactacntncacccatctcatctaattctctcacttgattacgaagatgtgcgcaccagcagangctgtttcaatcacggtaggcccgcgctctcttggaataccaccagcatagagtagangccaacagcaacgttaactgtgagaagcaggacaccactcactcaangattcctatctcataacactcccganaaatgcaaccaacctaacacacgactcacctcccatatacctcaatccacaatncactacttcgctgctaccactcataatacaacactatagtnaatgntcattctcgtctctcagtacaacttcattatatctgcactacgaccaacaaaccatctacgtacgagttccgacgttgtgtgtttactaatcgacctgtgcataacaactccactcgtgancgccgtnnacacgaacgcagncgccgcactacatctcactcagnacccgataccaccacaaacgacactccctttgnaccacatcaaccctactnttagatactatgaaaaagaatgttcacaccattagacaaacatnaatttgncncaccctcatctccgtccccctctctatgacccctcctctccacgtccccanaccgcgtaactccatctctacttntacgcgccaagtgcacttctcctcgctctaactttgntcntacctcntnnncctctcttctctnnccccnntctnnnnctntcntcctcctccttcntcanctctctttnnnctnctccctcctctnnccaccctcatatctccantcttcttcttatnnntcaactcctcctcgctcctctcctcccttgntcatcacttctctttctctactctcttcttttnnttaccttctatactatttnnnacatgactatttatatctccatnnncctccctctactccctctccttaccacctccnnctcactncttccaccacttcacntcttncctnnccacacttctaacctttctctnanacaactccactgtcctactctttatattccccccataaanatttctnnccccaacanntccctccccnncccttttcctcacacttcccctcccctcnncncctccnncncnntctcnnccctntcctccnctccttcctcct

SEQ ID NO: 8508 - DNA, 862 bp, Homo sapiens
  misc_feature (1)...(862): n = A,T,C or G
caaccagaagggttctcacaacctctcaattaaccgcaatactctgtgattaataacaaggcttagcgatttgtgccctttcctaagccaaggcccctaactgtaaattggttatctctaaatgccccattctaaccgtatttgttgggaaatcaagtgttaccagtagttgatttttaaagaaaacaatattgaaattcctttccacttgtgttacagaaaaagagtcaacttctgtaaaatattgaagagatttattctgagccaaatataagtgaccatggcccatgacacagcccttaggaggtcctgagaacatgtgtctaaggtggtcggggttcaggtgggttttatacatttttagggaggcatgagacatcagtcagatacatttaagaaatacattggtntggtccagaaaggcaggacaattttgggggtgggggttccagcttataggtagattttaaaatgttctggttgacaattggttgagtttatccaaaaacctgggctcaacagaaaggaatgtctgggttgcgataagaggttgtggagactcaggagttcgagaccagcctggccaacatggtgacgtagcaggacaagctgcagacaaaacccctcagacaccgagttaaagaaggaagggctttattcagccaggagcttcagcaagactcacgtctccaaaaaccgagctccccgaatgagcaattcctgtcccttttaagggcttacaactcttaagcgggtctgcctgagagggttgtgatggattgagcaagcagggggtatgtgactgggggctgcatgccccagtagtcagaatggtgcatcancctcagttaccgcagcttcc

SEQ ID NO: 8509 - DNA, 784 bp, Homo sapiens
cattactacatgaaaagatgcatcgtgctggagaagaaaatcaatattggcctgtgaaaaacccaagtgaaaatatcttgaacgacatatgacattcaatagaaacttcgcagcacataaaaggatcaagtaacatttaacatcctgatgaagagcatgctgctgaaaacactgctctggaaagtggtgactctttgatgcttccccatatgcccaaattccaaggagaaatctcccaactaacaggaccgcagaaaagttctcaggtttgtccaagctggagttgttctgcagcagctgggctagcagaaagccacctccacagggcaggcggagagcaggcgatcagagcagtgtgggttgcagagaaagcagaggctcaataggaaacccctgggggcacaggcaggacagtacagaagaggtttcaccatcttggccagactggtctcgaactgctgacctcatgtaattcacctgccttatcctcccgaagtgctgggattacagattcaaggagtacatgtgcaggtttttttacatggtatattgtgtaatgccgaagttgggaagacgacggatcccatcacccaggttccattgaagacttgacgaaagcaaaaaatctgaacaccttttgggaccttttggctcacaccattgatacctctgatcttgatgacaaaagccaatttggcttatggaaggtgcacagattctcttttcaccgccttacacccaccactgggatggaagaggggaaatctggccatcaagattgctt

SEQ ID NO: 8510 - DNA, 900 bp, Homo sapiens
  misc_feature (1)...(900): n = A,T,C or G
tcaacacagtattcaacaccttcgtttgaaaatcaaagctctatatgaaccctctgggtccggccggaccgccccaacgaggttcccttcttgctcagcctgtcttgactgttcccccaagtaatcgactgccctacccctcgagaggggtgggattccagatctaagaggttatgtccaggtttttctccatgcactctgtgcaatccgaaagtttgaggacccccgattcctatccccagggttccattaaagactttccgaaggcgaaagattctgcacccccttttgggcccttggggctcccccccatttaacccttctgttgttgatgaccaaggcccaatttggttttgcaggtgcacagattttctctcccagcccatcaaccccccaggggatggaggaagggaaatgctggcaattccagattgtctttcctagccccttccagggccttttccttgatatgattttaaaaccaggtcctgtgatgctcaccctgattttaggttctatgaaggtgctttcttgtgtggatatttgtccaatttggtgttcctgttagggtggagggaagagtgatcgctggaggcttctgtttggctgtcttgttcattctactcctttggtattcgtttttgactcctgtaaaagtgtcccaattttcactatttaaaaaaatagtgatttttcatgaagtgttatttatgctaatatttaatggatatttttaatattgcttgtgatgaaatgggaagtatgcatgaggtacttccactacataccaaactattaagctcatctgaaggaaaaagtcatgtgagactgtgttaacctagtcatttttcatggatatnttttttgtantcatgtctgtactaagcgggcatgcttttc

SEQ ID NO: 8511 - DNA, 964 bp, Homo sapiens
  misc_feature (1)...(964): n = A,T,C or G
ccgcctcccgtggcgtctctcccccgtttggtgctcgctggggctacgccgcggcggggctggtcccgtgggggcgccgccgcgggggctcgcccctcgggtcccccgggggccggtgtctggcgcgcgggggggggcccggtctccgggggggccggtggggcggcggcgggggggcgcggggcgtgggggggtgccgcgcgccgcccccgcgggcgggggcggggggtgcgtgtnttccccccccccggnccccccccccccccccctttnactctctatcttccccgccttctcgcccccctctttctcgccccccccccccgnccctcccgccgcaccccccccctccggntcctgccccccccgcccgcccccctgggcttnatcccgctcgtctgtgctctgtcctgagggcgcctgcccgtctgcggcgcgcgncgcggctcgtgtgtgtggtgtctctggtggccgtcggggcccggggggcgttgccgcgggcgcgcggggnggcgggtccctgtgcgccgggcgtctcgtggcctcgcaaccctccccccgtccgcgtctgcgggccgtgaccccgcttttccttccctgcctccctcctcagaacttcttttctcctnccgctcttctcctgcgcccgctttcttttntnntcgcggttgtgggcgggnnggcccgcgggcgctnccgncccccgctccgggccgccgcccccccgcgngccccgccggggggtgggggggcgcggggcggcgcgggcgggggggcccgcggggttcgcggccggcgcgggcggcggggtgggcttctcgccctgggcggcggcgggcgcgcgggtttcgcgccgcctgcacgtttttttttttgttttccctgcaaggttttgtgttttgtgcgggtncccgttccgcgcgccgcgcccgcccccccctcttttttcttccctgctgcggcc

SEQ ID NO: 8512 - DNA, 840 bp, Homo sapiens
cggttttaaaggcattgattccccagtttcctttttatataaacccttcattttaggttaagcaatttattgtccttggaaaaaggtggcccagttttatgttaatgtagtttttaaaatggggttattctgtgtttctattactccaatatttttgcaagtaattaatctccgcaatttttttatcaattttagtttggaaacaatattttttgaattcccaagcccttaaaaagaaattaattcttctcgcccccataataatagcctcagaaatgttgtttctctcctcttagacccaaactaataatacctgtatctggtttatgtaataagactgtgtagtcctttaaaaaataataactagatccaataagtcatttgaaacctttaaatatggaagggacaatgaaaacaggtaaatctgaccccccgattaatgatttgagcatcaaaaagtcaaaatagcacaatgattgtaggttttttccagagtcttcaatctaaacatcagattataaaccataatcaatattataaaatgttatttccaaattctagggtatattttcaaattactcttaatatggctttgatctatttggtatatcgttgttctcccactatcctagtgcctaaagttcaaagaaatgacacagtatgtaatcacaatgtaaaaaattacgagattattttaagatattttaaatgtaaattgtttcctttattgtttttggcaatagcaacattgttaagaatattaagtcctttggtttggttatagcatcaatacgaatccaagtgtgtagtgccttaatcagtttctaaatacttctaggt

SEQ ID NO: 8513 - DNA, 882 bp, Homo sapiens
  misc_feature (1)...(882): n = A,T,C or G
tttattcaaaaataaagcctatccttccaaccataatttttttataaataaccccatttggatttgctgtaaaacatcccccttgtcccaggcttttgttatatgtttagagaaaattaagcagtagagctggtagccaggtttttggataatgccagaagtttgtagccgaagtcaattcccctttcccccccattatagtataaaatcaggtaagaatcccggcttgaaatcctttcaacttttatgaattttttattctacgcgggcttattttcctcctaccaacttgaatttcagaaaagaaaggtaaccttgagaaaaaaaagagagagagagaagggaatccaagntttgatgcttttcagcgggtatcttctggctggatttttcttgtactgctgtatagtaaacagttcctttgtgtcttttttgtttgtttcaaacacctgaagaaaaagacaaatttttttaattttttttattttgtttttccataagttattggagtacaggtggtatttgttacatgagtaagtcctttagtggcgatttgtgagattttagtgcacccagcactggagcagtaaacactgcaccatatttgtagtcttttatccctcgccccactcccgctcttcctcccaagtccccaaggtctattgtatcattcttatgcctttgagtcctcatagcttagctcccaatgatcagtgagaacatacaacgtttggttttccattcctgagttacttcacttagaataatagtctccaatctcatccaggttactgaaaatgatcttaattcattccttctcatggctgagtagtattctattgtgtacacacagtttctttatccactctgattgatcggccg

SEQ ID NO: 8514 - DNA, 159 bp, Homo sapiens
gtcctcatagaagatcttcagaaaacactggagaagggaagcagcttgcacacccagagaaaccgaagatccctctctggatataattatgaagtttatcactccttagaagaaattcaaaattggatgcatcatctgaataaaacacgatcggccagc

SEQ ID NO: 8515 - DNA, 1346 bp, Homo sapiens
  misc_feature (1)...(1346): n = A,T,C or G
cgaaaccccgccgaaacnacccccccgcgccatgcggtacgngcacaccgcagaaccccaaaggaggctgcgccggggcagaacaacgcggcggggaanaaacgttctgccctcgacgcgcaagacccccaggtgagggataacctacacgctcagccgtgggcatgaccaccacgccgcagttttattccgggtggcggccacaaggcgcgcacgcccgacgacttataggtgcagatgatgacgcgcgcagtaggatgtttcagacacaacaacacacgatgcgaaaacctaatgattggcccgcaagaagtgcttccccaaatacgaaacacaccccgatatagataccaccacgggggacacccgcggctcgcaacgggggccgtactccgaggaagcaacacgacatcccgccaacgcctgatagacatgtggagatgtgtgggctcgtacacacatcaatacgccgcggatatacgaagaggagtcaaaacacgcgcggcggacgtcgcccccgctacgagccgggcgggacaagtcggcatagtggcgagcacggcacaatggaccgatatcgataggatacgtgccctgcccaggatcgcgcgcgccacgcgcgcgagtgagtacgtgattccacccctattgcgctgcccatacatggggaggcgttggcactcgcgtaatcccaaccggagtgtatggagacaaccacctggtcggtcagtggagagcggacggtcagagctagattcactgtgataggtacaagcgcttcagcatagcggcgcgcgagcacacgacgtgatacggagaggcgcgccgcgcggctgtggcggaggagggaggactcgttgcgccacgatggccgcgagttgtcgggagtgctgcgggtgtggcacgtgaccagagccggaccaccaccactgacgtgggaggacacgcaggcgacgaagtcacgcacgacccaaatgtagccaacgtgaagacgcgtccgcacgcgcgatacacaggtgtatgtggacacaaccgcggaggtgtcgtagttgcgatgtcgcatgcgtattattgacatcgacgtcacatatgcaaacggtcacaccaggccgcgcatgcacgtgcgggatgaaccaccaacgactcccggaatcgtagaggcncgcacccgcagagcgaccacagaaacgtcgcgcccgcgttgccagatcaggatccacgtggctagagcagcctcatagctagccctgtgtagtcccaccctcgcacccgctgatgtgtacagacgcggggggagaatgatgtcgcgcaccgcgtntgctgccttgtggcgccccccgcccgcc

SEQ ID NO: 8516 - DNA, 1448 bp, Homo sapiens
  misc_feature (1)...(1448): n = A,T,C or G
cttctctctctgtcgtcangncgcattcatacntcattgtctcatcacttacngngagcacttctctcgacgctctgnngactctcatcgtccgtagtacagtaggtgngncntgtacgtagacactataggtactctctgtcttcatnctagtcgngnngtcactcatctctctatcagtggancacctctctctactcgcgngccccgtggtanacgatggnngangcncnctgccgtggtcgcagacaccctgtgagagctggtgtcatgctgngncactcactgcatatgtgaatgcacgatactccagtgtgatcagaatagattgctataagctcatatgtaatagtatgcgatgaaggagangttagctgacacgtcgtggtgccgcgcgntcgctatctgtaggcgtactatctctcannngatacactccacatatanacntantntnnnncatcacacactacatactctcctcactcatcaatgnncacatactcanncccacagcnactatcctacatcacacacatctctgacacatatcncaataacgctactcatcatngatagatcactcntcccttattcttttaatctacctcccctactctctctcctcttantnacttctctggaccttctttcatcatgatctnaacatctcttctactctttnnnanactctcttaacnagtacgananctgtctatacgatgaacaaatgcacttgtaaactgtactccgctgangnggcctcgcacctctgcactcgcggtgcgaaggcgatgcccgagtgcatganactagactatatctaagagacgcgacgcttcctcactagggtctgcgatcgtcgtgtggncacactcaccactcacacaccaccatataaggaagatcacgacaacatgaatactctcnnngatctgacttctctccttctcctacgcttgccgcacgctcccgcactgaactctatctttcatntntgctcacatctnanctctcactatactctatttacttatcactnnnnnctactancatcaccccacaccttctctcagaacacctgcctacctatctncctcactcgactgctcgacacgctggagaatcgcgaggactctctgcatcaactccttgacccgaagcattcctcacacccacacccggnccgggtaatacaatatantaaaatantcattatcactaggcatatgttcaatataataatgtgtgnagtatggcctccctacgcgacacaccggcaacctccctcgcgctccgagttggcttgtcgcttttaactatctatctacgatccagncactgccgcactcctccgagaacactcacgactccgcctgtcgcgccnnnnacgtgctgagcgncggggctcggcatcnnnnccacacacacacgcgcggcggcggatc

SEQ ID NO: 8517 - DNA, 496 bp, Homo sapiens
ctgcaaaacataccatgccatatatgtcccagattttctttatccaatccaccccgatgggcatctaaggtgaaagaacttctaaatacatgaacaaaaactgacagaggagaaagagataaatctacaattggatttggaaatctcttcatcattgattgaacaactatatggataaataaataaggaaactgaagatctgaaccacactatacactcacatcagctagttaatatttatgaactctccacccaccagctaaagaatatgcattactttcaagtacacttggaacacatcgcatgttagaccatatgctgaactacgaaataagccttaaaaaatataaaacactgaaatcttaaaaaatatattctcaaaccaaaagggaattaaactaaaaatcaattaccttaaaatatctcaattttttttagtatctaaaaacagagaactgctaaatatctcaattgtcaaataaaaatcgatcggccg

SEQ ID NO: 8518 - DNA, 353 bp, Homo sapiens
agagaagaaatccaaggctccaagaactgaagttacctattcaaggatcatgtaattagtaaatcagagtcagctttcagtgtactcctacttccataaaaaaactataaaacagcctcaggcaggtccttcaggaggtattccagaagaaggcattgttatcataagagatgactgctccgtgcgtgttattgcccctgaagactttctggtgggacaagatgtggaggtggaagatagtgatgttgatgatcctgaccctgtaggtagacctaggccaacatatgtttgtcttactttttagccaaacgtttaaaaactataaaaaaataaataaacagggatgctgcaag

SEQ ID NO: 8519 - DNA, 813 bp, Homo sapiens
agttagtaatgttgggggagcggaattagtctcaaaggtctgacacaataaaagggctgccacacatgccagtcagcagcacaacctccacttaaatcaaaattatcatcaagaaagggccctgcagcagagcccaagaggaaccaccacatctaggctgttccagcccagaatgtatgtgggtgtctgtgtgtgtgtgcacgcgcacatggaaagtataggaaccaaatacctgggtccaaattctaaccctgcttcttcctgggaagatgatcttgtgcaaattaacctcacaatgcctctgctttttgatctggaaaattatcttaagggtataagggtacctacctgataaggtgtctatgaggttacataagctaatgtaggtaatgtccaaatcacagtagctggtatgtacatatacatacacccttgatagataccttattcattcaatccaaattgccactcactccagcacactggtatctctggctgccaagagttatgcaacaacatacttaaacaccaaatcatctaaatcatttgggtggaaccatcgatccttaaccaggcttgtgaaaggttctcttggctctgtttactttggacaggcatcaagcgtctgttttcctcagaatctgaaagtcactgggtcaaggctgtagaggccccttttcacacagaggaaccagtcaaggactgatattgctctgtgtggtggtggtggtcacctggccaattgcatggggggtcacttcgtggctttggcagagtctgccactgtctgctagaataaatgcagatcggcag

SEQ ID NO: 8520 - DNA, 627 bp, Homo sapiens
ctagtgatatgcagggtgatactttctcatgatgctgggcatcagcagtaagccgcagctcccagtctgccacatgatcatgacagcaaacaaccaatactctacactgtactgtgttgccaggaattagacccaatgaatgaagagctgcagttttttggatcttgatcttgaaggtggaagctgagtgctaagaatgttggagctgaatattaaagcagaattatagctgcaaggcagcttcaagtgttttccccagaggtagagacaatatgaaaaataaagcagtgtgtgaacactctcgctgactccattctggacacttttgtctcaacctgaatatactgccaggcaccaggaagatatagctttaaacaaaggtagaggcaagaataacacctgtctcaaactgtggaaatagtttgaatgctgaaatattcctgttacctcatatatttagtatgtaaaatttgccaattaatgtataacatacaaacttataaatctgtatacaaggccaattaacatgtaaaaagactgtcaactttattactgaaatcttctatgtaaatttaaaaagtgatagaattgtaatctaattaattaaaaataaaggacgatcggcag

SEQ ID NO: 8521 - DNA, 831 bp, Homo sapiens
gtgtagactaagtgtgtagctggtcaaatacgagtgaggagcgggtgtggactcaatgttggattagtagcatacggtcgagatgtgggtactaggaaatgatatcgcccttgggtatgtggggaacgagtgtatacggggcggctaggtgcaggatggacggttgtacggggctgatgatgccggtgtcgggacgcgcccacgcctcggggagttgagggtgtggaggggatccgttagtggagaagtgtggggaatatgttggtcttctgttgggttgggggctcggggtgtggattaatagccgggtgtagcgagggggggtagatcgtggtagcggagtttggtatgatagagaggttggtcgtttttgagcacgcgggtctgtatctgatgggagttcagtaattatgagcgtagtgtgggttctgggaggtgggtgcatggatgaggctgtgtcaaaccagtctcgccaggctgtgctcgagcgagctgtatgcacctgttcatatgtgtatcatgcatgtatgaggctgggttcacatcagggcaatacaattgcatacgtagggacgcaatatcatcctctttatagaccggaaatgacagtgtggagaagtaggattttatttctccttcatatatatcctgtctatttcttcctggcattttatggctttgactgaaagtgtgactgagatatcctttagtgaggacatccattaaaaggttaggatcctgtgacctatttatcagtctagtgaataatatatgtatgtttccaagatgttaagcaactctcaaattctggaataaacccgtgatcggccg

SEQ ID NO: 8522 - DNA, 819 bp, Homo sapiens
  misc_feature (1)...(819): n = A,T,C or G
tttgggcaaaaggccttccgatttaatgtaaggcggcagtgtttgtacccacagtgtgagattcagctgcggtgctcttgtgattaccaccgctacaagaacagggtctccgtgtgttacccacgatggtcttgaactcctggtctccagtgatctgcccgcctcggcctcccaagtgtgctgggattacagagtgagctcagcctcagctgtttttcgtacaggaccctgtgttgtgtgtttattaaagaaagatcatgcactgattgtgtccatgagcactgcctacaatcttgtntaatggggtgcttggaggggagagggagaagagaattgatgggctctggcaggcctgggactctgaatatgaggggagaggagagaccaagaaggccagaaggagggaaaacctgcatgtgttcatcaactcttttgagtagggtgcgcaagcatgcatgtgggcatgaaatcactcagggtaaaacatgaaatgaaggagtagggacataaataatagaagccaatagaacaatatagaaaaaattgttttcaaaagaatgcctttcagaagaactcagcaattttttttctccagaaaaagataaaatgccttcaaatcccacttagggtagaaggcaagatccttaaggcatctcaaataacaaatgcacaataaagaagtaaagagtttgaaagagatctgaattggaaaaaaagaaaacttggatgaagatttttcacaaacatgtaatgtgctttgtgctgttcagcagaagatatacaattatgataagtcagaataaagtcgtgatcggcaag

SEQ ID NO: 8523 - DNA, 819 bp, Homo sapiens
atagtctgaagtgttgaacccaagcaaagtctccccagatgagcttgacatgaaaaaagtaattttgttaccagcctcttacagtaatgatgagttatcacattacctaagcaggaagcagagcaaggaaggctcatttcatatggagccatatacagtgaaggagcaacaccaaacaatggcagctggaaagtcagaagaattgtgaaaacgactaagaaaccctacaagtgtgaggacatctacaagtttctgcagctcctatacaactctgaaatgagattgagtatccccaaaatagcttattttggaagtgattccaggaagcaacatgaggaagtttgtagtcagaaagaaaagccagcagaagcactggagagtaaagaacaagttactgttgtgggcaaatggggtccagtcttactggtgaccctctgagagaccatgtagaactcagtggagggcaaagaatctgcagtttatccatcaacccttctctctttgtaattgagagtcactgctgagcataacttctaccatgcagtcaacttgcccccaaggttatccgcactgcagagaatgcgatcagagaaacacaggaagctgaaatcctctgtgagaaacttccagggtggacacagaggatttgtacaggacaccaaaagatgctaccgcaatttatcagcagtcttggtgagtggagtcctaattgttatatttgatttttaaaaataagattctaaacaaaatgacaaaataagctaattcatggaaagcacttctttctattccaaacacaaataaatgacgatgcggcag

SEQ ID NO: 8524 - DNA, 806 bp, Homo sapiens
cgctagttgtacgagattcggtttattctttcgtgtgtccttgccctaccatatcgttaaaaaataaaagggagtttctcggactcgaagatatactactggggtttggcaaggcttctacaacactgccttgcccgccttggttggagtctcaacgggtctcatgtgttccaagtccattggtttttagataagcaaagcaccagtaattgcctagaactctcagtcctggtgatctagagtccctggcgagtgtatttagatccccagagcacttaaacttgttagagtggcagggcttcgtcaaactcagtttctgactgctggaatgcacaattcacctctggctagagcttatctagatgctcccttggaggacacaagctgggttgttcccagtgttgctttctgctgtgataaggtagcactgatttccaatgtgaagtcccacaatcactacattctctctccccaaaatgcacaggttctttctccgtgacccacggccactgctaggggatgggtaacctgtggtgtaagcaattcaagactaccttcttcagtgcatgtttccttaatatgatgttaatatcaagtactgtgatagctcacctgagtttcacttcttataatggtgcttttgttgtacggatagttgttcaattttgttttcctgttgggaaggatgactttcggtgcttctcttctgccagacctttggtgtaggcaattcaagactgtttttttctaccctcttcagtgacctttttcttaatatgatgttaaaataaagcacgatgcggcaa

SEQ ID NO: 8525 - DNA, 791 bp, Homo sapiens
atataaaatcactagtgggcttaatgagtactcgcggagcagtgtattatctcagttaactgtataggcgctggacccctccaggatttaggttagagggcagcagccaccctggagtctcgcttgcttcctgtgcgtgcgtgtagtggatggatctcgtgtcttggagtcttacacctctcaggttagaggagttctcgggcctcagcgtccccagtaggcagtactacagaatgatgaagggcagatcctgtgttgtgcacaatagtacatttaatagctctgcccaatagatgcgatcatgcagagtctagtaataagccagaccaatgcagagttaccctcatgattctcacatctgagaatattatctgaaaagattaccacagtgatttgtcttgaatgaattccatccttattctatccctgcagagtgctaactgaatttaaagcttcttttttcacttattatttgtggtcatttctatgtttgaacatttgcgtgtatgtccaggaatgtattttgtatcatccatcaagtaaaaatagtgattcatttataaagtacttaagtcagaatctatcccagtattagaggcagaatctagtcagcagtttcatctttgatggattgtgttgtcagagctttcaatgaattggcaatttctacttgtaagctgtcttctagaaaagatgaaagtattcacaagaccctaagcaagtatctaatcatccagttatcttgtatttacagcagtaagtttaattataataaagccgtgatgcggcag

SEQ ID NO: 8526 - DNA, 208 bp, Homo sapiens
aaaaaaaaaagcatcaataactcagggagaaatcatctataagtgagggtaacaaatgcaataataaagatagtattactccataccaaagctaacgcaaggagtttacatggtgatgattatgagacgaacaaagagtaacggtatacaaagatcacaagattacagtgtttagagaacgataaggaatgcaaatggaaaattaaca

SEQ ID NO: 8527 - DNA, 541 bp, Homo sapiens
ttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccaaaaaaaaaaaaaaaa

SEQ ID NO: 8528 - DNA, 193 bp, Homo sapiens
ctaattataatgggcagaaaacgggcgtaacaagccggggttgatgcgatgtaattatgccaggcgtacgataaccacacaaacacggattgaagcgtggaaaaagctgggagtgattagaataaaggctggaatggcactagcgcaaatttctttaaacggtcattgaagggccggtaattcctaaataacg

SEQ ID NO: 8529 - DNA, 664 bp, Homo sapiens
  misc_feature (1)...(664): n = A,T,C or G
aaacataatatcggcgaaacataataggggtgaataacgggagctagggcgtngggagatacgtgggggagtagtgattagtgttaagcggcacccggcgggtattgaggggtgggtttcatatgtgtggtttttggatgagtgtacgtgaggtgtgatagttagagtaggatcgtttaaggtggggtggggtgtaagatgcgctgggggatagggtggccgtaggattgtatatgttttctttggaggataaatgggggggagagaagctaatgcggggtcggcgagggtgtgaatcaaaacatggtgtaaaggtcaccccagggaatgtggttgagacggagatatcaaatattgtcggattaactcacatgtgggctactatatttggggttgtgttcgagttggagcgttcctacatatgtgcgatactagatggttgcgtattttgccaaattgatgtgtgtgtgtttgggggggcatggtatttttttgtaggttttagtgggttatctggtgggggcagttgttagtagtaatggcgattatttccttggcgtttatattacggtggtatctcatatggagcggggttggatgaggagcattcgatcagttgggaagtagtaatgtcaatagaagacgcgggataatggcttgtgca

SEQ ID NO: 8530 - DNA, 544 bp, Homo sapiens
ctcttcctgagaacaaaaaggatttatgaaggaaaaagcagctaatcaaagaagttctgagtttaaattctgttttgtccacttactagccatttgaccttgggcaagtcactttactggacctcagtttccttgtatgtgaaaggttttggtaaaaatcatattagttaaagaatgtaaagagttttataaattacaaagtgattaaaaaaagtaaaatgtattgttgtttaggaacaatgaaaaaaaaagaaaccttgacattttttcttcaagttcttgcctaaaatgtttatttgtttggccctttttagatttaacaaattctatgtgtctaaatatcagtgtagaccccttcttaccctactggatttataaggtactaaaagtagatatgcatctcttctgtcttggttcgctctaaaatgggatgtttgcaaacctcttggtttttcttttttaatatggatgaagcttatattaatttttggcttggtattaaattttgtttggaatattattaattgaaaaaaaaaaaaaaaaa

SEQ ID NO: 8531 - DNA, 266 bp, Homo sapiens
ggttgagaaaaagaaggaggaaggagaaggcagaaaaggcagaagaagaaggggttgggaaggaagatgggaggaaaagaagaagaggagacagagaccatttgtgcctcacaaggcctaaaatattgactctttggtttttgacaggaaaagcaggagcgaaaggcaccgcatgtacagtcggccctccatattgtgggttccatatctgtggattcaaccaaatgaagaataaaaatacttaaaaaaagaaaaaaaaaaaaaaa

SEQ ID NO: 8532 - DNA, 176 bp, Homo sapiens
caaaatatgtgtggacaagctatttttcatacaccttaggaaaaaagccaggtttaccttacagcacacttatcggagaatatgtgaagtaataacggaaatttcgttgtttcaatccagaggtattgaaaatttttcaggttggatattggaaatgggtgttaaagggggtgccg

SEQ ID NO: 8533 - DNA, 258 bp, Homo sapiens
atggtgtttgggaaccaatatctgggcattgtagttaagctttcaaaaaagtattaaaatagctgtttttggacagactcatgggccaccacatctgtaatcccagcactttggaaggtcaaggcgggcagattgcttgagcccaggagtttgagaccagcctgggcaacatggagaaaccccagttctattttataaatgaatgaatgaatgaatgaataaataaataaataaataaacaaaaaaaaaaaaaaaaaa

SEQ ID NO: 8534 - DNA, 861 bp, Homo sapiens
ctacccaccaaaagtcagttcgccatttaaaggtaacaatttgtcttctttttccagtcacaaatctcgagagctctgaaaccctgtcagaagcgtgttcccttaatcgccccttaaggggacccaaggttggattaaggtatcatacaaagttgctctccaagagtaacctcttacaccccccgagggtttctttgcttaaggggtgtaaggtttccacttcagaaaaggtaatcagtccaaagaaggatggccccaaagaatatcacaggcttccccatccaccaggaaaaagaatcaaacttttagtccagaactgggggttttttccaagtgtgttcttagggaattttacccaccccaaaagtttattttcagttactagccttcaaattttagtacccacggaaacctccacttccaaatataacaaaaagcaataggaaaatttattttaaaataaaatttaagtgtatgtcggtaggccgttactttacacataaataggtgggagcaaatctgaagagatgatatgagatgttcttacctaaaatacgtattgtcataccccttatgagtcatcctccctaacaggtaaaattaaggcataataaaagtctcaccaacctgcatattaggtgtgaagaacaatggagataatctactgggtttaatataggaaccacaagttaaatactaagtgctcatgctcacaatgcagcctcattagcaatcaagaaggaaacgctggtaaccccaggagaagtttttgcccagcagtagtcataccgtgatatcaagtcagccctactttctcaaactgtttccttatacaacacaataaatatcgtatccgaccag

SEQ ID NO: 8535 - DNA, 792 bp, Homo sapiens
caggggtccttgggccctttggggtttactttgggattgttggggaaacaaatggaaatgccttcctttatgtttcgcttttaccaggaactgagcaagtgcgggtgttagggaggttaaggaccattcgagggggaatttccagggaacttaggttggatactttaccccctaaaattcacagggctacctcaggggcatctgaatttgcacaaacatcaattcttgttggcaggcatatacgcaatggagtactgttcagccataaaaaagaatgagatcccgtgatttgcaacaacatggatggaactgaaggtctttgtgttaattagaataatccaggcatagaaagacagcctgcatgttctcgcttatttgtgtaagctaaaaaataaaatgattggactcatggagatagagaatagaatgccggttaccaggctgggtgcagtggcttatgcctgtaatccccacactttgggaagccaaggtgggcagattgcttgagcaacatgggggcaacgcagcaaaaccccatctcttccaaaaatcggcaccatcagcaataagaagtacccaggtgtggtggtgcacccctatagtcccagctactcaggaggttgaggtgggaggataacttgagcccaggaagctgagggtgtagtgagctgagatggtgcactgtacttcaccctgggcaacagagcaagactgtgtctcaaaaaaaaacaaaaaaaaaaagagaaagtaatagtaataaaaataatcaaatagcaaaaaaaaaaaaaaaaa

SEQ ID NO: 8536 - DNA, 150 bp, Homo sapiens
ttggtgattaaaatcaaattcataagtactctcgttacgggaatgagaaactggttttcactgtaataaggatatatatttggtataaatggtttgaaaagtccgggaaatgtaaggggattatctccgaaacgtacttaaagttttagt

SEQ ID NO: 8537 - DNA, 450 bp, Homo sapiens
ttggatttttttatttgtttaatatataggccgtggatatgtgacgggtatatgagataaattacttgagatcaatttttccgttcccatattcttttattaatacatcgcgtgtttttgttggcattaccattgccatcatcgctatttgtcttattttagatttataaatatcttataggtttcttcgttccgaaacactgtaagtcgataaatcacaaacacttgccgactattgtgccgggtgtttataaaggccctaattattgcgccgcgggggagtcttgtgtttatcaaaatcctttgccggtcggccccctatgtctctcctacgccgattgctatttcttacctgtcggtatatctgtcaattttctgtctaataaggctgcgctacctttatatcccctttcacgtaaggctaggcatctctggtaatggataagtact

SEQ ID NO: 8538 - DNA, 762 bp, Homo sapiens
gttataattattctctgcactccttcatgttcgcctctactctctggcgcctgtttcgtttattatctgtcgagttttgtcttcgcctacatcaggctaaccagttgtcctcgagcaaaattttaccttgtccatttctatcgcgacaccagcgctctatcctatgttgaattctaataactcgcggccataagggctttccccacccttaccgttttcttatttcttagactccgaccccgctgctcgtcattaagtctaatctctctatagggggggggggttccaagctaggtccttacaactcccccggtactttctgtatttcttaaggcgattctattcctctttccccaggcactcgtcctaccttttctgctcccctcccgcactctacctcagcgcctgacctcggcccccttcaacttccgcgtatcatgtttcgagcaatttccctgttccaccttcttcagcagctgcctttacaggtaggatttgtccttatgttcgtgacagttccatcgcatgaattaaagccacatggtcagtgaagatcattgttcgcagacaagtttttcatgttatggatccgtcactccctaatacattttcctacttttcaagaaattgaactgaatttattccatttatataacaggaaagatgccaaactgtggatctgcttattcaaagtgactgaactttgtcaggctatttatcaacaaataaagtatttgtaattatgaaaaaaaaaaaaaaaaa

SEQ ID NO: 8539 - DNA, 378 bp, Homo sapiens
tgagccttcctggatacttgaagggcctctacctgttctcctgtctgacttctgtctctgcagagcccattcctggttactcactcaaatgttgcttctcactaaggccagacctggaccttccctgggtcctgaatcaactctctgcagtgtctcctgggaagagaggttctctggatacctaactttatctcacttcagccgggaccatatgccaaccacttccttaactcaacagtttagactgacattcactgctggcctctaattcaatagcatgcacagttccaaaatcaatgagtcaaatatacctgtcttaaaaaaataaataaataaataaataaaagaaagaaaagaaaaagaaaaaaaaaaaaaaaa

SEQ ID NO: 8540 - DNA, 575 bp, Homo sapiens
ttgggataataagaaaaagatcttaatgcaaactatcggagacggataacgaagaaggggtcagacacaaaattttacgtaagtttaaccatattattaatttataataggttacgtcatatattcttaccagcagtgcatatcagtgtcacatgaaatcttcttacaagaggtacagcatcattcgcatctatttgagttatagaatgaatactcgtattttagagattatccgataagcatatcattcttagataacaacaagatctggttatgtcgattagttatgtaaaagtcgtgttacaatgcatatgcggcaggggcggcgaaaagctttaactccacagtctaagttgacagggcgaagtatgaaaacgattgaatagggcatactatcttgttctaaaaaacaataggcattaaataatgaagggtttgctagcgttatacttgataatacagagagtacgacaaacacatacctattgtcgagaaaatacttttataccgtctcagcgaaagtgaaaagtcatattggaacagggcatatagtgcatgtccacaatgctgtgtct

SEQ ID NO: 8541 - DNA, 375 bp, Homo sapiens
aggggataaatttgatctttaatcattagtcgtgacgggcatacgccgacggaatgtgaaattaataactggtcatacactgatattatgtcctatctgccatcggtccatataatatctacagtatctttcatgctgctataatatcgatcaccagacgtataattattatacaagaacacactttcaatatcattggcaaattcttcctataccgcatcgtgtaacatccacatgtggaaaatccattgatttatttgtccaacctatcaagagttccatatatataccatttgccgacggggggttaatttaccgataaccaccctagttttaagcgccctaaggaactccgcaccatgtggaataaccgga

SEQ ID NO: 8542 - DNA, 555 bp, Homo sapiens
agggtattaaatacgtttcttataaatgtttcaggccgtggaaatgtgaagcgtggtaatgatgtacttagactagagatcatatatagcgagtaaccacaaatcttcataatacgtaggcagctacatattgtatttagaattttaagttacaatctacaataagagtctgaaagaaccagagctgaaagaaagacggggaaagagcgtaatgtgcgatggtgagctgtttaaaactaaaaaataattgggtaatagcgtgccgtttagaaatacgatgattctgaaaatgcgggacgagcgtcactgaatgataggttagaagcaagtggaaggtacttatattcactggaattagcaagtaaattctctctttaaaattatagctatatgcccctatattgtataaactacgatacagccaatatatatacggaggaaacccctggcgctatattgaggtgtaaaaaacggggacaacgttcgtcccttttgaaaaaaaagtggggttagcagatgacacaaattgtattaatgaattaaataccgggacat

SEQ ID NO: 8543 - DNA, 821 bp, Homo sapiens
aatgcgaaataatatcgaatatatatactaattagaggcggatggacatgaagaggcgtagatatcctattttagttctctttagataatattattaactatatgatagatttctctgtaaaatgttaagtgtttatattatacacttctgttttactatccaaagataggacttctttctaatgctcttactcatataaattacatcttgatagaaacctctaaatcatatgatatcattcgtctaataactattacagaatctaaaccactgaacaaacccgatcgtactaattttttaggattattaaatcgcgggggcggaattcatttatgtttagattatgttttttacgcctctagtatgttttcaatttataagtgccctacaacttatatgggcccatgaatagtagggttaagagcatgtccacaagtcacacatcagtcaggggtttgacaatttaatgttaaaccaaggaataaattagatcaatgagcaaacaggtgacatcacagtcccagaagtctgaagagccagttaaacatgggagttctttggaaaaaacagtttcccacatcagtgccatttcagacataaacattgttttccaatcatctttattatttacaaggaatttgtcatctgcaaacatttagaaaatgcttggtgttgaagactattacagatgctgttataaggtctttgagtcacaaattatgggcctttattttggggttgaaattcatacaaatgttaacatgattgaattgagcactagtatgaataaaaccgtctatatccaaaaaaaaaaaaaaaa

SEQ ID NO: 8544 - DNA, 313 bp, Homo sapiens
tttggtttcttcttcctgattggtctctgttttcgttgtcgctctatcatgctctagagctagtcgtacaatctttccgaatatattgctgttatctcctatacatcagatacaaccggttacgtctgttcattcctcaactgtttacaaaagtcttcacaaactccagaatcctaaagtttccccttttttctatgccaatagcaaatccgtcttatgcattcatccgcctggctacacatgtcatctagccccgcatatcccttgcgcccatccttctatcggttattacaaagccttttgagccctcctc

SEQ ID NO: 8545 - DNA, 775 bp, Homo sapiens
ggcgttaaacctagcgtcagttcaactttctcggggtcgtagtccgatcactcctgcaccttattatggctagcgttccgttttcctacgctccgcttcttctgcttcgcccccacctcctttttctctccatttcttcccggacacactcacattacttcggctatcactaaatcctgtattcccgctccgtctttctgattttgccctttctctcgctctttttattcaccctccttcctcttcccagcgccttgtctagctcctacctatcaatacgcgcccgggtttaccgatttcctcgcacgacataaccccgcctcggcccccatccttctgaggaccgacttcgcctttgccgcaaaccctttcgattctcctgcacatttcccccctttccagcgtctgacttctggctttccgcaccactgggcagtgtcccacgggaacttatcggcgtcgctcgcgctttgcttcacgtatcaataggagggccgacagcgttagggcttaggcgatgtctatgtgagcagagtcggaatgtaaacatgcctttcacgtgcaatcctgaagggccgcccccggctctggggtgtcaggatcgggagtgagttttgccctctgcctttggcccagatctccatggagtgactcatcagacctctgcatttctgggaatttggaatgttcttatatcattttttaattaaggaacaaaagtgttttgcttaggatatatacatctacatattttaaagaaaaaaaaaaaaaaaaa

SEQ ID NO: 8546 - DNA, 781 bp, Homo sapiens
tgtgaataatatatacgtttaaattctgaaactgcggctaatatccgtccgagttgttcaatgtattactgacgagtataaaagtcgatagttttagtctgttatattatatatttaagaaccattaatcgttaagtgcataattcagataaaccagaaacttgttcagtttattaattttaatcaaaacataacagaaataaagtgaattccgtttatatatgctttatttatattaaaacgatggggtagctgaaaggatttgtatttaagtgaaatttatatgagacgagtacagaaaacagataagatgaaaactaatctgcaacagtttttatatatataataaggcaaatgttgattgttataaaaagttcaggatattagcttgtttcatcaccagtaagtgacgtctgaaaacagcgttaaaacccaatgcatataatgcaccgggaaagcaataacaaaaattgactttgtataggaaaaaaatggggcaacgagcaagacataaatcagtgttagcctcgccagacaccctagcacattgatactggaattccagcctccagaactgtgagaaaatacattttttttgtttaagccacccagtctgtggtattctgttttggcagctcaagcagactaatacaatatctttccccaattaagcagttaattgtaaaacaaacaagcaagcaaacacagttgctaactaaatatttcactgacacaatagaaaataaagtcattgatacccctgtaaaaaaaaaaaaaaaaa

SEQ ID NO: 8547 - DNA, 1074 bp, Homo sapiens
  misc_feature (1)...(1074): n = A,T,C or G
aagggtattaaacgtacagaagagagcagtacatcgcgaacacgcgcacagattacatagtcgcgaatgtctacgacgttgttgctgctatgagcgaaccgtgatactaagcgtaacgaaggagagaagattgatatatgtagagtgcagatgtatcatgtatttctctatgtgaattttcttcaataaaacagtagagagccgacacacatgcaactcatattgtgtatattacgatattaacaacaaaatgaccaaactattgttagaaatataactgataactttgttaagccgttctcacaatacatactattactagcttcgcggattcgatacgagacggacagtatatcaatccagtgtatatgacgaaatgaaactatatgaggcgcccggagtgggtaattacatatactgtctaattcgttatactagtcatatattactgagaccgcatgagctgtatatttcgacgactgatatntgcatagcgtagtggcagtatctctgttataattaacatatactctgacgaccacattgagaagtatcacattacgcacgattaatagtttacatcatcgagacttacatcagatgtgatgatggagaggaagcagacaaccaaagtgaacatcattaactcgttgctcgtctatatactccaatcgtgtcacgcgtgcgaggtgtctcagtgtatcagatacctacatcagtcgttgtctggttctcgaagccacatgtatagtgtatctactgaatgatatcatattacgttgagcatcctaaacgatgtacaaatagctctcccatacaagagtgtatcacccgtgtgtattacttgtcgacaaccatggctcgaatttccagtatatctagtcactatcttagttatgcttagtcgtcgatctgcccatgcttctaacaccattcattgatgataatgtacagtacctatgcaggtctaggcgacatcttcttagcatgatcttctgtacaacgtctattactatgaagataaatgctcagataaatatttgtgttttttgtttgaaaaaaaaaaaaaaaaaa

SEQ ID NO: 8548 - DNA, 791 bp, Homo sapiens
atgggataaaaagaggatttacatataatggtgttggcgacacaaaaggcgtgtgcgttttaaattattcaaacgtataataatcgaatcatctccctcgttagattatacttcaatcatgctcacatatatactattgttaatatagtctttgttagttactagtttatgtttctgtatccgtcactcgaaaaatctaaacggtaatctcatacattatggtaaacataagatttttattttaactcaaactcgcgtttactagatcgatttctataacgtggaggatctatatagggcggcggcggtacaaatagtctttgcgatattgattcttgaactaattaataacattttaataaaggaaattatatctctttaataaataagataaatgtgcatatagatccgagcaattggggcatgattcgcaaagtatggaaaaaatagtccgccacaattaatgcagaatactatcgtaaagtagcgcccttccccatgcaattatggccatgggctagaccaacatcattgatccggtggccctaaccagaagcgattcagccctcaggaggacagctttgaccccctatgatttcatctccagcccaaccaatcagcaacaagcacctgttacctggccacacccacctgttccctcaaactgcctttgaaaaacccctaacccatgagcttcaacctagatcatctgagtacaaattccagctcccctgtggtatggctggctcagtgtctattaaactctttctctactctaaaaaaaaaaaaaa

SEQ ID NO: 8549 - DNA, 365 bp, Homo sapiens
atgcgatcatattaagtgtgaatgatacctagataggtgtggaatacaacgtcgagttgagatcaaatttgaatgtgattatatcatattatgtctaatatgagtatcttatttattatataaatgtaatcataatttttgtctatcagttaatacgaatgagcaatctacaaggaggacaaaatgtaaaaacaggcggcataaaaagatgcagattttttacgcggtcattaaaaaagccgtaacactaagagcagggtagtgttataggtcattaagatatggcgggaaggcctaaaaatgttattgcgaatgccaatggcacacaaatcggtggaaatacagagattttttggccatagagg

SEQ ID NO: 8550 - DNA, 170 bp, Homo sapiens
ttgtatttagttttagtaaatatcgatattggcggggatttgagggcggatatacattttcatagcacattaagccaattatattgttttttctgttaatcgctatatttgtacatatatgtgtaataactaccagttatccgcgtggtatcacttccagattagtattt

SEQ ID NO: 8551 - DNA, 417 bp, Homo sapiens
tcgtcgcggcacgccgccgagtatttgacgatgccacacacgggcgaagggcacccactgtgggacgcaaggcgcccaacatcgtatatggtgtcgatgtatacgcgtggtttcagcggctccgagtactcgggttaggaacgccagcggcagcgggctgcccgagttagggaaggtgggggtgagggagataaagaatttggcccctattggatacctgttatatagtggaagtatgagaatagtatgcccacgggcagtgaggactcgtgtgcccgtgggatgaaaggttggctccactggcgaaaaacgggtgtcaataaaaatgtccagatagagccgccgttttaatcaaaaagggggtggaacctccccccaggggttgtgtggggcgaaagataatattttccaaatacc

SEQ ID NO: 8552 - DNA, 455 bp, Homo sapiens
ttttcctgagaatatatgaattgtttcggcaacacagaaaaattattctcattgtggcctcaaggttgcaggctcacttctttaataggaggacacagagaaatggtgcagatttaatcttcaaacacaatgggggttgtaatttttctcttccctgtgtgatttctacatgaagtgacagggttcaaacaagcacatgaaacagaagtgatgaaggtcaatggatgttgaaggaaaccaactcttgagatgtataaatctggattatctctctggcatatacaaacaagtcagcatgtgttttgtactgaagcataaatagcaaaatccctgccaaatatcaatgtctgtttgaaaactcttgtttaaaacctccttcattgccattgacattgtcttgttgactatttataggacatttgtaataaagtaatttaatacaaaaaaaaaaaaaa

SEQ ID NO: 8553 - DNA, 280 bp, Homo sapiens
agggagtctcactctgtcgcccaggctggagtgcagtggcgccatctccgctcactgcaagctccgcctcccgggttcacgccattctcctgcctcagcctcccgagtagctgggactacaggcgaccgaaaaaggatccttttctagagcttccagaaagaaatgcagccctgatgacaccttgattttagcccagtaagacttgggtcagtcctctgccctatcgaactgtaagataataaacttgtgttgttttaagccataaaaaaaaaaaaaaaa

SEQ ID NO: 8554 - DNA, 373 bp, Homo sapiens
cggcccagatggcgtagccatttcgacatccggccgcggcccgtgcagacccgccatcgcctgcagattcgccacgcaggtggggtgataagggccacgcctgtctcagtatctccacctccctttctttctcgcctccccgcctttgggaagtgtgtcttttgcacgtccctacacatgctaataagtgctgcctcccacccgtgcccgctgtcgttccctgggttcttcaaaagccggtaatatcccctgtaacggtctcggcatgcgcccatttagcacttccatccaatgcttccagatgttctttcgcaccccattggcatactccaccgctggtacatccaggtcattgttggggccgaagagacct

SEQ ID NO: 8555 - DNA, 445 bp, Homo sapiens
  misc_feature (1)...(445): n = A,T,C or G
ctgccccataagtggccaattgggtagtccaaataccctcgttgttcccccctccccccttgtttttgccccttgtttttcttttccctttgctacttgccccccccttgctgtgcccccccctccccttttccttttcttttccctcttgttatccgcgtgtccctctttcccatgttccttcgtcctctcctgcctttgccccccgttgtccctcaggttgtgtcctctccgatttttccccgcccccccttgtttttgttcttttcccctatttcggcctcagtccccccccgttgggctaagcccctaaataaaggccggataaaaacttgttcccccctccctttccgtcccttcncccagtgtgtaatatccagttccatcggctccggttataggctcattcgccattctgtccgtattcccccttcatcttccccat

SEQ ID NO: 8556 - DNA, 852 bp, Homo sapiens
aggggaggttggtttaagttcgtcagcttaaactaaatggttaaattttcctgggaatgccgtggggaaaaaccacagtggcaataacccgtttatggtggccgacaaggtttcagcgcacaccgcaaagtatgggcgaaaccccatgaataaaatgccggtggccagtaggcgggttggattccatagctgactggaaagacctcattaggcaggaggaccatcgggggacctagtggtaaacaaattacgcatgcaacaaggtcccagtccgcaccatacgtaggggaattcaggataagctttcataaggagggcgagctccgtaaggatgaccaggatacatcatgtccatagtatggagaacagtctcaagtccagtcgtactcagatcctgtgcggtcagagtataggttcatcaggatgctgtgagtcactcgcagtagtgctcaatacctgctgtctggtagtcatgaaaggcggaggtcactatccatattttcaccagaaggcaagccgcgacaggccaaaagcagagccaggcaccccgcgttttgtggcattgggcaggaaagcaagtcaaggcctatgcaatatggcccaggtgaaggtgggtgtccaccctacagtaagcacagtcaagcagcatccacttttccctactgagtgtctctagtgtcccacattcgaaatcatggcccatgatatcagatgtccatccactaatcttctcaccccctatggtgattctaccagcagtgctctatgagtaataattgtgagtgataggagggcgccacacctggcccccatgtccatcagtcctgtgcaggggaaaaaaaaaaaaaaaaa

SEQ ID NO: 8557 - DNA, 236 bp, Homo sapiens
acctgcaagaaactcagatgtgatggcttggagctgcagcagccatattgtgcacaaagtcacacactaagaataaagaaagaagctatgcactaaggataacaaacagaaaagtagacagagcctgagtcactgtgaaattggataaatgctatataagccttcgtctgcctattctctgacttctttaaatgagaaaaaaaataaaatcctaatttgttcaaaaaaaaaaaaaa

SEQ ID NO: 8558 - DNA, 409 bp, Homo sapiens
  misc_feature (1)...(409): n = A,T,C or G
agtttcactctttttgcncaggctggagtgcaatggcatgatctcggctcaccacaacctctgcctcccaggttcaagcgattctcctgcctcagcctccctagtagctgggattacaggaatgtgccaccacacctggctcattttgtatttttagtagagatgggatttctccatgttggtcaggctggtttcgaactcccgacctcaggtcatccacccacctcagcctcccaaagtgcttggattacaggtgtgagccactgcacctggcttatgacacttaaatcttatttatagtattattaggattaattgtgaaagcgatttctaaagtgctacaaataaataagctgtttcatcattatgttataaaaaggaaagtatgttacaaaaaaaaaaaaaaaaa

SEQ ID NO: 8559 - DNA, 251 bp, Homo sapiens
tgtacactactctcgtggcaatgaatggaacatttctctgacacatccgcaccaaaaacgtgcgtagaccacacgcgaagtaccactgtgccagccaacagaggagtaacagaatgactatgcctccaagaactcagtccaaagacaggacagtagtgcatagatatgtccaagttaaaaagattcctcacccagggacgataaatgtttttgcagaatactgaaaactcatgagataccatggagtattc

SEQ ID NO: 8560 - DNA, 318 bp, Homo sapiens
atgtcttgcagcagtccaatgtgctcatgcatgtgaaatccttggaaaagcgcaacagtgaggcaagagctgctgtcagtgattcccattctggtctttgcatcccatcttggagccagtatttgcagtgccgggtatggacacctaagacccacctgggcacctttcattgacctacacagggtgacttaatgtgcttcttacccagctgagaatttgagttaattattacatatttaaggggtttttccagttagaaacatgcaatgataagattcttccaggagcattaaaatcaaaacaaaaaaaaaaaaaaaa

SEQ ID NO: 8561 - DNA, 361 bp, Homo sapiens
atggagtgttgttttgtccctcaggctgaagtgcagtggtgtaatcatggttcatagctacctcgggctcctgtgctcaagcgatcttcccgcctcagcctcgtgagtaggtagaactgcagctgtgtgccaccaggcctgcctacttttgttttataatatgttgctgttgttgctgtagaggcaggatttctctatgttgcacagggtggtctcaaattcctggcctcaattgatcctcacacctttgtatcccagacgtgctgggattatgggtgtgagctacctaccccagactcacaagtaccctttaaagaattaaaatgggtaattatgttcttttcaaaaaaaaaaaaaaaaa

SEQ ID NO: 8562 - DNA, 394 bp, Homo sapiens
agtgcacacatggttctgtcttcacatatgcacgcctgaaagtgagatgatttctatactcctcagttgggaagggggattaggcatcagagaagatggagaagacaaaagggcttgtggataactgcaagtcaacatttctttggtaaggcagttaccacacatgagctgtggctgccgagcaaagactatggttcaatgaagagaacctgacaggagtagccgcccctctgtttcaggcagtaattgccatgtgagactgtgatggttgtccagatcttctgattattcaagtaaagctggaaatttagatttgtatttgatccctcacatctttaaatgcaggcgacctaattagaattaaaagaaatccttctgtccaaaaaaaaaaaaa

SEQ ID NO: 8563 - DNA, 836 bp, Homo sapiens
atttaaaaaagatgcaatgcacattacacagatacctagaagcaacgaggactccagggcaaaagttggaagataaataaagaagcaggccataagttcatgccaggtaagccccctaaaagggccaattggcacctccaaccacgtgattttttgtattagaaaactttcagtagggtgccccaattcccaaaccctttaaagtatggcctttcatgcgtcttgggtgtagcccccaagggacaattttggatccattttcaattcctagtactgtggaacaccccatttacacctcattcttaaaagactcgaagtaaactcatgctcttggcctgattcaaataattcccttaggccattctggaccccaagccgtctcctccacatcttggcctgctgaaaccggacttaccgtttcttcagtataatactgcagccactaaccagtaggaattaagcatggtcctaccttcaaggaggttagactcttgtggaagaaaaggataagtttagttaactatcgtgtaactataaaagacatggtgatgatatgtgataggtgtttccaaaaaatcacatcactgtagtaacaatacagtgggaaatgagttgtcggactttgcaaggaatgtttcaaaaataaaagcatttaaactgatccttgccagttaaatagggtccaaccaatcacaacagacagtaataccagctgattgttacctttccatctcttgctgtacctcgttaacaatagaatctcaaaaaatgcgtgctgaataaaccatacatatgcataataaactccaaaagaaagtaaaaaaaaaaaaaaaaaa

SEQ ID NO: 8564 - DNA, 662 bp, Homo sapiens
agacgggctggatgaatttgtgactggaataactcataagcaggaagacatgctgggaactcttttaagagatgaagcctggatgaagggcctagatcgcaccaaagtaagtgaagttgagagatactcacagaaggataactggctccctgaggatgaaaaaaaacatcaaatccaaagtatggagaataaactcaagtccagtcctacacagttccattgttaacaaagtctaaattaatcaggatggactgagtcactgggggttgtccacaatacctgctgtcaactagtcatgaaagacaaggtcattatccaaattttcaattggaggcaaggcaaagaaggccaaaagcaaatacaggtataccttgttttgttgcattttgctttattgcatgtcatagcctctgcattttttacaaattgaaggtttgtggcaaccctgcattgagcaagtctatcagcaccatttttctcactgtgtgtctctgtgtcacattttggaattctcacaatatttcaaactctttcattattattctctcctttatggtgatctatgctcagtgatctttgagttattattgtaattgtttggggggcaccacaaatgacacccagtaaaacagtgaacttaactggtaaaaaaaaaaaaaaaa

SEQ ID NO: 8565 - DNA, 821 bp, Homo sapiens
ggggtaagggcgaagcactgtatatgtccaatgttgacgaacacaggcataagtgtccgcgaattattatcgttaattagcatgtcctcaccagcacctcgcattggcacataagtactgtctactcggcctagcatgtgaatagtggccctttgggatctccatttttattatttctgttgttttgaccacccgccaactcacacttctccgttgctgctattagtttattggcccgatattgttgcatcccttccccaatttgttccggatccccttggggtccacggccggggcgtatatccagtggtttttttccccactagtaggctgaagtggctgtcccgaaagatgggcgcggtctgcatccttagatgccagccggactgcaaggatcaaggtgtccctatttgaccagccgaaggttgtaggtcagccacctgtttttcataggaagtcagtttcatgtgaaccagaaaaaattgtggatcccttacgtcagagtgctttattcctgagtcgaacacaatgtcccgttagttagctttttcgattttgatgccacgacacccgagacctccggtgccgttcccaattgcttgcatctcccccctacttttagacccttgctttttacatacatacagtacctatctctacaatataagacttgaacaaataaacaaacaaaaatatgtatagccatgggataaatgtcatgcaagtgcctggaatatcaatctttgtcttggtagcaatatcaaatattttatttaaataaacatggatgcataaagtaaaaaaagcaaaaaaaaaaaaaa

SEQ ID NO: 8566 - DNA, 782 bp, Homo sapiens
ggcgtttcatgcggaatcaaatggggcaaaaaaagaaggggcgcaataaacggggtaacatcgcggacaataacgcgggcgcggtgcgttttctactgtggagcgagtacaagggggccgatttactaataagcggagttgtatattattgagcggtagaaatgcggaagaaatcgtgtcccgtccgaagaagcgacggagggcagacaaaaaaaagagtcgtctctcccacgggcttcaaaaaccgataacgccgccgggcgcgggccggggttagtccctttgcccacctgtctaaaacacctcgaaattttctgtcgcgcccccttaagaaaaccgccgggcggaaactccgcgaattttttggccaaaagaggcccaatcacaggttaattcgtgccgcacctagtgatttttccaacgccgttttgaccttaaatgcgaggacttttttaataacccccccgcccagaaaaaaagaattcttttgccaaaggaacaaaatgattccaaaaagtctaagccaaccctaaaacacatggaggtgtcaaagcccaaaagtcccctttggatgtccagagttgagcaaggaagacaccaggggtttcgtcatggccaacaatgactccgatgcacaagaagatagaggccctaatcttatttttttgagccccatggaagccccctggtttctagggagcccttgaggagaaagaagactcctgtaaatgcctgacattgaaattcctgcaagtctaggagcatgtgactcaaaagggaaa

SEQ ID NO: 8567 - DNA, 837 bp, Homo sapiens
atcgtccacccacgcgctaagaaatactgcggacaaaattttataccctggaatcaaaacggccgattatatcggggcggtcaaatatgtgctattagggtcctcctcgcgataggagctcacctcctgacacccccggtaatttgggcgtcgcgccacactctaacgaatatggccccttctcgcgcgcccttatctggcgagggattgttcagcctttttttagcaaagaggctaacattgcgccccgcctcctttcgtctggaataaaaaattccccaactccctgagagagtatttacacctactttttcttgaaggttagagtcccgagtcccggagaggaggccccttttgtggttttctcgcttcttccacgggtcatctccttttccaacctaaggggcccctcgcctcaataaacccaaggtgttttctgcataggtcggcattccccacatcccacgggcataaaaaaaggtaggataagggagtctccatcctcttcccccaaggcattttcccaggaggaggaaaataaaaccattttcccttcaacttcgccacttgctgtgaaaccgaaggcttgttatataagcgtttggggacataatgaatgtgacttacatatgtcatctgggagacatggtgtttatatttcttgagttgaattggggcagaaaaaaaatgggcatctaaaatgctcaataattgagagaaactttaaaagttattcctcaccctagtttgtctaatatctatctttatcatcttatttgtcagttccttgggaaattaagaaatttagaaatttctactgaaataaacccggatgct

SEQ ID NO: 8568 - DNA, 871 bp, Homo sapiens
cacggtgattatggcgtagtaatatgggggaaaaaaataaaagacggtggtaaaaaagtgggcgaaacgagtaggagataattaaccgcggaggggggagagggacaaaaggaagtcgcctgacggtatttatggaggagggttacaaaatcgcccacgaggggccttataaagagagaagccgtgttggcaaaccctggcaccccagggcgggaatggtaaaaaataaaaaagctgggtcccttctttagaaaaaataaaaaaaggggggggtcaaggggggccccaaaaaaaaatgattttgccccgaaaaccagagggggggggagggccaatcatttggagcagacaaatataaccccaagggcttccaaaactaacccctccctttttttattaaaagctcttccagggatttatgtgagtaagagccccagcaaaagcagaaagaaacaaagtcagctagaacaaatatgcgaggggtcgtgaaattaaatggtcattgaaccaatagctctccaaaaataggcaagacctaaatttaaacagaagttgaaatagaatcaaaaggtgccaagcataatattcaaaatatccaagacacaacagaaagccattaatgataggaagacccataaaaaacacaaaagtgagaaaagaccatcagctgacagcagcactgagatgaatcatgacttgggattatcagataaagaacattaagtagccatcattaaaatgcttctacacttacatattttctaggaagaaataaaatagaaaatcttggcaaagaaacagaaacgtttttttaaaaaaaactataatttatagtgaaattatagaaatgaataaaacaaggatgcgtccg

SEQ ID NO: 8569 - DNA, 981 bp, Homo sapiens
  misc_feature (1)...(981): n = A,T,C or G
ggggagcacgaaagaaactacggtgggggggggaggggaaaaccggggagaaaaggaggggataacacccaaaacacaaataaattgtgtggtgtgggcacacacagtttgagtagatgtgtgacactggtggacacactcgtgtttttactaacactagactgtacttgtcctgtcagttgacacttattagggtgttgattgtggtgttattgttttttgtgagacttggcggtggtgagcgtgcaatgtcgacatgtttgggtggatgaaacagcgatgttgtggtcggcgttgtattgagcacaaanagattcttgaacactcggttgatgtgccatagttaatgtgtgtagttgtggtgattgtgtgcaatgttgtgataatatagctattagatctcgattacgcagcagacttttgtgtgtgtggtgttgtgtcctggcnattacntactatacacctctcctctcagctacgngggtgngcaaatacatgataagcatatatataatagcattatgtgtgctattatatgggtggactaaatantgcacgataatgactactaatatagatgcgttttagtacgtatctctnctgtgtgctacctcatccatactctcgaatctctctctctgtcatactatcaaccngtgttgtgctccncngctttcgatctcatcgttcggtagcaacgtgtctcttgtgtcgacacacacttctggtgattcacatcactaatctatatgttgacaatataccttgtgtgtcaccnttatctatctnaacatctacgcaangcacacgactgcaaccggatacatcggcttttctctttggaggtcactctgatngcacactctgatgtgttgtagtaactatactaaantaatgntgtgtggtccaacataccgtgccacgccgcacantctgcggtgtnatgtcggttgtcatactgcgtgtcttcgcctctaacac

SEQ ID NO: 8570 - DNA, 854 bp, Homo sapiens
  misc_feature (1)...(854): n = A,T,C or G
catttatatgacgagcaacatatattattatatatctatataacatcagcaatagaagtctacctctaattatctcttcgccatctgcataaatactcaagaatattaaaaatgctcatggaaacccaccaagggtaagctagaggttctctgcccaagagccatcagatgttgtatttattacaacaatcattttccacctcttatccatagcttgttatctgacacagctcatggataatttcctgtgggacaacaagtccgtggattcgataatatccctgtcttaaggttattagggagattcttaaaccatatntaataaaatcttaccagtttgtaggttctggcccaggtttgccaggtattaaagacaattaaaatacagccaagttttattttcttaagaatctccaagcacaatgtgataattgggtaaaaagaaaatgacatccaatctgattacaataccatgtgagttatggcaggaatggagtcatttccaaaactccagaaacacagattaaggagccagtccatcctccagtccaagtaggaaacagatcttcagaggcaaagacgatggggctagttttcataataggattcacttgcagaaaaatgggaggaaggcagcttggagagaaataggagtaggagtgaaggcaaaggtggttctggagctggtgaaccctgaggaaaaccatccctctgtaagttgcattcttccaggatcatctgcttctgtcttaggatatttgatttagattatctggcccatgttgttttttctcctgtttgtggacgttcatgatgaagaatagaaattaaaattttcaaaaaaaaaaaaaaaa

SEQ ID NO: 8571 - DNA, 843 bp, Homo sapiens
tcttcaatacccaaaaagtgccgaaggactatcaaagacctttcaaagccatcggccattgcaggtaattgcaaaggttaaaaactggaaaaaggggaacctcataagttggcaaaaattttaaaatcatgtttttgagggtcatattttttattgtccagaaaacaaataaatatttctccattggaatgtaagccgtgagaaaagtggattttatacagcttccagcaatgcctggcttagtagtgggccaagaagtaacatcaaagcattcccaaagacaagtttgcatacacacacacacaaaagttcatggtcactgtttggtggtatgatgcaggtctgatccattacagctatctgaatctcatcaaaaccataacatctgagaagtatgctcagcaatctatgagatgcatcaaaaactgcagcccctgtagccggcatttgtcaacagaaagagctcaattcttcacaacaatggccatcacacaaccaacacttcagaagttgagtgaattgaattcaaaagctgttgaatgaattcattcaaaagttgaatgaatccattcaaaagttgaatgaattgggctatgaagttttgtctaatacaccatattcaccttacctctcaccaaccaccacttcgtcaaacatctcaacaactttttgcagggaaaatgtttccacaaccagcaggatgcagaaaatgctttccaagaattcttcaaatcccaaagcatgaatttctatgctacaggaataaacaaacttatttctcattggcaaaaatgtgttgattgtaatggttcctattatgattaataaagagtgatcgcaaag

SEQ ID NO: 8572 - DNA, 209 bp, Homo sapiens
atcaacgtgaaaacagaagtttcaactttgttctggtattgaaaaatattaaggacatttgaaaagaatgtttatgaagcagtgtgaagtgaaaaagccagatctattattgtgtatctagtatgattccaactttgtaaaacaaacaaacaaaaagcagagaaaaatgtttaaataaaaataaaacaaaataaaatgttatcggcaag

SEQ ID NO: 8573 - DNA, 496 bp, Homo sapiens
  misc_feature (1)...(496): n = A,T,C or G
atactggagaaaccactggagtcaatatgatgcactgttctgaacatgaatgagtaaactctggacaaaatggccaagaggcacaagatccactcaatatgctcttgcttcctctgcctggaatgctcctgtttctggcagccacagggtccagtcccccatgtctctgctgtaacgccaccacatcagagggatcttctgaccagcctccataagacagtacccatcacttccatcactccccattctccttaccatgcaggaattaatcctaggaaacttagtatttatcaccccttgtttggtggggattttgtttgtttatttatctatttgtttattatcacattcccagtccccaaataagcttactagaggaagtgattttgctttgttcatccctaggatttagaactgtctaatacacgtagcagacattcagcaaatgttcagtaagttatgacagaaaggnccaatagngtngtatcagcagtcc

SEQ ID NO: 8574 - DNA, 1289 bp, Homo sapiens
  misc_feature (1)...(1289): n = A,T,C or G
tatgctgacgctgtatagnacacccatacatagtatactagagtagactgaaatcatgtagaantaatcacttgccacagacatccaaccgtgttgtcaatgttctttctcttgattatgcaagacgacacacacacaggagttatcatcatagtcacgccttgtcgagagatgcaagagcggctgacggttcgactggcgcgtaatagagtactatccgcaatgtacaagaatcagtgaagtggacaatctctaacnccactgccgccactacgacatcctgatacagtcagttgacgtatgttcagaatgctcgctacctgctgaatagagagagatatacctaagcatgttatgatatcccgcattaagataaggcgagcagagatgtcctcatatgcctagaactaccatatcattaatggacgcgcgagaggaacggatgactcagcaattaccggctagcgacatcctattttatcatccagaatgagtactgcggcattgcatatacaacattagccaccttctccactgttgacactgatatcactgattatactatccaccgcagcgcctataatatcgcaccagatcagtcactgtgtctgagcggacccaccgtttcatataccttccaccacttcgaacacgccacactaactcagatggaagaacataacagaactacataccgatgcgaaggccggcgttcgcaatgaattagcagcacacttgtttatcgcgttactcgtagtatatatacacggatgatccggcgtgccccgcggcacctcagacgtctaaagagccctaaactccatacaacatactcatacgctttgatcagatatcaccgcacccgatacgcagcccagcactagnttcgaggtcccctgccgagagttagccacgacgtagtccacgaatatttttggaatcagcatgtcagtcagattagagactgtgatgatgcattaacaaccagcgatctgtatacactagcactctacccgatgtcgcgcgcgcgacggctcacattgcgccgcagagaacactctgagcgagttctatagtattgatgcggacccgccgtatcataatcgtgtgcgagatctcagttctaataatattgccacccatagttccacaccttgcgccgccgttaccggcacaaccgtctcacacgcatgttacntacgcgatccgctgcgctagactcaacgtgctagcggcacaagccgaatacatgacgctgctgcagtctatgaatcgccgtgtcagcntcg

SEQ ID NO: 8575 - DNA, 769 bp, Homo sapiens
  misc_feature (1)...(769): n = A,T,C or G
cacacgggnnaagagtaggagagnnnnnagagggaaaggaaaggagggagaaacggttctgagacatctctaatacttccgggacagagacgcactgagataaggaagataaaagcagactcgaggtgtatgcctgcagctgcagaaagatgtatagggaacaaacatacaactctccctcccagataagtgcaacaacaacaacaacaacaacaacaacaacaaaacacagaaaaaagcctcagaagaaattcaagcttctaataaactctcccatcctgaatcctgtttttctcttagtctggtagagattgtgcctctaacttaactcagccagatgcccctttggggtttgttttctctaaaaaaaaccccgatgcggccgtttccctttaatgaagggtaattcatgatccttgatcactgacttgcttggcttgggaggttcggctggggcgaacgtgataaacccaactaaaaaggcgggaaccaggtaattccacaaatctgggggaaaacgcaagaaaaaacacgttggagaaaaagccccccaaaagggccggaacctcgaaaaagggcgcggttataagagatttctctcaaaggcgcccgcccccccggacagagaataagcaacaatgaccgcctatattaataggtgggcgaaaccccccccagaacgtcttaagatccctcgcggttgcccccgagaaaaaggtatttggcgtggtattacatgtacaaaaccaacaggagaaaaaaaaaaaaa

SEQ ID NO: 8576 - DNA, 1319 bp, Homo sapiens
  misc_feature (1)...(1319): n = A,T,C or G
tagtagccagcgggagtgcaatgnagntgtgaggganaggagtaatcacgcgcttcgcctccgcgacancgtgtctnnancacacccctacntacgccacgcacccactcttccccacagacaacgcacaccccacagcatgaacatttataagagacgacgtgagcccgccanccagaagcccaccgtcaagaaaacgcatagagcgacgactgactcacctctcgatacttcgctaactaatcccctcacagcntctcatcgttctcacagaaaagtgtttaaggtgggacaggcaggncggtgggaatcggcgtcgagtggggtgggcngggcggcagnnncccacccacaaacagcgacgatcgaaacagacagaggacacagaatgagnaaagttaagtggtccacaccgtagtccacttaattcaanatatgacggaanannatacacgggacagaggaggatggaagaagaaggcgggggaaggagtnncaaggtaggagggaggtaaagagggtnntggcaaagcaataaaagagagggctagggtcatgcgcgatcacgagtgggagtagaggaaaaggccaaggagtgtctacgagagcgcgcgcgggcgtcgcaatagacaggacgagggcagggagagatgggaggtagggggagaataattttcagtagtaatggaatatcctctcggagcgcgccccccacacagccctccccaggccaccacagaggacaagcgaaggctctgtccgaccagagacgangtgatgtgaggtaggtantccgtggcggtgtggggtcagagggggagagggagngtcagcgctagtaagatatgggcgaaatctgaccgtctgagtaggttacgagtaaatacagagtaatgtttantgaataacctaggtgtgatatgcgagagtatacggnnttttgagacngcaagagaatagggagatgataagagcnngagagagaaggcagagaggacnaagagcagaaacgaaagttacaacagtcagggctggaacggatcaacaaacacatcctaccgagacgaaaaggtcggtatgtacggtggggagccgccactgagagaggctncgcgagcgaccgatgcagtatccctacccgcagcgcgcacgtgagagcnaggaatgcctgcaggagaagtccatgcaggaggggagcncngagcgagggaggaagtganactgagacatgcataggcncaagggaggaggagtgtatgcnccgaggcgcgagggcagtcggagtagggggacagaggaagtcccaacaagaagacaat

SEQ ID NO: 8577 - DNA, 2078 bp, Homo sapiens
  misc_feature (1)...(2078): n = A,T,C or G
catgatcgcgcgtgcgccacgtaatatggacactcgtagtgagtgtaatagtgtcgctacgcggtctgatgattanactgtacgcgtacgcgtngcgctgtatatcgtgaatacgtatacagtcgcgcgcggtacgcggctatacgcggcgtagatgccgagcgtcacctaagtatcgcganancatacgtgcgnccgctactctacactgacgacacgtntatcacaaactgtctcatctcgcatatcggcacagcgtgtcgngcgacgaacgtnntcgtacatacactgtaacaccgtcgcgcgcgtctctacatccgtcgagcgcactgcnctgatctcatcgcgtgcgcgtcgcgacacgactantctgtatcgctgaggagtagtagaggttgnctgcaatacgtgacagcgccgtcgtcgcgtcggtctcgctgatgactnctacgcacgtagtntgacgcgcgctcgtatggcgctgtcgctcgcatcgagaatacgatcagacctcagantccgngagactacatacataatacgactatagcgcgancttacgctgcntnaccgacgataacagttcanctgcgcgcagcagtngctgctcgatagatcgcgctcgcgagtctgtagtattanacctatactactatctgctgngatcgcgtgatcgtagacgnanctgcngggtntatgtgatgcgcgtatcgattagagtgtcagagtnatnagtctcgactgntatgatgaacgcatatctgtgtgtaatacctctgctncagacantacgcatgcgctcagctcgtcgacacacaagatgattcacatacatacgnnggccgggctgtcgcgncganatatgatcgttccanagangctaagcgcgntgagntcanaacgccagctgtngtagacatcaacacacgctcgngtatagtcacacagtactcgtgcgtnaagatnatgtagangcgcggcgntgnatcagtatgacgtcgttactntnantctaactagantgtnccntcgcgctngcgtgctacgtcngcagtaccacatctgntgagtacgtcgactcgatgcttcgcacagtacatnanaagagncaactcgactgtacgtatgactgaatagctatatccagcgtgatgatatactatctgcagcatgcgtgcgcantcngcgtcacacantagtctactatcaatcgtancttagtgtcactgaagacgtancnctagctgcatattatctncgatcgacagtcgtactagcatagacgaantngctagtggtgcacnagatcactcgcgctcgantgcgccgngtnatctaggccgnacatagtatnactacttgtcgtgtagtcgacgtaganctcgctgcatgcagtaccatgccagccgagtgcgatcgcgctatgacgtcgcgcttccgtgcgcagcagagaccgagtacgngtgctagtgacgtgatcgtacgagaatngagctatgatgcatacntgactgcngatatgacnagcgtactacgtgatcatcatgtgatatcgactgtgctanancgcnnatgtntactgancanctagtattgatngcacgtatagatagtangtgagtgagctatatcaggtacatctgtcgcgcaatnancgctgctgcactgacantgtactacgaanctgtctagtctactcgatagcactcangcacnanatctcntctgcatgcgctcangncgcacctgagagngcgctctcgcntgatgacanatgtnctgtacngggtctgatncgatagnatctgtgcagtcagtnatagntgatccgncgagagatcagnctagtgctgtagttcttgngtcagnggatcgtcagacactgatcgatcgnctagtgtccgnctgactccaaagtcatcactcactatcgcctagctacngatcncancagtctacgaagagatggtntacgcngcgcgacgtatcgatcatatnacgatcgntcagattgtatatcncagtaacatcatccagtaatgatgacgtgacatgacgcgcatcgcacctggactacg

SEQ ID NO: 8578 - DNA, 783 bp, Homo sapiens
  misc_feature (1)...(783): n = A,T,C or G
ccaatgaggtaggtcatattttccttcccatttaataggtgccaaacttgaggcacagtgagggtagtacaataactagcaagtgtgagacaccggaattttaacatggttcatagctaccatgctgttttgcctctcatgatctggaagtgactccagtgctcagtgccaggggaagcccaggctcctatttgagcaggctcccaagacaccaagggtctatcaagttgccaaggaaaaactcattcaggctcaggacatcagtttctaaagtgcattcccataccctaggtatctggaaatccatcataaccttaagtattaatagtatatttatccccatttcacagccacaggaactaaggctgttgaaagttaaacaacttttctgagtttggacacatcatctacatttctcatctaattcccagacactgttctttccctgatgacatatatccaagtttaagcacaaccaagcaagggttgagaaagcttcagacatttacaaagctcccttcatacctagtactgtgcttagaccaggaacacagggaggtagagggcagcagagcagggactggcttcagagccagacaggtggctatgtgacttaatgtgtctgaaccctggtatcctagtctattaaatggtataacagcagcttctagtatgtaagttccttgtcaggagaaaaactgttttgctcatggctggagccttagcatgttgcatcatattgaacatgtaatagatgcacaataaatatcggtccgccntaag

SEQ ID NO: 8579 - DNA, 871 bp, Homo sapiens
  misc_feature (1)...(871): n = A,T,C or G
gnnnnttngnnnaaaatnnntttaaaaaaaatttttnaattnggggtntttnntnaaggggaaggaaaaaaanaancnttttttttaaggtgatttngggnnacncnttnnnnggtancnaangncnnaananaaanttanntttnggnanngnaagttanaatttnannggttttttnttccnggaagaaattttttttcaanngggggggtnaanataaaaananttngggaaanggggtttnanacaattnaattcntgggattttnaaagggggtttttaatttntttgccaaaggganaaattgtcaacaaggttttaaggantgatttttcccaggattttttntttttttgtgaanaagattantggnagtttngaataaaaaggcaatgtaaacaaagcccagaaattttaagtggaaaaagcagttccccaccagacntggnggtttgatcaggaatcctagggggagttgcntcctgtcattatgaaatcttggaggggtaacagctttccttnttcatacgggctgccntggaaagattccttgagtntgcacaagcctgtgtgcagccagagaatgaaagtgggaagtgttagcgcccaggagcctccccgctcacaagctgcaggtcttgttaaaaactcctgttctgtttgttcctggaacttgccaatggctttgaccctcaagaccttttacctgtcagtctaaccagaggcgatgccctcctgtgggcgagaagactcagtaccaggcaggtgacangaagtttcaactangagtgggcactgagttgaacactttggcatttccaatgtttggaaatgccaaagttttctttgtaaataaaaagatagncgtc

SEQ ID NO: 8580 - DNA, 1291 bp, Homo sapiens
  misc_feature (1)...(1291): n = A,T,C or G
ccactgacgcctacaagctngcggngctggangntnnncnaanttanaanatacactgacgacacaacncgnnancacacataananacagatnttccatanacaacagnacaacgaattcgatgacacattcttcatgactactctcntctctacaatcttgcctagcgaagcnacgctgtctatgatgcgcgtcagtgcagatgaaggcgcttgtcacacgcacatcgtgtgacaacggcgatagtagtcgatacacacggcagacatcaatgtgtatatcagccgagtagcacatcagacacgcacgtccagtgaggcaaacatttngtatgtatgtaagtctcatcaaagtaattaatatatctataatataactctgtgtcgcgncgcccgcgcgtacgcacggcagcagacacacgcacgaatcgccacacaagaacagataagaataataaggagactaatgttnaataagagatgtaatgagtagttactcgatgtataagtccgctgtcgacagataattactaatgaatgatataatatgtnnttaaaagtattngaaaataattatataagaggcgcaaaatagacatatagagttaagtgtcaacggatgaaactccagagccacataagtgaaagccaaataaataattnatatagagaattatcgtattaacgagcgtcacatgttgtagttatggntgtgtgtcaacatattatatcttgtaatgtagataaataagtacacataaaatatattattgcttctaacggcctacatcctgaccgcctccactgtcaaagtcctgctccccagagcacatcacacatcgagcgcagcgccaatgatgctaggcgtgagactcctagagagtagatcccacaaaacataagattattatattcacacttagctatttaaacgtgtagagacacacgaaaacgagcgatacaaatataatatattatatcatgaagagtggtgataagaggtccgagagattaggatgaggccaaacgaaaatcaggttcgagcacgcgaaccagcagaaccgcgtgagaggcaattatagagaacgcttacttcgaacaattatcaaaggacgtaccacgagataaggaagataaccgcccactccgtctacttatagatcaagtccaatatgagagtacacaaatataaggtcacaacagtcaaagatttacatatcataatacacacgcggacgattcttcccttaaaagaancatctgtggcgcacatggatactacaatatcaat

SEQ ID NO: 8581 - DNA, 842 bp, Homo sapiens
  misc_feature (1)...(842): n = A,T,C or G
tccctcctatcgtctttctatctgttcctgaacctcgttctcgctccatcttcatcacacgcctgtatgcgttgtatttcggcggcgtgatatctctctctctctttcactgtttccgctggacttctttattctcatccttccctcattgcggcgtccgttatttgtttctctgttgtcttctccccgtgtgtgtagtggtcgggtatctcgttgctgtcgtcatcgcccctgttctgtcccacttctttttttctgggcttggttattcacttgnagtgattcttttcttgtatccatctcatagtaattctcgttcggttcgtgaggttactttttcacatgcctttctcgctttcttcgttcctactcctatctccgcttggtctgttctgtcgcattttttcttccttatccttttcgttgtttttgcgctttttgtgcatctagctcttgccttagtcttttctttatatttttgcttttgtgttctataacactttctatctatcctctctttcctgtcttcatcataatctacatccagcatccttctgccatatgcttcttgaatgttctttctcgaatagccatctgctatttatccagcgttggcactatccgaattttttttttgccctatagtggcccacggcctgttagcttttcaccagaaagggatccacgttactcggcgccgatccttgttagtgtccagctatcatgtgtgtgccatattgattggctttgttagtgtcacctgtttatcatcatgccggtcctgaaacaaagtgaagattcacactttaaataatgcagagagtttcaaaaaaaaaaaaaaa

SEQ ID NO: 8582 - DNA, 369 bp, Homo sapiens
ctcgcgatcccattttattcaaatgttgaggaacttacacacaaagccatcatctaagcttttcacaaactgaggcatctgtcgcatgaaaggcaggatatattgcagaaatactgtgactgaaattgtgaagatattagcgcgtcaagacagatgagaacgtatccagctgcttgtcttgtgtgtcagtcttcctctgagccgactatcttaccgtactcactcagcatgagctcacctatctgggtctggaagaccatgtggatcgccatgtcccctcgattcattttcagctcgcagaagggtggagcctaatacaatccgctagctttgcgtggacatgaggttcttggaggctttggccactat

SEQ ID NO: 8583 - DNA, 361 bp, Homo sapiens
atgctggccaaaggctggagtaacctcatgtgcacggggagcttggggatagcctttgaacctaccctactagccagctgaacctgaaacaggaaacgtgtgtgatcacacatggtctaccatagccagatggctgagctgatcgctgagtgagtacagcaagatcttccggtcacaggaagactgacagacctgacactctactgactacgttcacatgttgcttgatacctaatattattacattcctgtaaacatatgactgaaatatttgctgcctttaatgcgatggatgcctcattttgtgaagacttattgatgattttgggtctaagctcctaacatatgaataaaattggac

SEQ ID NO: 8584 - DNA, 812 bp, Homo sapiens
ctgccgatctgcttttattcttagttttcatgaagaatggacaaccatgtagaaatatgattccacacaaaaaatgtatgatctaatggcaatagacggagtgggaaacccattaagtcctgcttgtttggcttctccttgacctctgtgtagcattcctttctcccaggtatggggcaggacccctctggaataaggatcttatgacctgctatcagacaaggtaggtcagagaatttctttatggccagctcctactgttgtgccagacctactgactccaatagggatagcaccatgtcctagaagcggaagaagagaggagacccggaaccagcagatgacacatagggtttactgaggacttacatatggggctagacagtggtggtgggctggactgaaaacctgctaccaccctccacctaacaacctccatataacccaaaacagaggacccttaatcccctatatggcctgcattccaaaggcatgggccaggggggcatatgttcttcatagacaaggagcgaatctataggtttgcccctcctggatttcttagctcaaaactccaaacacacattcttcttagattcgaggggtctttctaaggcgatgcctaaattattgcgtgcagatgcagctgtatacagctacacagaaaggggggggctacactgggattaagtacgtaagctaccaacccctatacctacagccctcatccacttacaccgcctaattagccataacgtctgagcaccccgacccagatggctgtatcggtacatttctctccccgctccggt

SEQ ID NO: 8585 - DNA, 769 bp, Homo sapiens
cggtgggaatataaatctagtccctcttactctatcctgcccagaagtggaaatatgatccttccattataaaataaagaatggtcctaagatttgagaactccaaaaggacttagtgttacggaataaaggtgaacaaccatttgggactgtttatctacttgctatctctcttttgagagagaataatgtctcatgagctccattctctgatgcctgcagtatgttatgaatcagcagagaatctttctgtctgtgcttggatcttgggatgtgaacttggaaaagctctaaggcagcccaggaaaaggcagacaagaaaccatcatgaatgggtgctgcatgagcatagattgtcaagacaacggtatggtaattcgcataggtccacaaagcgaacattgatttgaagcgttcctgtgaatggccagttaacaggatatccatacagacacgacatcggagagtgtattatggcgtatatcttttactatcagtgtggataagacttaccacaatgccatgttaagggaatccgcacttcccccggtacagatatttccataactaaatcggatttttttcccttagtatatactgcgccccatattatattcttatctgttcaagtcaaatttgtttctaagcgtaatctgagcgattcgtcccgaaatttcggccattgcttgtacgatgaaagttttctaccggtgagaaaaagctacaatgattaccgccgccaaatagtgtgtgagtgatttgaaccttt

SEQ ID NO: 8586 - DNA, 1116 bp, Homo sapiens
  misc_feature (1)...(1116): n = A,T,C or G
cacgcgcgtgccgttaatctacggtgcatgtattaatcgactgagcatgcgtgcgcggtggaggacatattgtaatgatatagtcgtcgcggtaaacgcgaaggtgggcaccgaaggcaataccggtgttactcgagagatagggtgatcgtgtatgtagggcggggggtgcacgttgatcttgtcgtctcgagcggcgggtgttagtctccgcgcggccgatatgggtgcgcttcgcgacatggcgcgcgcgattatggtctagagaggcatggggtggcgtccgcctatcaanagggactgaatagatgtatgttatgatgtctatgatatgtacggaggcttacgtggagaggaaatcatattctgggcgacagacgattaggatggcatgattaggagagataagcgggccgcggctgtatcactctataacgagagaacgtcaggtcaaccacggagtcgcaatcgggaggcatatcgagccgcctagactgtcgcgaacacgaggtacatattcgtagcgatatatgagaggaggagatgtatgggtctatgcaagtggtcagcggagggtgcgcgccctcatggatgtctgctgcagcatcagattacggtcgcgtggattatttccttctagtgaggacttgatgacggctgacatacatactcaaggaatcccacatgtttaatcgatgtttggtagaagaggcggaggcgcgctctggagcctcgagcaagagactagaaatgttggtntatcatgtgttgtattcacatcatatagaatatgcacagttgtattcatatgactggacgaagtatgcataagtcacgcgctctgtttatcgctcatagtctatgcatgaaagttgtaaggatagaattagacttatactcatcatagagaggcacggatatatagaagaaataaatagatgaatgcgagagatatagtagtcataagaggacttctaataataataatcacaataggagagcgaagaatgagagagtaagagagaagaagaatgaataagaagaaagacaaaacaagatagtgaaagaacaagtagataacaatataataaaacanatcgtgactgcgggccacag

SEQ ID NO: 8587 - DNA, 826 bp, Homo sapiens
  misc_feature (1)...(826): n = A,T,C or G
gttgtccacagctaaaagaaggactgtactgtggggggggtgggagtgaagggccgaggactagaatcctggcgaggggttgaagaagtagggaatatattctgttttgttgggcaaggtgggaaaggatacccagttgtaaggaaatcttttcgtggtcggaaggaaaaggtcctttttgttacgctttttgatgggtattgtaaaaacaagatcgccggagtgttattttaaaaggaataggcttattgaaaaggcaggaggctttgctcccccctcgaaagattttgaggaaagatgtctggactgtggtccaggaataagccttttaagcgagcgtctcaggtagttcgaatacaggtggtctggggagtgtgttgtaaatgagaacatgggattcgaatttgggcagcctcatttgtggatgtttctactcaccaatgctgcttttttcttcaactgtaaagtcacaggcatgaactctcaggaaccaattattgtgtttgaaagagcaaggctttgggtaaaaaaccccccccgttttgatatttattttcacctgaaagccgtgttacctggggcaatttatttaccctgtttccttatctggtaaatgaagaaaataacctacctcaaagggaggttatgagaatataatgaggtggtatgtgtttagggttccccccccccactagtgggtgaagggtgtaaagaaggaagaataaaaaaaaacagtgtgagacagtgtgaaaaataancatcggtgcgcgccgaaacttctctttttttttgtcctctttcgccctccctcagtgccgcccatctt

SEQ ID NO: 8588 - DNA, 908 bp, Homo sapiens
  misc_feature (1)...(908): n = A,T,C or G
actgttacgcctaagaaacctctatccgttccgaggtcgctatggggaatcgcagggcgacgctgtgtaggcgcgctcttgtagcgggtcgtagacgacgggggcattgtggtattcacatcttactcttcgttacctctatgtaaatcaatctggagaaagcgatagcatggtaaccatgagtgaaattaaagaaaaaacacctgcctaccgcctgccgggaaaccagaactcagataggaatgttccggaaacaaatcacctgacgccctcttatctccacatttaaaagaaaatataataaacattgtatatatttcacactcgagtcatcactgaattcaaccactaaaaacaaaacacaccacccggtactttctctatatcattggtatctgcaatgagttatacttatgtgtgatgactcctcattatcctnacgaaccagagctccgccttccctgacccgctcatccgcaaacccgcaagtaatagatatgcaggtggtggaggggctagagaggccaatgaacacggccactgagcttgctattctcctgacgtacgcctctctgtgcgtatttttggctcttatttatgtttttttatatatagttttcatgattatctcacttcaaccacttcatgcattttctttataagctaattattttataanttttcagnaactccgtacactttctcttttcgcggcgccgcacgcagtttcttcctgatatactactattatgtatgtttactaacaaaatacatcttaatccttcgccaacctatntnatcccttttcttcctcttcccctttctactnacttttatttattattnatttaatatattatatatgtnaaatcanntaaaaataatnnaacattagattcgttcctaaa

SEQ ID NO: 8589 - DNA, 808 bp, Homo sapiens
cttgcgatctctgtttattaagcactctgtctcacactgtggcttttcattcatcctcctctacacccagcacccactaaggatatatatgagcccttgacacataccagctcattatattctcataacctccctttgaggtaggttattttcttcatttagcagataaggaaacagggtaaataaattgccccaggtaacacggctttcaggtgaaaagaaagatcagaactcagctctttggggccaaagccttgctctttccaacacaataattggttcctgagagttcatgcctctgactttacagttgaagaagaaagcagcattggtgagtagaaacatccagaaatgaggctgcccaaatttgaatcccatgttctcatttacaacacactccccagaccacctgtattgaaactacctgggatgcttgcttaaaagtcttattcctggaccacagtccagacatcttccctcagaatctctggaggggggagcaaagcctctgcctctcaaataagcatattcctttgaaaatcacagcttaggagatgctgcttttactatatgcaggagaatgcgttaccaaaaaggcaccttccctccgatgcatgtaaagctgaactttgcactggttctactttcccacttgattaaaaataaagataatacccctgacttcttaaaggtccgtaaaagggattccatattctggggatatactttgacccacttcctggaatttgccctttttatggtgtggacatccacgtctgaaaccttaaccagactgagctccgccaga

SEQ ID NO: 8590 - DNA, 783 bp, Homo sapiens
ccattgtgtgccttctctctctgcccggacttgtttcagacaggatgactgcagtgacaatggatgaggaatgaaatcagctgctcctttaaaggacatcttgcctaagtggattttgggaaactatgatcttttcagcccccactgaatatataccgaattcatctttgatacagatttcttagaatggattgacttcaacaatctcatccctgtgcctccatcctctcgaggctgtagggaaatgccgtggcaaggtttcttgtccgtggttgtccagcagcataaaggaggggcagattccatggatgtgggttcagagtatagcccagaggatcacaatccctttcaaggccactaagaattaaggattatcatatctcatctttagacccgtggcactggagatcccttgccggtgctggtttacctgcactggagggaaggggcccttatgcggggcgcatttttctgagatatgttttaaatcatataacgtcactgggtttcgcctaggatatatttatgtagagccgagattccgccgtctgcgtttttccgtcatcaagtcccgatttcatcgcattggttcccacataccccccccttctgttatcgccgacacatcacatccttgtgtttctttcggtgagcggtgtttgcgcggcaacgctatgttatgctgaacacataccggatgttatatggtagtccgcgggacaagaattatcacgatatttccgcgcccgccggattcctcgtgaactcacgtgcggccaagcg

SEQ ID NO: 8591 - DNA, 498 bp, Homo sapiens
  misc_feature (1)...(498): n = A,T,C or G
gcaatgaggcaacgacgctctnaacctccacggctacacgaggctctctgagaagagacagcaaagcttcttagttggatcgaaagaccacgagctgggataccaagttctatgaaaagcctgtcacattaagcaacaagatatccttgttagccaaaggtgccaagctgagattcttataaagctaataaaagagctgttgggccaggtgcggtggctcacgcctgtaatcctagctccttgggaggccgaggcaggcggatcacgaggtcaagagatggagaccatcctggccaacatggtgaaatcccgtctctacgaaaaacacaaaaattagctgggcatggtggcgcgcacccgtagtcccagctgctcgggaggctgaggcagaataattgcttgaacccgggaggcggagtctgaagtgagccgagatcgagccactgcactccagcctggagacagagcgagactccactccggttaaaaaaaaaaaaa

SEQ ID NO: 8592 - DNA, 728 bp, Homo sapiens
tcatccaaatttggacctaaggccgagggattatttaatttcactcgcgtacggttaaagaaataaacgtttaaagtggtctgtaaataaaattgggaatgttgtgttatattctgccaggttccactaagggaagaattggccaacaaccaaaagcttctctctatgtggtgatataaaaaaatgggggtataaagcccaatgggagagttttgaaccataaaaaaaagtgtaggtgactatcttttggatagctatgaaagagagttgtaaaacttcatttaaatgaatttttttcaaggcgcagaagaccaacccgcggggttttttttttttataaaaaaaaggacacttccaatggaattttgttccggtaaaaaagggaaatactttaaggaaattttttttggatttttcccaggattgaattttgcttggacatgggaataatgttttaaaaaacaaagggaattatgttttttgaatacaaccaaagtttttggaagaatttttaccccaataaaatggggtattggaaccctctgaaaaaaaaaacccccccccccccatgggggttccacttaaaaaaaaaaagaagcccaaggggttttttttgtttataaaaatgggccttgagtttaagggaacaaagcttttggttaaaggttggaacttaaaagtttttttaaaagtttgaaattgtttttaaacccaatactcaaagggtt

SEQ ID NO: 8593 - DNA, 835 bp, Homo sapiens
  misc_feature (1)...(835): n = A,T,C or G
gctagcggaacggctctgagtaactaacaactatcactcttcagtgtaacaagagtgcaattttcaagtgaatagatatttccagacccttgaacccacatagtccttatgactgtttttgaccaatagaaagactccagtggagatgatgctacgaattctggaaagaacaacccttaactgagctcgactgctcctctcttttgaaaccacataagaagagtgactactcttttatcaccatgctgtgagaagccacatagagaaggcataaaggatgtgaagccaggtagagagagaaagagaacctaaggggccctgggacaccacacattgagtccagaagcgtattaaagctggagcctttggtcccagctgtcttagctgacaccacaagtgtaatctgagtcacaccctccagcagagactttccaaattcttgatgcacaaaattgtgcaaaaagatttaagccgctaatttgggggtagtttgttgttatgtggcaattgataaccaaaacactatgcaacggggttggtttgaaaacaaaccaaaataaagtgtttgaaacactcanaaacaaagcatatccgagatttttcccgtatatcctctcgtgttgccgttttcttgctccggctctttggcttttaggcaggggtataattatgtaacccgtttccctgctccctttatctcccttccttacgcgtttgctccccggattgaagcaattaagggggttattccgctccaccaatctcggggatgtaacccggtaaaaaattgtaccaaccgggcgccatgggtgttggttttctaaacggcccgttt

SEQ ID NO: 8594 - DNA, 130 bp, Homo sapiens
ctagcggcaacgactctcttaatcttccaccgctacacgtcttggaattctgatggacaaaaccaacattgcctttggcaggaaggaagaaaaagaagtcaatgaatatcttgtgctaaaaaaaaaaaaa

SEQ ID NO: 8595 - DNA, 859 bp, Homo sapiens
atccttcaaacccagatcaagactcttacagtcattaccacggctccagcagtggctctgtggcggatgccattctggttccttactttgctctaattttatcagggtttgcattttacctctacaaacacagaacgagaccaaaagttcaatacaatggctatgctgggcatgaaaacagcaacggacatacttcgttagaaaaccccaagtatgatacaaacttaataccctcagaagcacaaagctgcgagagctagcacaagatcttgacacacaactgaacaaaagtatatcgccacgatgtcctatcattgacagttacatccccgattccttttaacgggacatgctctacagttctatatgcaacgtccacccactctatggtagacaacgtaaggataactagaaagtaaaattagacatcataccaccagaatagtgtgcttactaggacccgccctattaactacaaacccgcgcattaaaagatgcaccgcttatccatcgcatttatcgccccccaaaccacgccatataacgtataagccccatattataataaatatagaacgacaaactcccctataataacgactacagatactactctaataaacgtcccagaattagatatatgaccgccccgccatgtattatcctcttcccactatagcgtcgtaccacatattcacacacaatataatacatatattctaccaacgcggcttgcatggatactcctatattattttatccacgcgcacgcgatcgacgattatataatatccattttatgataatgaaatactaccacagcctcgacagatactgctaatcgtcctcatgcccgcaa

SEQ ID NO: 8596 - DNA, 773 bp, Homo sapiens
ttccggagtatatgagcaggacgtgcaggtttgttacatagaaaccgagaccctgaccagatggaaactgctgactgatgtcacatagacctcagacaaaaggaaactgaagcctgaatgaactgctgttctttgttctaaatttcttactgagggacctggaaagacagtcatgactgctggccatcagtcttgataacctgaccactctgacccaatacataattggctgtgatctgactctcgattagcaagcccaagattgttaattggcttccttatcttaactaattgaggataaatgtcaaaccttgttcttttctttctgcttaccttttcttattatacaataccttccttcattaacccatatcaaattaaataatctctgaaattacctaaaacccttgaggtctatgcttaaaaatatcccaccttttttttcccaccccatttatatcctactgtttttaatttattcttataatctcgcatttttcctcccctttcctccttctatttattttccagtttcttatctagtataccacatttgacacatattcctgaaatatttcttatcttcgcccggatataaaaacatacctcctaattttttatttcccatattcgcttccgatttttcaattcaatttttttttctcccggcacatttaatttttatatatatttcaacatctacgttctttatttttattccgtatttatattataatatctccacccgttatttatctttatctttccacgtt

SEQ ID NO: 8597 - DNA, 274 bp, Homo sapiens
cattgcggaacgactctcttatcctccaccgctacacgctgcaatggcatgaattgttggaggggcaacgttctgtttaaatctggttttatctcactccccagtgccttaagagaagaaaaacaagcatctctggtcttcattattctgattataaagaatgttctcttaatttcctattgttgtgtacaagatttagtgcttaccctttaatttcagtgtcagaatgtgtactttaattaattttcataaaatggaaagcaataaagacaga

SEQ ID NO: 8598 - DNA, 944 bp, Homo sapiens
  misc_feature (1)...(944): n = A,T,C or G
ccggccgccgtcgcgccccgccgcgccgccggcctcccaccaccccaggcgccccacgaccaggcgagccgtacccgaccgccgcaccccacgccagcgcccgcccccggccgccnggtgagcgccggacggcgcggcgccccccgcgagcggccagtccccgccgtgccggcaccccacgcggccacacgcgcccgcccccggccggccgcccactccccgcgccaggccagcagcacacggcgccccgcgcggccgagcgcggcccccccgccccgggcaaccgcggccccgcccgagcggaggggacgctgaatgaaggccgcggccgaggcgagaggctgggcggctacgccctgcgggccgcggcgcgcactcccgcaagcaggggcccgcccgcggggcgcccgccccggccgcggccgccgggagcaaaaagaacaacagccggggcgccgccaaggggcccccacgaccgcacgagcggactgggggcgagtcggccggagccgccgcacgccggcgcgtcccccccgaacacccgacccgggcgaagacacacggcccgcagggaggaccggccgcccatcccctttattttataaagacacgcgattgaaagtagcccccccccaccctgagtttattgtcacagggaatctctagggggggatctacggccaccccatttcccctcgcaccccgcgacgctccagaactctttgtaaaacacccttctccaacacaacccaccaacgccgggcggcgcctttattgggagagggtttttttttaacccccccccccccgtgattgattgaaaaatataacaacctccgcgacggcgggaccaggggtcccgcccccaaatttgggggccgtcccccggcagcctcctcctccttttctcccccgtcctgccacccggcgcccgcgcgactgct

SEQ ID NO: 8599 - DNA, 1813 bp, Homo sapiens
  misc_feature (1)...(1813): n = A,T,C or G
ataacctcacagtcgacacacatacnactacatatagtantacttctatgttttgtacatctnataantatctctccatcgtcnctagcgtacttctaccttattatacgacatgacatatatagancgcntcncgcgancatcgctcctatcgatcacngcacggctgcggtcacactgncgtactagtcgctgtcgtantatcagtgcagcgctacgtataatagctgancctgccacagcgcngtgcgtacctgataagtatatccgatagactcnctagcagaccgacacactacagatangaggagtctgctcagtatttatcttgatcgtcacgtgatatagaatcgtagtactgnantgtatagtgtgtcgagtatccagtgtngagtgatcgacgatcctagtaacatcagatagcggtcgcagtaatctcgtgtgcacgccgtagcctcacgatgagcgcagtgagcgccgancacgacgtacgatagacgcatgctcactgtcgctgtgttatacatggcgatgccgtgtgcttagcggacatgactgtgaacggagtgaanctgtaggtgatattcttctgacactgacagatccataaacacagcgatgatgtttagtcntgtcgtcgcagcatntagtcgctgctccanctcgattagagtcatgtgngttcacttcaggttacacacctatactcacagagcggcgatgcgcgcgncagtgcagtgcatctcagncanacgcgtcncgtcgacgcgngtcgcacgtgtgcgttgtgcgnagannagatgactgagagacaancgtagtgcgatactctgagncgcagtgtagcacggtgtcnacgcacgctctgatgacagtatacgcnaatgcacgacactgagtgactccagctgcacagcgaggtgattcacgntatgatgnatgtcacagatgctcgacggtgcgtgtgaggacagcggatagggtctacgcgtaatgacgntcgacgcntatagatngtcgcgtagtagtacgcatgccgncgcgtgcgctggcctgagngncagcagagagcagncgnacgcagcgtagtagagcatanagatagatgacagncagacgacgggcgcgtcgcagagtgcaggcgtatatagagntantcgcatacgctgagcgcncgtgtcatagagctctcacgatangcgcactgtggtgcagtaggagcggagtcagctcactgcgcatatatgaccgcgtgtacgtgtgctgtacgactctacttatccactcggtgctgagacaccagacagcgtatanactcatgntagtcgctctatccgtagagtagccgactctatacgtcgnacgcatgcaacgcgcgagacggtatctgtgcggcgtgctcacgtacgcgagcgtctacttaatgcgacggtcgcgagacacacgtcgacgtattganatataagacagctattgtaggtcgaagtcacgagtgatctaggatagagtcnagagcgcacgacgtacgtcgagatcgacgatctcgtatctcgtcgtcgttggcaacttctatcagtgctcagtcaataatgtagctatcacattttctcganagcgcagatacagaangatgatgcgtagcgantaacntgtagagcnggcacgcgactcgcgagctggtgtcgattactgttgatcgatgnctatcggcgtacgtcnatgattgtgtcatgctcgacgtgatttagcnagttcagcgtacacgagtaagaatactcgnctcgacatcatcgcgtatgcagtgcgcgacgcg

SEQ ID NO: 8600 - DNA, 223 bp, Homo sapiens
ttcattctgcaactgactctcttaatctccaccgctacacacctttcctcccaggactgctggagaggcagcagcttaatctcctccatccgcctcgccagctgggcacgcaggaaggcctggaaccacctagagcaagcttgtctaactcgcggctcgcatgcggcccaacacaaattgtaaactttcttaaagcttttatttaattttaaaaaaaaaaaaa

SEQ ID NO: 8601 - DNA, 736 bp, Homo sapiens
aaaaaaaatggcgtattttttttcggtttaaaaaagccggaaaaccactagacggtttggttaagagccatgggccattgctgaaaagcccccaaatgttcttttccaaccccatggggataaaccacggtgggaaacccaggggtttttttggcccaaaaggcccatcccaggtaaattgcaccgcaggaagggctttttacccaccagttttggacttaaggtgcaggggcttttttaattaaccccccccacaggtagaacttagttttttttttttttttaacggggggtgggcttaaaacctaccttttaatgaacggaaaatgggggaagaaaaggcatgtgggttcccagactaagtcataaaaggccccgagggttcctccctgctaggggtcttggatccccccctctggggaaaccacctgccttggggtaagggcccccaaagccccctaaaaaaaggccccctcccaaggaggtgggggttttttcccaaaaccaaatgagtgagcccttttaaaagcagatccctttgccccaggaaagttttgaaaaccctgatgatttttgcaaaaaactattaattcctccaaagttgggcgagggttttcccggtccacccttctgggatttttccatttaagaaccgggattttgctaagaaggattttccccccttatctctttggggcaaaaaaaatacctttcaaaccacaaagggtttgttttt

SEQ ID NO: 8602 - DNA, 1193 bp, Homo sapiens
  misc_feature (1)...(1193): n = A,T,C or G
atctctgcgtacttcataaaaagccgccactcaacttctagtcatagagccgtactggtgtgattgatgggcctcgttcaacgcaactcgacgactgagagcgcactcacaagactgttctatgcatgcactngccctctggagagcggatgagggatcaactggagaggtaagttctcacactcgatatatacttgcgtcaacaaggagggcgattgaggacgcacataatgccgatcgggacatacacgagaggaggcactgttatgcctgcnacaaagnagtggatcactgtttgtgggagcgcacgtgagcgcgtatttattgttcgaatgtaggtgcggcggtcacgggcgataagagcacgagactgtctgtnatctcctctcctaagagacngcgggggctggggaggacatactggtgactgcgctccttttatacgttgggggcgtctattatgggggttgggtggtattagcgcgcatagtggcgcccttccacattaagnagactgctgagcaggcatatgcgccgagatggagcttttctctcctcgcgctcagacggtctctctgcggagcacactcccatgttatggggagntaagagcaaactaaccacttatggttggtgaagaggcaaacgggacaaggcacccttttatatcataggacgcgcacctactctccgccaagatgaaagctaggagaagtgtatgttacatcctacaatcactctttacatgtgggaaccgcgcttcgttaggaaccacacagcccgtttctagccgcatatatagaagattcttggaacacactcacatcctcatctctcttcccccccgacagagtaattaaatctcttttctcaggaagagctgcgcagtgaagggttcttgtccgaggtatgcagccgtagggcgcggtgctcgttatcttggaaactgggagttcgccgttgaggggtgttattctccaacaagtttgttttggtggacgcgatgaaatgaccctttatattcctgaacaacgcgcttgcctccctaagaaaaaaaaacatatgagtgtgaaggagcagagaaacagaacggagaagaagggaggcaataacaaatcaggtgcatggtctccctgtgactgtgctgcttatgttgtcggagtttcttttgtatcctgacatcactgactttg

SEQ ID NO: 8603 - DNA, 852 bp, Homo sapiens
  misc_feature (1)...(852): n = A,T,C or G
tttgcgcgtccggttcctgatcctctgatggcccgcgtcccccgctcccccgacattgcctctcagtcgcggtagcccacatagtgatgtctcaacgcgccatcgaatgcgtatgtcccccgtacgacaccttacccccacccagcactctgctctccacgttcagggtctatcaccctccacccgcacccgctgcaatccctcggcatcaaacagcgtctgcttcctaatgcaaacccacgtcccgacgaccggcccgtgtgacttattaattactggcctgttcagaggggtgggcgactctattgtacctccccttcttcacccccgggaaataaggatggatagtaacagggcttatggaccgccgactcgcatcgggctaaaaagaaggcgctccaggcagctggctctaccctacggaaagaattgctaggtcaccccgccccttggagtgtacatcccctcgatcgccgtgggggtgataagctcacaccaatacatccgcctttgggcatggggcactcgtcccctcaccggggttagtaaaattgtttttgctcgtgggcacacagaataaactgtacgcccgtttttagtaganaccatgcgccctatattggcgctatcgaagaaggtgctcgtgcagataccccgtcactgagttcttcttgccgccgcggctctataaaattgagctcatggggtgggtgggaggaagtttcccagactccgcgccatcctgggatttttttcatctaagacccgtggttccggtacgaggatttttccccccctatctttttgggcgaaaaaaattacctttctcccccccaaggctttggtttttac

SEQ ID NO: 8604 - DNA, 822 bp, Homo sapiens
  misc_feature (1)...(822): n = A,T,C or G
ctttttccgcttccccctccgccccctttcttttcctcctcttcccctcctccctccgccttctgtttctcttccttgtggtttcccggctctgtctctcgccccttcctcttctccctcggctgttctttccgctcccgtctcccggcgctgctccccgcccctcctctcgttctcttgctccctgtgtcgccccttgcgccgctgtttctccccttgttgtcttccccgtgcctttcgtgttttccccccctcctctcgctttcttctgcccccccctcccttcccccccccccgctggttgtctcccccgccccccccccggctcttcctctccccgcccgctctgcctcgttcctccgttctcctccctgtttggccttctttcgngttttcccggggctttctcccccttcggtctctccgtgcgcccccccttggtttgtcccccctgtctcttcctcgcctcctttcgccctttttctccgcccttccgnttctgtctttgttcgcctttttctctgcccttttcgtcctttggaattcggggctttgtgttgtctttgctgctgcttccccctctttttttccgtttgtccccccgtgtgttttggtgtctcttctcccccgtgtgtcttccccccgtgtctttttcccgtgtttttcccccccggtcttctggggtttttctcgggcctttctccgcttgcttcttctctcccgcgtttcgttctggttctccccctcagcttcttgtcgtttcggccaaggtttttttctcctttcccccccttccctcttctcttcgctcttgtcgctcgc

SEQ ID NO: 8605 - DNA, 728 bp, Homo sapiens
actttgcgcttctcaaaggggaccacgcagaaaaggacacaagctgtcttgcagtacaaccatctgggacaacagaaccaacagggggggaaaagacttgggatgaccatgctacatgcttaaggctgaaaatttttttttaaaaagagacttcaacccacacaccccttttgacgaaaccgcctattaattacactctatagcctcccgctttttatgcagggggggccagccgtttacttgtcttttgactgcaggggggggcaaataagacaaggacttttgcttaaggtccgagacgggtggggacaaagaacggcctgccatagcaactgcaacgggacagggctccacggccaaaaaaagaattggctaacccaccgcgggtatattcccccggcgaaaaaaaagacagggtgggggagtgaatgtcagagcgtcaacgaaccataagaccaaaacgcgccgttagcaaatcatggccttgtttaaaaccggacataaaaacaagcgcaagaataatccagcccttattaccacccatcgccacccggaaaatgccccccccgaagtactcaacacaaaaaaaaccgcgggccgggacaacggggagtgcggcatatccagcaaacacaggtccttagaacaaccgaaccaatatgcaagccagggaggagaaacataccgataaagagccgacgcgtccctagcgcgacacagcgagaggg

SEQ ID NO: 8606 - DNA, 904 bp, Homo sapiens
  misc_feature (1)...(904): n = A,T,C or G
gctagctgcaacgactctcttaatttttccccgctacagctcagaaaaaaagtaaccaactggcccaaacagcatgaaagaacaccaggcaaaaaatagaagaaatataccgtatcatcaaaaggtgcgtctgagttgaagtctctgttgaaaaactgcttattagcctgaagaatctagcagggtcatcagaagacttttcacacccagttggttcagctgtctcagatgattgttctgccaagaagctcctgtgattcccagcttggtcccctttgtagaaggccacgtcttcttaacctaggaataaatgaaactgaacagatgcctatataccaaaaaaatatattattccctatctattcccgttcgtgatacgcgctcgcagtctttattcttttgcgtatcggttccaccttagattgctgatttctctgggttccttgcgcgggtgcggtgattgttcggcgtactagtgctcacttttagcgcgttgcgggctgtacgcgttgtgccatcagagatggatatacgacagggcgcgccttttggcagtaataagccgatctgtggggcgcggcaacaaagaatagtgtttgccgcgtcttacgcgttttgtgtataagagctattctctcatattatactcaggaacaaattgcagcgattaatgtttatagtccgtgtttgatattcgtttatgagtcgcgcgcccgttcctgtagtagtgttactcggagtgtacgtgtcgtttgagccggtttcccggtatggctttagttggggccgtgtctatggtggatctctcttttgatgcagagnagatgtatttccagcatttgaccgatacgcaccctcacaatagtatcgaacccgcggcgtaacctatccgcgcgcccgccgt

SEQ ID NO: 8607 - DNA, 1288 bp, Homo sapiens
  misc_feature (1)...(1288): n = A,T,C or G
caaaccccagaaacccccaacaacgtcctaactcgcgaagcacagagtgttcccggggagaaccaggcacgtgaatttgttttcccgcacgtataacccacagggtatatctcacagacgtggggcattctccaacatcgattttgtcgctgtgggcctgaacagcggccccatccacatgcgttaatatggtgctatacgtccaccaccacgtgttgcttttcgcgtgcacagtacacacgaccgacccggtaccacgtataagtatacgtcacgtggaaactcgccgcccaaataaaacactcccccaatatactgcggcgccaatgattgccgtcgatcaccaacgcagagcagggaggagcgccgcgtcttcaatagagccggagacgcagcgcgcggtatctgtcgatgcatagatgaggaagaaaccatagtgcctgagcaccactaagcctacacgcgctataaacaagagaggctccatctatgctgcccctaggagataccgcttgttccagcantgcagggacacacacagaagatggacgggcaactcgaccgaggaaaaatgtatagtgatcctccccaatcactgtggcacacgttgtatatttgcctatccccccgcctaggaaaagacacgcagagagggccactacgaccttattcactctcgtgtttgctttcctcccgcacacaccggctagttacagtagcaattgggtataaactcgcgtaggcccacggaacccaattcgcacacacaaccacttttgtcgtctatccacatatcgagggccagagagacccaacgaacaccgtgacagaattgcgattatatttgtgaggagcacttttagaccgtcacacatccagcattctatgtggtactctacgtgaactggcgaccacccgccagggtggcgccatatagatgcatctccatgagagtaccgggaggtagagacaccccgccgtttacacggtatatgaacgcatgactacgaaactcgccgatctgtactcaacgcctcggtgtgagacagcggcgaacaatagctgtgacacagatcacaactgagctaatcgccncgacacacggccgccactagatgacctcgcacctacaataacaatatgtgatcacgcttgtatcgctcactcgcctcatctcaaaacgccattttatcncctctaccccgacaaccacccgctgtgtctcgctcaccatagatatagttgccccacaatgtatcgccgccgtagtgggccagccgaccactcg

SEQ ID NO: 8608 - DNA, 782 bp, Homo sapiens
  misc_feature (1)...(782): n = A,T,C or G
caatgtgctctgtgtgtggtgtatgctagcggtgcgttcggggtgttggtgctgggggtcgggcgagtgtacgccactactgatatatggtgttgttgcgggtgtgttgctttggagcgtggttagtgtagtgtggactgagatggggattgttgcttgagatgtgtggcagatggttgcgtgcgtacgtcgggggcggttagtaaccagtgggggtgtcgagggagagaggagtgggtggagaggtagggcncgggcagggcggcgggcggtcgaccgatgtggacgggatggtaaaaatgttggaaagtatggttacgtgaaggttggtgtgttgtgtatgggagtgttgtgggtgtgtgtttatgtaggtatttagatgtatttgggcggggtgtgttttctttttttggttgtgtgtgtggtgggaccggacttgctctgcaagtccagtcatttctcgnctcttgctaaattttgattgaggctgtggcgggttgaatgtgaaaaagtttttaatttatgcgccggagttccctttcctgtagccatttctcctttccttgtctgtttcttcagtaactgtccgtgctagtcatcctttgcggcggatgttcagcatattatttagccacagcaagggaaaagagtaggtacatcagtgccctgactaccgtctcaggccggggttgttcagtgacgccatccgctcctctggacgtggtcgttctccagaaaagtgtatccttccccctccatccacccattctggactccgccat

SEQ ID NO: 8609 - DNA, 792 bp, Homo sapiens
  misc_feature (1)...(792): n = A,T,C or G
ccttgccccccccccttccctctgtttgtccctttccccccgttgttgtttttgccccctgttttgccccccccccttcccccccccccttcccgttttcccccccccttcgtttttgttttggcccccttgccccccctttttgtccgtccttttttttgtttttcccccccccccgttgcccctcccccccccccccgttgtccccctccccccctgtcccccccctgttttcccccccccctcgcttccttttctgttcgcccccccttcggtgtcccccccccccgcagtgcttgttcgtgttccttctccccccctgtccccttgggtgtccccctgtnntccccccncnnncccccccccccccccccncccccnncnnnnnnnccnnnntnancaacntgntnnnnnncccnncgtgttgtggcacaataacgcccgggggggggggtgttttttaccccgggaaaaattgttggggacccccccccctggaggttaataatttaatattagccggggggggttttctctaaaagggggtgaaaaaaaatggtttaatgggcaaaactttcttccttaggaaatttttaccaaaagggggggaacttagttttgggttatagaattagtttttaagaacccctttttgatccatagagcttaganctgaagggaatggagacncaaaatttcttcaaaaaaaataatgntccaggagctggttttttggaaggatcaacagaattgatagactgctaccaacccctataaagaacgatgccgcca

SEQ ID NO: 8610 - DNA, 150 bp, Homo sapiens
cttcccctgcgtaaatttcccctgttaacggggcgacagttgcccaatggcccgttaaaccaaactgttacctccccaggttgcttagcgaaaccctttttccattccccttaggaattggccggttttccccttccccccccttttgga

SEQ ID NO: 8611 - DNA, 896 bp, Homo sapiens
  misc_feature (1)...(896): n = A,T,C or G
ggcgacgctgatgcgggcgtaatgcggagaaaaaccgggccagaagtggagcgcgcgggcttcggtcgcctacgggctacgtttcatcggcggggcgatcaaggatgggggggtaacgaatcggcggcgaatcagcgggcgtggggggggccgggcggcgctcgcctgctctacctggccacgtgaacgtggttcgccgtggccccgcggattttcggccgtcggtcctgtcagagatcgttagatcggcttttttcttcataatcgcgcgggtgacgcgtgagcacttacatcaagcttagcggcgtatgtggcgcgggaagtgggggcgaaagaaagtatatatcaacatacaggaccgggttgcctcgggccgtaagctcttagtgttcggacacgaagtggttctgactaggcgttggttgtatgacgctaatcatgggtgggggagccgggttgggggggcggggcgtgctttatacccgtggcttcgggggatttaactgatatgcactggggtccggatgggtccgcgccggcgaattgttgggggggtggcattctgtgggatgctgggggttaacgtaagacgcggcgtgacccgggtgaaaaagcgggccaaatcgggttaaaacggggtaataggtggggatggcgtgacggcgcaaggtatggatactaggcgggcgcttggggatttaaaataaagttgcctatagatagaaaatgtgttatctcttgtcaccacctgttttcaaactatgatattttaagtggcctttatattttacagtctgccaatttcaacagtaccctttccagtataaaaataaactcgtnaccgcccagctgctggtttttcttatattggcggtgcggtgggcgcacgcgggact

SEQ ID NO: 8612 - DNA, 821 bp, Homo sapiens
cttacgcaccatcaatttccatgtatgatggctattttgtatgttaaagattgatcatttcaaaatgtctcaatgcaggtgaaaattaaggtgaaggtagcacctatctctcaagttgagggtgagttctagtaaaatttgaatcttgattcctcgctctatttacagcttttaaccaactagatgtatttgcattgtgaggctggtttaaacttttgctgagaaaaagcaaatctgtttttttttttcttgattcataatcaaaaccacttctccaatgcaagccagctgagaccaccagtaagttggggtagttacttgaggtagagttacttaaaacccctgactcaatggtgactaagaggggaagcagtaattgtgtggagagaacataaatctttaaatgctgctaaaaacatatgtttctttttctcaactgcaactgttagactcatttcaagctagtgcagactctagagttgacatgcctctttggaaacttgacttcacttaattacgtgggtggtcttggctgaattgcttgcttcgctctacctaaaatgtacctgagaggtgatacaatgttaaaggagataagctatgtaagcactggtcctccttaggccccaaaatatataatatactattattacatcaaaacaattatttataggtgttttgttactcaataaatgtttactcaatcatgtgcttcaattaacattggaaattactctttctggcactcaagcgatcatttttgttccttgttattgttaatttttccttcccttatattataataaatggagatcggcaag

SEQ ID NO: 8613 - DNA, 845 bp, Homo sapiens
cgcgcaacgtataagcgatgatcaccaagcgcggctaatataacgccgcaaaatcaccgcaccgtccgcccgcacgggttcgtccaactggggaaccagactcgaaggagcgggtcaacaaacaaaaggggttccttacacatattggcgggcgaacacccccattaatatatagggcgcgcgctatagcttaattcaccaattagtctcaaggacccccccacatcccaggaccagaagcaagggattttaggggccaggtccccacctttgtaattaataaaagtttggccaagcatacttaattttccgaccgttatattttctgggctacaaatatatgggcccagtcctgttaaaatccaatgagatatggatggggaaacccctttgttaagtgtaaaccacccccccaagccaataataccacttaccatagggctcccccttggaggatcatgtggaaaaatgaaagacttgagactatcttttgcccatgaacagaaggagaaaaggatgttgaggccacccttcaaaatctgcatatcctctgttcctctgcttctctaaaaattgcaggaataggtgaaattgagcctatctcttttctgtaattagtacttcatttttgttttgtattctgtgctgttcacattatcctgtcttcctttgtgtctaacacggcatctcctataatctccctgctttcgcaaagtattatgattgtttgcttattgttctgccttccctgagggcagggacggattctgaagatacagctcccaagtgtcttccctggtgcctggcaaaaaaaaaaaagcagcttataaaaagtgatcggccag

SEQ ID NO: 8614 - DNA, 782 bp, Homo sapiens
cctcccggttaatggtaccgcagacaggcttttgaaccaccagtttgagtttaaggtccggtattctttaattaacccccccacacagggtttgtggcacaagaaggcctggtgtaatcataaattaacgaaggaagggactccaggagcccagagtgacttcccggagcataaaaacaccaaaaatgcgatgcttttgtggcccaaccaagcccaggtggccagagttgttgggggatggacattgtgggccataatgttgagactgtggtctaacatctgaattttctctcaaactctttgtgttgcttgagctggtagcacgtgtttggacttgggagatacccaggacaccaatggctgtgcttgggcaggcgagcactgcaggatcccaccccctggtcattgcctggggccctggcctcaccttcccctgctttgctggggccccagctggctgaccctgcagctccgcagaccactggcttctggctggatcctgataacgaagatactgaagattttacagcggggaatggacatggtcagactcacatctaacaaaagccggaagatgattttgaaaaacacccccgtggcaatttggccaggaggttccaaagatggtggtctcaaaggggagcagtaggagcaaatgggaccaggaggatttttctcttttttttgggagaggtatttttaaggatgtagaacttattttctgacagaaaagtaaacaaaataaataagtattgtggctaaaaaaaaaaaaaaaaaaaaaa

SEQ ID NO: 8615 - DNA, 320 bp, Homo sapiens
aaggaaaggaaatcgcgatgcatgacccgagacacttcccccgaataccacgaaggtgtcagcgtcatggtcaaattccggagtgattccgcagtagacgggtcgattccacttttcccagtttataaaaacagagtttggccttgccaccctaggtggagtgcagtggcactgtcgcagctcgtgcaacccttgcctttctgggttcaggcaggagaatcgcttaagcccaggaggcagaggttgcggttagccgagatcatgccattgcactccagcttgggcaccaagtgtgaaactctggctcaaaaaaaaaaaaa

SEQ ID NO: 8616 - DNA, 811 bp, Homo sapiens
cctttgtaaggtatctcttatttaagtagtcaactcttctctaatgttgagtatgtctggcttgccttgagcataaagaatagaataatctcctgaccatcccaaatgatcatcactaacacagagcatatttcaaataatactgctaatccaactttgtgtatatgacacataaaattgggcctggatcacatctgaaatgcccaacagatgatttgatttattttactcaagtgaaaatgaatattttatatttggcataatttcaaatagccacaaactaataatatgaaaaaacccttatgtattgattactttaatcatcaaataatctttagcacatactaagcctgatttatataaaaatggtctaccagcaaaaatgtcatcatgttgtttgggatacatgtgtcaatgataagaatccagaaactcatttatctggaaggatcattagatttgcaataaggaattatatggtgggatgtgattttcccgagatgactaaactaaaaatcaactaaaattttcagatttttcatatagaattatttctactacaccatgattttgcaaggagtctttatttttacattgtgaattaatccgtaattaggcatcatcagtcttaaacaaatgtgaaaagtggggaaaatgtccatgcagtgcccctgcactttgatttgtattacctgtttattttttcctctaatgacctaggttgcaatagatcaaaattcagtgtgtgtgtgtgtgcgtgtgtgtgtgtgtgtgtgtgttgtgtgagtcaaataaaacagggatcgcaaag

SEQ ID NO: 8617 - DNA, 781 bp, Homo sapiens
ggctagtggtcggagaagaaaagggataaaagcgcgagaaagggaccggaaggcaacggacggtaatggggaataaatgcgacggggtagaaaaggaagtgggggtataaataggggagataagagggaggagggcgcgccgcgctgtcccctaccaaaccgaaacggaaacgattagcgacgtttgattacttaggtgtgggaggaaaaagtacaaaaagagcattgaacacgagtaggggcgagacggggaagtagaatgcccactcacgaccagacagctgaagcacgcgtaaaaaatgatcaaaaactattgacaaaacactcgcccagacaccaacagtgttggggccaatacatataaatacgctatggggtcattaaaagctccgccgatcgcctccttgaatcgatgcatcatgtaattcactctggggcgcagacaattggatgcattctttgatctctgtctagcacttgatcctattcaaaaggagtttggaaggagtcatggaagtaaacagccaagtgggaaacacaagttatcatataaaagtccccctacccttgcattctcttggtgaaactccagaacatcttctggcttggagctacctgattcatgaattgctgtttgctcaaagaaactcttgaaaattttattgtgcctcggttcacatatttaagagattttgtgacttatatatctttcactctttttgccatggagagatttttatagcaaatatatagtagtgaaataaaaactgtatctggcagg

SEQ ID NO: 8618 - DNA, 825 bp, Homo sapiens
ccaaacgcaaagcgaggataaaatggttagaaaaaaccgcataaatcgaccctaagcccaaaaggtaataacaaccggtttagacaaacggcggactgtcaaaataggccgcagtcttgactccaataagtttcgatgtttagaagcaagagttgccgtaatgtgccaaatccattaaaatgcaagaaagctgcagtgggattatagctaagcttttatattcagaaaggtaggccaccattttaataaagttgtcagtaacaaatatatattaatgatcaagaccggtaaaacaggacatgggaacttaatgaaatttattttcaataaagcaagtgacaatatgaaaacacatgtcctctattatgaactgttacctgtaactgtgttttgacagtctacttcaacaatcccggtgcctaaaaatacatacttaatttttctattaatatatttaaatgtcttaacaaaattctatatcagcaaaactacagtttttcttgtgggggattgtagctaatatgtgcttattgattaataacatagacccccttttacttcacacaacttggttgaatcccaaattatcttaatatgtcagtcatgttatttaattaaacaaatatttattgagagcccacagtttgccagcagtgactctgcactgggtccctgccctgacagaacttacattttagcaggtgagacagacaatagacaaagcataataaaccataccgatcattatagattttaataggagatactgtcatgatgcagaagtgggaaacagtctcagaatattattaaaaaagtatcggcaag

SEQ ID NO: 8619 - DNA, 316 bp, Homo sapiens
caatggactcagggtggtctccaactcctgaccttaggtgatccgcgtcggcctcccaaagttcttgtattacaggcgtgagccaccgcacccagccaggcagactgatttcaattcttttggttatccacccagtagagagatggcgggatcacatggtagtcctctttttaatttttttgagaaagcttcatactgttttctataatggctgtactaatttacatttccattagcagtgtgacagggttcccttttccccacatcctcaccaacgcttgttttgttttgtcttaataaattcaggatgcgcccg

SEQ ID NO: 8620 - DNA, 891 bp, Homo sapiens
  misc_feature (1)...(891): n = A,T,C or G
accaaccaggggaccatactacatggggcngccgtgtctccttaggctcctctanactgtgtcagcttctcanacttcgttttcaatgaccttgacagttttgaggagtactgcttaggcagtttgcaaaatgtcctgaatttggtgtgtctggcgtttttctcattatgagantggggttatgggtttctgggaggaaaacttcccatcatattatatcaaggatgcatactgtccacatgacgcatcactgatgctgaccttgatcatctgactgaggtcgtatttgtcatttcccccgctgtctctagagtgctctggacggaactcactctgcactgcccacataatgagtggggagttatgttccacttccctaaggtggggagtatgtacataaattacttgggaactcttctctatgggagattattctattctattcatttantcatttatatcaatatggactcatggatatggatttaatactntgnatcacatcccaanactgnganttatttggctgctggagttggcccaggttggggcactgggagctctttcagtgggcccctgntgaaatnacacatgccccccatnactgggtgggnnnctggcacttcccttccttttngggnctataanagcttnntnctnatnttntgnttccttggtnnnccctganataacctttcttcaaggacctggnncctttactgaaangggnnacccatttcnggggnnnangnctccggctntgaacnaaactggattaaaaacaangnnaaaatntnctnnntcnttanncncgngcnggnggntcttngnntaacanattnttggtggtcnaanannatttntngnnnanatnnntggnatngnaacgng

SEQ ID NO: 8621 - DNA, 1236 bp, Homo sapiens
  misc_feature (1)...(1236): n = A,T,C or G
atatacatacttagtatattgacacactgccagaggtcgagtacatacctcacgagagtacctgctatagagtcgggtgtagcttagatcatgatattcatataactgcgtgcgtcaccatccagcggtactatcttctattacgcatgacattaaagttatcttgcgccgtaatacatacacacacgctaggcgacaaccaaggatatagatcacgctggtgggaccggtcttgattgtgtgcgcgtccgggatcgcactcgtattaacgcacatcacttaccacggctaagttagatngaactcctccctcactctctngatactttctctcatccacctttcattaccactcctcctataaataccctttccatactctacatcatgttatatcataaactatattacactatcaacaccagactataaacaaaaacaaccacatacgcacggtgtttctatcataacatagacatatcatagaactnaagacctataaataagatatatcgtggataggtgatagatacagggatgctgttacttggcgtcctcggtcgtgtaacgtagcggagcacaagactcgcgaccagctgcgtctgattacttctcgcccttaaccaacacatatactcgaacacgacccacccagcctctcttacgttatactcacanaacataacagcgaatcaccaccacgtctctcgctcgccttctcgcagacacagcttactggccatttcatcttctctncatcccttctctattttnnttaccatnnngactcatacacttcatnacatcaatgtatcacgagattacagctgtaagtattatttaaattgtgttgacttcatctagttcatcgtcacacactcacactatatactcgtcgcagtgcctgctcnttggttgcccgtgtgtgacgctgcgcaaagaactgatgcgacacgtgctgtatgtcgtagagaagtgagagacacgcagtcaatggacctctccctctcgctgtcctaacaagcgcacgatctacacatgagagntgtgtatgagcatccacgcgtcgctcgctcggctngcctcagagccctcgtaagacgtcgngtcgtttttcgtgtcctgngtggtgagnaatcacttgcgaggcgctcctgtggngcnctncnttgctcaagcgaacaacgacatatttgttaatnataagtnannttncntagctccacagggcgggag

SEQ ID NO: 8622 - DNA, 1406 bp, Homo sapiens
  misc_feature (1)...(1406): n = A,T,C or G
ccgcggtcgccggcacgcccgggcgagctgtgtgtcgggatacgaagaccgtgatgggtcacaggtttgaggatgataccgcgggagcgggcggtcgttgatgcccgccaaccgccccgctgccagttatgattgggacgcaccgggagtcgttccccgagttagatgaaaagcaatggcgggcttgatcattatcatttatagtccagtggcataaacgtacgtatccgtcgcgtacggcatctgagcgtctccctcatcattactacttctctgnccctctcggcccgcacgaggagtgaacagcacgcacggggaacggagtgtgcgtagtcctacatcgcgcctctcacaacactatcatagatgagaccttaggcttgcgcacaggggcatactcgttcgagagcgcctacctccgccgcccgtccgctccgcccgcgccgcaccgacatgnaccgcgcctcgattgtgcgnagaccgacatccgtcgatcgcgcgcacagacgccacacctactataccctcgcacattcgtcaccggcatntcgaatttcatctctatcctcgcgattacgacacgaccccgtcgtgccgcccgcgcgatagctcgaggatctgcgtcagtgtgctcgtcgcgcctccgtggcggtccgcgccgaggcacagcgcgcaccactatcctgccactcgtcgcgtcatctagtactattctggcggtgtatgtcttccgtggtccggcagccaccgcttactggctatatcactatatacaactcacatggaacgcgtactgtagctggcgattcgatgtctactcgtgcgtccggtgtaacgagtaccatcatttgcacgacacgcgtgcgtgtatantcagacatatcgacttcgcatacagcgncatgagacatcngaccgccgacgcgtctatgttatatgacgcgccgccacgacgtattctnatataataacataactgtgtcataggcgcgaacgcgcacatgncagccacggcatgcgacgcggacttcagaccntgaantcgcttataactatnactagtgatatatcacgatatgagactctgcccgccgtcgcaatgtctgtattngntctctgcacatagattagctcgctacgcagagatacgcgacgactcactgctcaccgatancaccattccatcgtagtaaccaccgcgtatcagcactcgcacgcactcgcgtctccctcctcgtcgtggagcactccgcttntatanatatatacaatacccagcgatctaggatgcgacgcacgcctgacatgcgtcatcaagtcgcgtcggctagtacacgcggccgcggcaacgccaggcccgccagagcggcgtcctagttcaaactcacgacgacgtattatattat

SEQ ID NO: 8623 - DNA, 1288 bp, Homo sapiens
  misc_feature (1)...(1288): n = A,T,C or G
gacgcaggcgcgcccgccacaaacaaagccgccagcgcggcgcacaggagangagaagagcgaaacacacccctaaacacagagaagactganganganaaggagncgctttaagagagaggcaggaaaacccgcaaggaccagacgnaacgcacacgaggacaggcggagcgcgancacgagagacagcaagcgcacgcggcggcggcgcgcgcgacagagaggcgagcanagcagccgacacacgcgccagcacgcccgccgaacgacagcgagacggcgaggaggcaacagccggaccgcggccgccgacggaaggcgcggagggcgaagggaggcagggcgagaggagcggcacagcgcgcgcgcgcaacgaccgcgcgacgacgaggaccgagccgcccgacgcacaacacgcccgaaggacgcagcggagcgaagagcagagcaaggcccagcagaacaaaacaacgccgaacaacgcagagaggagcaggccagaaggacacaggacgcggcgcagccgaggagagccgagaagggacggagagaagaaagggggacacagcgagcgcgcgacgcggagagcagagaaaacgccgcccacaccgacacgcacgaacaggggacgaccaaaccgcaccgcagagcgaagccaagagcacaaagacagagaacgaacacgaaacgagagcagcgagcgacgccgaacgcagcacgcacganccggcgcaaggccgcagaccacgcggccgaaaggccagagagaaagggcggcggcggagacaacggggcgacagcggagaacgcagggaccgaaacgaggacagcagcggcgcaacgagaggcaggcgngaacggcgagagaggagcgcagacgcgcctcgcgagaccacgacaaccagaacgagcccatcagggacggcgagaggcgcccacggccggcggcccaatcgcgccccaccgcccaaggcaacacacgacccgccgccagcggcgcgaaggcaacgaaggagagacacaccggcgccgcacgaagacagcgaagcgaggacgacacgccacgacggaccgcgcatcngagcagacgagacgcngcacgcacgccgacacgaaacgccgcgcgcagacgcaacaccgccgccgcaacacacacacggcgcagcacgcaacacgcgcatcgagaccacagcgcacagaccgtacgtgagagacgacatgagcgcgcgagagagagcaacgggncgagggtgagcgaaggacgacgcgcgcgcgacatcagnctaag

SEQ ID NO: 8624 - DNA, 1799 bp, Homo sapiens
  misc_feature (1)...(1799): n = A,T,C or G
gcagctcagttcacacgacgcttcgctctcnggttcttctatntatactgtgtgtccgccgaantacatcgcactacaggccccagtcgcgtgtatgtgtgctcgcagataggtatatgacgactccagccggcgaagctttgtatcgcaagagactcgaacgcgatcatactatagacgcgcgcgcggaggcggangaggcacaggggtcttgatgatgctctatcacacnaccatctatgacagtccgtgcggtgacgtcgagangangattgatgtgcattatgtgaacggtggagtcgcgtcacgacgagcgcaggtggcacgcncnagttgttagagttatgctaantccagcgcgcgaccgnctgtcggcgactctgtgacagcaatctgnacncgtgacacgcgagtacaggagtgtagcttaaagtgtagtctcatnctcgcctcgctacagcactgcagatctantagtcctgtgacaccgagntgatagaangcgtcgtgcgcagcatcanctagctgacgatcgcgcacntccactgtgtcgacgtgctcagcacagacgtgcagacgcagatgaacataaactgactagacacggtgatagtttacgtcgtacggcagatacggcgacgcncgcgngcntagacgtgtacacgatcacgacntgccacactatcgtcaacngtgtagctganagtgtgcntcgattggctgtgacgacgacgcgctgacgtcaccgactcgtatgctgcgctcaccactagcancgtacgcatgtcgacacgnacatccagcgtgctgtcgcgacgcgagntcanagatacagcccgcatatnatcgtgancaatgtcagacgatatacggaccatgacacatcgatctcgtgatgacgctcactatgtcgacgacggtatcngacgcacagtaacaatgcatagcagtactattggcgcanatcatctggcgtacgtcgacatgacataatgtgtctgatntctacgtgcaaagtgcatgntgaccgtctgccgcctgcgaagaaagtcgangagacanattccaatcctagtgcatctgcacacgagcgtacgttacatgagatcgaccgcactgatccatgcatggtgtacgctagctcacacagttgtgtatgctcgatctanctgaattctgagatacgcgacataactacgcgcgcgcgacgtgagacgccagactcgtggcacgatcaagatatatgatactatgacgatgtgtgtgcaantagcgtcgatccggcagcacgcgtcgagcgcgcctgcgcgatagtattgtttntcgantagcgcagctgcgagatcgncatatcgtggtagagtntatctgtcacttgagtcaagcgacacgttacgacagatagtacagcgagtactacgtgacgctgcagaccctggccacgagctacgtactgtactctcgtcntgcgttacgctgccgtctccacgtagtncngctccgcgtatcgngnagcncatctcgtgtaaagtcgcgcgctgctcgaancgcgacgncacgnagctctgtcagcagtcacgacttacacacgcatcnaggcganacgcacggctgctgcgagccaggtatagcgagatggtctattactgactantatgatgatcgtgagtcatgactaaagcatagattaagtatagaatgtcgccgtacttgtcgctgcggcgaggagcagacacgagtaagcacatacagngtatgcagcgtatcgcgtcgcataagatacatgaagagcgctgagt

SEQ ID NO: 8625 - DNA, 2003 bp, Homo sapiens
  misc_feature (1)...(2003): n = A,T,C or G
aaatcctgatgtaactcgatctgatctgctcgcagtatctgatacatcacagtcacgagcagagaggcctattcgtcgcngcngctcgacttcaactncatctcgactagtctacgcacagangtctctcgangatcgatgtngcaatcgtatanatctgctactactgctacgcgtnagtcgnctgtgccgnactgagcagacagtcncanctncnangcactcatatatcganatgcgttcgnnatctctnctgnactctatgattgntgcanctcanctgtcgtgntcngacacanctatagnatgctcatcgtcctatattagatgagtctctnctacttngtcgtactgtctgctggtgcatgcgacgtacaatcatgctacaacgcccnacgcacgntactgnantgagccagtcatgatgattgtagatgtagtgtcgtttgtngtatanattataanatanantantagncatactgacatctanaggtcatctcacactagaaanaccgcnacatgncagcngancgagagatgngttgcacgtgtgtctgtcatagtagcgcgangatcntangagcactgtctgcncncngctatgtangcatccgtaatcagnantgntagctggtgagtgacgtacatctctgaggnagatgcntaagatcgtgcgcgcgcacgctatctgatagnagatantagttatcactacntctgtgctttnatctgcatcgtcgtcgaggccgacgattgctgtctgtatagtgcgcgcnagcggangtcancagcatctgctcattctnagtataccagataattnaatacgcgtcancgcgantatacatcgatcacaactatatacagatatcagtacaactnataatctatctatatgatataaactnatattagccntcganntactcactactcacagcgccacgctagcatgtcgtctnctcgtatntnactgtcattacacgtantatccagctcgcggtatgatgacaangtctgctcagncacgtatatattcatctattacatccanagcacgacgtacagatacatcanacttatatcatcgcatgtcatgttntnttgntcatcgtcnantcattacatcgcgtataaactactgtctcgtatatatagttatgcnatncgacatcgtacatatatagtattnacgcatacagagcactgtatagcataacgctgncactatcgctgtaccacatgaatagcnagttccgncgaattactnacgngcatcgacgntctgagagtgatacacatctatgtgttgtnagtcgatcgntgtctcatatacacacagtnttgcantctatancnngcacgtacgcnctcngccgttgatccgtatgatgatctacccntcntatcgatgtttcttaactcntatcgtctncagtgagtacatgtgcctcgatatacgtatcgctcatgtctgcncgntacgacgtcgcnaatgctagtagtcgatgtctactacacgntcgncntgacagcactgaccgaacgatgatgacgacacatntcntnntcgatnattgcgcagcgacgtgcaggatctacanagtcantcgtaancagaaaactctgtgtganatagtcagtatacatgactgcgaccgctccatgacgntgatcgatancnacatgctaaagcgatganacacagcgtctgcatgtgtgagcgcggnganggcgcatgacgcgatnncatannactagtgacnnnananaattatttagtctacacattntatgattcantcatacatnacgacactttaatgagatncacntgcantcntnctaccataactatagattcgcgctccacacgacatcangtgacancttgcgctctctgtacacgtcangntactcacagctcgcactaataaactatacgactcaccgagtcactcanacctctagtacaccgtcgcgcgcnatacgacgtcggc

SEQ ID NO: 8626 - DNA, 1524 bp, Homo sapiens
  misc_feature (1)...(1524): n = A,T,C or G
gttgaaagagggggagggaaggagggaggngnagagagggtgaggaggnnnagggaagatgaaagtagnnngaggagctaaangcgcggcaacnaacagaagaanagaggcttgacaggcgcgnngnaaaacccgaggagaagangagagagcgaggagcgaggggcgcgagnaaggaagttctttaagtgacggggcccgaatgaaaggagacgagagacacgcgngcnncggagtgcgcgcgggtgtcgtatggtatacacccgtccaatcagcatccaaggaggattgtacgcaacgacccgacgacgatcacacacgagagtatcagacgcgcggcacagcgcgnccgcgacancggtcccagtcgagtgtgcctcctagcagcgctttccncactgatcgtcgctctcnctgtcgtcgtaaccaccacagctctcaccactcgcatctccgcgcgccgcccagctacgntcggccgctgcttgacgcgtgcagncgctgctgagagcgagtcgtggagtacggcggtcgcgagctgatcggtctcncgacngtgtgagtatgatgtccaccgcgagcntgtatggtggtggttgntnagtagtttatntccagtgtatacgagcagactntgtggacgagtgtatanagatatgtgatcgcgtcgantccacgcacgntgtccagcgcggtgaagcanacgacaagcgaantcacaatagggntgtcgcactctcactctcactgccatcagnactcgcagcgcgtcgccgcgacgacgcncgccgacgcggcgacgccctatnncgcngcgcgaagccgcgccacgccgcccgcaccgcagtatgacgctgcncgtgatgagacgtgnaacaagcagcgaccaccggtggtcgcattaggttggcgtgtctccgggcgtggcgtggaggagagagagagggcagngtagcgaatgagtgcgagctgaagtgnagcgaggaggagaggtgcggatgagacncaangtgntactgctcggcgtcgatngantgtagagantatcgagagtgtatgagtgtcanggntgagtaatgatatntatgagcgtgagggtaagtgnggactggngntggcaggtgatcgtcgtcagtgctcagaccgtctcagcacctgtatccgcactactccacgcncattgcgtggcgcgtgccgacggcgccgacttggcgngcgcgctccgacgcgcgcgctacgcattgtatgttcnaccnccgctaggtggnnncgacagtgagtgagtgcggtgagcgcgcgagagcgagacgtcgtcgtggtccctntacgcgacacggcagcancgcgacgtggtcacacgcgctgtgagtcantactcgcgcagcggtcgnctcgatcttcggcgcgacggtgtgatcgntcacaggcagatgatctgcgtcgcggcggcgcgcgtagtgacgagagcgcgnagtgtagctcgcgtacgtcgagagcgccacgtcgncagatgcgcngtacgag

SEQ ID NO: 8627 - DNA, 199 bp, Homo sapiens
  misc_feature (1)...(199): n = A,T,C or G
cccgtcacacactcgttnaaccatttngtggacngatntcnnntantgcacacnggaancatttcctagtaattgaactaacntgtaggaaaaaatcagttaagaaacggcgcctggcncctatgntcaagggaattncccacatcncaccatganaaagtttgatctgaataaacnaaaaaaaaanaaanaannaana

SEQ ID NO: 8628 - DNA, 1751 bp, Homo sapiens
  misc_feature (1)...(1751): n = A,T,C or G
cagtataactaactaacgactgatcattcactagctcgtgtcngatctcatagtatcatgagtagtgtatagcagcnctatcgncngttnggagagngagacctatgtcagcgatcgacgcacaccacanctgacgtctngcggacgtgtgatctatttcgatggtagatganacacantactgtaccatgttactcgagtatncaccagtagtgtatattgctgcgagtagcacaacgaactgaacacgcagctcagtcgcntcaactgcgcttatcacttatagggtgcagaggaggntagagacgtgtaataacanagtatacaggtgatgatgctangcagngagatgatataatgngcacactctggtacaactggcngatatgaggcgtgctctcgacacactcagcgcactctcgccacgtgctgcggngtatgtagctgtgnctnctntgtgctgcgtcgcgattagctgtacggatgatnactcggtgnacatcggcgtagcgcgtaggagtgtgcgctcggcgtagacgcgctgtgcagtccgagaggtagtgctatggcgacgagcggactcctctcgcgtcgtcgacgtagtcncatctaacgtctatgatactattagaccgaaccgttcaccgtgcgtgcgtcggccggagccgcagagtggtcnagacgaggagggacacgaggcggagatgtgtgtgcgatcgtggtggacgtcaggtgtgagttcgtcgtaagtatagtgtacggaagtgtcttactctggtagtattgtagtctatatcagtacggctttcctgacggacgatggagcgcgctcatctcgacgcgcacgttctcgagctcatacgagcattattataacgatagccacacgcgctacgtagatgcgggcgcgctacaccacgtggtcgcggcagacgtctcactctttgacgntcgantctcgtgaccacggtgtcgtnatatagnagtgatctgtgtcnactcacctcgtgactgtgatactagtcgtaatattcactctagtccgagcangacacgtcgcgagtgntataatgaggatagcagggatcacacacgaatatctgtgtagaactncatacctcagccnatgacatcgctgccctctacactcancgtagtagagatgcgccgcgcgagagatactatgtagacactgatatagtagtgcagatgagncactcgtcaatagaatgagtcattctgagactaagatagagatgagtgacatnatattacttagtggtgtagtatgagtagtaacagacgaggataggtgacaccgaccgaggcgtggatcgtgtgcgtcgtgtagtcggtgcgtctgtgcgagtgtgcgtnacgtgtcatatatacacatcttctcttttagtcatacatagtatcgagtgatcgtntgtatctcntgtcttggtnctcagccgtcgacatgntacanatantagtgntaagatcgctagaggacgtctgagantcatanagatcagtgacgtacgcacgcacacatatagtaagtgcatatgactgtgcncnctctgtcacgctatgacagcgtgttagtatcgtgacgngttnccagttagtgagacatctagaccgagcataccancacgcgcactcacattcgagatgagtctataagtattcgtgatagtcgatcatagtgncgtagcgcatatatcgtcatctcatcacactgctgtcacgcacatact

SEQ ID NO: 8629 - DNA, 1172 bp, Homo sapiens
  misc_feature (1)...(1172): n = A,T,C or G
gcgacgcccgccccgcccttcgttatttcgttcgcggtgcgccggaccccgccttttttctttatacacttgtcgccccgcgttttgtcaatcgccggcctcacacgtatgccgcggggggtgggggtgtggttatcgatcgctcttattccgttgattccttagggttgttatatcagcacttactgcatgacggggccgcgggggtatcgaaatcatgagcgtgtgtttttacaatcaactcgagcggccggacgattagctcgcagtctacggcggcgtatctatcccttaatgaatcgtccgagtgctcaccgctgatggcaagtgagccggatcgggcgtgatctgtcgcggtatagttgatcgcgccgtttccgccctcttgtgcgtagtagccggacacacacaaggtcgccccgctcgctctacttattctctaacggcgacgaccacctctctgctcgacaaactattgtggccggcggtaacactgctgtcgcgctccgccctttatcgtctgtatttccctctcacacagctaggcttcggccggtaacgccaggatgtagagtggtttagaccgccgcacatggtatgagtacctgcagtgcagcactcgctcctcggccgcctgttcccttagccgtcatatcccctacttctggtgttctatgtgtttcgcgccttcgatctgttccgcccgccatgtaggtatgtcgaccccaccacacacgcacgcactgaccacgctccgacgactcttcgcgcgagtggtagcaagcgcttgaggcggatcccacgttcctactgacttatctccccttgatgcttcgctcgcgacacgacctctcgaagtccgttatcctccgatcataccggattactcccaatgatcacccatgtcactctcgccagtgcgaacgcggaatcgtctggcgtggctctctcccgatgctcgtcgaaggtaatacatcgatatcacgccctccgcatgggctgacctatattttgtcgcttctcgtgtaacgccnaaatcatgattgcgcactcgtagacatattctcacaacccactgtgagcgctgcactgctgccatggcatcccgatggcgatcagatatactggtatgccacgctctatcctcgagacgattgactcatcgttgaacg

SEQ ID NO: 8630 - DNA, 1023 bp, Homo sapiens
  misc_feature (1)...(1023): n = A,T,C or G
ggcaccgccgcgccgggtatcggggccgaaacggaagagggcccttatcggtaaacaagaaggcaggctgtggggggccaccccaagacagaccgtgggagaatgaaagaatctggatctgcacccggaactgactggctcgcacccgctaagcgccagatatgcctgtagccagcgttgtctaaagagcgaacgacgccgcatagcaaagatgaccgaggagagacattgagcgcacaataacggaaggggcgatacgcggtgaaaaccgccggcagccgaaaggaggcgtttgtatccgaaaccgcggacagagaaccgaacgtgacgagcacagcggtggcggaagtggtagacaaaactgcccgccgggaccccaaaaggagccgacaagccatacaggaattacaaacacggaggaccgttgacgaggagcgcgccaacaaggacaaaagggcagaaacggagaggcaccagcgacgagtgggaggcgacgggcgaagggcgccggcagcgaggcagacgatagcgcggcaagccgcgcaacgcaggagagtctcaggaacgaagacacgcgcgaccgcacgcgagaagggtacaagtgcctacggcacgaagggcgggcgcgaggcagacgcacccgacacgaatggtcacagcgacgcgcagcgacgaggcgcgagaacgcgcgcacgtgagcgaccgcgagggaggatgaatacaggaaatacggagaaagccgtgagcgggagaagcgggagggcgagcgcgcgctaggcgcgagagtagcgtgcatggcgcacgcatcggacagtgctgaacgtaagaaaacagagtcaacaaccactgccgaagaatcagtacgaagtggaagcagggagagagaagagcgctgagagtcggtgaagagtcgcctcagcgcggagccgcggcataccacgcgtcgaccgacgagcgccgacagcgcgcggcacgagcggtcgagcgacnatgcagcgacgacatgggagccgaaaaggcaag

SEQ ID NO: 8631 - DNA, 1465 bp, Homo sapiens
  misc_feature (1)...(1465): n = A,T,C or G
gagaagaaggagcaagaagggaagnaagcagaagacaggccgaagaaaaaangganaagggacttagaccagaaacaacaagaccaagtttcgccacgaacaagaaaaacaagaaggcacacgaaagagaggaaagacgaagatttttagcgcctgcgcggaggagagggccgacggggcaggcggccgcggcggtctccgcgtccctgctgactagcgcgacgtatcggtccgctcgcggggcgttaggaggcggaagtacgaggggtgagagagacacgtcaagagagatagggagactgagggtgacaggtgaggnncgatacatattaaactttacgataagcataacacattatcacccacctcacacgagcagcggagcgggcggccggcaggaccgcacgctgtggcgagnctcaccgccagccgccaagtggcgccgatgacgcatatgtaacacgctgatgatattaacgcccgtcctccgcagagagantgtagttgacagcgggccggagcgatgcgtccangtatcgttgcccgtaaggctgttagtgtgagagtcgacgcgcgcagcgtgcgccgtgtgtcgtcgagttgatggcggcatggtgtggcgcgagcagagcggagagacgagagcctgagaccggaggcgacacgctggcacagctgtactgtcgtacagcaccgacgcgtcacagctaccactcgtgccacgaactcgtcgcactcgctggcactgcnagtcgatgaacgtctctccgaccactgtcgagactgctcgtactgtcggcgcgacgggagatggttgagtacaggcgatgacgcacgacgagtgatcgggtagatatgtgcagtagctgccagtctgcgagatcgtggggctagagagtgagtggagtgngcgtggtgtantcgcgacatcgtgnatnatacgaggtgtgtgtgacgacncgntatngtagctgcatggagtctacggagctggcnggtgaatacgcggtggtgacagcgagtgtanataatgactgtagcacngcgcgtatactcgcaaaccgtgtgcgcggctgcgcnccctgcctactcggngaccagacgcgctatcgacagatagccgacagcgttggtactacgagcgngtgacatagtgtggatgcagaggcgcgcgcagcacgcgagntnggatggcgagtgcagatgcgcgagnctgttcgtgcgctggagtatgtgtatcgatcagtgcgacgatgagcgagagannagcacgacacgtagcagtgtctgcgaggtgtagaagtgntggtaggatgtatgagacgcactgcaatactacgatgcacgcagcatctntgncgcggtggagagggcnaccgncgacgcgcgncngccgtactgcagcgctcgcgagcactgtacaataacgaagacgtccagacgcagagtatacatagaatgcacg

SEQ ID NO: 8632 - DNA, 636 bp, Homo sapiens
atggagtttcactcttgttgcccaggctggagtgcaatggcacagtctcagctcactgcaacctccgcctccccgattcaagcgattctcctgcctcaacctcccaagcagctgggattacaggcgcccaccaccatatctggctaatgtttgcatttttagtagagacggggttttgccatgttgttcaggctggtctcgagctcctgacctcaggtgatgctcctgcctcagtctcccaaagtgctgggattataggtgcgagccacctcacctggcctaaacatttacatttttgaaattaataactgaaaaaaaaaacatgcaacagatgttaggtattatctacatcagtggtcttcacatttttgttgatatacactccaaaaaaaattattaaaatatttcctttttgttagttttttaaattggcatctaaatttttatcatatatgtgaatagagaaaaaaatttaaacttctggcatattagaaatggtagcattacaaattttaaaattggagactaagggtatgtaatgtcaatgaaatgccaagcaatttgacactctccactgtcattaaaacaataaacccttggcctcgtggacctcagcggtggagctctgctgtcatg

SEQ ID NO: 8633 - DNA, 1932 bp, Homo sapiens
  misc_feature (1)...(1932): n = A,T,C or G
cgcagcagatctgccgccacgacgccacaatataatgtgtgatgtgcgagtcggccgtaactcacacgagntagatgcaccccgcaccttattctaccacgacattctacgcgcggactacgcctcgcagnagtactactatatgttctggacaccatctcagctcagcgctccgtagacgacgcgacgctgncgtgcgacagtgactgaagtagcacttctntgtgaactgacgatacgacgcgnanacgtagactangagacgcacactactgcgagtgctctatgatatcctcactatctctcatgagtgcgacgcnagcgcatctgtagtcctcgcgctgcgacgagagcagtgcactagcttagcagtcgctcgcgctcgctgatgcagctgatatgtacngagcatactgagnctactgtcgaggataattccacagatnagtgggtgatccgcgctcaacggctattatcgcggacaccgacaatgnacgaatagagcnacaacagcagagcgcacaccaccacccgagtcgccactgacaccgcagctccgcagacgatgacgacagtatagcgacgaacgtgcntggctcatgaggatcacgcgtcagactgatagcctccgatcggtgtgcgctccgagccntgacactgcaatgatgcactgtagagagaaacgatgactgcgacggatcgagaggacgncgcaagagcatgaatatgcgtgaataacacgcgtacgactgcgcgcggaccactcgaatcacagacagagagacgaactatgtgactacacgncagagaagacggacgcagtgaccttgcgctcgcgtgacacncatatcctgcgcgatacaccgatgtagcgtgtcagtacgatctcatgacacagtacgncgatatcgacgaatctgaacgagatctatcgtgtcatctgatgcgctgagtgagtatgtcgataagacagacagtgcaagagcatatatcacgtagcgtagagtactgagtcgcgcagatcgcactgacgcgcgagcgagcccngcgtaacagcgagcatagcgcgtcgcgacgataccgagcacgagngagtagtcgcgacgtacgtcgcacancgagcanacatagatcgatgcccngccgntaatcgctcgctcgtatagngatcgctcgctccncngncacgtattgtacntgcagatgatcgatcncagacgcgtctgcgacgaacgccagcgatacanctgatcacgagcgtcgngaacgcactnagcgcacgcgctcacacacgaatcgcgcgcangangatcacttataccggatgntntcacntacgatcgactcncagacagcacacacacgtccgaatgtgcgacgcgtacgcagagagatcggganaatngnagctgatgagacacgctaacgaacagnatnatgacatatatctcactagcntatatcattcacgacatatgcctcatgcnacagatgtagacgagtaccagtgacgctgtntagccagcacggccgtcngtagatncnagtatangatgacntcagcgntcgtcacagctgactcgtgcgcgctagtatacagcgcgcgntgctncntcgtgtctcagaacgcattgagcgcacgncagncgtcncnacgacacacgtngcgcacatcatgatangacagtnacatcgtaatctgaatacgccggtcgcgtcgacagtacgantgacgcngcacgacgcagtatgctaacatagtncgtcagcccgactgcgagcgatcgtgtagacgcganagcagacctatctgaggtgcagcaacaagtacacatagtacgcacatagagacgcncgtcgancacgagagataacacgctagaacacgcgtcccgcacagggcagatatacgcganatatacattcacgcat

SEQ ID NO: 8634 - DNA, 854 bp, Homo sapiens
  misc_feature (1)...(854): n = A,T,C or G
agaaaagaaaagagacaaaaaagcacacnccccncttgaaaccaaaacgcacacctgcacaccatccactgcgcaaaacttgtgccttctggngggccagtagccatttccccttcacagtgggactaaagacacttggcatctctcatctggcacatcattccaagaggggctgttgatctcaaggaagagcactaggaagaatgaatgaatgcatataaattcatcactgactgaacactcaccctgtgccaggcactgggaacacagcggtgccactgggagattatgccctagttcttgcgccgactccctgctttttgttaaatattatcaatcaatnatacgtactcgacgcaaggcgccaaggtggatgtaccaatctctgtaatgtacgtgctcctcgtggaccagggaccagtgttggcctcccctcaacctccgagccattctagccccctacgtccatcgcttcaaggctagcgcattaccctcccaaccctacggtatccctatcatgcttttatctcattatggttacttcctatttatctacacctagtctttgtctaaacattatgttcgataattattttgattattttattcgtccaatgcacctggcgtagacataattccacgtccagcccccagcccccctcttctccccacgtttaacacctccccctcctcctactcaccccctaaattctctatatacgtgctcaatatatttgctatccagacagatatcagcatagcccacaatattaaacacaacgcaagtatcctactattttgaccgcgtcatacccccgcgtcggcctcacgatagcagtctcagtaatctatgg

SEQ ID NO: 8635 - DNA, 789 bp, Homo sapiens
caattcttaaaaaggtaggtgagaatgtaaattaagtcttaaaagaaatttagagcccagagaagttttaaaaaatgggcttaaagggtccacccagcttaggtgaagggactgataaatctccttggctgtggaatggatcccagagaagctatacttccagagaatgcactgatggtcagcttccaatcatagcagtcctttgtgggactaaggttaacctagacttactaattcccctatcctggagaaatatagcaacatagtcctgaaattattttttttcatgtgtaattgctgatattcaataaaaaaaattacagacatacaagaaggtactataataaactaaggaaaagtacagaagcagacacagtggattcagatagcaaacattatactcaattataataaaggaattaaaaaataaatgtgatgatttaaacagaactggaatgtatagaaaaatagacattttgtaactgaaaagaactaaatggatgggttcagtagcagattagacagagctggagaaagaactagtacgctggaagttagatcagcgaagcgtgaagagaagagactggaccacatggaaaggaccctgagcacaaagtctctcatgtccaccttgctcatttaaggcccagaggttccacatggtctcgtccctgcacctctctcccagctcacttcacctttacttcttgtcttactctattcctgctgctataataaaattataatattaataaactataataattagatgtaaaaaaaaaaaaaaaa

SEQ ID NO: 8636 - DNA, 1214 bp, Homo sapiens
  misc_feature (1)...(1214): n = A,T,C or G
gccgcgcccgcccccccatatttttttggttccgttattccttgtccgccccttttcactttaatacagcagccggatgtgttttatgcgcatacacccattcccgcggtggggaggaggtgtatttaaatttaattaatgagctcataatttatttaattgtaatttcgctagcgccagtggcggctgtaatgtaacattcctcacctacattgtgcatatctattatgagaccggacgcgtgtcatacggacagtgtgccagacggacgtgtaagcgtcatttcaagtggaattttctccgtggccttatcgagtatcggtgttgacaagcttaacaatcgcgcagtttaatatctccatcctccagacgcgagattagagcttcgaaacaaattcagatcgtatatgcgggtattagttattaccacttcttgttcttccgtcatcgttcgacaaaacgatttgacgccgtaatgacgccgtatacggtcagttctaaccgcgcagctccgctttttgtgctctataaatgcgtcaaacacaaacattaagagatgccgttaacgagtacacagtgtcctcatcatacactatataggtatcttgctgccggtaaccgtttacttcttaacttaataagagtgtaattgaggagtatggtatatattttatcccgtatcaggttgtgctgccacgcgaacacgtttttgttgtatcgcatgtatacagttcggtgactatactatgtggaggttggagaatctcgacctgcgaagtataaaaactcttatttcctaagcaagcgggcgatgagtagctgcttagtatcttatcactactcgctacgtgagcgccgcgggtcgatatagcgctacttatagccatcctggctatattgacgacgataattgctaaagaccgctactacaagtattgattgttaacgatgagacgctatcgacgcatagcgtacttcgcgcagtaggagtgatccgatctagtcaacgatcgtatactatgttatatacattgctatgtcgatctcgcaacctgttgctccatccttcatgctatgttgctgtacgcgacacaacagtgtgtgccctangctcgatgatcaggatacatacggagagcccgtcgaagagagctatgatactaatacatggttgaattcgtgctctattataacttacgagacctgactattat

SEQ ID NO: 8637 - DNA, 1614 bp, Homo sapiens
  misc_feature (1)...(1614): n = A,T,C or G
gggggaaaaggaannnnggcagagnnggnnngngnnnngaggccagnnaacgttgnnnnnagaaggngnnnnngggnnnnnacgagannntnnggcggnngnngnnnncggngagnnannggncncnaaggctgnccnngcgtggnnncgcggtnggtttcnngagtgnntcgtcggacgagagnnntnagtagnnnantgtctggtggacnccgcaggcgatgngancagtggntgcgccgtgncnaacgaggtgagaggaccgtacatgacacgcacagcgatcttcacatgtccgcaccagtatgctgctcgttcnattcgtgtggcgtggctggcttccgcncgtgttcgcgngcgagtccncttgcgngtcctcgcccgggcgtcgtccgcgtgacgcnccacgcacagacatgtcccgcncctccgcgaataccgcgcacgacgcacagcgccgcgccgcagcgagcgcgcgtagcgtacgcgtgcccgcgcgccgcnacaagaccagcgagtcttcagacanccgcacacagccacacagaatacccactctctaagtactgctgtattgacatccacagtgcgaccgccacgatgcctcagtatagagttatagtagaagtagcgtgcgtgccgtgggaagagaacgttgatacaggaaggtgnagatagcgagagcgttgggccgacgagaggangcgcgaggacgcgcgactcatgaatcacantagatagtgctgagtgtacagtngataccgcagaggcgacccacgccgcgcgcgctccgctccgcgcctatggtgtntntattgcgcctctccacgtatctantctntcatacttcacaccttcgtccatccngcgtacacggcggntatgtcggtctcgagtctctcttacgtcgagcaacncgantntatatgactgagagcgagcggacgagtangcagtgttgtaatccanatgtagaggtgttgtangtcgtgtnantagatggtgatgcagctggagatgtgagggtgantagcgatatatgacgatgatgtcgcttaagctagaagtnantgntatattttattaggataattaggtcttatgtcgttntaatcatcgtctctgaatacgatccgtaanagacattagatanntatctntaagatgtagctcacatgttcatgtcgtgcgttcacatctgttcgcgctactactacgtatgagcgcggcgaatcgtatacatgcgagcgtgtcataaactcngcgagcggagtcgccgtccggactacanatccgcgcgcgcgacagtctcgagacntactagaagtagctgacgcagcacgtcngcgacacgtgaagcatgcagcgcgtgtgagcngctactcacgtgacganacgcgcntgcgagaagttcgtgcgcacgagacgacagtagttacacacgcatggaaggatctgcnatagttctataggtctcatcgaaggtgttctncnatactagcgcggatacgantctatnanatttaaccgcgacagtgacatgacgtcgcgatcgcacgtcgtctctcacgcacagcgacgtgcacacgtcgcgcgttgtctcgacgactacgg

SEQ ID NO: 8638 - DNA, 775 bp, Homo sapiens
ttgttgagtgtgggatctaataaaaacaacaaggtaaaggggcgcttttaaaggataattatgatcatttaagttcagaaattacaggcagagaggaagtaatagaaaccataacattaagaagtactcttttaaccaatcatttaaagaaagtttggaccctcaaaagaggttaaaaaatgtgcaaagtttcattgatacagaataaagaaatagatcttaacctcataaaagaccttaaaatcaatgtgaaccatccacccttcttctgcatccctatacaagatgtcattaaaaaggctgtcctgcctatcggatcacagcactccgtctttcaaagagaccattacgtctttagaaagccttagagttatccttatttagtttaaaagtccttccttatattgtgatgaaatccttcgatcactttcacccctggggacatatagaacaaatgtaatttcttttccacatgacagctcttcaaatgtttgtagacagttatcaaatcccccctgagtcttctcttctccaggctaaccatcccagtctctgcaattgcttcttatataaatacgggcaggaaaataaaaagaaggttagatccaacattttcttgccccaagccatattcaactcatattaacgctaaccaacacttttgtttttaaaccttgcactgtatctaatgcgcccttttttgaggtgtgttgattttgtctttacacatagattaaagctaatttggagaagaaaaaaaaaaaaaaaaaaaaaa

SEQ ID NO: 8639 - DNA, 1905 bp, Homo sapiens
  misc_feature (1)...(1905): n = A,T,C or G
cgtcacgtctcacggccgcgcgtcntgcacacgactcgatgcgcgcactagcangagtattagagactcagggcgactatacgacgcgcatatcagcgtctacttctttagatcatcacagcagcataccacacagctcgatggccactcgataggcatcgcngtgacgacacacgtgtgacgangacatantgcgagtgccatgcatcacgctgctcgatagcctctctgtatgtaccactcgtacgctcgcacatacagcgtcagacgtggagcagtgcctcacttgatgcgcggatacgcttgcttccgagtgcgttgcgcncaacagctacgnatcacacgcacatcgggtnaccgtgtgatctctcgcnctgcagcctncgcgcacgacncgcccnaccncaggcgtcgaggacatgcgcgagacgctncgcagcactgatcccgatactntcntgacacatagcctctctcgtactcgctacctcatgtagttgcgaaatantntactatcagctactgctactctctctatactacacagtgtgtgatacatcgatatcgcactgcgagcgcacgtacgcggcgcacacgtgcagtcgttgctacgcacactcacgctgtcctagtgacnanacncaccngatgtaactatatangnagagagcgagtcagtgtgcgtgcgcantgcactgntcgcgacagcgatctcgtatcatgcgcacatccgatggacgncntancatgcatantgcacgtcactagacacagctacatacatagncnatcagactgcaccatnttcacgangtgtctcttcaactgatctgtattctagtatagtgagtgtgcatcngngatgatgagtgcagaccatatgcgtatcgaatcgcactataagcgctcaccgtacggatcggcggcaattcatatagcgcaatgtcatacactatctgacacattacnatgcgtgcagagcactntcganagnagcgacacacctagagtcagtctatataatttccncactcccacaggatgagtatagcgtgatgagtgcgcatctatacacatagtngctgntgcatatttgtgnatnttgcaccncnacacagggctctgtataggcntntgactgatcatgtctcaaataatgcctatgatcctccncncgtgtcccgntgactgantgagtagagagtcactgtatatantcagtcacactctatctgaactatacagttgcgctcgcacagagcgatcgtacggngacgtnaccnancgtgctactatanattgcggatgtcgatacttncagagancgacgacatgtnagtngagtgcgcgacacgcgcgcgtcactatgacgtccacctcgctcgcgccaacgacgcaccgcgncgctcagtcgcantcncgatatcgcgtgcacatatacacacacnctactaatcataatgagatntncgtaacgtccnatcacagaccactagtcncacagatgctctcacgacgcgtctcgagcgacatgctcatcagacgctctacacntagatctatatcntcanngacgtnactcactactcacatacacactctcgcacacacacgcntcgcgcgtgtacgtgaagcactgctgccgtngcggcgctgnatccgngcgcccgcgtcactcactgcgctgtacatatcactcagcacgtatcgcgaccactcaccacaccccgtctgatggctatactcgcttcancntatatcgcccncgtcgcgcgcgatcttcaatcagcgacgacctcaccanctccgctctatctgggtattcatatatgagtggcaacgcgtagatggtcgcgcttcttaatgtagcggcccgacctacaccactaggantatcactccgcg

SEQ ID NO: 8640 - DNA, 469 bp, Homo sapiens
  misc_feature (1)...(469): n = A,T,C or G
acacacacaaccaccccacccacctccacccaccacaacgagcccaaacaaacacacccaaaacccccttaagaaaaacaaacaccaccccccacacctgaaaacaaaccaacaacccaccacaccccacacccccaccaccacccacaccaaccaccccgcccccccccccgcgcgagccgccaccgcgcccaaaaaaaaacaacaccccccgcacccacacccacccgcgcccccagcacccaccacccaccccacccaccaaccccccgcacagaccagcaccccacccaccccccccccccccacccccccgccccaccccgcaacacacacaccccacaaccccacaccacacccaacccacgngccacacccacacacccaccctcccctctaacaacgacccgggggggcgcgcgcccccccccccccccccacccaccccaccacacacaaaataaaacaa

SEQ ID NO: 8641 - DNA, 937 bp, Homo sapiens
  misc_feature (1)...(937): n = A,T,C or G
gttcacgtgactcctttactgccttagctgtttggtcatgtctgaactgctgctgatgaagccttttctggcaggttgcccggggagcagctctcctgtagattccgcctctctccaggagttgcctgccttcagtataatgggcaacattgaaagcagcaaggcgttcggtcgacaaggtcagagtgcctttcattcctgcaataatcaaccagtgtagctcttcctcagacctggggagagagaagatagaggtcaaaagagcaattacatttcacattgactccagaaaaggcctggatcacaagactgaaaagaaaaacggattctagcctcattcttatccattccttttctggccatttttgttattaacactgccctgaaaccataacaagttttagcttgatgacgtgaaaaacgcattttctgcctgcagatgagatctttcttcttagacatttagcactgtcagcatattgcaaaagaatgcaaatgagctgcaggatctataaccagagacagtaagctaaggccattaattatgtgtttaagaaatgttaaacctagcagactgtataacaagcaatggtgcctaatttaatctcgaatcaagtccaacattaacatattcttatatattaagcattaacgcaacatttagaaaataatagttaagatggaaatgtctcgaattttgccatggcagatggttagtacaaagctaccttgattggaccttacagctggccagactaattgctttatatgtatatttcgcctgaccatcctggggttaatgatntttttgtcattttaaccatagacaaaaatagcggctgaatcttacatatcggcccagcgtacttctaatcccctagaatttgttggattagaaagccaatataaagaattgtcatgtcaaccataccatagt

SEQ ID NO: 8642 - DNA, 786 bp, Homo sapiens
  misc_feature (1)...(786): n = A,T,C or G
atttggtttgtgcgcgagcggggggatggtagagggggggtggggttatgttatgacgttcatggatgggtgggaacattaatgtattatggggtagatggcaagagtgggccgcgaaaagagggctgagaaaggggacgggtagtgtatgagttgggggtggggcaagttatggttagattaaaagggtgatggagggagtaggcggtttgtgagcacggaggggttaaggtcttcaggtgatagcatatgcgggatcgggtaccggaagacagacagtttaggcgctgtgtgtgaggggagtaaagtgttgtagacatagcaggcgggtactcagatggattggggtaagagtaatatgtcggcaaggcatagcgtggataagtgttggtgtaggtgagcatgagtgcaggaggtataataatgcgattgagctgggattggcggaggagtttgcagagagagggtagatgaggaggggcgacctgtttgtgactgtacagactgccagtggcagttactggaaatgcattgattgcactgatcattatggtgttgggtataggtagtgtgcttcttcanccatatgagcagatcaagtctggctggatcctctgtagaataggccgatgctcctttctgaatctcctttgattcttttctgcattttgagagcccagataattcacagattgctagtgttctcactgagaccatgaattctgaggagagctcttgaaggaaataaaaatctgtactatattactgtaaaaaaaaaaaaaaaaa

SEQ ID NO: 8643 - DNA, 1726 bp, Homo sapiens
  misc_feature (1)...(1726): n = A,T,C or G
aagtaaataaatananngaagnnaagaaagannncacccagcaacnncaaccncntcgtgagagaaagacacaggcagcaaacatttcttggagccacaaacaactccgttagacngaccacacagaacattgtcgcacgnactgttatagaggcagcgcgtcgacatcacaaacatcgtagcnacgatcactcacacgagtcnntnaatagcttgngttttttatcactctgcgctcacgagtcctagagacnccacatacaacacacagagacgccaactaacacgctgtgcacatgcgtacagatggcgagataatagaacgcactgcgtctgactcatactatgttatgtatgtntatgacatgtgcntaaatgatgtatctcantgatttcgacatntngtntcatacacngtatntatgaactgacactancagcaagatgatagtgtnaggtgaacgcaggtcgacccgtgagttcgtcctcacgcaaagatgacagagaagtttcgagagtaagnatcgaggagacanagacatacgacacgacacatagatctacaggattganntgtaagacgcncgaatgctacatgcgtccgtagagtcgcacagagaaaagagnaaatatattatcgcacatagcttctgatcgacacgacatgngttagagtagtatntaanagtgatctatatcgacgcgaggacgacgccgagcgcacgcgananaggacgaaatagtcagtacaatagtaggaattagaatgcgccacagaaacgcacaanagctagtgcantagangatgnatcgcgctggcagatacataaactggagaacaangngtgaaggncgtgtgacgcacgagtgtagtgacngtgaagagacgcagtgagcgcgctncnacgtagcaggcgagccggcacagatgcgcagtnangcgcatgatgagctaactanagaccnantatcgacatntagtatatagtgncgagncgantgctagagtcacganacacgnaantntnctagcacaatctatcagatgacagaacttacgtaatatananacatccacacatatatgaatatatantactgatgatattntacactanncactganctgtcgaggcacacatnctntnacaantatcttgacatngaantgtactcntatanacgagtacacatatcgaccaacttgntagaantgagtacnacngacgtgactagtgcgatgtanntgacattctgtacntattcgtgcacacgaatagagatacatggaggctgatggcgtgcancgaagcgagacacgtacgtgtgtatnacaggacganctcatatgcagctgacncntacntatctcacgtcagcaagcgaagangagcacatacgcatgtgacggtgatacgacgcgacatatagacgataatgtatacggatgtgcgcncgcagaaatgtacgancnntgncgagactgtgagaagtgngtccatcgccgtatcgacgagtaacngtgcaggcgnncncgacagcatcagagcataacgacaccacgatgacacaactcacggctagatancnccatgtcacgaggcgggccaagagtaagctacatctgtagataccgcacgcaggcgacgctacacaanagagcgcacccgtgcaacagcgtacgacatgtantacgagcgaccacatggactatatatcgcatgag

SEQ ID NO: 8644 - DNA, 511 bp, Homo sapiens
ccaacctgataccagatgcatgccccacgatggagtgcactaaaatgacacagcatcattcatgtggtatttctgccaaaaatgcatcacctgaatctcatcatgaggaaaaaaaaatcagaaaatcccacattgagggacttcctgtagaaactgtcctatactcttcaaaaatgtcagtttcatagcagagaaaggagattgaagaagaatgaaaacaaaatgcaatgactgatcctgggtgggatttttttttttctgtgaaggatagtttgggaagaactattgaaatatgtatattagatgatagtaatgtatcattgataatttcctaaacttgctagttgcattgcgattataaatgaatatccttgttcttagaagctactttctgaagtatgaagggtcataatgcctgtcatttgtttaaaatttcataaataattattatggtattcatctatgtgtagcaataaatatagatatattgaaaaaaaaaaaaaaaaaaaaa

SEQ ID NO: 8645 - DNA, 1347 bp, Homo sapiens
  misc_feature (1)...(1347): n = A,T,C or G
ggggaatgtaggggggagggggccgaggagcagaaccctttaacaaatattggtaaatcttctacacacttttactctccgctgctccaggctgcgagtgcaataggcacacgtctcaccctcacacgcaacactgccgctctttccctgatctcaatgcagatacacatcctcgcgcgtccaacgcgtcgccaaacgtcacgcctntgtggngatgtgacgagagtctgctcgcatcgctaggcgatgatgagttgtgtcctgtgatgatatgcggactgtctcgtgatacgtgagagaaatacagagggtgttgtgatgagagagagcaggaggacttcgaaagtactgggaattgtcacgagactcccccttgtaacgccaggacggggagtgtgccacgcaagacgagaacgcgagagtcagcacgtgacgatacacccaacaagtcacgcactgaatcgaataaataatgtctcgttntgatgcgtcgcatactacgtagttgattataagtgacgcacctatgcgaagaactagttgagtttgtgtggtacgctcgtcactcttccatgacacttcttantactctcttctactgtcatcacctgtgtcgtactaacttatcanattagctccaccatacccctcctgggtctagtttcttcttctactctctatcacatctctcttcgctatcttctgtgcggctatatcgtcctcacatagcagtcgccacgactncttcgtgccgtgtcanaaggacagtccaagcggctagaagacatataggtncaggctagagttgatattatagtgatagtagtgtgatgtgcacagaactgacgaatcactacgatnatagtatcttatgtgccgngtatgatgcaaacantagctanatatgatggtanatcgtacaatgtaatcgtgcggcgatgagtgagttgtcngtacataccatcgatactctagattcgatgtctgagtaatatatataacgaagcntcatcgaccagcgctgagcggttatacggacttatgattgtacacatcggtncatcgcacatagtgattctagcgtgcggctacgcgcacgtgatggtgtgagcagacatcttataccatcctttacananctatacgttctcgagtgatacgccctcactacgcgcttctacgacgatcacatcncgcagcaataagtcatcacactatagtatgcttactgaatatatgtctgtgtgtattntaatcacctacttatgtctatcattgctgcgncacgcattatantcttactcatatgtatatctgtctgctcgaccgagtcgatatatcatatcg

SEQ ID NO: 8646 - DNA, 1537 bp, Homo sapiens
  misc_feature (1)...(1537): n = A,T,C or G
agaggtaaggagaaagagggagagaaaagagaagagagaanaganaggagcaggaggcgngtgacacagnnaagggagagaacaggaagaancaagaananaaaaatggtttttagacggagacgagacaccaaaagnaaganagatgagggtcttcaaacgcgngccggagcaagcnacgagacgagagagagcagagcaaggcagagaagacgagcacaaaacacgaagaantttgagaacgcggcgacgggggagagcgaagcacaagcacaggcggcgccagacgctcgcggaacctgcgcggcgccgcactcaanacacacacatccacaccaacgagagtagaggtacgacgccgccgggactccactccggcggtacaaacagangtcagacggagananagagaggacgagaagaagaacacagagagaagcaaaacgagcaactgacanacaatcaacaacacaacacaacaacaanaaaacaccaagacccccacacaatanactcacacaccccacacaccagggcgcgcgaccacagtcgcaagcggacacgcagaccctcggtagaggcangaaagagaggaggatgaaggcgnggngagagagaganacgcgccgtacggacgaggcaaggtnagcgcgacgcacggcgacagacggccgaagcggaggtaacagaggaggcgaatatagacgagaagagggcgacgcagccccacaagaaagacagaaggcacgggcaagacgcgcgggctggagcgaanaacagcagaggcgccactgcgagagagccgcatcagagacgctacagataatccaccgcgcccgcacccaccatacgcccacacgcgcggccgcgccgcgcaccgtccggngccgcagcgcacggagaanacgcgcgagtgctaacacacgcacctcgtcgagngaggaaagctatgtcaactagtacgcgtagtatcgatcgtgtgaggacgcaagacgcgcaagacgcgagaacatagcgacactacgtaggaaagacgcacacagtgagagnganantgtggtgataatgcccnacnnctgcactgcagacntatgctgacgaagaagaagaagtcgcgacaacataatgtaggacntanncaaagagagagagcacaccatagaatgagacacggacgacgcgcggcgtcagctaggaccacacgcngtaccgcgagacgaaagcgcacacacanacctcgcatanacgcgacatacacaagaacgagtttncgccgagcacacaactcacctcgacagcgacacaacacacacgcccactacgcacaagacatatagggagcngacanacagcaacaccagactacacacatcagcccctcccagatagagtctntagctcagtgctgcgggcgccgacgcagcgcgacagaggcgcgacncacacccgcgagaccccgcccgcacacgcaggcaccacacgcgaacacgacagagcaagactcacgacacaccgcacagagacacacgaataacgc

SEQ ID NO: 8647 - DNA, 1350 bp, Homo sapiens
  misc_feature (1)...(1350): n = A,T,C or G
agggtaaaaataagaaanggganaggngggggaaggnaagagtcgcgcgagagacggnngngggggggagaggaggtacgaaggagaggcctttttcggggaggaacanacagacgaaaacagctccttcnncgcgggcgaacgaaccagaaggganaaananacaaaaagcaagaaaaaagcaagaaaaaaaatcttagcgcgggcacgagggcaacaagacgagnacgcagacccgaacaacaccgagcccgaggcacgcagaccacgccagcacagaggaggacagaggaaagcagcgggaagacaggaccgaggaagggaggggacagagagnaagaagggnagaggggaggaggcgcgggagagaggcggagagaagggcagaggagggagggaagagacaaggggcgaaacgacaacagagaacagccctcgaacgaccagcgagacagacncnaagacgacagcgggaagagagagcggaagagagaagtagacgggcgcgcgacaggcgaggcgcgacgaggcgcaaagagagactacagagagaagacgagagcgcggaggcgcggagggcgcgcggagaaaacaaggagatatatcgagaatgggaggaggangagggggcgangacgcagacgggtgnatagagaaggtggggtagggaagaanaggcgggtagcggagcaacggcagcacacggacgcgaagagaagcaacaaccacgaccgccccgcgaccacgcgcaccagcaaggagacggcgcgcgagcgcgaaccaagagacaagcggaggcgcggaggtgcggaggccgacaacgtgggacgcactagggccaacgcagcaaangaggtagaaacagacacgacaagagaatgagacgcgagagaaagttatataagnacacgaanagggagagcagccntcanagagcgtgcgaggaccaacggcgcgcaggaaagagaagacgcgaagagagcgacatgaggaggtgaggacgacgaggacgagcggcgacgaccaacgagagagncgcagacgcgggcgcggcgcgggcggacgcggccggcgcccgcgacgcagacccgcgcacccgggcggccgccgcgccggacagcgccacaagggaaagaagaaacagagcggcgggacgnacgagcaaggcagagaggagaagcacgcgcggcagcgagaggcacatgcgaggcgcgncacacaggaacgacngagaggagaggcacagagcaagcgcgagacgcagcacggagagccacaacggcgagcgggagcagcagacggaggggggagggggagagcgaaagcggcgggccgcgaagacagagagag

SEQ ID NO: 8648 - DNA, 806 bp, Homo sapiens
  misc_feature (1)...(806): n = A,T,C or G
ccgggtgtgcgggcacgagcgtcacttgtcaattaatatagataggcataatccaggtgacaaattatataatagaaaagtagatattaaaaagagncatatcttctagaaattattccttttacaataggaaacattccgatgttgatatattcacattttatattaaccagttcataatatttatagtgtttcaaaaactactttnttagaattattacaaaatattaggtataaaatacgttttcatatatccaagttcattagtatagttttaccttttatcattgaaaaatagtcccttgggtcataatttatttaaacctactctttttggttgaactttttccttaaaattttcctatttttaacagtactgtactgaacattcttataggtaaatattttcgtatgcactttttttctgaaaatcactatctaaaaattaaattaatgggtcagatggcatatatatattttaagctatcagaaatgataatactaatttatactctaattaataggttgtaaagtaattttgaatcctgtaaatcctcaaaaacttaagtctctgagttacttgtagaaggttaatcaaaatgcaaagagggcaagtgacaaattctagtataattttaagagaaattaattttaaataccttgatattttataacattctctctacaaaatagaattaataataacatgattaatttacataacatttcaaacaactacagagactcagcagttaaagtatgtaatagattagagagatattaactggaaaaaaaaaaaaaaaaaa

SEQ ID NO: 8649 - DNA, 1081 bp, Homo sapiens
  misc_feature (1)...(1081): n = A,T,C or G
agaatggagggaggagagaggggggaggccaccagagaagccggggccggaggtgnagggagattcttacgggggaacaggacgtccgaggtttcagcccacggaacccaacgagacagacaacgggggcacaaaaaaaagaacattaggacacagaaacgggaggagggcgcacgggcgcctacggcagaaaacacgtacgggcctctcggaagcggaggatctatacgaaaaaacgaagaaacaagaattgaagacaacccccaaagcacaagtagccagcgagcgccaagcgagctaacacgcaaggcgaacgatcccgagacagaaaaaagacggcagagcggggaaaaacgacgcgcgccagccactaggcacccgaaagacagacagaagaaaaataaagaagaataaaggacagatatagagaaaggaccaaggcggccaggacgccggagcgcaagccggagcctataggtaggaagaaccgcacccgggaggcgcccgcggggccggcgcgggtcggcaggntaacgatagacctcagaaagaccaaaaaggtataaaaaaatagaaaccatacaacaccaaacggagcaggccacacccgctagtacaggcccgcggcgcctaggcagcacgaacccatggatagcgcaagacagacgacccaggagaaagagaacgatgtcgcgcaggccgcacgcgaaaaaaggaatcaacgagcgcgaaggaaacgatcgatagaagaggacgcagagacaacggaaagagggcagaaaaaacgcgtaagcaaaaagaacgaacacaccgacctcacccaaagaaaaagcgacgcccaggaacgctaccggcaaaggcaagaacggccgccgcagtgcgaggcgggggacagcagcgcgtgcccaaagagtaacacgacgtcaatacggagagccggtccaaccgcgaaggacacaggcggagcccagtagagaaaatgcaagacgggaagaaggaagtcagataataacacaaagagggaagaaacagcagacgaacatggagcaaagcaccagtcccgcaccagagcagctagcca

SEQ ID NO: 8650 - DNA, 789 bp, Homo sapiens
  misc_feature (1)...(789): n = A,T,C or G
ggagaagtttagtcctcccaagttttaaccccctttaagaacttggggtagaaggttgccatattccgtaaaacagcatgccccagttgtggcatcgcccaaaattataataatatagtaccctgcagtctttatgtgtcaagctgtttacgtgcctgccacatcagtcactaatttcacaatacctcgtngatagtgctgctgtcatttcatttataaaggagaaatgaggcacagagagtgaagtacttgctcaagccagcacagctaagaagtggtggtgttgggagttgaaccaagagtggctgactccggattctacacattgacccacaaactataacctgagcagcctcccctattcaacctcctacctgagttaccttcatggacagccactgcccattgggtgtcaatggtgtcattggagaacaattctccatgggtctcttgcatttctgtacaccccaaaatcaggggctcagacggcttttattccagctatcttttcaaggatgtttgtatagcaaacagccttggaagacagagtttcttcctgtgaagcagagggcagtttcatttgctatccatataataaagataatgtctccctctggtattaaaatagaccaggtttgtttgcagtcaactatacaaatcgagatctttaagctcagagttccttggctgtggaactaacccaatgtgggctagtgcaaacacaaagttcatgctgcctgctgtgccacgagtaataaagtcctttgtctctgaaaaaaaaaaaaaaaa

SEQ ID NO: 8651 - DNA, 1753 bp, Homo sapiens
  misc_feature (1)...(1753): n = A,T,C or G
aaaaaaaatatnaaaagacaaaaagaaaagngngaaagcccgcgcaagaaggaacagaaagtgcagaacagtggnttaaaataaataatacgcgacaacacancacacgacancaaaagaataatactcgctacgtcaacctacacatgcaatacgcaatagtacaatccatgatcaccgcaagcacagcaatacangagagtagtgactatatacgaaacgacaccgactgatagtcatcagagaaagaaagaggacacagactacaacacgagagatancncgtgagtgaagaggcngctagcgcgcgngactacaatcgcaactacgtanataatnataaagagagatagttgaatattagattaatagaanatagatctcgaagtatgatatcangatatgatatagcnatgatgctancgtagaagacagtctgaatagtatgagagattggatattacagaacagacgtcgtncantgcgagcgagctggtgatacgactgagtnagatagcagtcgtgcagtagcggcagatnagagagagaggcagatnagcagagnatcagagatgatgcgcagtaatacgatctcaccgacgaacgcacacatactacnaatncatagccacagctacgccgcgancaacagccactcgcgncnangacagaattgacnactanattagtggtatgctcacatctctgaccgaggagcgtatagtgaggnagatgnaagtctatatctagctagcacatcactctntctgcaccgagaatagagagntanttgactaaagaataantgtaacaacggacacagacgatagcgatggagatgatacagacactataacggatacgacgactagtatcaacacatctctnctttcatactatacctcactattctcganctatattcatcataccacacgttccatgcttctctagcgcgtcgtagatgtcgttccgtatgtgtgtctgttattgcatatcgcagactcattgccagactgcgtagtcntccccgtatggaagtgatatatatcactganataagcccagctcatatgactatacannattatgatattagtaatataccaatatgatatactcacatncantncnagtgagcaagancgatagctaantagatgatcgcacaatgaaatgtgtatgttaagtctgcnatatgtgtgatgagtatgatgtacgtgagatcagtcatggntcgtgnganggagagttggcnagngtgatgtatgtgctgtctacgcgtgntgcatcgccgtcgtcgntacgcggcgcgaccacgcgacgcgctgcgcgcangagagcgaagaggntangacgagatcagcaacagtgcagcgatcgacatgagtcggagtgacgctcgtgcgacgccagcgagntgagtgaatcagtactacgtagagtacgagagacgacgacacacgcgtcgcgcatgtngctagatagtnggtgacgtgcangtgtatgagtngcatcacgtcgttncgatagcgcagtnccgtctancagcgcgtgncnanctcatatgtagatatcacgctacgcgacggncagntcgctcagtnctgncagacgntcatctgtcggacagactcgcgantgncgacgagatctcagctagcgcacangaatcaagagcnacnctgngagangatcngntanagtgntagtaggacgcanatgctctagatagatgtagntcgagatacgt

SEQ ID NO: 8652 - DNA, 1355 bp, Homo sapiens
  misc_feature (1)...(1355): n = A,T,C or G
taaatatgtaatggcatggacactgggcggaccccacgcgcgggcgnatccactggaacgggnagatcgggnatatgcgccggactgcggcgcggggacccgtctcaccgtgcccctgagccgcatcttttgccacgcctccgcgcgcgctggacaatcgattgtatttaaggcccactgtgtacaacggcggttgatacggcaccgtcggacattatatgttctgtatagtcttaataggacgagacggaagtgtgagtcagagaggtggaggtgcggaccagcaatacgatgcacagatagttcctggtactacgcctaaataacgggatcgagtcatcgcgatagacgcactcgccgaatgtagcgtcaagaagtgcgcgacgcgctcatatcgattctatccgtctgagtagacgaagtcgaggtgaacgtcggaagccaccgacacatccacgagccccgccccgacacgtcgtatccgtaatcatatatataaaatcntcgaactggancnagnccgcagtaataaatggagagtagnagtaagtcgacgcaccggacgacgcgagagacgagcacgtgtcccatagtccatgtgttcagtacttgagccgcgtaacggagaaggagattaaaggaatgaggatgagactaataagagacangatgggtataatgtgtatcctgccgctcgctagtgtgtcggagtagctagtatgtnctcttcttgacatttcgcctcgctctttctctcgatgcactagtgtgcgcagcgctgctgatctgactaaactagactgatcaccgctactctatatacctcggcgtctccacaagatacttatcgatatacgntagtatatattagtgtacacattgtctccagatcgtctcgactatactgtcctatggntacttatcgccactgtgttatctacctctatcgattgttatttacgcgcgttgctgaatgcagatgtcgtcacattctgtccgtggtgtgttatcgcgcggtagtcgcgacatctcgtactacgtcctgattacggtacgccaaagctgacgattatcgtatctgtgagtcgacacgatcggacnctgtctgcacagacagagatcgttcatatcatctgacctcgcagatatttgagcatccagcggagatgagaggtcgtatgacctccggcatggagatatcgacctatctgacgccgacctatagatttcgtatagtttaatggcnatgtggtgaangaatattaacggtatgagatggtcttgttataatgcggcagcngncgacgcatcactgaataggatcagatattgtncaccactaagtaaagaagtgt

SEQ ID NO: 8653 - DNA, 578 bp, Homo sapiens
  misc_feature (1)...(578): n = A,T,C or G
aaaaaaattttgagagctttaatataaaaatagccttcatttactgagcacttactatctgctaaaataaggctaggaactattgaatactagagttctgccagtagttctgactcagtgctatgaaatgaatagaataaaatcactattccttttatacttcatatgtttcttctatgcatattgtatatttcttctatgcaacttgaaacactgccatcatattttgtattgcactttacataaacatctctaatttatcataagcctttcataaacattatttttccattgtgtggacattatgtttaacccttccttatgtttagacactcagattgtttcacatttttttgcctcagctcaacatataatcattatcaagagtagaattactgggttaaagattacagtagtccccctcttatccactggagataagtggatggttgaaaccagatatagtacagaaccccantatatactgtttttttcctatacgaacatacatatgataaagtttcatataaaaattaggaacagtaaaagattaacaactattaaaaaaaaaaaaaaaa

SEQ ID NO: 8654 - DNA, 1781 bp, Homo sapiens
  misc_feature (1)...(1781): n = A,T,C or G
aaataaaaagaattannnnaatatacaaaannatnggagaatanngcanagcacccgtccgaanatgtnagcganaagcaccttcgtcacagataggctagaacgatcgcnctagatcccttaacggagcaagcacaccacacagcgacaccgagacgagngncagcttctntaagcntncgcgctacatcgccgcaccgcggggctaagtcgacacgctagtccgcagccccnatatctacgcaacaagatatattaccattcttttntcgacntgcgtcgctgtacgcancggagcacggaacactcgctagacgcatcgaatagtcgatagttctgctgcgctgctgtactactcatcggctacgatatagacaccgagcntgatgttacngangtgtgtgccgtggcgccgcggaggcgncgacacgagagtgatagtggtcgacgcaaggtcangattgggtgncaaggagggagtcgtgtantanaggtagcacttagtgtatcgtgcgtcatgagtgagatatcacagtcgtatgtgacgtagtgtctgacgtctcctacgcgctcgcatcaccacgcaccgtgcgcacgncgcatagtgtgtctgtgtcgcngactagcccccgtgccacacnactcacactcgctgctagctactatatatagtttnatcanancaattcnctcgttcgcgcgacgagcacgctcaacccnacgtctctnattnnagangtggtagagcgcgcgcgtctcacgcgccggtgatgatggtgntntatatgagtagaattgacanagtatatgagacancaanagactacaggagagacgagacagtggtgagcacgcagcgagtgaggttacagcacgaggggagagagatgcagtgagnactnagacgagaggcgtgcgctgtgacgctcacagccgtccgcagtccgctgcgtcatnagctatatancgccatgcgacncagttcgnctgtccgngagcgcagtgtgctgcggcgtnactatgtgtgccgttctcgctatcgtctctcacacagtcatcagcgctcgantgtatgatgtntgtnagcgatcaaatgacgtgattatagtaattaatntgcgttgtatagatgtngagtcgtatttgatggagacatgtgagattgttactgatgatttgctgcaantagagtctgtcgtagacgtacagatcgatagtatnatattgacttctagcantgatattattgagcgagcgagntagggcgtgcnctgtatatgactagctccgatgagnatgtantgagatgacatatagcagatagatctcgagtnactcgttactgcgtanatcatgtaccgctctagcgcatgcgctctgcgcgcggcgacaatcgtantacgtgttcgtatcgacagcgcgtgacgctgatgatgttgatatagactctgtatacgtgtgcntcgccgctcgaccntgcgcgatccagtcatcggcagccggcagctgcgtcgtgcgcagantcggactncgacgtggatcngtgtaccgantcgttgcgtcgacgctcgctgcnttactgcgtncncaccacgcacgatgatgtcgtgtganctgacgtgccgcntgtcacgtaccgatgaactactacatgcgtactgtcctacagagcgaaagacagtgttcngctctagngcgcanctgacgagactcgtggtcgcgtgtncgtcgcngactacgtacctgtacgccgagcgatactgcgcagcacgctctctgag

SEQ ID NO: 8655 - DNA, 810 bp, Homo sapiens
aaagctcaaaggttaaaggcccttttcttgcagtgtataaaagttaatgttaacacatatttatgccgtttaagttgaccttcatggcctggtgagaaaaagtttgcagtgttttcccctgggaagtggttctcttcctattcttttccacgttgtgtctttgaaagaaaggcactatatgctacccccacttatgggtaggaagactagctccacttcctgagggccagagtaggaattatacttttatttgttaataggtttattttctcccttcctgacacaatataaactcagcttgggattctcattacctaaaacagttcctgatatagttcctaatatgcatagcctcccactaaatattaatgaaagtaaacaattaatctcccatcacatatacctattcatatgtctaaggatctacctgggcactttcatccacctaaaaacctcttttttcctttgctcatatttttcggtaaattctcattcagtcttaaaactctttttctcattgttcatgtccgcctaagttggaagacacagtcacatgcacgtgtatgtgtataatgtgtatacactgtggataatgtgtagagttgtgcctatggatcagcatcgtaattgtttcttcacatctctgcttgctgccatccctgatgagtaccttgagatttctttacctttatgttaccctaaatgcctagcactgagcctggaatattgtatgctctttcccaatgtttgctggttgaggagattaaactagattaacagcttgataacttccaaaaaaaaaaaaaaaaa

SEQ ID NO: 8656 - DNA, 1348 bp, Homo sapiens
  misc_feature (1)...(1348): n = A,T,C or G
agaaaaagaaaagaggcggngagggggaggnggcacgagggggggcgctggaggggggagaaggagaagaaagagttaacaaggcaaacaaagacacacgagggtttcggggcagcaacaccccggggagaggaaggcagaaggcagcacaganagataagaantttttcagagcgacaggaaagaaaagaacacgctacacgagaagaccaacaagcgcccgcagcgcgccacccgctgccgcgtacggtgtgaggatacgcgggtgggtggcgagcgtaagaagggtaaggcgagtggaaaagtaagaagaaagagaacaagcaganaaagagaaggagantacagaggaaggtgnatgcgaagtaggtgagatgagggcgcggacagcgggacgggagggaggagaggagacggaccncgcgacgacggcccaacgccgagaaaacacagcagtgancacacagacaccgcgcgcctgcagcagcgcacgaggtagcgataataccgataatagatacncgtcaggagttgtagaaggaattaaatctatgtgaccgcacggcagacagccggtgtgcggtatatttttaagatgtgtataataaaagcgagggagcatgcaggacagaagataaggagagagaataggagtaagaaagacgaaggtagtgtatgagattgaggagaatgagaaaagatggcgcgcgagcgcgcaaatcatgagtatggcaccctcgacgtagcagcgccaggctgcgatancgaactagacagacagaacgcagaaaaaggatgatatacaaacaacagaataagcggaaacgaaacncaggagcggagtacgatgagaagatgttggattacggagcgtatgatgagagtatgnataaggataactacacagatataacgacgagtggttcgcgtggcaaggatatggaagacgaaagagaagcggttgaacgtgtgggctgtgatatgcgtgacgcgctagtagctccattagtggacttcgatacggaagagagctgatgggagacgtgcgacgagaggtaataaggaagggacgagagatgaggacacaaatctatatagtagaggaaagtgtcgcnagatggntccatgacatatgcgtactgacacgttgactgtcgngtaaatatggctcgcgnagcgcgacgtatagangctcgtattaggtgaaggagcgagaggatacgatagcgtcagcaagagacgctacacgatagcgtaggacggccatcgtacgacgcgcgcgagcgaggacggacngagaacgagacgcatacaacgcacgaggatacgctggacgcnagggcgagcg

SEQ ID NO: 8657 - DNA, 809 bp, Homo sapiens
ctatccggccgtgttaatgtcacagttaagcattcgtcctggagcagcaagaccatggcttgagttaacgccctcttattaggggccaataaccgtaaaaagtcggttgtgattgatgggtgggatgtaccaaaaattcaacatgccaagactttgtaggggcttggcctataaaagcagtaatccaccaacgcccttattatgcagtacctggattatcattatgacaaaaatatggagcgcaaacatctttcttttaatgagcctttctcatttggagaacttactttggcttgggccaacctgataccagatgcatgccccacgatggagtgcactaaaatgacacagcatcattcatgtggatttctgccaaaaatgcatcacctgaatctcatcatgaggaaaaaaaaaatcagaaaatcccacattgagggacttcctgtagaaactgtcctatactcttcaaaaatgtcagtttcatagcagagaaaggagattgaagaagaatgaaaacaaaatgcaatgactgatcctgggtgggatttttttttttttctgtgaaggatagtttgggaagaactattgaaatatgtatattagatgatagtattgtatcattgataatttcctaaacttgctagttgcattgcgattataaatgaatatccttgttcttagaagctactttctgaagtatgaagggtcataatgcctgtcatttgtttaaaatttcataaataattattatggtattcatctatgtgtagcaataaatatagatatattgagaaaaaaaaaaaaaaaaa

SEQ ID NO: 8658 - DNA, 1466 bp, Homo sapiens
  misc_feature (1)...(1466): n = A,T,C or G
gcggggtgagnanggagnngnngnagngcaggagacangnacgagngcgngngccancggggcgacgcggccgagccnccgcgagagcgataccaacacacgagcagagcgccggcgacacgcagaagcgcccttcgcgccncngcgagcacgacacccacagaagccgacacacagagacccgctctcacgcgcggcaggggaccagacacaccacangcgcacacgacggcgacgcacgncgccgaccaggaccggcggcgaagagcagaagcanagagcgctttcngagcgagccgagagcgcgacgggagaacgagcgccgcgcgcagancanagangaaggagaacagagacgagggagagacgagacncagagcagagcgggcgccgccgcggcgacaccggngcacgcaccncagcaggccgggccacaggcacgcgagcgcggaccggccgcggcggccgagcggcagagcgcggcaagccgaacaccacacacgcgacaacggcgagcgcagacacgcgagccaagacgaancganacaagatagcgagaacgggaacggaaagcagcgcgaggagggagcgccgccgccgcggcggccgcgcagagcanagacgcaacacgagnagccacgccgccgacncagncacacctgcacggaagaaganagagaaagagaacagaaagggagacgaagagcagcacaaaagacaggagaggagagggccagcgaggcggcgggaggccgcagccgcacgcgcgcgggcccgccaggcggagagaggcgggggagagaggagggacgagggaggaagggagagcgcgcggggcaagacggcagacgcggcgcgcgaccggagcgagggagaagaccgggcgccgagaccacacagccaggacgcccacgaaccgagagcagggcgggaagagaacacagggcggacaacaacacccgggcagaggcgcgccgccggacacacgaggagcaccagccgagagaggggccagggagcacgcacaccgcacgggacaccgccccgggcggagccaaccccgcgcgacggaacgaagcagaaccgcccagaaggacagcagcggcccgcacgcccaccacaggncaacgacacccgacagagaagagaacggcgaacacagcaggacggccacgacgacacacaccacgcgcaggacacgcaggggggcgacggggcgcggagcaaagacgccaacgccgccaccgccacgagaganccatcccacaacacacgcaccaagcacacaggacgccgagcgacagcgcggagggccccgaacgagggacggctcgcagagggggcacacagagagagacgacgggacagcagcgacatgcgacggacacgcacaagagaggcgcgaccagcggagactgagaggagacggatgacacgcgccacaacagaaccgaaggcaaacgcag

SEQ ID NO: 8659 - DNA, 798 bp, Homo sapiens
tgaccaagttcttaaatctaaggcctgtctatcatgggacactccttgtcttgaagtctgtttggtttattttaatataggcacaccatctctcttggtatatgtttggcgtggtacattttacccttctcttaactttccaaatcttcatattttaatagttaaaaagtctcttgtgaatagcatagaaatgagtcttgctttttaatctagtccaacaacttagcctgttaattatagctttcttggcttcttttggattaacctagtaatttttcatatttggttttatatactttattggctttttagatacatactgttgctttaaatttaatgtgtgctgaatggattgcaatgtgcatcattaacttatatcacatcgagttttaaattaatattatactactttacatacaattcaagaaacttaaaaatgtataagtgattttaacatccaccatttatataaatcatacatctctgtaattgcatttataaactgatatataaacaatgtacatatataaatatatacttttatatatcagtgttcatatatataagtatatactgatatatgtatcagtttgtacatatatacagctgtgtgtatatatatacatatacataacttctgtgtttgttataaatcccgtaatatacaggatttgtataggatgaaaagttaaaccacttataataatgataagaaaaaaaaatgttcttggtatttatgcatttttttcttttctattgatattaaagtttccaccacaaaaaaaaaaaaaaaaaaaa

SEQ ID NO: 8660 - DNA, 284 bp, Homo sapiens
acagatggagtctcgctctgttgcccaggctggagtgcagtggcataatcatacatgactgaagcttcaaactcctggcttcaagcaatcctcctgcctcagcctcctgagtagctgggattacagatgtgagccaccgtgttggcatgtcttgacttctgaagctctaaaatgcctccagcttctttatccactagccacgctctgtaaatccatgctcctccataaattttgtttgaccataatattatttaattaactatgaaaaaaaaaaaaaaaaaaaa

SEQ ID NO: 8661 - DNA, 871 bp, Homo sapiens
aaatatacttaatacacgttaatgttgaaatggcaagtagtcttaaccagtgataaaaaatatattgatagcgtggatccagtagattatctatgcatattataatgatttgtcaaaattcactacattttaaatatttctcaaaatcataacttacaaaaagttgacattttacataatgttatttatgggtgtgggcataatattccggttgtaataagctcattaattaatttgattatgttgacgatataaattattgcatgtctttattttatatatataggtgtgtaatgggtgaggaggttattcggtgtatgaagaagtttgatttgtgtctacaagagatacatatataatacaaatttgtgctaataggattgtgattaatagtatatatagtatggtcttcatcgtcaatgagatctatgagtttggtcactaaagcttgtgaatagatggttctttgcaaggtagaaatatatggttatttttaaatgagggcagtcttactacattaataattgttagatttaaataagttaaggacatagcatttacagataattcctagcaagtggcttatgttgacaatacatggtcagaatctctgtaattattcactaaatttaaagtgatcgctattgttattcatgagtttaaacctatgttgaccaatgatggtataggatctcttgtacctcgtagatccggccatcctctagcctccctaaagtttaggtattcgaggctcaaacgcactgcgccctggcccataaatgtaacttttagattgtccttactgtaccctatagctttgtcttttcaagtctaataaatgatattgtcatctaaaaaaaaaaaaaaaaaa

SEQ ID NO: 8662 - DNA, 402 bp, Homo sapiens
atcacaggcaatcaaacaatagccagtggaaaagggaagactgttttgggggctatttctcctcatgcgtattcttccgcttctttgacgcaacaagacctttcttggcagccttcggtgacatcctcttatgtctccttggccaggacagagcctcatggccacccctaaactaatcacaggcaaaggcaatgaggtcatcaggatgcttcatctgaaagaatgaagatttacccggagacagagacaggagacataggattactgaatacaattggggtctgtcaataaggaaaatagggaaaactgttttgagggagctaaccaattatctctggtctcagtagatgcattttctctgtcttacaaataaactaatcttcagaaaaaaaaaaaaaaaaa

SEQ ID NO: 8663 - DNA, 834 bp, Homo sapiens
acgataatgtcgttccgaagatagtgatagctacatgcgtgttctacatctatcgtaattataaaattatgaatgtggcgtacttagagaaaatgcctggtgtcagttgtaggtcggtacacactattagtgaaagattgataggggagaaatagtgtggattctattgctttgtcatgtaattatacttgcgctgagggggtcgtatcaagggcggttaatatccgaaaggtattgatgtattttttctggaaacgatgtgagttctcgctgctttattatgtattacggtatggctgggtattgtgtgtttatgtgggccccaactgtatggatatctaacgaggagtataagaactcgaccgcttgggttcagagttctcgatggagagtaaaatattgcgtcatattcgtaagggttcagttggatcggaagaccatacgcgagaagtattggtttattataaagtttgttattatatgaggtattaggtgtggcctcgtgctgcggttggggtaatacgatccgcgtcggcagggagttcttatccccagagttgttccctacaggcgtgagctatccattgccttgtaattcatcagcaacttggcatttacactccacgggggcagggacagcaaagacccccaggctggctctcatgtctctcctgtctgtctccgagctgagaaactgacgcagtcccctagagcagggaactgtttaagagcacctctggattcctggggaaagggaaatgaggttgaactgtgtgtcctaagcttaaaaggagtttttttttggtaaaaaaaaaaaaagaaaaaaaaaaaaaa

SEQ ID NO: 8664 - DNA, 301 bp, Homo sapiens
gctgtgtgactttggacaactaactggacctttctaagaccacttgcaaaggaatgtttttaggttaaaagttctactgggaggggaacccatacactcaatgggctacagcctcagagtcaggcccaggaattccagaagcaacaagtccagaaactcattcctgtcctactccttccaagtacagacatggggctgtgactaacagctgctgggggtggcagctccattgttagtttcctatggctactgtaacaaattaaaacggcacaaataccttctcttaaaaaaaaaaaaaaaa

SEQ ID NO: 8665 - DNA, 287 bp, Homo sapiens
aggatttgttgacctttggtggaaaataatctaccagaccttgtgaagaaccaggagaagggtaacagacatctagctgcttgattctaaaaccattaaagactacttcaaggaggaagaagagttttcctgaaaattggccagaggccccagttcacagaagtccctttgcaggttggcctctttgtctcctacatggaaggaaactatcatcatgtgtcctcaaacccctgcaatcctgtcactttgcaagatgtatctagcagttaccaaaaaaaaaaaaaaaa

SEQ ID NO: 8666 - DNA, 714 bp, Homo sapiens
acagcacaggaagtccctcctctgcacaactccatagcattgctgagcgatcaaggtcaactgcgcagtactgctgagtgatcacgggtctactgtgaagagtagaagatgtgatgtgcacacagatgccaggaagctcttgctctgcctcaggctttattttgctcaatgctggagaaacagctggactctgtagatgaagaagctgggaaggttgcatgccatgtcctaagggggcccactggaacagtcagctcccagagcagccctgagttggaatcacaccccagcctaagtttagcaccatactgtcatcagtgaacatcctagggtcctgaaactgggcacactctggctggcaccacaggggagagggcagatgctggagaagaatcaagcctccaaaatgagctctgctggcttgagtgggctgcttctcccaatactcaggctcaagtcattgaaaagtgactgacagacaccccagggtttctctgatttgctaggtatctctctcctgcttctatggacaagggctcccacctatctgtcacgtgtggtatagctccccctttgcaaaactcagagcaccagaggcaggcataagatgaggtccttgtcttcctagtggctttcctcatggccctggcacttctactaacagcagaaccacacaaataaagagctctgaaatctcaaaaaaaaaaaaaaaaa

SEQ ID NO: 8667 - DNA, 385 bp, Homo sapiens
accataatcgtgactcattggcaaagttcacagtacccgcacgtccatatctgttatttgtattgccaacgtgaggttatttattgggtaattactcatgtgagtacttgttttgttgtttttgattagggggaaaaggggcacttttgccttatgcgatattcgttttttgttgtaaaaaaatttggtctgggttcttcgggggccaaaatgttaaaataccgggcaacccagccgctttttttttggggggtttaaaaggccgataatccctcttaaggttggttaaggtccattaccatttggttgaaaccctccaaattttttttactacccctctggatattaagggggggaaatccagggattttttggccaaaaaggc

SEQ ID NO: 8668 - DNA, 612 bp, Homo sapiens
cgagcctgtcaatttcccagagaaagggacagcttttaatttttttttttttcagccttttaattcattgagcacagtttgcaggttaagtgaccccaaaatttgctggcaactttaagcagattaattttaggaagtttgctgaaagatttcctagtaaagagtctttagatgattcctgtatacattagagaacaagaataaagtccaatcatgttagcattcaagactttctacaacttaactataatttagtagccagcatgcaattaagagcacagacttctaagtcaagtggtttgaatccaagctttgacccttcactagaagtctaaccttgagaaagtagcttaatttattcaaaagtaattttcttcattttcaaaatagtaataaatcatctatatcagctttgtgaagattaatttagataaaatatgtacaatgtttagcacaatgactgacacagagtaagctctcaaatttgtcagctgttattaaaacctttccactacactagcaatactcctcttaataaaaccttagaggtcaagctggtcacatcactgatctgaataaaactcaatgagtggtaaaaaaaaaaaaaaaaaa

SEQ ID NO: 8669 - DNA, 783 bp, Homo sapiens
tgtttttaaaaacccgccaacccctttgggtggttcccctctttcttagccccccgtagcccttttgttttttgccaaagaaataaaaaccaaagcttttttttttttttaagaacccaaaatttcaggtttttcccaaggaatcttcattccatttttattcaatttttttcaccccttctattagccttatttgccaccccgtagccagttcaaaaaacataattaaatgtcccagttttgtcatccagcccctttccctcctcctgaaatgatagaccatttgcaaaacttgcagtccaatggaagagaaacaattttttaaggatgccatttggcaggctctaatggagatatgagcaataatatgactaaattcagttgaattcgcaatatgatcatataggtatattctttttcctgcagagttcccaagtaggtttgttcagcactcttttgagcctcaatttctccacccacatgatagagctagtgtcttcatttgaggacatctcagaaaaagatgctactagaaatcattttgacttatgcatgacttaaaatttttgcaacattccacttgcaaaaatgtttattgattttatatatagatccagaaaatagctgaagtccaaggtcatgtgctaattatgttacttgtttttctgttcttttaggatgtttgaattcccctaaaatatagcatgctctctcattctttcaaaaaggaaagaaaatgtaatttaaaattataatgatattatccaaaaaaaaaaaaaaaaa

SEQ ID NO: 8670 - DNA, 811 bp, Homo sapiens
cttctcccaaagcggtattcagtttcattttctcaatttacacgcgtgtctcacggttctcgcgtacatattactcctggccatgcgttttttctttcccttcctcaattcgggattgtcattcttctagtcggcaaaacatttgaaaaaaagtcccaataaaacctgcgcccatttctctttgaccgtctttaacaagccgcgtaaatttccactcttacttgttctgggtgttagggtccacttgagtatgatgactcgaaagccctttctaatttttttttcgatgccctattgcataagaccaccggtgggtatatccagccgatttgtttggcacatataggtccgagcctcgttagtctgtccagaaaaagggtattcaggtgtggaattcatttgctgaaggtgcgtccagttattaaaccagcatcccattgcttgcctgggtgcctccccaaacaagaagaaaacttactcatctttttgcaagtcccttggggttaggatttgcatttccagcccctagccttgtgccagaccccaatacttgagttcagagacttcgggtcaccgcgctaccttcccggagcctagttcatcatagtaactctcagctcagggttgataagtgaattccacaggtccaagtgggtaaagcctatagcacagggcctgcatttaggaagtgctcataattgggagctattattgttgttgcttttgctgtgagtagatgtttgttggatgatctcaccctgattatattaaacccccctgagaaatcttttgctgaaaaaaaaaaaaaaaa

SEQ ID NO: 8671 - DNA, 639 bp, Homo sapiens
atagcccatgtagaaggtaggtgcgctgtaatgagtaggacgatgacagcaagtcgagacatgaaactcacacatcacacaacgaggatgatggtcgcggaaagtaatattgtagcaatgtatcgctagtgagcgaacacacgggtccagctggtcgggagcaacgataagaattaagctcacggctgggatcgggtgggtaggcaccgcacaggcggacctcagcgtttcaatgttccaagatcagtcctccccgcgtgtcgcatggtcagtagtgataagagagagcagacgtagtatgatcaggttaccgcaagcgcgtgtgcacaatgatagaaaggaacccctgtagggagtattataggtccgtggtaatcgagacattaaaggcgtgcccgatatgtggcatgttaatctaacaggcttgcagacgtaaactgagacaagcgtagtcggtgtggtaatagggcgcagtaggggataagtccgaagacctggggatggtctgaaagatagcattagttaagagaacgcggggagatccaaggattcttaggccatagggcatcgagcggtcagacggtccagagaaagggattcagttgagtaggggccgatcctcgctagagtagagctatt

SEQ ID NO: 8672 - DNA, 345 bp, Homo sapiens
acagtgttgttaatcaaacacaagacccataaagtgaatttggggtcatcttgtcctttactggtttcctgattggcaggctcacccttggcttatgatcacatccatttggcagaaagtcagcttatttgacagggttggaaacaatgccatgtgagcagaagagaaattgctttcatccctttttctacctgatggtcttatattatgatatggtttggctgtgcgcccacccaaatctcatcttgaattgtagttcccataatccccgtatgtcatgggtgagacctcatgggaggtaaataaattatggaagtggttcccccaaaaaaaaaaaaaaaaaaa

SEQ ID NO: 8673 - DNA, 754 bp, Homo sapiens
cagtaccaaaacaggggtttcaagtttttgtggttgattaagcatttcaggaatgtttaaggtattttatcccacgtcctcaggtatttgaattaagaaagtttcttggaaaatgtgtatttgatagattgagaagtctcccaaggctgttttgctttgtttcatcactcactatttcaatgttaattcaaaaataatacatactcactggaagaaagatcaaacgaacttaaagcacagaaaaattttaaagcctccttgctcttggtggctttctttctcccaccaatttttggtgacttcaatttttgtgttagaccatttatgttcaaagcatccacatgaaacttaccctctataaggtgctgtgagcaccacagacttgtataccagttcccatgctcaagaagccttcaatcttgttgaggagatagatgaaagaactggcttacaacagagaagtagatgtattaaagagtcagttttcccagcactctgggaggctgaggcaggtggatcacctgaggtctggagttcgagaccagcctgaccaacatggagaaaccccatctatactaaaaatacaaaattagccgggcatggtggcacacacctgtaatcccagctactcgggaggctgaggcaggaaaattacttgaacccaggaagcagaagttacagtgagccaagatcgcgtctttgcaccccagcctgggcaacaagattgaaacttcgtctcaaaaaaaaaaaaaaa

SEQ ID NO: 8674 - DNA, 188 bp, Homo sapiens
  misc_feature (1)...(188): n = A,T,C or G
agacttagaaccagagaatatttgctnagattcacagggacacattgtccttactgacttcggactctgcaaggagaacattgaacacaacagcacaacatccaccttctgtggcacgccggaggtaggcgctgtcttggtttggtgcctggtttacccccgccttccaagagagagatgtacaatca

SEQ ID NO: 8675 - DNA, 722 bp, Homo sapiens
ctttaccattgaatactaaaagtaagtagtttagttggatagctgtaagcaagtctttcgcaggtgtttaaagagaagtatgcgagcacaaataccaaggacttgacaaatctgattatacttgtagtcctatacattttatagcgagaagcttggctgatataaaaggagagagcctaattatatattgtgttattcggaggtcagttagatcatgtataagtgtaagtatccatgtaaaactccaatcttggaacttctgaatgtcagcagatcatacaaaagcgttccgagagtagggtagtccatggtttgtgttattgatctccgtatagatgtgttagcaaccagtacggtttaagagtttcaaatggaccattacactgagtaattaggagtccggttctctatggtcaatttaggaaaaatggattaagactatattcctgttataaatgttgtccaagacagggttcttttaataagcataccattcagtggatgtagacataggttttttacctatcacaaatgggcagtggatttgtctttttaaagactttttatctgtagattttatcatatggagaagaaaaatggctccctaagccagaataatagtttttatgcctgcaatttttcacagttcgatatgtatgcgtattacctcttgatatgttagttttaaataagatttgtggctcttaaaaaaaaaaaaaaaa

SEQ ID NO: 8676 - DNA, 763 bp, Homo sapiens
agatgtctagatctttatacgggaatgtgtatggtcagtatagaatgcagcctacctcggatttcagaaactgatctgcacagaacagccatgcaatgccattttggataatgctcacctgtaaaaatatatatagacttttccagaagattgagggagaggtgatatattaagaaaaagagatgaatgaaattatgaaaacccagaaagaatgacttcaggttttttataaaagcagagcactgaaggagttaaaatgatgccaccgcaaaatatgctaccattctggcatattgtctattttgagttaagagtacttgaaaaacagcaggtgcaacaagatcactttgagattccttctctttcttaacaacaggtgatgacagtcccacatgaaagatgtcctccctgtaccagaaggaaggcaatattattatgacaaaggacaggaacttgaaacccagagaattctgtacggaccttgttagaacaatatgtatcttcttttagccttcctagattatttagttactttttcacaacttcctactatttgtcaaattcaatatgtaagtattcaactctaattgcatctttgggcctttatttccttatgaaggctcctgtgccatatgaaacttgtattaactaaattttcatgcttttctcctgttgatctgtcttatgtcaatttaatttcaggtctaggaaaaaataacaaacttaaaagaggtaaagtaaaattttacctcccctacagcac

SEQ ID NO: 8677 - DNA, 1358 bp, Homo sapiens
  misc_feature (1)...(1358): n = A,T,C or G
aattctgttctggacgaacacctaacccagcatatcgatttatcggacgctatcacactgtcgagagtgctcacacgtatttatcgcccatgcccccccacatgtagcgaagatacggtgttgaatgcgagagagagatacgacatgtcgatgttatccacgagtcgatattgatatatcgacatattcggatatattgatataccgcactagagtcggcaacgcgatccacgcgcataatatcgttgattcgtgatcgcgcgcgtgtagaaggcgcgataaaccgatgtttatataacacacgagctcgatagcgttacacgctgctgagatcgtcgtagtgtacagggagtaagtatacgccggagttatgtcgaagtcgaatagacgccgccgcgcaactaatactatatgattaagtgagtatnagtttgcgccgtcgtcgttaagcccgcacgcgtttgatttatgatattcgcggcactgcccacgatatacgcgtcgcctctcgcgatacttngctgcggtactcctatatatgcctatccgatatacctccgcgccgatactgcttcgcacgtacctcggtttgcgcgcgcgcgaaatcatgttaacggcggtatggtggcgttctgatctgtgtattatcgaaagctataccgctagccatatcatatacggcgcggtctaccccaattatatcgtgagccaacttatccaacgagtccaagtttataagcgaccgccgacatccatatacaagccccacacccccataccattttttttagttagttcagcagttcggacgcatcgcgaaatcccacctaagttctgatctgtgtcagcgcgacgccgcactgcaatatcggttattatcgcgcacacgctgcccccgcgcatatcctctccccgcgagaaaagtattatatttaattcgactgcgtagactccgccgaattcgtatgtcgtgacgtattgcgtgcgccgccagcgataattatatattattatttgcagaggccgccgtcgccgccgcgctaccttaaattcgatgaattgaatagatgttatcatgcgcngccgcgcgggctgcggcgctctatttatgtatatggacgcgcgatgcgtntgtaaagaggcgtgcaactcacangacgctgtgctatagatgcagtttcacggcgccgcgcgctcacactatatatgcctcgctcgcaccacgcgcgcacacttatacgctgacatacgcgcgtctcacacgcacacgcgcgatattattaccgatacgcgcgccgtatatgtattacttatatcatacacccgtacgcgccgctcgctcctcttagtctaantat

SEQ ID NO: 8678 - DNA, 1274 bp, Homo sapiens
  misc_feature (1)...(1274): n = A,T,C or G
gtatgagccgctgatctgccgcangncnctcacgcgagtgctgacacccatatctcgatatgattccggngcgctggcattcggccactcgatttatagaagtagtatgtagcgctgagtgatatctgcagcgtgcacgcgcgctctgccaacacctgaacagtattacacaccgacgacgcatactcngtctcatcggcgcgatataatatcgacacacgtgcgcgcacgagtgcgcgntactgcgatacagcgagcatngtgcgtcgancagcgaatagtagatgtgtatgatctgatattgattctgcgccgacaggtatcgagtatgatggaactccngccgttgagacggcnatagcatgatcagcgctgaacaggcgtacgtgcagttgtcatcagtgtatcgcgttataattatatacacagcgtgctggtnattcgagcgacgctgcctcgatattatgtatacatgtataagatttgtatctcgcttccactgtagctgatcgtcgccgacgcgacgtattattatattattatgttatagcgcgcgccctctcgttcgcacctctcttgtaatgagacgcgcgcactcacactttttactcgtcgccagcgtcganagcactcatccgataaccgataataacaatgtccccagtcgcgactccacgcggtataccagtgcgtacgcttggtgacatacccgcgcgcttactatatactacgaatctatatatgacgactcctccacgacaagaagctatccgccaccgtctcgtcgcacgcgtgttcgcctgtatagtgtctgcgctgcatacgatctcatagctgctttctaccccacgccgagggcgatatagtgatcatcgcgcgccgaccgcgatatatattatatatgtgggtggtgcgcgaagcccccccatccgcagtgaactcacactcttattgcgctgccctctccccttacagtttattgctgggggccgcagtatccattcgccgagagggagatgattttcatagatccgcgtatcgatccgcgtccgccccccccgatttttttttattcctccgccccgccctgttttttattgtaattacgatacccatccaccgcgcgctaattatgccccctagtatgccgcatcgactacgcgttcatgctccactcacatattcccccccacgcccatctgctctatccctgcccgatacccggatttccgtatccggcgtttctattaattccgcgcgcccgcctaatcatt

SEQ ID NO: 8679 - DNA, 520 bp, Homo sapiens
  misc_feature (1)...(520): n = A,T,C or G
agatacccatggaatgagtaaatctcaaaaaagtggctttgaatctgagcttcaatagaatcttgaacaaagaaaagtacattnttagagatgtgacaagagacaaaggaaaaggactttaatgctctatgggtggcaatttataggaaggcaaatgaccttcagataaactctggtctattctggatgccaggaccagagaagtggccaccaccacgtggagcagttgagaccattggtgaggcagaggcaagggcctccagccagctaatgtgatggacacggtatctggagagtcctgcatttcaaaacttactctaaggaagactgctttgattttcaaagtctctagtctacagagagattgagctctggctgcaagacactgtctatcatagagccacatggcgacattgccgtagagaagagacataaataaccacaactgccagaaaataaagctggtaatctctagaaatgcctggatacattaaaatgaaataaacccgtgatcggcaag

SEQ ID NO: 8680 - DNA, 1061 bp, Homo sapiens
  misc_feature (1)...(1061): n = A,T,C or G
atgctaaagaagtgcatgggagtacacctggactcatactcggcgtttcatgcccgcaccgggactaggagtgctaaatgcactagacactgatctatctatcacctacacctttgtgaactctgtagtgctgcaagacctttcttaccctcgcactcgcctgcctaagtaccatggaggacttacatgggcattgttgctcgggccatacatgaacgcgctcccttgcaccatcaagaccttggcttgtatagagcgatgcatcccttagaacccgacacagtacgtgcgcatatgcgtggatgcatgcaggcctgtttcgatacctaacgggagtagaagattggcgtgggctgcggttaagggcaatagggaatatgctttcgagccagcccctctcaacntttatactaaagctcctactaggcaagcatgcggtgacgcctttggcaactgcggctccatgcgccgcgtctggcgatatattcgcttttatgcgctcagctctatcaatacatgtatagggcactacctatgtaatgtaatcggtcctcccccgccgccaactcctgattattttgtgctcccacactgggagtatcacctcctatggtatcctacatcgataatattcttgtcccgctagaccccactgctaagaaaaatgttctccaatgagggcgcgcctctgctaatacgtacacacccatatactttattatgactcatntatgtgtggcacggcgaatcatatcgcctgcgcacatccacggcgcccacataggacaatttatctgtctctcttcctcgcgccgccgccacttaattttcaccgtcgtttgtcctgtctgcgcaccactcgccacactccttaattgttttgtggactctcatctggtcccatttctgagctgatatcgaagagatttaccgcgaaataccgctattagcccgctccacgccccgccctataccgttttgccgcgttctgctattcgcctttactatctattaacgaatatatatcatttcattctccccgccccccggcggttccgcct

SEQ ID NO: 8681 - DNA, 836 bp, Homo sapiens
agtgttttgtaccgaccggtattccatgatagatattgggacatatcgtacttcgccatttttaacccatggtacaccgccgggacacgccaagggtggagataaatacccgggcaccagtttaactctttcaaccaagaatggagttcaatgtcaggatttaggtttcctgcagccttagattcaagttcaaagcatttttctgcaaaacactcccaaggtagctgggatactaggcacctgcccctgctcccaggatctttagataaaagaactagattcaacagaatgtgtgctgcagggataaatgcccataaccaaggaaaagtgattctttttctacaaatattgtgagggaatgaaaaacagagttagagcccacaactgtaacagaagcagcctgaatgatttcctgtcccattattcagcctctgttccacagggcacagcagtcatcaattcaaaacaggaaatatcagaagattgcaaaaaaggctagagactgtaagaagtcagatatgcaggcagaatttaattatccaaattggaatttaaccaggataccatgataaggctctgcaggttggggaatgcattgctatgggaatgaactcctgtgacatattcaagaaatccttcaaccattgctcattttataaagtgtggttaatgctgaaatccactaatagaaactaaacttttagaccagcctcaaatggcctccttcactaaaatatcccctgaatgctattacttttttcatgaatgaatgcttttgacaaaagggcaaaaatgacacacatatatgttataataaacctagtgtatctgtcaag

SEQ ID NO: 8682 - DNA, 818 bp, Homo sapiens
cgcctaatggtgtcggtgtccctatgtatatatcgcggggaaagccgcgatcttttgcccaaggggccgagccaggtaaattgttacgctagcagggttggtactgaacagtacggaattaaaagaagtgttctcttaataaccccgctgcagaattgcaattccctgaagagacacagttgacttccaaaaaaccaagtttgaaatgcaagggtcacattccggcggctttctctgccttggcctcccttgagccagcaagaccctcatcactctcggcctactcaacctgaagatgacgagaatgagggcctttatatcatgatccacttctactcaataaataaatttttgttttctacctattgaaagagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagatggacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccaccattcaataaaaccgtgatcggcaag

SEQ ID NO: 8683 - DNA, 347 bp, Homo sapiens
ctaggcttgtgtctgtatcccatgccaactttggagaagaaagatttttctttgtttgaactgcagatctctttcttgggcttcttgctatctctaaatccgcagaccctgtgctattggaatccgttgaaaaggctttgccctctaatgttctgtcagactctcacccccccttattttgggcgatttgccaactccacccccgccacgtctgcttacacggtatcgctcttggccatcgcaggtggatcagcaacgccctgttccccctccccttaattggggtattccctgcccccccctatttacttgtgcgtttgtttatagtcgcgcccgcgcccttgttt

SEQ ID NO: 8684 - DNA, 871 bp, Homo sapiens
ttgctagatatcgtgaaacgtgactaatacgggcatcgaaaatgatactagactcaactcccctcggccaacaaactgacgttacgtgtatcccaaccgatcacactttatatacgtaaccgttcggtgggggtgacgcaggctgacaatcgtacgttaatatatcccccctatataatggtctacgggtccaccgtattcgctgggaggaatataagtactctccgtagcagggtgcgcgatgtcccgccctcaccccgaaatgcagaagcctgtagccccgtgcgggttacctctggaatcacacggtcctgccgcgcacctcacacgcgcgctcccctggcgcggcaacctacatccccctcaaataatgatctccaatcagaagtgaatatcgccttactaccagaagctgatactctaccaggcacgaagtcgcgtgaatgagaaaatagggcacacgataggccccgcgtcccgaaaggcatatcttaagacgctgtctcgacctcttataaggctacgctccggtatatacatcgtagccccccacctaccagttcggcgtgagtatgcgtcgcgcgcgccgctctgaaggacgaacattcttatctgtttgacatgcagatctcttcctggggcttcctggagctgctaaatgtgctggccctgtgcaaatggaatccgctcagaaggctttgactatatagggtgctggcagatgcttacactttcttatttaggcaaattggacaatcacaaaaatgcaaaggcgggaaagatggtatggcttttggcaatgtaaaggaaaataaaacggttaccgacaaggtggggcggtatcagcgacgaacgattggacggcggaaaa

SEQ ID NO: 8685 - DNA, 757 bp, Homo sapiens
aaatcccaaacaaatccttttttttaatttttatagcacatttcccatgtttttttaaatattccctcctcacctttttggaaaatatacatccaaaattttttttatgttttcctgtatatatttccgacccacccaagttttgagggagcttttgcagctgttggaaaaaaatttttgggatggcccacaaaatggggtctttttaatggaatttaatagctgaagggggggcacttttttagggaaacgtttttcctaatgcctgggattccagttgttttctttagccctaagtgggggaatatgaaagggagggctactgctaacattttacttaaatttttctccccatctccttttgttttttccctttaaaatgtctggacctgggatcagattcttttttcggggggctggaaactaagggccattcacctatttaacttaagggctcgcccagggtccctggggttggtggacactaatcccataaagggggtctgggggattttgttttttttgtgagactaacctgaaactaaaaaaatagtggacattgtaaattttactttgttcgggggatttttaaatctttgagggattttaatactcgcccacctggtataagaatggatggagttttctaaataaaaaggatccccatttctcgccccacagagggctctttattttatgatgatcagggcctgttattcgatcctcaaagtattgcccgcagacctttatattattg

SEQ ID NO: 8686 - DNA, 822 bp, Homo sapiens
cctagcgtgagcgactctcttaatttccaccgctacagctagattatagaaagagcacatttcaaacttcaaataacatgaatgaaagccagagatgactactactccttgtgaagatttttggaatacccttttaactatcttcttacttccattccttgtccttctgcagtttattctccacccagcagccaaaaagatccttttaatcacgaatatgattatgtaatttctttgctgaaaggctctgaatgcttccctgtctcccatgaagaaaaaacttaactatactattggtggaaatagtgcagccattatggaaaacaatatggaggttcttcaatgaaatagaactaccaggtgatacagcaattttacttctgggtatttatccaaaagaactgaaattaggatcttgaaaagatattagcgctcccatgttcattgcggaaccattcacaatagccatgatgcggaaatggcttaaatgtacatcaatagatgaatggatttttaaaaacgcggtatacatgtacaacaaaatattactcagacttcaaaaggaggaaattctgtgattatgagccaacatgggttggaccttgaaaacattatgctaagtgaaataatgcctttacaagagcgccagtaccatatggttgcatttatgagagcaatcccacgacaagcactgataaaaccccaaggacgtgctagagggaggcgggaaacagaaaattggtataacgcggggtctatttttaggccgacggcatacgcgtgtatagatgctcgtacaatattgcgcccgccgtactttct

SEQ ID NO: 8687 - DNA, 662 bp, Homo sapiens
cgcatgtaagggttcccgtccaccctcgaaagcaggccctacctcttgctgtgggacgccgggccccccgctggggactcaaaagaaggggttttccacgaacaaccgagcccgcggcggcccggccaccctgtttgggggggtgtgaccgaaaacccccggtttggggttcggcaaaagaatgccccccccctgcctctgggggcccccccccccaaacccctagtggggggtgggctctacgggcgcccccctacaggagcgggtttctttaaaagggggtagcggggccccaccaaagtcctcccccccccaaaagagggatattttggtgtttatccccccaaggggggccccgaacacccatatctatggggtaatgaccccctccctaagggccccacccccaaatgtccccattccgtgggttctttaaaaagaccccttaataaagccaaaatgggcgggccgggggggggggtacccagaaactgtgcaaatcggggggaatatttcccgttgcccaaaagaaaaatagtttaagcgtttttttaaaatgtatggggtgacggaatatcttgcgtgtcttaccccctaaaaactttttaaaggggggggggcgcctcaggcttttccccccaatacattttttagttcttgtt

SEQ ID NO: 8688 - DNA, 853 bp, Homo sapiens
cgtgcgatctttgtttattgttatgagctcagacattctgggttgaagtatatttactaatgcagggaaataaaaatttacaacatgacacatactgtggatacccagaaagtaccacatcttgatttggtgaccaccagcacagccaacaaatggtcctggtagatactagagaccaaagaaacaggactgctacagtttgaatgtcccctccaaaacttatgatgaaattgtcattggaacagaattatgaggtggggcttttaagaagtaattaggtcttggagggaggtccactttcatgaatagattaatgccattatcatgggagtgggtgagtataacgggcgtggctttgctctatagtttagctacaactcacctgtcctttcttgcccttgacccgttttcatttgtattcataaacgctctaatcctatcctttacagatacccgatccatacctatttgacttgcctagttttaacaaactgtacacatttctgtcacttgtttccttaacttgcctaacctttggcatattactattgcctctcggatatcgtaacaacgtgcgcaccaatgtacatagcttagtcaaaattatattagtatcccactatcgactgtagtgcagcttgtattttgctgctcgtgaccgctatacttttttttttattcccccgttttccttatcccgcgatccatcacgtctctagtcaaaaagcacacgtaaattgactcacgctcatacatactgcacagcactcactttttcgacaatagcagtcggacttgtatacatcaatcactcgcaacacatatacaccatcgcatacaatttacataatag

SEQ ID NO: 8689 - DNA, 759 bp, Homo sapiens
tctggaggctcgaaagttcaaggtcaggggcccacttctggtgaggtctttcttatagttgggtactctctgtagagtttctttctcttataaagtcaccagtttcagtcccatgataatccattaatctactaacacattagtctattaatccatgagtctattaatccatattttgtgttaatccattcataaggacagaaccctagcatcctagtcacctcttaaaggcctcacctctcaatactgccacattgggtgttatgttttaacataagtttcagaggggacaaacattcaaaccattgtagtttattttctactgctatactacaataccataggctaggtaatttatttaaaaagcgatctactctggctcacagttctgaaagctgggaagtccaagagcatgggactggcatttgctcagcatatgatgaggacgtttttcgtgccatgaactacggtgaagggcaagaaagtgcaggtgagtgggagctgaactttagaacaaagccactcttctgattacttacccacttccatgatcggggcgtttaatctatctcatgaaagtaggacctgccttccagacttaattactttttaaaatccgcatcccccattggtttccgatgaccctccatattagtttgggaggggacataagactgaagcgcactgtcacttggctttattactaccccacctctggttggctgtgttggcgaacaacaaaatactcgcccgttcggt

SEQ ID NO: 8690 - DNA, 956 bp, Homo sapiens
  misc_feature (1)...(956): n = A,T,C or G
cacctccccctcctcttttgatacgcctcaataccccgtttaaaggcaccgcccgccctaccggcgttgtccaggaggggagttcacatgcgctttccccaacgagggtatcaaattgtgtctcggggatgcagaaaaagctcttgaaacaagaatcnaataacggaattaaagggggtccccctagaccctgaatgaatagctgaaagaggaatggtttagtcccctcttcaaaactcaaggtttcattagggaccccccaccgggtttctattcattagctaccccatatctattaataaatttgtggtgccagtgaactttttaacgacttaaaattagcaaatactctcttttttttaaaaaagtctatcacacgctcagcaataaaaatttataatgctcattcgctcttattcaggctgaatattgatctaaagcaaaggaactcaccattttaaanagttcatatttttccataagaactttccctatgatatctcagaaagccctacagcacattaaagcctctatatccaaataacacatgttactcctggctgtataattatacttagattgacaaatgattctaaattttatctgaagactaaatacaaaaatagccaagagcattaagaggaaaggaatataatgacagggactttaccagctgtttatgaatacacaatcagatattaaagtatattataaatgcacaacaatcttaaaggtatagtaatggcacagaaagagacaaaacagaaagaacaaaagcaaactctatctctatcgtgcaagaatgttgacatttgaaatcagtgatggaagagtagataaacggtgctgaaaataactgggtaaatactcggctccaatgatcattccattttcatgcctttcatcacaaataattcttgatgaaacaccaaaataaactacgagtcgggccggaa

SEQ ID NO: 8691 - DNA, 624 bp, Homo sapiens
  misc_feature (1)...(624): n = A,T,C or G
acttgctcctgttccctcctcctattatactattagattatataatntaagacgcctagtctggcgaacgnactgctctgtgaaccctacncacacggctaccacggagnctcatgcaacataactcccttattgtacacctctgctgaatgacccctcttgatntgagatccattatatcgtagcatgtacttcggtcgcggagagacgcaaaggcagatntctccccgcaagccncgaagccgatctatcctatagccgcgtactaacatcccgcgttacctaacttcaaacaaatgtccaaattgtaccgtccgcaatccatctgctcttcgaccggacccgcccaaccaataccttcttgtctttctttccctcacaattaacgcattccagcatcgtaccaacccagcactctattaccacatctcaaatcccgctcgccgtcctcttccatcttatcttcggtctaattcataatcctccccccctgcctaacttcctcagatatattgacccaaaattcccccccccttccccatttttcccccccttttctaccctaccccccgcccttccccctcacccccccccctttcaccatcctattgcgactcccgcccc

SEQ ID NO: 8692 - DNA, 732 bp, Homo sapiens
accatataagatgattttatgtcttttaaaactataaggacatactcgatgctataaaacattgttcacagtcatttaattagaataacaaattttagattctaacgtatgtcatatcttctttgcttgactatttatctataaaggtacatattcagaaggtaacagcatgagactagtacttctatatgcacattttattagacggctctttctcatccctggtcaaggagcttttctaactgatggtttatattttacagatggcttttggttcctaaaaatgctttttgctttattaatatatcgtgtaaaggtcgtattatacaggcaaatttctttaattttggttttagatttttatcatctagttaattctaaataatattgttggattcttttatgattattgggcttcgttctctaagagaataaatgcttgctttaatcttcatgattttgtaatttaagtaaatgtaatattattggctgctacatacatattttttttctgtttgtcttgtctcctttgttattattttatgttgtctagtataattatcacttttatttcgataatgtaatatctcattggatcgtactgagatttagttaacacactggtgcttctgatatgatgattgactaggatttttatgagattcgtaattaattattttgtacgcattgtatttgttatggtgttagtcttcttaattcatcgatgtattt

SEQ ID NO: 8693 - DNA, 1226 bp, Homo sapiens
  misc_feature (1)...(1226): n = A,T,C or G
agtaagataatatacacttatatgaatagagtgaagacacgttatccacatcggtgcgtcagactataatctgatagattcaattgtagtcaaagaagatacatggagcgtggagagtatatgttatgaacgtatgcggcccatgacccgtaggcactaggctccactatgtttcgcggtgcaggggagtgagcgacaaacacagctctatggcgttggcgacgtaatagtgacgtattcggtcaagtatatgtataatacagatattcatgataagtagagtgctgtggtagtataggctacggcggcggaggggagagacttcgagtagctggatttgtcaggtcgaaggtttaatcaaaagtaataatacagtattcatacgaaagttgtttcgtgtctaatataatgggtgtattttcagatagtaagatattaaaatagattttataagcatatcaacatattttgcaactatttgtggggtgcgactagagcgctttttattatggagtacaacgagagtgatataaattagaggacaagagaagcaagggttaatacggccagcgcactgagggcgaataggtcctctaatttataaagaaggttttatatgggacttatagagagaatatattgcaatacagggtattagtaagttatacatattcaagacgttgaggcgcgtaagtgatagatgcgtgagagggggtagcatagtattgtgaatgttaatatacataaaacactatactagaaattagtgtatagatcaacccgcggtaagtgtggttttataaggggctagggtgatgtttcttgttcacacatacagagacatgcgatttctctcggcaactcatctcaattggaatattgtgtagcgagaaggtggattgtatattgtgttgcgaaggggagtgagagagaatgttatggaaaacaatttagagagggtacgattgagaagtcgctagtggtataagacagatggtgtggtattattattcatatcgccgccgcaccccttgagaggtggngtgtaatatgttatgctgatgtgtaganacgcgtagagaagaananaacacagtgagcgtgcgccaacagtataaaacaataacacgcgtggcngcctcgtggtccnctggacaagagggtgttctaaagtacttatacaagcatcggttgacagatatacagtgtgttgttatactacatgt

SEQ ID NO: 8694 - DNA, 1184 bp, Homo sapiens
  misc_feature (1)...(1184): n = A,T,C or G
atcgacgcgctcgactgtacatgtcggtcctcgctgtcagcgnttgcgcgacgcgtatgcctagcgctagcttcatngacatactagacgcgaacatcgcagcaacgcacgcgtgcgacttactccatggctcgtcggtacatcggcgcgcgcgtgaccgcttgagctggactctatgcgattacgcatgtaacattgtactagagggactctcctcagcgcctgtgcgccggcttatctaacgctgggcgggtgggcgcggctggtggcacggctacgnaggcaggctgggtgcgtgcgtcgttatcctgctgatggttgcgacgtgtctggtgcgagcagctgtgactggggatacagcctacttctcgctcgtagcgtcggcttcatttctataacggacnattacgtgtatctttgactatctgtatacatcgcgctgtcttcgcccacgcagtcatcttcanctgacctcttaggctgaatcttagaattcggcatcgcgatggcaagctgctctatagcctacggtggaagcgcgatgtggcggtagttgtaatagtagatgcagggacagtcgacgtggagcgcacgttaatgagtatcgaatatataattagtgtaagatggagatagaaagagaagtgcggggtataggttgtgttgagtactcgaatgcctcgtggcgcggcgggcggggcgctgtctactgactgctgttgctgcctcctcatcatccttcatacgcaactgtatcttcatcgcacgatgatttatcgaagatgtatacaccgtctctatgtagtatttttcgcgtgttactatgcattaatatagcaaatctctcttatctaacttttattcaaagcatcacaatatctcaccttcaccatcacatacctgtgataataagtttctgtcatgagattagaggctttatcgcgtngaggtcgcagggtgtttgctgacacactacaagatattattctgtagaacaggtagaccattttattcctcacaactcatgattttcttattgctaatggtaaatactcccaaccgcaccattatggcaatatttttcaagtctgtccctcttaaattaataaagatggtttcgccaagattatccaaccacaccacaaccccacttccttctttactttcttctttcctttctcctc

SEQ ID NO: 8695 - DNA, 1453 bp, Homo sapiens
  misc_feature (1)...(1453): n = A,T,C or G
caactgcattatcatatactgtctntacactactcgctncgcaagtggctcgcggtgatcgcatctctgacgagtaaacagactctacagagtctctcgtgagacgnggtgngantacacgtcattanacaactcgtcgagcgtcgatnacgacacacacacaccgtacatacctgtagcacaacacgtacacagtgaaaaatgcanaacatatatctgcatgtagctcgttgtacatattgacctactattanacagtgacatatctgncagtacgagtngagaagtacatgcgacacgngtgcgacggtagctacatnagcaggcgtgacncatgtacagatgtagcctacagcggtggtacatggcttgtcgtgacatactctagtgcngtacactctcggaagtagagagtgaatataacacntgtatngggatagcgagcgcggaggagaatanagaggagatgcaagtggcgcgacagcatgcgtgnttagagatcgatcgaatctgttctctcgctcatacgtacacgaatagatgtgcaatagtagagagcatacgtattctgatgtgcgccagtatacactcgctatgcctgtgcgtggattgatgctagggtagaatggaactgcgatgcatctacaaccgacgccgttggcgactgatacgctgtgtatcgatgagcctacatatgttccggtgatgtctgattgatanttacnccaatcatttgaacgggtagacgaggactgagagcgaatatgatatacaacatagacgtagacggtaatgatgatggtataagatgaagtcgacacctgtccgaatactagtgtgtggagcgcgcagtagtcgaaattattattacatctgcaacacactcacttctctcctttgtctatactataacatagtgagaaaacagcgtatatgatgagcatctacacaagagaaatcacgaccgctgcaacagacatgtcgtgatgcatattgctacagagatanagtaagacgtaatagncagtgcaacgacacgcaagcaatgcataataagacgaagataagcatgaagtggggcagggcgctgagatatagtcgagagtgtaggcgacacgagagtcatgctagcttcatttactcgagccagccgacagcagcagaagactaaacggtacagggatgaacgatagcgggtggagtaatcagctctatgccgtatctcatgacgtcgtcggggtgctacacgacactgaataagatcaaagagaatagatagttggttgtcgaagggaaacaccggaagatgaagaagggaacaaagatgaaagtaaaaacaaataagacggaaacgagggaacactaaaataaaaataggaaatcgtggtgtcgttgaatagtcgctatcgttaaatggatcaaaagacacgtacgttagcaggcgatgatatat

SEQ ID NO: 8696 - DNA, 746 bp, Homo sapiens
ggaagttaattttcttttttttccggggggttttttaaatggtttatttttttcaggggggaaccccatcccaaactttttttttaaagggggggggccactaccaaatttccctggttggcctggaaatttacccttttaaattatagcccaggaccagttctagggggggccccaggggattttttgcactttggaaatcccccccccccccattggggagtaccactctgattttccccggtgcataaaaatatttaaatcacccaaaacccgggggcccctttttggggggttgatttaaacccaaaagggcccagttttaaaaatggggaaaaccccttggaaaaaaaaaaaaggactgaataaagttggtttttaagagttaaaaaagtttgccttgaaagggcacaaatgggcccattagggcgccctttgtggccccgtgccgaaggaaaaatcaaaggggaacccaccccaggtgtggggggtgtcactaataacccaatgggggacgcacctccggggggtttttcagttctccaacaaagaaaagcggcggttgcgttttaagaacgggtggcgaattcgtgggcgccgaacccttggctatgagtggacgagtgacacccctgatgggatattagtgcgaggtccaaagtggtcgccaatgatttgtgatatagtatgaccccagagcctttgtgaggaagattatgaatgacatgggacagtgggtcgcgggt

SEQ ID NO: 8697 - DNA, 845 bp, Homo sapiens
  misc_feature (1)...(845): n = A,T,C or G
aaaacgaaacggacagcgatataggagggagaggaaagggcctgnaagcgacnacgcccngaatttccaagnnnncacnnngagagnagcnnggnccagcaaggaaaagcaagttagacaggcagggaaggccgacacaggcacaaagagcgacccagaccacgcaccaaagaagcgggcaaaagccccagccaccagacgacgccancgccagccaacagccacggacagaaaccgcaagagaaaccncaaccaggaaagacggaacgatttctttctagggagagcaaccggacaaagggagcggagcccggaagancacaacgagggagagcgacagcnagggccccagagagacgcncagacgaagggcnacaaaggccaacaggagcgcaggggacaccgccccagaaagcggcagcagaagaacacagggacaacacaccacaaccgggaaccgagccaggagaccaccaggaaggcccagcccgagaggggaaacacgaaaccccagaaacccggcagggaaacccaagagacggcgcagcgggcagaggccacacaaggccgcacccagagacccagggagagcangcccagacaaacggcggaaacacggacaagccagcacaccaaggaccaaaaaaaccggaccaggggaaccccaancggaccagccggggccgcaggcggcaaaccacaggcagaaaggggcgggcaggagggcggagcgaacgaacggacgcccaagggaaaagagaaggccacacacagggggggggaggacacaagcaaaagcgaagagcccggggagaaccaaagggggcccagggcaaaaaaaaacg

SEQ ID NO: 8698 - DNA, 1990 bp, Homo sapiens
  misc_feature (1)...(1990): n = A,T,C or G
atatatagatgatgcagtcatagcatagtgtatactgctgtatggtgtgtgatatcagagcatagctacatcgtagtcgganctaantagtgttgcagcacgagacaggtatcgaatatcataggcgttgacgatgacgcacatctactactcaggagtgagtcgacgagatatcatacgnagtcggaatacatagcacacgacgacgcacgtagtatggcgantaatgtgtcgtgctgtntctaacagcaatacatgcaaactangatgatgctatcgtcagctgtaatcagtgatacatctatgtagggtgacgaccgtgctctaatcagtattgcacanagaatctactcctctcgatatcatactaccatacacgagtagcgtacatatatgagcgtgtgtagtgaggtagattgtcttacgtatacagctgactgtgccgtctggagcggtgtctgtatgacacgactatcgctgtcatctagtactcgatactagtgacggcgtctctataaacattgatatagactgagctgctcttataagnggtgtgtgctgtatgcgccggtatatgagtatntgtcgtggagacgaatatatgtacanagatacgacgtcgagatnataacagatactgataagatcacatactatatataatatgataaaagagattgcngtcgtctatgtgttgngtagcatatgcacgatctctngtactaactagtcttagagcatatgatctctaagtagtcatacatataagngatngncggctgtgtgctgcgagtgttccgcagtcgtngctcaagcgtcgcnagngacgcgtacgacacgatatgcatanctngcgtatcgtgcantatagacacactaacgtanaacgatctgtgagcgagngctagacacgcagggcgacanggtgcggtgctntncagagtatctgctgcntagtgagccggtgatgnctaggatgtgtacatgcgagagantnctcacagttcgtatgcttgttttgagangcgcactgctgtgaagtgactantcagcgagacatnnactatacatacacagcttctgagagtgaccatcatctcatactatagnttagtgtgtactcgcgtgatgtctctactagcgtgtntagcactatcagtatgggatcaggtagagtgttgtatatcaaaagatacgnagacactgagacgatgagtatacgcatcatcatcatatgcatcagtagcangngtacgtcatatacagtgacatagaactntatcactacaagtnacagtngtcacggacgatagactgncatacnatagtcgctgtcaatactatcatcgcatgtactctgnncgcgagtcgtacgtcgtgctgagntanctgcntgtcatcatcnaacatactgananccgacatctgtagagagcacgtaaactatatatgagagtgacctcgcagtganctgagatacacgacggtnaaagntagtcacgactgcgattacgaggatgtgatnngtagctgactaatcgcacagtgtgcggtgtctagtgangtagtgctcgtntgacgangtgctagaacntactagctactngacatgacgtgcagagatcgtaagagtggcgagcgccatacagtgngaagcacgctactctgtatgaccggatttgtatcgaatactatatatagtctgtatngtagagtattcntncacatgntncngtgatgacgatgtgntngaccatacaactgtgacatctagcactganngtcgacgatgataatcagtataacgatcganatatangagtagacgacagcaactacttnatagacgcggcctgattanatacaaagagatgtcaatcataatacatnggctnacctatgtagagagagaagactgtgatcagagacttatgtagctcgtgtgcgtactacgagactcgcatcgtantagntcacacaagatgtatac

SEQ ID NO: 8699 - DNA, 2069 bp, Homo sapiens
  misc_feature (1)...(2069): n = A,T,C or G
cttcaacatcgcataataggtataccgttacgaacgtggggtgcgcggcgtacgtcacgatagtggtgagttggatgtagtggtcacctatagcagcgtatactgtggaacattgtgtcagccgtcgcttatacgcatgcgcgcatgttggcacgctcgatgtaaacaattatataagtatagatgaagacagacatagcgaaagcgagaacaactaagacaacatcagtgagagtagacagacttagtggcgattgtgcggatatgtcgcacgacaggnactcggagcgtgtgtactcatcattgcgctacacagtggtatnaatactcagtgacttctgtacgcgcggtagtgtctantcatgtacatattgatatgactaagcgagtacgtggtgtgctgagatgatgaaatgtgcanagacatantgatgagttgtcagtacagcagancggtgacatntggtggcgtcttgatgcgcgcgagatcgnaagacatgtacgtggacgngtatagtanganaggtagtgtcatgtgctgtantgatanatctatgtangctgtcgaagacgatgagnagcatcactganacatactgtanacgagatgacaaagacggacgacgctagtagcgacttccantaagagagtggcatgatcgactgactgnacatgactgattnaactaatactctcatactatacgtgctacgcgatcgtggtatgtgcagatcagacagcaacncagacacggatgttgacgagtactatagtagatgtcgcactanganagagagcgtcatctagntcagtaagagtagtcgttgctagtgacgacgacacntgctgctgangtagcncagcactgctactgcacatactctcacagtngtcgtacgagtgcgcanggcgtagtacgtgtnacgcgtatgatccatgangcagtcatgattatctctgcatgctaactgcnttcgnccanttacnacgtcatacatatctntactcacgtctctgacgttgtnatgcgactntgcgtagngntaagcatcattagagtcngaagtacgcgntnattcgtatgacgatgnaggacagtctantatcagctagtatctgtcagacgtncnactgtgcgcgcangngcgagagcatgncatcagactatntaantatgagtgtnattcgctggatgagcgctcgtgactagctatatctacacagcggctncgtgatgtgtgactgagcgtcaagcgaggtgacacacgaccgnctgtntacactgagatcactatcactatcatcaatnatgtgtacgantgatatagcgcacganactgactgngctgnggggtgctactctgcatcacgctgctaangatacacagctacgtaacntagcgtacgcggtgcgtcacattgngacgaactggtgtatcgatgtgcagcgtcagctggtgtctctatgctatgntgacgcatgatttgacacatatattatagtagtactgngntttacactgatgccgtcatgaatagcgagtgcgtgantagatcgccatcgatcttcgctacntatancgtacatagtagangtgatngtgtcgctagcggcgnangancgtgcgnctgagtcngacactctgtantgattggtacactgctacatcnatacatatngatgtgtganactatcatatancagtcntactancatgctactnncncacctctacgtcacnttgangtcatntctgtacatcgatgtgatanagcgacnacgagatanatagatatacagatgtgtgcaacggttcctcgctcgaatagcaactatnctgtatgtatgtanntgtatgngngagcagcgtcagatatacatcacatcaatatnaaatagatcatgtagactagagatgcgatcgtgantnagtatcgtcgcgnaggantatcagctgatatgttacatgcgatactgtcnataatatnatatgaacattttactngacatatacagtcatgatgantagtcatagagtgtgagagtatcgntataaatgacattcac

SEQ ID NO: 8700 - DNA, 1701 bp, Homo sapiens
  misc_feature (1)...(1701): n = A,T,C or G
catactacgctgacaatcaatcactcagactcacatcatctctatagcngtagcgtcgacggacttgntcgctgctgcctgtcgtcgtgtagcgntgnctagtcgntctagcntctctccngcctactaatcgcatgtagancgaagagcaacgctgagtacaagtgagagagtcgacgcatgtctgtcagactcgatgcgatcangcatcgttcgtctgatngtaatacccgtacataccactcctacananancacactcatcgtgacagtctacaccctgcanctctgtgantctagcacanctatcgcactcacgcagtacncactctantgtataatacgagtgtcgacgtagcgcatagatcgatatatgaccggtagtatacatccagtgatgacagagaatgcgacatatgcngntagctcgaggcactcgtctctatcgtgcgtctcgcgtactcgtagtntacgctntntnacgcggactactgcgacgagaggtgcgcgtgctgatacatgagctatcatctctcgctacctcgaacgcgcgatgcgcgactgacgtgcacgcagtaganttngcgactatacgtagagtgacacacacaactgtagcgcaatcatcatcacnagcatgtcntactcagaagctgagtacaattatcttctccgtacccgcgacatgccacaggcctccgcgnggcgggttntagcgtctcgtgtanctgcgtgctcaactcctatgctcatcntcgcacgctcgctcgcggccgcacgatactgtctacatcgantgcgcgtgcgtcagcaatnatcatatacggcgtacgcgtagtgacgcgcgcgcgtgtcncgacgcgacgcacacgctaagctatatatcgtgcggctcttcaggtcatcatctcgaagcatacatcggagcgtgtacgagtggactgnacaaatcgntcacgcacaagtcgcgctccggtgaccgcgcggaggcagtagtcagacaactgactacgctacgcacgcagatgcactatgatcatcaaataacgatacactagactagactacgtaagacagttactatacttcgacgagacgtcactagangcggctgagtcggctactcgctctagcgctacgcctgcgctangcatacctgtgcgtcacgcagcgtatgtgcacgtcatccactctgtcctagcnccctagcatacacggtccagtcaacaggatgcactacgagagcttctactagacgangaatacaatctatgttgcaccacactancactgatcgtctgagcagtatttcgttgatgatcgatcacgatatcttaatcatctatcgccagcgtgctcgacacgccacgacgcagaggctgcagcgactcgcgcgcactccncngcgacgagtagaacgcgtatagcatgcgcgacgngtcgcgcacgagtaaacttgtcatagtaacctatacgtgcagtccggcgacaccgagtccgtaatataagaagaattggcgaacatggtctagcgcatctcgccatcagacaggatgataggtgtttngtaatataaatattaaaacaattaatagcagacaattgctgtggcgactgtcaaaagtagcccttccaatcgacacctgtgnctcgcgactatcacgggtcatcctagtctagcaacgtataattcacatcttc

SEQ ID NO: 8701 - DNA, 1317 bp, Homo sapiens
  misc_feature (1)...(1317): n = A,T,C or G
cgtgtgtgcggcgtgtggtcgcgtgcgcgccgcgctcgcggatgtcacgttccctcgtctgtgcgtgctttgtntctctgccttgcacttccgctcgcgcgtgcgtttgggtctctgtcgcgttggcgcncncngcgctgtcgtggtcttcgctctcggcncgctgcnctggcgtctcgtggcggtccggcggcgctgccatcgtcngcgttggtggggtgggcgtctggttcgctgtggttgcttcgtggcgtntggctgttgtctggcgtacttgtcgtgtattcncagcgctcgtacatgctgggcctatctntggctccatgctgcgtgcgcgggtcgtatccactatgtgtcgctgtcgagccgcgcctcagtgtcgctatggtgggtcgttatttctcgggcgacgtgcgccgtctttggtgtggctgttggtggcgtcggtggtccgcggcgcctngtcccgggtgagaactcgcttgctctcgtctgtggttggttgtctcggtgtgctttgcgatgcggcctggtctctgcattgtcgctgtcttcgtttggtcgcggctccgtgtcccgtgtggctctctcgctgcgttcgttggtctgtccgctgggccgtcgcgctaaggggtcgtcggtgcgtacgcgggcgcgtggttatgcgccgggcgggtcttgttcgctggcgggggtgcgcggggtggctcccggtgtctttgtctcgggggtctagcgttcggtgctggtgtggcggggcagggcgctggcgtgcttcgtgatgggcccggtggttccggcggctgtttcggcgttgtggggcgcggccgcccgcgtggccgcgttctccttcccctctcgtcctcctgctcgcgcctggcccctgcgccttttcctctgcggtctgcgtttctggtccgcgcgcggtggcccggtgccggcgctgcttcgtcagggtcggtgttgcgcgttgttttgcgtgcgctcgctcgtccgccgcgtgccgtctcctgtgtcgccgggctgctcggcggccgttccgcggctggcgctgtgtcccgctttgtcgcgcctctcntgcttgcgcgtcctgtggtggggtgctggtcgttggcgtcgggctctcgctggtgtattgtncttgttggtccgtcgctcccggtgctcgccttgtgctgttcgctgctccgcgccgttctgtgctccgtgtctgtcccctgttgtaagacggtgtcgtgttcgttttccccgtgaaagtctgtgttctctgtcgtttgtgggtcgctgcgggggttgggtccgtccgggtgggtgtcg

SEQ ID NO: 8702 - DNA, 1185 bp, Homo sapiens
  misc_feature (1)...(1185): n = A,T,C or G
tcctacagaccgagagcattccagatggcgagagtgacgcgtcaggttaagagagaagtgagaaggtactctagnaccagcgtaccctacggctcagaatacacgtctctaagagcgggtccgccaccatactcatacttgcaacgcaagcgcgcgaacgtaccggcgtctctattgttctcaaataagcgatatgagcgaaactacaatcgtagtagatgcccaacgttgcatgacgccgcgaagtgtgcctcaagaaagggcgcgccgcgctgatgcgtcacggctgaatgccaccaacctaagactaacgcccagcaaccaccccaccgtaaagacatttacggaccagcgagatacgccaccgccggcgagacccgcagcacagaacagcggcgcgaatcagagcgctcaccctgagcaccggagcccgcccggtaatgggcacctcgacaccgggaatcacacggcttcgccaggtgcgcaggaaccgcgtagactacggggacgccctgaagtgcgctgtagtgtatagccactcgacgataactcgtgaccgtagtgacgcggccgatcgagacggtgtggtatactaccactacagtacaagcggcgagcgagtcgtagatccagccgagccgcgcgctccgttgtttagtcgttcgcgctccggagttatacgcgcgaccagatagaatgcgtcgcgcgagagagctaaggagatcagacccgcacgacagcaatgacatcgcccgcnacgagtataccgttgaacgccgtgcaccccagcgtccagccaaacgatcagcgggccagcctactacatatggtgaaaccaccggtaggacgcactccatagccgagctggatatagccactgggaggggccgcagggggccgcagacagagagtatgaagccctccacatcccagctcttaacggacagagtttgctgatcgtgactcatgcgacgcatatccagtcgaatataagtacgacggaggacgcacggtnccgcgcgagggtcttgcgcccgcccgcgtgagcaactgaggtgagcacggactagatgtaagcgatacgtgcggtcgcagtctaaactgagtcgcagtactgcacacacccaactcgtcgagcggcgggactacggaataggcgctagacgcccgcagctccataatatg

SEQ ID NO: 8703 - DNA, 1248 bp, Homo sapiens
  misc_feature (1)...(1248): n = A,T,C or G
gtcaatgactgtcaaactgacntnctgctaaaaacctacacacgcggcttacaacaatcgtcaggtccttgcggtgttagnctctccctcctattaggtactaagacttaagcacgaatgaaatagcgaacacagnccctcttctctcactatatatctagccctcttaacacttgagtacttgtcattctgagctactacagtaacatcggttgagtttactagctagatgattcgtctgagataccgcaagcaagcaagagctagatcgtgccacgcacgctagcgctagtccacgcgcctgactcgaatcgtaccgcaaaatactctggcctccgctgtcgctaaatccgaactgccactgactgaatacccatagactcagcgcttgagcctcccccccgatacctactccccttaatgtttactactcgcacatatgttgaanattcagtaacgcgaaagtttccaacctagccactttatctccgataagtagtcctcccacaatgcatctatccagctatatatatccccgattctgttataattcgtcccgattccaattactttaccagccattaatatcgtatacagtgccattgactgatcgtaacgtcactcttatttaatcacatactactaaacacgtacatcatccactgttgaagcagtcacaaaggatatattatgacgctcgccacacatagcattttatatttacgacatcactctagacatctgtccgtatcgatacaccttacagtcagtgctaccttccacccgcatacgcatttataaataagatagattatatatgacgcaccactcccatatcatatatatataataatatatagtatgtaattgtgtagatcacaacnagcactctgtttcgtcagattcatagcgcgatcagtaatatagttataatctccgcatgatctacaaactgtgtcctcttcagaaaataaatattctataatatagctccacatatacctccttgtatataccacagctgagatgtctcgcncgtgntgtagtgtattgtcattacacgacaccagtcacgatcacatctacactgaatatatattatactcatcaacacnctcctcctacactatctaaatcatgtgcatattatcatactacgcacttattggtcaccttcttatataccattataattatatatctcacatatctccgccgatctcagcatatactaaatgtttagtagag

SEQ ID NO: 8704 - DNA, 1815 bp, Homo sapiens
  misc_feature (1)...(1815): n = A,T,C or G
acaatcgcgaaatcanagtcgtctntnactcgcgacactatcagagggtacgatccggtacttacatcgtgccagagctactgactctcagcgagtctcgatgatgcacgttatntgcaggactatgagagaggcgatatantggatgatacacgatgccgcgcacgccgcgtgcgcgcgcncgcgccgcanataggcgcgcggagacataatcatgatgatagtatgtagtagtgatcgtgctagagacgnagacgagtctgatcatcagacacgctcaactgcggngttcatgcgatactccgcgtatcgtatagcggttcactcgatgacacacgtcgtatctantcaatgcataatactgtgaggagatgagtantgtgctgatctcgatactataatgacacggtcagcaaagcactaacgtacantagacatacgtcaatctgngctgtgcgtatgttnatntagaatgttaattatagaccgtcggtcacgcgcagctcgtcatacgtcagancactgatcacttatgagtagattagtncgactgatatactatactcacagtatcgagacaccacgtgctgtggtcagcantngcatantcactctggtatagtgagtgcggcatagttgtaacagagagaggtaganatcacctacggcgattacacgcataggagaatagtggtcgaagtgagtaagatacgtgtagaacgtaacgatgtcgtatggctatgctgcgagtcactcgcgcacatcatgaatatctatcgctacgaagacgtgatncctagagtacgcatgtganaagtcggagtaatagaatgatcatccgatgtacgncagcactgacaagctanctgcacatactncagccgcgcgacgcgtgttatcgagagcgtcactactatatcgtatcatacactaatcgtatacgtagtgatgcgtgtaggacggttattcgtgtcgtgatacacngcagagagcgaatgcagtcgcgtgataacagatgcataactaaggacatcagctctgtagtaggttatatactnctatatatacacagtcgcaggcagtagcgtacgatggagatgaccgcctgnatcgcgaatgcagacgcgtatggtgtaggtgatgccgcgcacctcagcgcaagacgatgtgaaaccacacaacgctcgcgacgtcgccgcgcatagagacgatcatgtncacgtcggngtgcgatacacgtacatgcgataacatagactgtagacgacgctctcgctcatgcatcatgagacgagcgataggttgcgactgacaaccagtgcgcgagagntgtgatcgagacgntgtggatggcagttaccagccatgtgtaactaatcagttaggcggatanagtatgcggctgcaaaacgatgcgtcctatcngctacggacaactatatctanatcgcgcgtggagaatgttaagtgtgtacgacgcgcgcgtcacaagaagacacgatatgatcgagtgcgggangagcancagcgccactatgagtggaccccaccactgcgatcancacgtagtnattacgggganattcgtatgagaatgatgctacacgctaagtgagatagagtcaacgaacgtgagatagaagtgagtgaggatgagaacataagttagatcagtatgagcagagcactgctccactcgtagancgtgacgagaggacgatcgntcacttgctcttatagatctgaatactctgcgacgtctcgctctcgctgtcgatactgctcgatatcgcttcggccgctggccatgtctga

SEQ ID NO: 8705 - DNA, 1314 bp, Homo sapiens
  misc_feature (1)...(1314): n = A,T,C or G
ctccatactgcccttttctctattctttagtagggaagaagaggagaggcctgctcgggataactagcttttattcttactagngagtgtggacacaattaactcgggtacatgaaaatagaagtttgagtcctgtctcggtatgagaatgagatgacctgtagtgcccacctcattgatgaactctggtcagctccgctcctgcggtaggtgtaccctcggtataccagctcgtcgtacgaaatagtagcgacttgtcgccatttagacgcctacgacagcctctaagtgtcnaagttataagtactcgagtttattgctcactccttgctaagaggggtcatatattgtgcgtccaatgcttttttattatcaactatccttgcgttaccttatgctcttctcttcagatcggcgtcgacctcgtttatatcatcaggcgaactcagcagaagcgctcggcataattggcattatgcttgcacatcctctactacgacgtttcatatctcgccccttgtattcgtatattttaaatgtacactccctcaccatcctgcacctgtttattcttattccacatgactattctctctttcctatatacctattactctcagccgcaccggctcccgtgatcatgtttgattgaagcgtactcagcatgatataccacagcatatcatactcctcttctctacttgcacttcttcgtgtgtacgtgntgtcctgtatcnactgttgcagcttctctgtactctcttatcgaatcagctctttcttatccgtcttcggttcgtcacactcacgatcaacgttctattctagtagctctcttactattgatatgtctgcactgtcgtatctcttattaccctctctgcacatctatccgttcatatatatactgcatgctgttgtgcatcgcctttcgtcactccttcgcatcgacgaatgctcaatctagataccagccctcgtgtctccactactcatctttacgatcgtatcttagtatgacactattgttagcgacatgcacacacataggtcgcatctcgtgcgccgtgactatagatgtattcgtcatgctctcatatcacccagcgtttgttntctgctcctcgtcactcgtgttatgtatctatcgttcgtctctatacactactctcttgtgtctgcgcgactgcacgacgantgagnatctgtatatcgttgctatcgactacacgtggcagccatctatgctgccgcacaagacatgcgttgctcacgtatatgcacggtatacgcacgccgctctgttcatctaat

SEQ ID NO: 8706 - DNA, 1562 bp, Homo sapiens
  misc_feature (1)...(1562): n = A,T,C or G
acgacaaccgcacagacccnacacccacaagggacaaacgagagcgaaacgcgncaaaagcgacccctaaggctggcccgatngnacgcncaacgagaacccctacgcacgcggccaacaaccgcagaccaggncgaagcacacgaggaagccacggccagaagagcacagcgccaacacagggaaaacagcgccgccccgccagcnagccacaaccgagaacaacgaaaccacacacacaaccgacaaccacaagcagacgcgagaganaaccgagancaggnacaaccaagccgagagagacgacacagacagcacgcaagcnancacncagngaaaacgcccgacgaaccagagncgaacaaaagacgaacacacagcgaacacaaccggcagacagacaganaaaaacgagagaccacgaaggaaagcaccgaacacaggacgacgacaacagaaacacacactctctctctctctaccgcncgcagagaaanaccgacagcaggcccacgcgacaggcaacaaacacacacaanacaaacgacgcagcacgcaataacnccgnanccgaccgccgcccgacagacgaganccgccngcgacaacaacgganacncacnccaccgcnacanacagaagaccgcacacagacacaacaacacgcacacacaagacacagngccaccacaacgaccacaacgagaccagaaacagcgcaaccaanaaccgccagcgaccacaaacaaaaccaccgagacacaaaagaaccacgcccaacgcaaaaagaaacaacagcacaagcaagaaacgcaagagcacacgagagaaccgagacaccaagaggagcaaccaacgaccagaagccggagagcggcgcacgacaccaacaagagcgccgacaaccacaaacccgaaccgaggagcggcacagcaacagagacgcagcgcacaagagaaccgccgcgcaaaaggacacacccggagncagaaacaacgcacaacaacccgccaccacaanacgacaaaaccgaggaaaaacaacagcaccacacaacacacaangaggacacaaaccagacagaacagacaanacacaacacacacaagacgaacagcacacgaaacngcgacgcagaacacgcacaccaacaagcacgcaaacaacacaaccaacacaaacacacaagcacacgcacacaccaccncacnagcgaaccgacgacagaaaanangcacgcgccaaganaccacangcgncagagcacgccagcagcgcaccacgagcccgagacagaacacanacancncacaacacgcagagcncacagcagcagcagccacgcacacacagaacagancanacaacgagcagacagaacgcccacgaggacgcacacagcgcgancgcaacagagcagacgagacgcacanagcagccaganacanacggcgacggngagataaagancgaacgcaacagaaacgaacgaancnacgcacagacgccgacgacacgcacgancagcacgcaacagagacagngcgagaacagaccgacg

SEQ ID NO: 8707 - DNA, 894 bp, Homo sapiens
atagatgtgaggaataggaggagagagaggaagggggaaaaagggcctgccagatgaacattgtgttttttctttttggttttaacttttttttttttttttttttttttttttttttttttttttttttttttttttttttttttttttggggggagaggaaaatatttaaaaaaaggggccccttggggcccaaaaaggtgtaatttgcagaaaaataaaccatctaggggttggggggggggttttttggagggaaaaaccaaaaaaagtttggggcactttttttgaaaggaaaaaaaggcgcattttttgttttttgggaaaagaaagaaggcgcatagaggagatgagtacgtgatttgataaaggggggaacaaataacacacgagaacacttgagggggaggggaagaacagtacaccgcgggggggtaataaaaaaaagtgatacccccatagagggggggagggcatataaaaaaaagggaacgggaaacaggggttaaatagtgtggggagcagaagatagggtaggcaatgaagggtaagggatacatacagaaaatggtggagagtggggagggtgcaaatgtttgtgaggcaaggtgagggggcgccccgatggagggaggacggagaggaagagatgggaggggaggtagagtgtgtggagttgggaagcaaaacgaggaggcgggacaagaaagggtatgacgcgatagaggagagactgatagagttcgagatgagtatgagtggtaaaaaagaaagatgtacggcaggatggaagaggaagcgataggtggaggctacgacggtgaggaagtattggtgttggggatagaggagatcaaggagggaaaataacggagagaggaggaaaaactgact

SEQ ID NO: 8708 - DNA, 860 bp, Homo sapiens
aatctagatgtttttaatctattagcttatcatttctctacatgatctggatctggttaactaaataactgttgagagtgtcaaagtattttttactataatctccagagagattgtcttccgtaaaattaatattccatgctctcttatatttttcataaatttagaaagttatggcctcccccttctgtaagagaatatgtataaagatcaagggggcctgggttaaacatttttatcgtggccggtcttactaaatggacgattccttgttattaaaggaaaacaaatttatttaaagataatagcttataggaattcttacagacctttaaggataccatcatatttggctttttaagcagtattgaccccttcagaatacccctcccattttgaaagggccgccccacagtgaattcgcttgagctaggacagggcagaaactgccccaagctctctttggaaacacagaaagcaggaaacttctgccggagagtgaccggtgccaccccaggagcagaaccaacacttctgtccgcagggactgggagggacccttcccatcttcagagatctcatgatccccctgagacccccgggttccaggaggagcatgtttcatgaggacagtccttctcaagacagggtgactggttgctcccctcccactgagggtgtcacagctggtccctctgtttcccttggctgagaggggaaatagccaacatctgtcgtttgcataatgtgtgtgcttttgccacttagaattctctgtttctataaacaaatgcttttacaataaaactcgatgcggcagaccccctttaacttcaaataacttattatatatatgttat

SEQ ID NO: 8709 - DNA, 1241 bp, Homo sapiens
  misc_feature (1)...(1241): n = A,T,C or G
ccatctaggatctagatcgtctactgtacaagacgcnaatcgcacgtagncggtagctgtgntgtgtgcgtcntcgagcgtttctagctgcgcacgtcatctaaatcagagnaggcgatanggcgctacacatcagcncatgtcatatatgagcggtgagttcgaagcgagacagatgagctctcgagctcggcacgtgtcagtcgtgacntacngctgacataacatctgtgacacactctacgtactgtatcttctctctgtcacgacgagagncagaaatgcgccatatgtctganccattcgaagaggacgagcagatcgcatgngccgatcgtgtgccgtgcgctgagaatagctgatcttaatctcatcagtcactgtactcaacatatanctgagtcttaagcactcgtattatcacaggccacgctcgtcgctgcggcgcgcgcgcgtgcatcatctctatcatcttatacactctctaacaataactcaacgtactctccaccagtcacaatactnagacatgcagacacgccgcgagtcgccagtcttctnacatcgtactcgatcgttgtgtgactctatgtataagccctgtggccgcgctaataaccgcacaagccctcgtgctaactcgcatcgagccagcgcgctggcgctgcgataacacgtacaagaccgcatagtcaatatctacactaatacggactccagcaccaccaacgcactgagtagcaagatgtatatcagagtaatctctggatcatgtgactgtccgacaatctccctgtgtaccatatccttcaattctggcagcgtggtaaaaaaaactatgcaacacgtgggcggcccagacgcgccttcggtagactctactaaacataatcgaacccctccatataacagcccacaaccaaaatcttaagtaggcgtggtactgcgagtagaaggggccgcgcgataaccctactcaataagaacgtgtctcacgttatcctctctggaccaatccctcataagcatccaaggatgcacggtatcggttgcgtgcgttggggtactgtagcaacacatctaaacccttgaacacgggaatccgctccgctcgtggttgtcacttatatgtgaggtgtcggaacgggtggcctttcgaggtatgtatatatgaaaaggagtaagtagtcggacacgaggcctcggcattaggcgagctcatcaggcgcacaccgcccttg

SEQ ID NO: 8710 - DNA, 1156 bp, Homo sapiens
  misc_feature (1)...(1156): n = A,T,C or G
cttctgggtcgcgtctgtctcccctgtcgttgtttctgctgctctcgtcctctgtgcctcctgttcttccgttctcgcctgtcgcgtctgccggctcctcggttttctgtcgcttggtctcccgcgtgctggctgtccctgctctgatgcgtgacccgtccgtactcgccgcagggcagctgtctcttgttgcgttcgtcggcttttctgcggcggctcctcgtcgtctcggctgctgtccgtctcccgtcttgcttctgtgtgaagttgcgcctgttcgtcgcctccgctgtccaccggtcccttgtctnggcttgggtgcctattcctgttatcgtgtggtgtccttctgcgcatggggtcgtgtcgctgttcgtttggcgtcagttctgtctataggctgcgactttgcttgctcatactccgtcgcgcgctgcgagcgcgctccggggctctttcccttggcggctcgtctgcgccttgcgtcccttgcttgtgctgcgttcgtgcnccatccgggctgccgtgccgtgttggttggtcgtgtgcggtgcttggtcgttcaatgttgtgcgctggtggtgttgtggggcgtgggtttcgcggcggtggggcgtgttgcctgtgctgggtgggggcggttgcgggcgtcacgcgggttctctgtgcggcggtgtatgtctattacgggcggtgttgagtggtgcggtgggtgtgcctgtctcttgtttggtcgggcgtcgcgtggtggtcgcatcggtgctactgcggcgtgtggtgcggcgcngtgcggctgtctgagtagtcacgaggggtgcttgtgttgtttggctgcgtcgttgttgtccttgtcattgtcatgttgtgcctggtttgtgcgtgttcgtgtgttgtgtgtgccttccgggtcttgtggggggtggcgtgttttcatccgtcgcgctcgtgctcctgcgctcccgttctgcggttcggctccctcgctttcgtcgccgtgttgctggggtgttggtcggttctctcttcccgtgggtccctctggccctcgtctctctctcgtgggcgcgtttagtcgcgttcttctcgttaaacgctcgctgtgttccccggaggttttttttggtttttggccggtggttggggcggtcggggtccg

SEQ ID NO: 8711 - DNA, 965 bp, Homo sapiens
  misc_feature (1)...(965): n = A,T,C or G
ctacatactctcagagactagctatccctacaaactcactcatattttcagaaaagatccaactcttcactacacaccagttcagggcaccgcacgccgaaccacaccactagtcccgaagcggataacataagatgtgcatacacaattagactgaactccacgccccagcgcaacacaaaatcaccctatagacaacaaatgaaagaatgatacacgccagctgttagataacgttatcaacaatatatgtgactgcaccacattaatcggattatatgttatatggtaacggatcatatcagtgaccacctagctaatcattcgttacaggtttatagtctagagataaccaatatcacgactaagnaaccaacaggtacggacaccgaaataaaatctacgcctatctaaatcacactaactcagtccacgtgattggcagagagaatacgtcgcgagtaattacacaaaaagtgctccaccctcgtaccaacatgactgcacacgcttatatatcgaagaatataaaaaatatcagtgcgaggacccacaaagaaatcatatataatccgacaagtaatataaccgatgacgtcgcgatcacagaagtaatatccaaaccgcacgcgcacatcagtactatacacgaacgcggtgcctttattatgatatgatatcagggtcaatgatcgctacagattattaatagacagcacaagagtcaccagaactgacgacactattctatggccgcccaatgatagggctccaccatgtggaaataatgatatacctattttctcttgtcgaactgggcacccagtgacgctcggctatatactgtgatagatcagtatacgaaaagcaagggatccatggccgccttctatttcctcaagagtccagtggtaattttcgtgcaatacctaatacttctccgtcaataaacaacgtatggagaa

SEQ ID NO: 8712 - DNA, 1788 bp, Homo sapiens
  misc_feature (1)...(1788): n = A,T,C or G
ctcnctcgcatnaagatagacgactattacgtcgcgcatctcggcgagctgtgcgtggtcgtgtacgtagaccttgcgcgangggcgtgctgtgtatgcgctaatcactcgcgcgcgcgattagtgagagatangatgtatgangacagacacatctatgcatgtcatcgatcgcnggtgtgctatctgcatgatctgcgtgtgctnatacgctctatacatccgacantcatctcatagagatntantancgacntcgtcatctcagtcgtngtgactgctctacgtgtgactgtcgcantactactantagatatccgcgtgactacgtntcntctcttcgcgcatctgcctgctggagcntatactcntcacggaatgnagtgtcagagcgatagtgttcatcgctatgtcacgcgttagacacgtcacancgcgtatactaccagtctctcatangtgacactcatcgcacaccatgacgtcttatctcgatatgttggcatagatgngngggctgtcggcgactcacatgtgtcgtctctngtttgaggagatcgtctcagtgtgagtaggagctgaagtcatcaaagcgatcgtgcncgacatgcgaactcgatgctacngccgcatnagtctgtcgtccgtcangcacgcgtggacgaccgtacctacgaggcgtgtgtcgatactcgngtcattagcgaggctgaggacacanatcctacacgngngtctatactttctactatacgatataccactacanattagtacgtgncacngcgcgcgcgatgcatcggtggacgatagatntgtactactgcgctgcgtcttancgcatgcgtctcancctctanttcatgtctcctcgtaacgtgcaccgcantcgtacangncgaccgcacactgtcgcacgcgctacactataagactctacgcacgtgcgactacgcagtactgacntcagacntgccgagctcgcggcgctcgtgacgcantacttgntgggttcatgacacgtacggatgncgagatcatggcgtagtagtgatagatatcgctcgagctgcgcacgcacgcgtcgtcagctcgacgctgactcantantcatcngacctcatgtngacatgtacgcgttgagcggagctatgctctcgtctctcgcgatcgctgtcgctggcgcgatgatctnctcgtacatgctgtggcgtctgcggtctgttntcgtatcgtgctagacggacagagcacacgacctatcacatccctcancgctactctctcagtccgcgcgttgttaggtgtncgctgtgcgtcattaatattaatgcaacatacagaatgtgagcagtatgtagcgctttcgcggctgtcgtacgtagagtctgacgtgcgtgcngnttgatcatatatcacacggtatcgctacatntccagntgatgacantgtttgtgcgctggcattctacgnactcttctattgtcgtgcgactgttgatgagcgcgtggtcgagtgcgaggtgtattatgacgctccgtgtgagtgatgtctactgcagtgacgcgcgctacgccgttgctggttgtgtacatcgacactgatggctggtcggggctgagtgtcttcgtggtatgaatcaatacaggctttgcggtcgcggccacaccacaataacataggtgtcgtctgatacgtgattccattatgccagaccgctctacatgcacatattggcgtcgactcgtccgcgncacgtctaattaacgcacgcttttactcttaat

SEQ ID NO: 8713 - DNA, 1480 bp, Homo sapiens
  misc_feature (1)...(1480): n = A,T,C or G
cgtcgcgtcgtggagcgcacgcgcgggtaagtcatctctgtgtgcgatgtgcantctaccttatncgcattaagtcatcanctatcgtgtctcagcatctgacnagctatgactagatgagcatantcgagaccgatgcgnctacactgcagtgttgctatatgcgcgtcacgctcgctncggatgacgacatttatgtcgcgctgagtgcgggcaactgatgcgtcagntagcgangctgttgccatcgtgtacgcggcgtgagttatgctcgccatccgagcggcgagantaacatgatgcgctagacgacacttcgataacgttgacgcaggtaaggcgatgactgcaggctgcgcgcgcgacagcaatcgngcgggcgagntggtcgcgatgatacgccagatcgggccgcgtgtgttgtctgcgcgtgtgcggcttaatactggntngtactnttgctatcgttgcntcacangctgctagtgantctcgcgtcgggcnacgtcacgtgcatcgtatgatcgtgcgtgttcgtcgtgcgtgtgtcgtcgcgatatggtgatcagtatcgcgatctatcgtgatactgttgcgctagcgcaacactacacgaacacgcgcgaactcacgcgtactgtctctactgtggttggtgtcgtgtacgtgatcgtcgtgtactcgacatactggtgtgcgcgtgagatatgaggcggtacggagtttgatatcggtggggaagtgggaggatcggatgtggactcgatgcgaaacgatgacggcgacgatggtagttattggggtgggttagtgtgcggtggcgtttcgatcgattatatcgcgatgcgtgcatgtgcgcactcgtatgttcaattcacatcatagagatncgcgtcctctgacggatcacgacgaatcgcccgacgnctcggctctctctgccggcgcgtacgtctcatancgcgtcgctactgcattagcgactatacggataagaatagatgcgattgtgtgcgtgctctgtgctagatagcgcagctacacgtagtnagctctagtcggggcgcgcgttagctcacggcgtgcagagatgtaagacggtncgcttgaatacacactcgtcctccctacngccgctgcaccgncccgctggacacatctcgatgctccgcgctccacgcgtggcccgcgtgtcanctgtctaagtgttctctgtctgtacctgtcaatcgcatgacacgagtgtatcgcgtcacggcttntgtctcgattagttgcgctgcgatgtggctgcacanctgtcgtctgtcgtgattgtcgcggtncgttctgtgtgtcgtggtgtctcgtgctgcgtgctcccgaancgcgtnntttctngtctgttttntacccgangcgcaggtgtccttgctcttcgtcgtctttctctgctggtcttggcgtgcgtgtccggcggccgctcgttggtgtggtaggc

SEQ ID NO: 8714 - DNA, 345 bp, Homo sapiens
ttctactgaaatacctgatgatctcatgctgtcactgttaactcctgtgaaaggaaggcatccagtatctttatcctaagcatttggagatcatgggttccagcttccagagcaccactgaagtggggaaggaagagcatggggatcaaagatcaacctaaagggcagtgcgattttttttttcttatcaacattgtaatgaaacaggccatgcctgtaatcccagcacgtaggaggataaggtgggcagatcacttgaggtcaggagtttgagaccagcctggccaacgtggtaaaacccagtctctactaaaaaaaatgcaaaaataaacatggatcggcacg

SEQ ID NO: 8715 - DNA, 611 bp, Homo sapiens
  misc_feature (1)...(611): n = A,T,C or G
gatccatgtgcaganaacagcaagaggactctagaaactaaggacagtcagcaactcaaaactaaggacagtcagttgagagcaagcaaggaaaactggacctcagtcctacagccacaaggaagttgattctgccatcagcctgatgaacttgctggctgcttctccccaggtccctaacaggaacgccttcctgccacaccttggttttacctcctgagcttcccagcagaggacctagctaagtcacgtggtgctgggacttctgtaaccaatagaactgcaaaaccatcaagcctgtaatcccagcactttgggaggctgtagcaaatggatcacttgagcttaggagttcaagaccagcctggccaacatggtgaaaccccatctctactaaaagtacaaaaatcaggtaggcatgggggtgcacacctgtagtccaagctattcaggaggctgaggcatgagaattgcttgaacctgggaggcagaagtttcagtgagatgtgatcacgccactgcactccagcctgagcatcagagtgagactctctctcaaaaaaaaaattaaattaaattaaaaataaataaataaagcccgatgctgtacg

SEQ ID NO: 8716 - DNA, 901 bp, Homo sapiens
atttataaatcttatattatcggatttagacgattacagagaaattttgcattacacattaggtaataactacgtagatgtcgtgttctgagaatgggaaatataattgtgaacatagatctcgattgtatatgaatataaaattaggcgtggaatggacatagatagtagaaagtgatcgaatggattattgcatgtgtggtctcttgacactaagataattatgggattaaaagagattgcgagtatataggaatgaaatgtaataactatatcatgcgaaagaatacgtggataagatatttagagagggatatatgcattggtacggggggtgaaataggttatatgagcatatggataagattgtattcaggtatataggaggatgatatatatattatatgggtgtcggatgcgatctcatagcaatattcgcagaaaggaggcgtggtgagtataacttcttaattaagaccatcttcatgttatacggttcttgatggtgaagtagcatgggtgggcctaagtttttagggagtcagggtagccaatgaggcaacactcaaatatttgtgataataagagaggacctcagacattccataccgatgataaggtggccagcaacaggctggatccagtgtgcagtagtgtttagtgaacaccattcgctatttgtttacttgggttaaaaatgttttatattagttagcgatgtttgaacattgggaggattaaagagaaatgaaaacgtcgttcccacaaatacttgcacacaaatattcacagcagatattgtttataattgcccaaaactagaaacaacccaaatatccatcaactgatgaatgataaacaagttgtggtatatatcatcctaataaacaccgatcagccg

SEQ ID NO: 8717 - DNA, 898 bp, Homo sapiens
ttaaaattatataaattatttaatagatatggtgatatcttaaatttttgtgattgtggataatgatagtatggataataatcaatatggagtggtaatgatcgaatacttattgtataggcgggattagttaggtcgcgttatatatttaaatgtgtaattgatgggaatatcaaatagttgtttatacggaaatatacttcagtgttagaataggatagtaggaagtgaagagataaaagatattatatgcgaaatatatttatagagacggttggaccatatgcagctgggggatgatgggaatttactgaaaaggagtgatcgtattatctaaaagcgggagaattcaatagatgttacttgacagggctaatagatatattaattgtttatacacacagtgaggttgtattcattaaataaaaaaagatgtgatccagtccattctgatcatcatgtatgattactggaactctattgcatatcgtagagaaaatatagtaatctcttgtaacacaatttatcttaactcaatcatgcgaatactaaatttgaatatacaagcaaggagattataacagtaatcaaaaacctcccaagaaagaggatctcaagatcagatggcttcactgaaaatgccactagaagatgcataggagaacactgctgagtatttcaagaacaggaatatagtattcaaataagttatttagtgtgggagacttattgtacagttaaagtacagatattgccaatatggctgagcttatgctgtttgctagataatatttcaataacatgaaatgtgaagaattagatttttgtaaatcataaaataaagaaggcatgcgagaggttggttttggttgaatagcggggacgcaaggtggggaaa

SEQ ID NO: 8718 - DNA, 817 bp, Homo sapiens
atatcttaacacattgttttaaagatttggagtacagcaaaaagggaaaaagactaatagcactaacaaatatttatgagaatgaaactattgtaaaaaagttttagcctaggattatgatgggtatgtttagtgtatttttgttccttgttagcgtaaaaagataggagtcatacattatttagttaagaatagttttttacttcagtagaataaaaagttgttttgtacctttagaatatagaagggacaaaacaactttgggccgtttaagattattctctccttaattgtcttagattatcttccccagtgcctttcaaatcaaaaagtggaatacattaaagcccccagaggatgctcatgtcatcagatattgttaataccccttctccaactgcatagcatgagggttgggaactcagattcaagagtcattcagacctgggagaaaatcttgcgcatgctatgacctttaccaagttattttctatttctgagcttcaaatttcttcatctgaaaatggggtaatatgttcatctgtcaatctcacctcataggattcttataaggattgaatgaagtaatgcccataaaaagcatttaacagaaaacctgacacatagtgagtgcctggcaaatgtggtaaatactgtctcttaacatttcttcctcacaatgtaaatagactctcctggaaataaagaattccagactcaattaagtttggaagatactgctttaaattagttcttaggtgaagaaccattaatgtattcccgtatgggacaatcttcaataaagagagatcggccg

SEQ ID NO: 8719 - DNA, 1045 bp, Homo sapiens
  misc_feature (1)...(1045): n = A,T,C or G
attacagatataagagtattagtaagaatagtgtagaagtatgactcacatatatatagtatatatgatggacacgttgaggaataagtgcgatagagagatttatagtggatactgtgtaagggagacgggataggatgggatatgtatggtataagagtgtactgagataaaatanatgacgaggaagaatgataaagataatgtttgagtagctctggatggtcaactaaggtatgaagnagagtaatgggaatgaaagagggtcggtggggaataagtgggaggtagtggatgcaatggaagatagcgggaaattttatagtcgttatgaaaatgacggggtgggggattgagaattgctgaaggagcggccaaatcatgcggaatagaatgggaataggatgcgatatggtttaatagtattaaggggggaagaattacattaaaatgaagagggagagaggcggaatagaaccggagtatatatgaaatgacatatgggcgacaggggttattgagaggcagatagaaggtagggtaaaaattagacaactgagccgagccccgatagatgaagtataatgggaggtaattgtatttaataaggtgggtgaatagacgtacggcacagggatagcgtggagtaatatggagtagaagaatagtctgtttgatgaggtgttgaactacctaggatacggaatgatggaggatatattcgcctggagtgaataatgtgaggggagaggatgtactttgataaagtatgggggagaagaaataattgggaatcgagcgattcttcttagcagaacagactnactagtttaccaggagagattatgtgttcaatttctcttctgccgaggggacctaaccgtaccgaagaaagctggcgaaggccctactagcctacctaggaggaacacagnacccggtttgttcttttgacaaccggagtgaaactgacggggtcgggcgcctgccctgcgggtcccctctctctggctgagaagaaaaccaaataaacctcgatggacct

SEQ ID NO: 8720 - DNA, 774 bp, Homo sapiens
  misc_feature (1)...(774): n = A,T,C or G
aatagaaagtattacatccaaggactacgcgaaccatggtattcatggttatctagcccaattcagcattaaagagacgttaaccgatcagcaaccatcttagggnttgcactaaaaagggttttctgcacaaggtatattagaaggagtcaacgtcttgcagtccgtgtttgttatgttgaatcactcaatttttaaatataagtggacaagataaacaatactcactggaagaaaatcaatctaactcaaaggcacagatgaattttaaagcctccttgttctggggactttcttttcccaacaatttttggaaacttcaatttttgtgttaaaccatttatgttcaaagcatccacatgcaactttccctctataaggtgctgtgagggcctcagactggaaaaccagttcccatgctcaagaagccttcaatcttgttgagaagatagatgaaagaactggcttctaacagagaagtacatgtattaaagagtcagttttcccagcactctgggaggctgaggcaggtggatcacctgaggtctggagttcgagaccagcctgaccaacatggagaaaccccatctctactaaaaatacaaaattagccgggcatggtggcacacacctgtaatcccagctactcgggaggctgaggcaggaaaattacttgaacccaggaagcagaagttacagtgagccaagatcgcgtcattgcaccccagcctgggcaacaagagtgaaacttcgtctcaaaaaaaaaaaaaaaaa

SEQ ID NO: 8721 - DNA, 825 bp, Homo sapiens
atcctcatacatcctatcaagaaaaactttccaagaacttcctatcaggtgacctctgaaagttgaagtccatttcactatcaaagacatgttgagacccctgtttatgacctggctcaagaatttatgtaaagtaccaaaagcagatacttatctagtcaaatgtccccaaggatattgaggaacaatgaattcctgtgatccaatccttcaatttaaagatgaagggctgaagtgcagagaggagaagtggctcactcaagttcacatggccagtcacaaagcagattttcaaagcagaacaatcattagtcggcacacaagggcaggttcttactctaggttttcttaacatttcttgtgtatatgaaataaatattagataaaaatgtttttttactgtgtaattttccattcatagctcctcttcttgctaagaatccaatagatacttaataaaaattaattaatttgcatactggctcttaaatttcctattgttcataatttttggtcagctaggaggtgtacccagaaacagaaatgttcttatgagtagttctagaaacttcttcaaaatttcagagcagaggatattacgcaggaagtaagaaagatgtggcttctgtggccttttctcttaaatcaacacaacccccatttgcaatgctggtttgtgtaatcctggcaactcccagctagcttggcagtgtgtccacattcaaagactgacccaaagctataggtcagtgagcaaaaagcagtcttggcttcccctgcagaagtggagaaatgacagaaacattgcgacttcattatactaag

SEQ ID NO: 8722 - DNA, 854 bp, Homo sapiens
cattcatataaatcgttatgggtatagccgaggttgttctttcccatataggccatatcccggttaaatgtcttgagcaggcagcgcatattcctcgacaaggctcggacgttaatgggcagtgcctctggttaatatcccaccggtgcaatccaaaccaacactgtagggaagaaagggacttaggttgaaaatattgcggtctggttttcccttatccaacaggagtcatgaatatttatgaaaggaggaatcgcccatgcacaggttcataggcagaaggttctttaccttgcctcagcaaggcaatttacttctatagaagggtgcgccctcacagatggagcaatgtctggccggactaaaaagaaagcagaagaagaaaagaacccgtattattaaaagtaggaccccatctgatttctactgagaaaaaataaatgaaaactatacgctgctaaggagagattttgttcattactcaaacaacggtcttgactgtttttactaagtaaagagctagaggaaaaaatgatgccttacacctaatcatgatgacctgcctgcagaaggagctacccactgaaggtctcttctctgctgagagctggacactcattgggatgaactgcctgtggaaaggagctacccactttgggtctctagagagctgttctgttgctcagtgaagctcctgtgcatcttgctcaccctccaattgtctgcatacttcattcttcctggacatgggacaagaactcaggaccaaatggtgggactgaaagagctatgacacaaacagggctcaagatttaacagccaacaactagacaaaataaagctagatcagcaag

SEQ ID NO: 8723 - DNA, 1000 bp, Homo sapiens
  misc_feature (1)...(1000): n = A,T,C or G
cagagttttctctcaacacaaggagtttttataagaagcttgggacctgttctcccacacattttatgcagccccaaatgggagcgggaggagcaagcgcacaggaagaagaggctcaagaggcaaccatcccaccggtgtcatcctgtaccctctcacttaaaggattgaatagcattcccgacacgtcggtcattatcagccacagaagtccttacttgattaggtgtgtgggcaagtcaaagtataagagaggaggagcagtgaaagaattgaataacgagtaaacgcacaataacatgcacaccctgtgatatctccaaaataagactaaaaacaggatcagagaagtcgcgaggatcgagacaattatgacttccaattacttccttatgaagaataacacgcgcgcgcacacgaacaagatgtcatcttgcgtcgtcgagctcccgctaaactcacagagatttgtccatgaagacgaactcacataaagcgcgactttcacacgaacaaaaagcagcccgtgaagtgtacccctgctgacgtatctatagaaaataaacgcattcagatatggcgcttaccaggtaagtagacttaacttaaaacgcttacgctatgcgatccgtacgagtatgtaatataaataagattagtaccgctgggcaagcgtagccacattaagtaacgctacgcaactcaagcaactgcgagtagacgcccatttaataataataacatagaaatgttatacaatcgcaacctatcaatccaaagaaacacacgacaggatgtcaatgtcaataagacgtgaagttgacaaccacatcatattgttcaacgacacactcgatcgctaagctaatatcttacgcccacctcaactataccacaactggaggtcgaaaaccanctataaggcatcatacaaggatgccgggaggatcgaataggaataagagcgagctcactctcacgccgacacaatcgaacctgg

SEQ ID NO: 8724 - DNA, 819 bp, Homo sapiens
cctccgggtaacagtctattttgtcacccaggctgctggaatgctttgtataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaaccctccccaggcatggttcaagttaaagctgaaactgtgtcttcgtttcagctcaagagaggttttgattgtgtcgtggcttttccttgtgtattggttgaggaactgtgccttggaggggcggggagtctcgagaatgggtcaactgatggagggggagtggaagacattggttgcccaagaaaatatgtcaacatctgtccatcactgcaactccggcctgattatcattgtctctgcttccggaagcaccaatgagacaatgccactgaaccacattctttggtgcctgcagtatttcccaccactgcgccacctctgaatgctaatgaggaagccaagggttctgcggggctgaaagcctttcaggcccattccggggtcaccatcttaactctggccgggggtcaacctgctctgagagaggctccttttccgaagggtacctcctcacaccctttctggagaggcccatggactaagggagggccatcaaccatctggccgcgtggcccctggagaaatcggccgaaccttacacaggatcaactctaaccttgaaaccgccaaggggccacgctcgcccggcacgggggggaaaccccacccatggcca

SEQ ID NO: 8725 - DNA, 189 bp, Homo sapiens
attacaccccataagaggaaaaaacaccagagatctctctctcctcaagcacactgaggaaacaccgtaaggatacaggcagatggtggctatctgcaagccaggaagagaagcattaccagtaacggaatctgccagcaccctgatctatgactcctagtcatcaaaattgtgagaaaataaagctga

SEQ ID NO: 8726 - DNA, 812 bp, Homo sapiens
  misc_feature (1)...(812): n = A,T,C or G
gtcatgctgtaacgactctcttancctaccacgcgntcacgatataccagaagctaacattctgctgaattttattcgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcattccctcctcctacatttccacactcaacattgatgatgaaactacaaaagtagttcgaaatagatgttccagctgtggttatattgtaaatgaagcatgtaacatgtgcacaacttgcaacaaaaactccttggactttaaatctggctttctcaggtaccatgtgctgatggatgcggctgatcacacaggtgcccttgattgctggaggctgacaggaagaggtggtaacgatactttgagccggccggagcatggaggtgcatgcgctgacagatgaacggggtagatgctgaaagggagatgtacaggcaaaacaaacaatggtgaggtgaaacttttgtatggggaatagcgttaccagagtggagattgaggatgtggtgggtcaaggggggggtctggctgacgggggcaaaaacttgggttaccatatagattaggaggggaaaactggttacggtacattcatgtttattggagtaagatgtcttgtcaactgggattgaattggattaagtttgtgtcctgttataatatatttgtaactattgagagaaggggtgggggaaaactgggga

SEQ ID NO: 8727 - DNA, 308 bp, Homo sapiens
  misc_feature (1)...(308): n = A,T,C or G
cgtttcacttggtctggacatgcgatttgctttggctgaggtatatttgtggaactactatgcccatttcaaggctgggctttaggaagttttacgggtttccacctattttcctgtgccttttccattctgtcaagaacaaagctgatgctctaaggtggatgagagaactttcaagcagagctcccccagccttttttgcctatatctaaccaccttcctaatgtacagatttgctgaaacacagctgacacacagatccttgagaataaatgctcatttttatacaccaganaaaaaaaaaaaaa

SEQ ID NO: 8728 - DNA, 182 bp, Homo sapiens
tgccacatagtcaagaacagatggttccacacgttctgctgccatcctgatcaactgcctcactgatgtgcacactgctccacagcgatttgtggtctctgctgttagaagtgccagcagctggcaacttgtaaatgacccatcctttcattaataataataataatcacaataaagacaga

SEQ ID NO: 8729 - DNA, 1218 bp, Homo sapiens
  misc_feature (1)...(1218): n = A,T,C or G
gggagaaggaagaaaggcgcgagatacagcacgcagaacaagggaaaaaaaggaagttgacgcaagccacacacacacagccactgtagcaaagacacaaaaccaaccgcagacccacggagacaaagccagaacagcaaacacactttccgagagaacaaagaaagaacccagccaggaagcagacaaccaaaaccgcaaaacacacagaagcaagaccgacggcgcgaagcgacgacagtaagaagacataccacacggcggcggggaggagagagagggcgaacgcgcaagacagcgagacgcgcacggcgcgcacnggagcacataccgagaacacgagccacgcgcacaaaacacagaagagagaaaacgcaagcaaaaaagctagaaggcccggagccacatgacagaaggaacagcaccagcacggaaggcagtggcaaaagagcatatagaaaggcgacccgagcgcacggaacgaccgcngctaacggcaacacgacgtacacaggaggagacggcacaagaaaacaaaacagagccaacagacgcagcaaacagcacacacagccagccagaaacggcggcgacacagagaccaggcaccacgcccccgcgaaagggaaaacgacacgagacaaggaccctgaggcaagcgcggcaacgaaccagcggaccgcaacggaacgaagtccactaaacagcggagcggcncgacgtgcgaggcgagaaaaccgcaacacgacagaccccgggaaaaccacagcgacaaacaacaaagacaacaaggaaaccgaagcgagacacccccgcgcagataaccgagaccaagagcaagggatccagacaccgagcgaagcgagaaaaagcacaatcaccacaaccacccgcgcaaccacaacgaacaatcccacacaccctgacgcgagggacgcaganaaacaaagcgaaaccccgccagcagagcaaagccagatcaagcacaagccacgaagaccgacacaccgcatcccaagaggacgcaggcggacacacgatacaaggatgagctcaaccgcctccgacacgccaaatacacgacgccggccgacgccgagagagcccaagacgccaaccgcgcagcagtagggctcacgaggcacaaggcccagggcaagagacacattacgagcagagtacgagcgccggaatccccggacgccgaacacaccgaag

SEQ ID NO: 8730 - DNA, 369 bp, Homo sapiens
gcctagcgtgccctgactctcttaactaccaccgctacacggtcatcaaaaacaaggaaaacctaaaaaactggcagagccaagacagcccaaggcaacatgatgactaaaagtaatgtgggatcctggaagagagaaggaatgtccgtgaacaactcgaaaatctgaataaggaagccagagaaagaaaagtaacggaagcctagagcaagcagaaaatgaataaataacaatttttacagcagaaatcaatgcattttaaaaattagaaaacaacagagaaaatcaatgaaaccaaaaatagatttttaaaaaaaatcaatcaagttgaaaacctctagctagtccaaccaagaaaataaaagaaga

SEQ ID NO: 8731 - DNA, 814 bp, Homo sapiens
cagaggggaaggaattatatttgacatataaaaaaacacagtctagggctttcgtacaaattcatttctcctccagtattgtacacggcttaatcggagtcaaaccaacctgtatataatatgagttgtagtaattataatacatttagagtatacagtttccttgtaatagccagcccacatgtcggttgtgcaagcactccatgttagtgtatgacattgtttaaatgttattctggaggaaaaattaaagcatgaggggtgcatatatattttggattgtttcacattacttgccgccctcaccagaggtgcacaggaaatggttcaaaacgaggctcctaccatataggaaccctgcccatggccagaaacccagttggtagtaaagctcagatttgacccacaaatattactcccaactggccttgtgttggattattttgcccaaggacaaggagactctgccacccagcgctaacctgttatgattttgattcagtttctcttgtgcttttctgtgtggaatacttttctacaaaatcaatattatgctctctatagtttttcgaacaaacaattctaattattattatatggtgatttcttcctgttgttcacatgcaaaaatatggttttttaatggcagcaaatacctatgcctaaggatacaccctccattattcagttaatcccttcttttgacatttaggctatttctaatatactgaattgcacatcctgttcatatctcagatgatgtctctggttatgttaatacttttaagttggaataaaagtgttaccagaaggg

SEQ ID NO: 8732 - DNA, 363 bp, Homo sapiens
aatgaagacaacagcacaagaaacttgtatgaagcagtgcagtccagcctgaggaatgcctgctcaactggtttgatcattttgactgaaacaagtggtcatttcatgtcctatgggatgcttgctgaggacattaaacacagaaacaagtagaacatgaattcagagtgaaggagatgttaaagaggagaaaacagaatctcagagagtaacctgccttaaccacaacaatgtaagtaatagaagcagagcatgaatcctggcttgcttgactccagagtctcagctttccccactacactgtgctgttatgatgcttaattcatttattgtatgcagacttaataaaaatgtatcggcaag

SEQ ID NO: 8733 - DNA, 818 bp, Homo sapiens
  misc_feature (1)...(818): n = A,T,C or G
taagggtcccgcgaagaagcggagantataaatatttttctcgctcgacggaagatagaaatccgtatgggaatattagtgcgttccacataaaaaacgccatactagattacgttaccaaacagccagagggtctccacgacagttatggacttaagaaaaagatactcgtgtaatatcacgcccgcaaaaaaaaacactatgtttcaaagcacatgggtgagatttggtggctttagttattcttgttgcaataatcataagcagagtgagtgtcaagaaaaaaatcccaattccggctatatcaacagtgcgagtctaagtactcacgcgattttaagttgtagacacacaaagaatttttgtttttagagtagaaaaactagagtttcactcttgttgcccaagcttgagtgcaatggaccaatatcggctcagtgaaacttcagcctcatgggttcaagcgattgtcctggctcagcctcccaagtacctgggactacaggcatgcatcaccacgcccagctaatttttttttgtatctagtagagacggggtttcaccatgttggtcgggttggtctagaactcctgatatcaggtgatctgcccacctcggcctcccaaagtgctgggattacaggcatgagccactgcgcccatccattattatcctatttttacagataagagtgttcaccaccagttggaaatgactacagtgttaactgttatggggtcacattttctttttttttaactgctagattcctggcacatatgtcagtgcataggcacataaaaaaaggcaataaaatg

SEQ ID NO: 8734 - DNA, 973 bp, Homo sapiens
actcgctccatctgcttgtataggtagtacgggaatattttttgactgtcgagttgttgtgttggttataactatttaaattgaaggaattttgtctatctcgtcaattttatgttatagctactggtttctgtattaattatatattaaatatgcattaagttgatcaaaaatggtgtgagtggattaaatataagtgtaggggttactgtctatgatagaatgggtaaatatgtggttgtatatgatactaatatagtgttatagtattatggtgtcgataatgtatagttgagaataaaaaggataatattgggttgtctgtgatattatattagtggttgagctacttgttctatttggtgtatgttcaattaaaattagtatggtggccgacattaagttgttcttgcgatatatgtcaaggttccgttagttaattctgattgttgtgcgttataattgtgtgaattgattatttgcggtctggttggggtttaataatctatttctggagggatgatagttattattcagaattatgtgcataatggaatgtctaatctaggcgatgttgtttgttgtgatgaatctagtcatacctataatattgtgttagatttcatccataatgtatcgctttcaactaattctgatgtaggtttcatttatctggagattgtgccggtagaaatcctagtctgggtatcaggagaatacttcatctcaagaaaaaaaaatggagtggtgattatttaatattattaaagggctctcaatgccctgatcagtcccaaggcctgtttttgtattaactgcacagtctgcaggacaatgcagagactagaagacaaagatcgttgagagaagttctccagattccatgggggcaatagaacctacagctatctagtagttaacgaaaaggccctttttttttcttcgatttattctgcgtgtggaatcctgcgat

SEQ ID NO: 8735 - DNA, 900 bp, Homo sapiens
aatcagcggttaggactaatctgcgaggagcaaatcatacactcttctactgacaatctaagattaataaaatctagttgtatttagctatgtttaccagaggtaactatacagaattcggccccagagattatctataatattatttatcggaacaggataatctataagtatatcctttataataatcagtagaggacttatttcatagattaattaccatgttaggtgcgattctaatttagttattcattcgaaccgctgtcacacatataagtttcaaattaaaagataagaggagagagggggatcaactaaagtgggggggcattcaggcataccagccattaagctaaaaaataaggtagcgaaattttgtgataggtgctaatgtattgagctatctttgatcaggtttctacatacgcataataagacacacttacatgttagaagaccatatacagaatgatattatgttaatggtactatttaatgctaataggcaaaaatgataattattctgaattaaatcaatagacaatatattttctatcactgtcttttcttctcaatttgtgtgttgttttaattcactaagcaatgactcctcttaattccactacattttatttaacactgcattttttttcatatgtgcaatattacgctgcccaatagagaggaaatgcagaatttggtctattatatcagaaacaccttagtttttcagctttgggcttgtgcagtgtggttaatttaaaggttctcatcaggctttgatttttgtagtttctgtaatcacttctccaaaataaacaatgtctgaaactaatagtacataaaaggtcaggagaagccccttctctctctgagaaaatcggccgcggaacaaacgaa

SEQ ID NO: 8736 - DNA, 819 bp, Homo sapiens
aagggcgaggggaataattatggcgcgatatataacgccaccggtgagggggtcgatgtacaaatcgaagggatctggacagtgtttaactcggttatatggttgacaagcttccgccacgatggttagtttagtcataaacaaaagaatgcgacttgtatatgattgagtatcccactacaggggttagtccggatcaagggggcgcttcatataaaaatgaaacgataatgtacgtaaatattcggaagataacaatataacgcgggtcgtgcaaaataaaatgtgagaaatcgtcccgtaagcattctaaacaaacttggtcatgccaagaaatgatcgatggtttcgcatgcagcgatgctcacatttttccacgtatttttttgcagtttcatctaacccatgagttatccaccctctcccacattccattttcaatatctgaccttaaatatctacacttgtcaagatgcctgacagctaacactaagacatcaggtgcaatactgcaatttttttcttaagaaaaagatctgcaagaatcttactatacctttgaatatttctgtgtctttgaatattctttgccttaactccctgcaggactagaaactcctaactctccaaatttccatataaaatgtgcattctcaagattgtgaacattaagcagaatatatactttataatttgacctctgttatttagggaagtgttcacatttttaaatatgtaaaatcaagtggaaatgtgaatgcaagtctataccaacactaataaaatatttcttattctcaataaaaaggtatcgcaaag

SEQ ID NO: 8737 - DNA, 957 bp, Homo sapiens
catttcccattattgccatacagtgtgagaaggaaaacggggtacacggtaaacgccctataaatatacctgaggatacctgcggaatttataccacatggtccaacctagtgaacttttttagggatagaagccactcccagataaaagtggatcaggccgcacctgcttttttagacaacaaaatgtgagtgatacggtgttggggggcgtttttatcgatgcagctcctcagggatccagagggagaacaaaaacaaccaaggggtgtgggcttgtaaagatgggcccgtcgtaaagaagaggggcctcaacatttcaaaattaatacgcccggagggcaaactctgaaagaagcgtggtttcacgaggaggcggacgatttatgggtcgacccataatgtcacagcgtatattatgcccacccctgtaggcgccaacgatagtgtggttctctcatagtattcataattttcttatttccaattatccaatggaagaactcccccccgccattgttacaaccgtctagtttgtgattggatacccattcccatatccaagcgcaggttataatagatgggactgggatggccgatgccttatatcactttagcgtgagacttctatgagattgcacatccatcaacgacagagagaatttaaaacgttggtgagcaatacgaagatgacgtttatagctccagttacagtgggatagatgacgccaggggaggcgtgtcacacggttagtatgggctgcagttgagatgacataagtctaacagggtcaaagatcacacagctattatgatcccgtcgtagcacgcgatatctaccgacctttctaatgtttactattctgtgtcgcctagacacccagatttaacccacataccaaccgtttccatcttccaaatatattcccgcgatatccgccttgtcagctcagcaagc

SEQ ID NO: 8738 - DNA, 1668 bp, Homo sapiens
  misc_feature (1)...(1668): n = A,T,C or G
cggtgcgcgagatacgctgcggacgcagtgtgtgncggacccacagtttanannaanacagtaagngggntttttntctntncgataagcacacagcgacacgcaaccacagtgttttcatcagtgtgtgagatgtgtcgctagcatcgcgagnatctatctggcgcgacgctgtctctctctaacactntaancaagtgtgtatatctaataccgcagcggtgccgtggagtgtgagtgcgtgctcttgcgctnaaccgctaagataagtaggacgngtactacgctccgcagctcaatgcgcagtcctggtacgacaaccgcacctaggtgtgtgtgttgatgttactgatacgcacccgtataagacgagagatagcagacgaatctagagtagacatagtgacggcagatcacacctcacagcagcccgtcgtcggagcgtacggtcgttctctcattagagatagatatcgatgtctgagcgaacagaccatgtggacaatgatcgctactgctcacgatctcactttcagacgacgacggtgtggtgctggcggcatctatatacacatacgtctagcgcacatacacgcactcatcacagtagtcgaggctgtgtactgcgacattacagtcctgcacgattgagatagtcgtagccgatgtacgtcagcagcacgtttgacgcacatcatatatatcatgtgcgtgtatattctntatcatntaccatatgcgctcagcgtcatagtgcgtgtgattgcatagctatgacgattcttattacgagtgacgtagttacgagacgaagacgagacgcagatcgntatatctattctagattacgtcgacgtgtagaggattcctcagtcgatatgaggntgtgtcgcagcgtcacagcgtcagcgcagatagcatctcatgtagaattagtacaaacacacaatgttgacatagacatcanataacatgatctctgttctctctcagttcccgatcacactgcgcaccacgagtatcagtaatcataaagaatgctaacaatnctgattatgatgaggagcatgttcgatactcgcgttcgactgcttgactcaantcgtagcatccgctctcgccgcggcacctatctntataacatgtgttgaancacgctgtcatcagcaactaccacagacagaacantctcggttagatgcaagcgaagaattgacgatagatggtatattcagtctcatgcgatcgtcttcacacgacatacgtcactgcgcgagcgacgtcagcgaacgggcgcatcagcggcgtgatcaacgcatacgtcggtggtgtgaattgtgtaagtgtacatattatatacaagctagcgacaaacagtacgtcnatgtngtcgcgacacctatcatcgctctactcactacatacatactgcgctctctcgtgataaagcacactatgtnagtanagatcgtatagctgtngncatcacntcgtnnggatctgacagtatatagatatcatactaacatatcgtcacncgcagagactctnattanttatattntgacatatcnagatgtgagatcgcgacgactcgatncgccgtgtacatatctctccacacatacacgtntcccagagcntacgcactcgtgcggctgcgacgag

SEQ ID NO: 8739 - DNA, 862 bp, Homo sapiens
catgccgacgcatcaccggcgacgtgaatattcgtagtcgcgcggatgttccgaaatcggggcgagtaatgaagcaccacaacgtaggagatgttgcaatcttcactgctatatcaactgaaagtctaacctatgaataaactctcggcgaaactcctcccgtacgctgacacttaccgacatggtcatagaccgcgtctcgtgaacgacaatgaataacgacgacgcccatcctattatgtgccaagaaaacgaccaacccgtgagggcgaacacaaacgtgcactcaccggctgtgttacgccggactctaaaaaaaagggacgacaataacgcaacggcgtttaagggaagtggccggcttatcatcgcgagcggttgcgacggtaaattgcgcgtcccccccgacagcgcttaaactatgtggaggaagataaaagcaaggactgaagaccgcatggaatgtgtgttggaatatcatccagggacgtcgcctgcatgacaaagtagaagacatgcactaaatatggagccataccgcaagtgtcatatgcatgcaaaggatcatctttgtagcagaggaaaaaagcagacattctttactgttaaaaacagcatcaccaacaaaacctgaagttgcacactctccctggctgtgagaaagtaaagctcaaacacactgaaaaccctggatcataaggaaatgttctgttggttttggctcttccatcatacaaatccctggaaacatgcttgtctggggaataaagtcatctgctttgtaaataaagaaaaccagaataaagctgtgaccaggaggctcttttggcggtgcggatattcttccgcgccaccggagata

SEQ ID NO: 8740 - DNA, 848 bp, Homo sapiens
catagcgggtgtgaatatagcgcgggcgcgattataagtgtcggatgaggggcagagggctaaaatcctcaagccatctgaatggcatatccacagaagtatacgtaatatttatcgcgatgtataaagctgcagaaaacgcgatgtagactagcacgtgggagtgaataatatccgcgagtggaaagtggtcggcaattgggagacacgtgcgtacttgtaatctcatctaaaagaggtgggtcagtgttaatggggaataaaatgacacacgggcgtggggctatataaacgctggcgagccgcgcgcgtaagagagctgttacattaaagccggcggcgacaataaactatcgtgggaggaaagaggggtagaggatatctaagtggagtaagacagaggttgctgaagacccctaggggacgggggggagaattttgcccagtatggtgcaccggtcgtgcaacacaggataacaggtataatgaggtcgccaatcatggaaccttatgctagtggtagaaatgtaaagtggtccagaggctctgaaaaataatctggcagttcatccaagtgatatactatagaagccagcaattctacacctaaatatgtacccaagaaaaatgaaaacatttctaaacaaagatgcgtacgtgcatattgatagctacattattccttatggcccaaagtggcaacaatctaaatgcccatcaactgatgaatgaataaagaaacatgtgttatatctacacaatggaatataaagaaatgaagtactgttccatgctactacacagatgatgcttgaacacataggtaaaataaagcgttaccagaaaac

SEQ ID NO: 8741 - DNA, 460 bp, Homo sapiens
  misc_feature (1)...(460): n = A,T,C or G
ttagtacaaccaagttcgctcaatatttatcacatatggttatggaaatattgttattttttctactggcaatcctcatataatgctttttagggattggtatatctcatcatgttatttctgaagagctgattgctttacccgaactcgctttcccggataaaaactgtatattcaatacatacaatcataacttttaagtgccatctaatgtatactgtttacgcgaatatcttatggatcttgccgttctgatttcgtgtcctcgatacaactacatcctttgttttagatattcccttcctagggtttatgtgagatatagcgattcgaaagcnttaaccgggaaaaatcaaatataataaatatataaatatagctcacagatattgatatttcaaaaatcacctaccatcatacccattatgtattctaaactctcctgcccttcctttctagc

SEQ ID NO: 8742 - DNA, 515 bp, Homo sapiens
accctctacctaccaagtcatgaaatgccttcctgaatcacctccccaatctcctagtgatggaatagcaactatttctttgctgggaacacaacagttcatataccagacttcatttttctccactaagaagatttagtattcatgcagaggaaaaaaaaatcacattacttcgaaggacaagattgatgggacctcgggaaaaaaaaataatgattgaaattctcagctgctctccaagacatctgccatctgccagtgctgaataaaacaaaagcttttcctgtcttctgggagcttataattgaggagtaaagaaaaattctgaaaaagtaattgtaagtaagagtcagaagactgatttgattcttgtaaacaatatgagaaattgagagagaagcacattattgtttttcaacagcatgtcatttgagtttggagaagggcaaaggaaagaagataatcactggaagagtatacctgagaaaaggaaaaacaaaacttactcagtcagg

SEQ ID NO: 8743 - DNA, 920 bp, Homo sapiens
  misc_feature (1)...(920): n = A,T,C or G
gttaattgctggcgaactgacntcnnntcttaaatcctacncacncggcntacaagcgtngaccatgaccatcacgcctggtcgatagtacgcatagacagtaccgaatactaggagaagagggcatctactcactcgtnaggcgacccgagatagcatggcaagttagagtcacacggcnagagaacgccatgcntcgtgcacactgtgcntcgcacgcacttnaantcgaagcgaaattaaacgcaagcacaagcaggtgtagacggtcctgagcgacnagaagaatgggtactctagcagacatcttatctcgggctaggatggcaagtactagttaatatgtgtgcttttttgaagataagaaaggcggaaattgaacgtgtgaaacacccgggtgaggaaaaggggaccgtctcaactgtgggtctcaatggaaaagaagctctctagacctgataactcgagccgaataccgcatacttaatcattccgatcaggggacgaccaagatcacaatacttatgtgtactgcccccttaatccctcacttgtcgcctcctttgctgggaccatacaagtttatatcatgagcaggacgcacaggggactatgtgccaagacgtgcctggaaaaaggcataactttgaccctccacttgttaggtaagaatttaagttacatgagcctagcaaatctataatgggatccttgccacgatttattctagggcgcctgaggaaacaatttacgattcattacctcgcacccgacctcgagtttttattgcgcagtacaggcctgatcgccccagttgcacaggcccacagttacacccctgttcccatttgcttgatcctcctcggtcggagatatccatgcgcctcaatcctattcatcccgcgccccccttattgttt

SEQ ID NO: 8744 - DNA, 769 bp, Homo sapiens
  misc_feature (1)...(769): n = A,T,C or G
aatgaacacttattggcgattaacgatccatgacgataagtactagcacaaaactggttctgcgtatttatcctgctccatggcaaatatgatatttgacgggagataaaaaggcggaaataggacgtgagagacaccttggtgaggtacaggatgacggcgcaacagcgggtcttcgtggaatatatgctttgtagaccgtatataccggggctaataatacattcttaatcattccgatctccggatgaccatcacgcttagtactctttggactggcacatcatgcttcaatattttcccctttgaagtaatcatataagcgtagagcttgagcatgagacaatagatttatttacacaaaatactgtcacaatattatatatctgaacctccattatatgttataaaatgatgacacagagagatagtaatacctaatgcgatccttataanctgtgccttcaaggactcctgaaaatgaaaatttgataaataatgtctatttcagtttatatatataatatgctagtatggtatattttctggtgttagtgagaagagaaatattcttgtctggttgagtatgcggatgtctactaggaaggtggcagtgatggccgcgccccgcgcgagtgtcntatgttttgattcttgataatggacatattaattcaaagtccggatagtttccctatagacattatcaaccctcaagttctatttaatattcacatcttacagtttgataagttgtgcatgtacatat

SEQ ID NO: 8745 - DNA, 792 bp, Homo sapiens
  misc_feature (1)...(792): n = A,T,C or G
actccaccgctcacgcgaaaaaggaattcgtattactttatttttggatttggagtctggctctgtcgcctaggctggagtgcagtggcacgatctcagctcactgcaacctctgcttcctgggttcaagagattctcctgattctcctgcctcaccctcctgagtagctggggtgacaggtgcgtgtcaccacgcctggctaatttttttgtatttttagtagagacagtgtttcaccatgttggccaggctgatctcgaacttctgaccttatgatccgcccgccttggcctcccaaagtgctaggattacaggcgtaagccaatctgcctagccttcatattacttttaatagtgcctagccatattctattcattgatacacgattatagatataagtgtttgatccaaaaccgtgaaaacctgcactcccgatcgtttatgaagagcccaggtgagtgccctcaccaaatcaacccccaactatgaaattgttgctgtgtgctatacacaatacttggaggctcattatctttnnttctcatggcggcgcttggtggggggttctccccctgtatataaaaagaaccccactctcccaagaggtatcgggacttatccaagggctgacccctgcttataagctcaggctgaaatcttaacctttttggggtccaaagaacatgctcgtcctatatcgggtccccactagacaatttacaacctctgaggggcttctcttaatcggataccccaagttttaacataaccaccccagacccgttccttt

SEQ ID NO: 8746 - DNA, 818 bp, Homo sapiens
ctccatatatctcagaagattagccaaaatacaacaaactgcggtcgtctgttaatattttactcaagaggcatagctaactaatttataaactatcagccagagaagtcgttaaggattatcgtcctggtggtattccaatctacacagccaccagaatcatgtcgaaaagaccaatgtctaagtcataatcattaagagattatcacagataaacaggtatcaaataaaaatgtcacacatttaaaatgatgagctataaagcacaagtcgcggtattaatggcttaaataaatcaaaaggtgaaaacaatcaaaattgattgagtgagttagggcaccataattgatgggtcatcgcgctaaatcatcatcaaatcattgtaaggagggcattttctcttattatacgaaagcaacccagatttacagaggttaggtgacttatccaaggtcataaactgctaggaagctgagctgaaatcttacctttttatggtcccaaagacatcttcttaggacatggtttcctaattgagcatctacaacttccgaggcattatctttcatgaaaactgcaagggttgcacagataagagtttagactgctgccctaaatgaccataaaacgttaaggattagctctgccaagatgcaatccaaataaaaataagagctgtgtttaagaattctaaatattagaattgtcacgtcaatgatttgtagttgtgccaagtgttgggaatggaggaggtaaaatactatcacctccgcattaacggatctgtctgcttggagcctcctaaattaaagaggcaa

SEQ ID NO: 8747 - DNA, 1156 bp, Homo sapiens
  misc_feature (1)...(1156): n = A,T,C or G
ccttgctccctgttgttcttgctttgcctgctcgccgtggccctgtggcgcgtgtcttcttcggtcctcttgcttcgtggcgctcgctcctctctctcttgctgtcgatcctctctctcttcgggtgctttcttttcggctctgtcttctctgttcgtcggtgggctgctctcttcgtcgtcggccttggtcagtgctccggtgctcgccctcgcccgccgctcgcgctccgctccctttgcgcatgctgtcgggccgtgttggcgtgccctgcggtgctgtcgttcttccgcgctccgtgtgacccttctcccctcttctcggatcttctcctcttttctccctctccggctctctcttccctccctcccctcctccctcccccctctgtcttcctcctctatctttctctctcttctcctctcttcctctcttctgtcttcctctcctccttccgcttctcgccctcttcctctctcccgctctcccccgcccggcgtcctgctctcctcccgtggctctttttgctcgttttgtgttgtggttgcgtgtgtgtttcggttctgcgcttcgccccggctcggccgcggggtgcgcgtcgccccgggccgcgggccccctctttcgccccgttcggtgtctcgcgccccctcggcccccgcgcgcgccgcgcccgtctcctccttgactgtcttccccttctcccccgcggccctcctctcctcgtacttcttgtttgttgtcctttgcgncccctttctctttctccaccctcccccccctttctactttctccccctcctcctccgcctacgccccctccctccctctccctttctgtttttttctttttctttctgttcctgttgctttctcttcggcgctcccttgtctcgttctgctgggggtgttggttctgttcttttgttcttttcgttgttctgtttttttttgtttgtttccggcctgctcggtggtggggttctgcctcgcccttggagctctcgcgccgtcccgcgctggcgcgcccgcgcttcttgttgtttgtcccggctttgaggtttttttttttttttttttttgtttagcctggttcgtcggggtgcccccttttgggtgtcgctgtatantaanatcgggggtgttgtcctccttt

SEQ ID NO: 8748 - DNA, 563 bp, Homo sapiens
accagaatcgctcaagagccgaccggtatccagtgacttcacctacctaaccccgatggcctgtaccatgcggctctatggccgactcgcctgtacaccccacctacatgtcagtttgagtgttctgagtcaccaaacaacccgtctccccacaaattgtgttacagcgtcgcagccttatagaacaaccatatcataaatgaatgtcagcaacaatcacatgccaccccccgagacgtctggttgtccccccacctgtgtattctgcgtgcacagttgagtcccgacacaccgactcaaccataacacaacaccactatggatactttctacacaccgcttgcgatccgtacccggcggcaccaactagcttcacataggccgccggatagcctcgttatcacctaggcgctcggccccccccccatactcctctccccgaccatcccaccccctcacaaccctctcccctccccgctccagccctccccctcagccattctcacccacagctgtaccccccccccagctgcatgttgccggcgctccatcccgcatcaccc

SEQ ID NO: 8749 - DNA, 121 bp, Homo sapiens
ccaaaacagaccaaggagtcagccaacataaccagcacccatccagattattgaatacaacaggagagatagagtagtaagttcctcaagttatagtataatagaagataataaccgttta

SEQ ID NO: 8750 - DNA, 1811 bp, Homo sapiens
  misc_feature (1)...(1811): n = A,T,C or G
ataccagctgcgtctgtnnngcgtagcacaccatctctctctccgctgcgctntgatacttctcatgtgatgngtcaagtatcacagctcactacacaactcgaaccagtatcgcggataatactgacacgtagagagcctagtagcgtcatcgcgncgancatgactctctcgtaancgtatgaacacatccgcatctcaacgtngtcatcagtggcgatctagagantgagagagtgcgcgtctgcagcgatataacacacacacactcgcatatctccatcgcaagcntgcgacanacgatantanatactgaacactctcatgcagtgagagcatgacgacncgctctatctatagcacagagacatgacngcggctananctagccaagtcgangtgtcgtgngcncacactcgacnctcnctgcagcnnagtanagcgacgtatggancgtctctcgcgatctgacantgnggannacccgcacgangcagccgcagcccgctgtgtgngntctactcatcnttganacatactacatctaatagtacaacgcgacgngnacngacacatgtctactnctncactcatncacancttancntcatnacacatangacncnctccgcagaaatctcncctcgtgancgagagtnatanctacactagcntacataccacacgcacatcatatctactatcacacacaattacgtntgtgaactnatcactgactatacatcagcacacntntcactcgtgtntcatctaccactcttcagcagctagatgatancgacaacacaatcagatctacggatagaccacacaacagcgtcacacactcatgagcgcagaacaagaggatgtgcagtggtgtatgagactatgtatcgtngtagagagtcttggtggtgngtgtctgtagagcgtcattactncctgggaccgtggtgtgtcggcgcacaggcacattgacataacgagtcgaacggtatgggatcactgtgtgtgccatctgacagtaagagcactgatcacgagtagatgtagatgtgtagagccactacacttactcactcttacctancgcgtagcacaccatcgcctatcacgactataaatagngntagacatagcatctcgtagtgatagtgactctctggtatctctgtattaccgtcaatgcgataactacacatccatgtctgtatatactncgtccgcnaccactcacatctcctcccactncncctcncacctctcnacatataanncacaaagtanctgtccataacaatgaaccgtncgtcaacactgaaacatanngcagatatggtgcgctacgacataattatnnaatacatgtatctaataatatcatcagtngtcacctagtatccagtcagaaatcattgagtaattgtagctacttctccatananacancacccatatcacacatacatatatgatatatgaacattgtatagcataaagcacagagagaccacacacgcaccagacgggagcggangcactgaggagtgtgtctggngtacgctctatggagatggtggtacaattcgatagcgcttgttcntnttgtgngtgcgtgggacgccgtgcggtgtgctggctcggctcgcgcacatgncgngcgagaggcacgaaacacatccaaccagagggacagaacaaagcgagtntggcgtgcgccgccgcgcgcncgcacctaatgaggaggacacgatacaaggggagcacaacaaagcgcctaccactanacaatttaacacaaacacact

SEQ ID NO: 8751 - DNA, 782 bp, Homo sapiens
cactcatcccacgatctaacttgatcgtggtgagacacataaaagaataataaagaataatataattcttaagcaactagtctaaacagatgaatttaagaaacaaaaaaaaacaataaacagatgtaagagtaaacgcacacaatattcaacaaagttaaaataagaaaataagatagaagaagaataacgaatcaataaaaaatccttgctagcgaaggacgtgattttagaaaatatagaataatagaaaaactgacaacacgcccacgtactatacgtaatataagaaaacacaaattaagaaaatctcgacgcaaacggataatataaaatctatgttttgacaaatagagaacgtggcaaaaatagaaattcattaagctaaaagaggccatatgaaaagaaaaagacaggttgcagttaagggaatacggacgtaacagttctcaacgtaaagattgaatgaattcttttaaataaccctcgggaacaagctaaaaatcatctcttgaacaaactttcatgtgtcaagaaggaactccagctttatgattccagcttccattgctgtcaggacacaggaaaaaaaaaaaagaaaaagaaaagcaacagcataaaacatgacctttgcttccttcatcagtgttacatcacacaatatagtacctgacttctggaatgtcttcattactggattaatgaatgaatattaataaaggagtagcgcccacccccccaatctctctatttcttctgagcacgctcgtaaagaaataagt

SEQ ID NO: 8752 - DNA, 1675 bp, Homo sapiens
  misc_feature (1)...(1675): n = A,T,C or G
atcgagattacgtacaactaccgcacagataatacacgatcgcaagtgtagaacgcgtccgtgaagagtaaagctatagcgtgactcacagctcagttattctaggcactacgcagattgagctcaccntgcttcactacggacagtgatagcataataacgcagaatcgacgaataagactgactgatttatgtgatgctcaattgtcttgtgagtganatgcatccgacttcaagattatgtatcgtacgttgctgcgttgggcgagggatggataggagcaaagcaccaggaatagataagcaacggatgaggatagtgttcgtcacctttatatatattgtatgagtataagacgtaccaaactagataagaggatcagatcgagactatacactagaactcgcatggttacgantaatctcgcccngatacgcgcgacncgaagatactcacatagactaactcntgaatactctatatagtantatagacaagaattacttgccgctgacgcgaacgtagtcatcgtgtncgtactcgctcagtgatatagttcttaatccgagtgtctatgtatcgcagacagtagcgtgcgttgctgantcgcatctccaacagttatacgcacaactgtcacagtctcagtcgctatatacccacagtagtgcctatccaatatactgagagagtcgatgactatgtatgtgtgcttgcgcgtgtagttaggagcacgctcgcttgaacgttgatctgtgctnatgtggtatcagtctcgtaacatatgcgcacctatactctcgtgattatatgctgtattatcgaccacgctcgtagtaatagtcatatatatnacgaagtcgcacagcgctgctaacgagagatatactatgatcgagtctcttctaataagtatacatgatcgacatataaagttcntggcaacagagctactacagatctataagtagcgaagcatagactattcaacagacacatatgtcgcattatcggatgcagtacaccgactcactgagactagatagagagagctatgctgatagttatcgatgagactgcagtcgactacgcgcatgcgactggcatattagactgtgcgctcatactcatcaatagtgtagatcgctgttcgtcgtactcnagtgtgagtntatactcatatcaggagtccatgtcagntgaagacgtgattcngcgcgcactatgacagncgagtacgcgcntntnagagctatcgacttgtatgcgagtacgatacatagagcgcgcaatgtatatgtacncgtgnagatctatctgtctatanacgcacctcgcatctctgcatngactanctgttgtactagatatcagcatcacgtgcgagnagtgtcacaacgcganacagcgacgcgagatngcacnncggncgnngaatatatatacntatnacccattgtatatatatacatacanatcatatgatatatttatctcatgtantanatagcgtnntntcgtagtctcaccntaatgacaaacatancgattctcgtatcacacgatcactcacgtgtatctcactcatactcaangtatgtnatgtatgtacaatgtcactnatgtacatatcgcatcatcatantcatacgatncanttantcatgcgtnatc

SEQ ID NO: 8753 - DNA, 843 bp, Homo sapiens
caaagagtaaagtccaacttccaaaggccaactcctaccaaaatccaaggcgacagaaagatccaggggttagaagcagctcctttattggataaaaccagccctttaaaccggcccatgtcaccatgagtaactaatcaaaataattagaggtgcttacagttgaatactgatcaagccttcttcctgttggtgagcagaaatagtatggtgagcatttccacactggttcccaaggtgtataaaaatgacaagaatgaagatggattcctgtaaatggtatatgactctccggagacatttggaatgaaatttctatttaagactggcgagacacatctattctagaatttttaaaatacttaacatggaagcaaagggatgctaccagctgagatggatccattcattcaatcacaggtcatcaaaacagtagcgtttccacctaggagttgtagaaaagcagaaacacttagctccagatgagtacattcagctttggaaagctatattacttaacctacgctttagaaatttaaaaacaaaatactttgcatttgaagttgccaataaaagagactttcaagttactttaatgtttttttccccaatatgaatttgcaattcaagcagtagcttaaaatcattcagagagactttttctctttagtttcacagaatctgccaacttgttttaaaaccagagaaatctccataagaggatctttaggtataagttttcaagaatagcccccccaaaactcattgccataacagttactgcaaagcaggatacttgggggtatatttaataaaaaacaaaacaaaaacagatcggcaagg

SEQ ID NO: 8754 - DNA, 1608 bp, Homo sapiens
  misc_feature (1)...(1608): n = A,T,C or G
tccactctctactgcagcactcagcatggtcacccatacggcgtcacagatcttcttcccagagcgcgcanaggtgcgcgcaccgaccgacgtatcctctctcgtatattgtgtcgctgaattctgngtccctgccgccgacttgctgagattggagtagtcgcagcgtaatcgtaaagcttattctgaacgtatagtaacttatagcttgcgttcanatcagtttaccgctcgagtagcattccgcagcttcggtgcgggcgcgcgtgaggggnacccacacgaccagaggcaaccggcgaggagtgttgtttgtgtgtttgtcatcaattacattcggcaatattctccaagacaattaaatatacttataccagcatactaaccaaggtcatttcgactatcagcgccccgacctacactgcgtaaagcgtaagcagggccggcgcctaatatacggccttaccacagattcgctgcatataagtgtattcatgtctgtttttctcatgtctgttatcgcagcttgatcgttcacgcgatttacggatgtgtgatagtatatatgagactgcgaacagaccaatgcacgttcatcacattttacttcaggtggataccactcctcgcccgtcgctgatattaagaaatgcattcagataagtgaatcaaagcgctatagatccataactgtatagagtgcagtacgacgccgcccgatgactcgtatgagtggtacgacgacgatagattgcgcgcttcgtgcgtcgcccaacactagctcagcgaccgctggatcactttcggataaagccggcagaatgaagcgattccctacttacgtcggcgcgtactgtgatttcacacgtcggtcggcacgtcatagatgtaacatgtctcgcagtcgcgcatctganatagtcatacagcatatagcgagactaggnatatacatctncnatcaccctctctcatattacgtctcatagtgatttgttatctcgagaggtgcgtgccgactgctgactcattactacatacatagagcgcgtatccgcgcacgagctctacacatatcgtcatgcattcgcggcgcactcacgtgctacngtcactagtcataggctgacgagactgaacgacgtgactgcgtacgcgagagctcgcacacccgcgcgcagcngcntctgcgagctaaagagacgtcacgntcacttgccgtncacgttcgacgcanatgttgcntcactctngactgcgcntcagcactctagcacgtatcactactcctagatactactcgcagcancacgtcagcgcagcgcagtcgcgcgcangatgannanactagngagcgannnnanntaagtatggctgngcattacgacncanatnatgctcactanctactcactactgtatgttctncgngctatagtcggccgtatcgngattantgtgtgatagtatcgacactccggacatacagcttagccgcatcgcnagcgtctcatngagctggcgtcgcgtgtgtcactacgctctgcnntgtcagcncgacatagngtctgacactagccagcagcgcgatgtgctncgctctgntct

SEQ ID NO: 8755 - DNA, 828 bp, Homo sapiens
aaacagttagtccatacaccattatactcttttatcggcacacaaacccagtatggttcctgtcagtataacccacgcactgaaaccgattactattatataagtagtcacgaacataaccagaaaaagccccgtttgtattcaacagccacgcaatataccaacacaataacagattcataattataaaacaataccaaccgacactatacataaccacccaaataattagtatcacaaagcatgccgcattaggagccaagcaccatcactgaaaaacaacaactcacagacaattggatacatgcacaaagtcaatgtcatagcagtcctttgcacatgcatccccacaccagacgtacaccacaataataagaatcatcagtattccacccgctcccagttctattccacaaggtcctggtcagcttccatccattttttatggaatacacttggtcttggcaacacactgagccaggcagaatggccatgcatcaccatggcttttaaatgtatcagcatccttccttgctggaacaaacacgcatggctcagacaggtaaacatgaagccctgggcagctgcacgtgtggtacattttcctggaatagtgacaatggcttgaatttctctctctctgggtattttgttttaaatttttaaacaagtcaccccttcaaatgcattcactaccttctcattctgaattactcagaccagaatccctctgtgtctcccatgtgtttgatacaaacacatttctcccttaaggagagagggcctaggatcatggcccttgaaattaatccctaatgtatagggcag

SEQ ID NO: 8756 - DNA, 1195 bp, Homo sapiens
  misc_feature (1)...(1195): n = A,T,C or G
caaagggcaccctctcgcacagacaanacaagaaaagaagngccgttagaagtctaactagnngnactnctnctcctagataaggcgaccgaacacnnagttgcactagacnttccccgtacgtggtgagataacctactgatacggggaagggcttataccatctgtgccccagntagctgcaagtgatgaccngcngaggacaccacagctacacgcgggctttccagtaattttatcagtcatatataaccctagcnccagcacgggtaatggggcactgcagccgcccatgaagtagagtcctcttggcatacctttaatccacgcactacacataccangtacgtatgtatttgcttgtgttncagggaaacgcataagaaagtttaaaccaatgcattaatgctctcttcgcaatcatactgcttacatggtagaacgtcgcgtagattaatatatgctttgatgcacaatcaccttggcgtatagttcagcaaagccagcttgaggcacaagattactttggacaatgggatgtaatctccagtttaattcgcaccagcagcgctttgcaacgcagtaattaatcgcacagccctatgcacacaaaagctcagctcatgctatgatgttcggcaagctgatcacttcaacagtttggtaattgtgggccatatcgtatcacaattctcaggccaaattggggattgccgaacaagtggggatagtaagccaacattcggaagtcattctttaattgtaaaacgacagaatgttttgcctcctatgcgtgacacagaaaagaagactcacacatgatgccactttcagccatggcagacaatggccattgcccaaggcgaccttccgagctaccagcttgaaggggagaaagaccggagtgagttacgcagtggcataacctactctggtctgatctgagctctttgacccaggggaccgaaacatgatatgaaaggcttattcgtatctaagccatcggaattggggaagagtctacgaacagggaagcttggccattcctttaccaacacattttctacaatcctaagagaatatatagctgggcgcctcttctagtgaaaacaaagaaaacatggaactcccacgcaacaagtagcctaataggctcgttctgccgaaaaacacatccaaccaacaaaaaagtaag

SEQ ID NO: 8757 - DNA, 858 bp, Homo sapiens
  misc_feature (1)...(858): n = A,T,C or G
tttctatctatcaccattaccatatcatcttctatcattcaacacccctatctatgaccgttagttaattaccacccccagccaaccgcaacgctggaccgtccatggtaatgtagttcaccangttcctccctttactacaagtttctaacacttggatacagctatatcttccacaaacatggtattaggaagttttatttttatgccaccttggtctttccctatcccccacacatagtcctattttggcggcaacaccccgtgggttcatattttctgcaacccaaagaaccttcaaccccactcagatggtagtcccacaggctgttttgccctcaccacacacgtcttcccctcccaatatttagtgagtgcctcctttgtgcaaattacatgaaaacagagtcatcaagcttaaagagggcaacgggtgttaccaaaaccatgttgcagctacttctgcaaaatcagacaggcaatctgtcatcagaatccacacaccctctgcacccctgagtgctatggtcactctgtcatctatcacagaccctggcttctaggaagacttctttccatttctttaaaataaggaaaaatattttgcctgtgaataagcccagtgcaaaggccctgcaccctatcatctctccgtgccttgaggatacttcttactccttctgtatgtgctggtggcaccattatacccctgctcattctcattggccagtgcctgtattgcacctgttgttaaatatgtgtaagatcatgtctacccctatctcttccctacaaatgtttacaactcccttctctgtgaaatctccnntagcaaaatanaagtcagtatcagtaggg

SEQ ID NO: 8758 - DNA, 930 bp, Homo sapiens
ctaattttattaaaaatataaaccagaaaaacctgataggtaacagtgactctctcttttaaccaccgatacagtatctacaagcctctcttcaagttagctccatggtttcggagaaacaaagtgctctcccctgagttgcttgggtccccagtgaaaagggcgacatcatgagcccagatggaggttatgcatctactgcactgaaccacagtcaaggaatctgggaccctgtgtctgacacattttatggcaaccagcatacttgcctgggaagcaagcccttgccatgttgacatgctctggtcacttttacctaagcaggtacttacatgactagctactgaagctgcctgacatctggagatgataacccttgtcatctggcacactgaacaaggaggtctacggatgctcaaggttcatgttggaactgcctttctaaacacttgagttaaacaggtttgggtaattttttataaaaatattctcaagacatataaatctaaataaaatttctatattcgatgttacctttaacattgactgttatgtgagaggagtctaatattttataactactaatgaaatagttggtgtcattatatgactaaatcccgtatgtgaggttcgaacaaggataaaagtaacaatcaacgtactttctttcagagtaactcacccattataacttgacatttaaatggatctccatatacattgggtacaaaacatttataattataggtcgtaaagtgcttgatagattttaaaattattacatcttgaagtgccttgtcagtaaggatcccacaaatggccaatatttatatatttatttatggaaagctcttcttttagcgttagggaaacaggacacagaattccacagttataaatcacaatacttctcataaatttatataccag

SEQ ID NO: 8759 - DNA, 888 bp, Homo sapiens
  misc_feature (1)...(888): n = A,T,C or G
tcctcgtcatccgcgcctcgagagtccgcccgcggcacgaccagacnacgtcaccaatcgtttggcttatgctgcaatccagttgaactctggtttaccacactcgtttgtataacgattcacagcacttcgcccacatgtgacatcctcccatgcagtcgcccgtctccccagccccttgtttccagaccataagtctgcccgcccccacgcgccgccccaccatcccagccgttgttgaccgcaggtcaccgcggagctcgacagcgtccacggccaagcgtgctccgccgcttccccccacaggggcctgccaaggctctggccatatctcaccccacacattttcccccctacgcacacctaccaacgcgttgcacatcgcatgcgtccttacaccatctctctcagcgcacacggcccgacccctcattatcgatccgactaaccaggaggggccagtacagccaatacacatggcagcacagtaggtcaatggtaccaaagccacctccaccccaagattctcgcacagtttctcaaccttggcaccctcacattttgaatgtaagcacaatcacattttggtccaggtaattcttactttacaggaaaaaaacagtgcattttaggatgtttaacactcactacatacttgtagctcccctctcccagttatgacaactagaaatgtgcccagacattgtcaaatattccctggagggaaaagctgtccctggttaagcaccattgggttatacacaacaaacaaagcaaaaccaaacaacaaaatagaaaaccagaatgaaaagtttacccccctgagcgtatcnccccgtaaccgaaagaccccttcctttcctttcccccaccgggcctcccgccagt

SEQ ID NO: 8760 - DNA, 545 bp, Homo sapiens
  misc_feature (1)...(545): n = A,T,C or G
ctcttcatataccgcagcgcaggactagtataggagagacagtactagacagagtgctaacggctacacgactaggaactagtggtaaggcgatgaatctcgtaggtgatagcagtcgtaattgaagtgtaatatccggcaatacctactcacggcatcccatgtcatcaagcgtgaacacatccctgcccggttgccctctctagcgtaagctgtgtttgcagccctagataactgcgacagtcaattacttacatcgtgtgttatgcgtgcatgccggagttgaatactcacacagtgcgaaccgagcgcaagtcacacatcgctagatgcacccttcctcctacacatatgaaatctgataaacaaaggagggacgccctccctcctaacccacatcagccgatcctattgacgtcacccacacacccatcaactccaactctatacattcacaacaaccacacatccaacagctaatacaagcaacctaaaaccaagcaatacattgagcacttcccccancctcctaacaaaaaaattga

SEQ ID NO: 8761 - DNA, 1254 bp, Homo sapiens
  misc_feature (1)...(1254): n = A,T,C or G
aggaaaaaaaannaaaataggaaaaaaaaaaganncnacacagacgacaacaaacacgagacaatgggacgaacatacanaaacaaaaagtccttacagcccgcgaacactcacacacacacgctactctttancccgcacgcacagcgcacnnaaccacgcgaccgcgcgcagcacacgaagcacgccgtaagctctcctgaacgcgccagcaacctaccgcacctcgccgagccggcgagcgagcacgcataagaagcaagcgcggaggntacgggacgggcgcggagagcagtcagcatacaagacaggcgagcgaagggaagcgcgtgacagagggcgagagagggcgtagagcgacggacggcacaggggaggcgggacgggcgcgcggcacgggaggagggcagcagggtagcaccccggacccccgacgccaccagccaaccacagggagaccgcacacaaaacacgataggagtaatatataggatgagcagccgagcgaagacacgacgantcaagggacgccgcccgccgcgcgagcgaggacacactggcacgatacgaacagcaaggcgcaggcgcggagggagggcgagtgaagggcggcggacacgtgacataagacgtagcacaacaagagcccacaaccacacacatgcgaacatgcgccgcgcacgtcgcaggccagggacgcgggccacgcgccgtaagcggcagacaccgcagcccacgcgcgatcacgccctcacgtgaacagacaacctctcgcgagtcgcactagcgcaccgtctaacagttacacgcgaccgcccaacacaggaagcacactccggccgccgacaaaccgacgttaggggcacgtcaggcgagacacnaagcatagcgaggacacaacngtgaggcagggcgcacatgacggacgcacagtanagcgagacaccgcggccaccgactggctgccgcgcaacacgacgagacacagacagcgacaccaaagcgccgtcacatacacgaccgcacacacgcgtgaagcacacagcagagagcaaagagagccgcacgacgcgngaacagaancaccagacacacacacaccacccgcgagcgcgacaccggatggaggatcgattgcgcgccgcgcggaaggacgatcgaggcgaggtcgagtcaacgcacgaaagacgacggacacggcacgcgagacagttcggaggatccaacgcgggaagacgcgagcacgcacagcag

SEQ ID NO: 8762 - DNA, 809 bp, Homo sapiens
  misc_feature (1)...(809): n = A,T,C or G
cagcccccaccccacattgggaggttgtggagaggttatatgaggttcgactagtcgcgtggactagagccatttctgcttatagcgccctnaccgaataacacaatcgcggcatagggcccgtgcttccaattacagcacttttaaagggtgaagaggacgtgcacgtctcgtcattttctgtcacccatcggattactttgatggaatggccagatcctacggaacccaggcgcgaatgaggttggatccaggagaatatggagaatttacaagccctaaggcgtattaagggggttggaggtagtcatcccacatatcccaagaaaaagttttggggccggagggttctccaggtggattctacctacacatttaaatgagaaatccaaatagttttcaaattgttccagaatttgaaaaggatggaacacttcttaactcatcttatgaggtcagcattacctggataccaaagccagacaaagacattccaagaaaagagaggtatagaccaatgtcccttatgatggaggccttgttttcacatcagcagtgacataaccaatgaagcttctctttcactccgagttcagggtggcacatcctctgaaacatgctcacaagcttggtgctgagagatgagagattcgcaatttttattggcagaagatataaagaacaaaatatcaaacagtggcagagaacccagactctggaaggcagccatctggactgggttccttggaattagactctgcgatgcccatttgtatgcagctttccttgggagcattttcaaaaccaat

SEQ ID NO: 8763 - DNA, 1790 bp, Homo sapiens
  misc_feature (1)...(1790): n = A,T,C or G
gggggnaaatgantgagngnnggannnngcgnggacggncgccgcagcnagggtgngcggcggcgagcgtaggggcangantngttnaggtgngntgtcctcttcgcnggctcantcgccacgganatctccctcgagctgttagaacagaacgacgagcanacagctngagagagtggatgtgtcgttgatgggcagcacgttagtagtcagaagagtgtaggtagtgaggtcgagagagaagtagaggagctgcgtggagcggccgtactcgaagttgtcnctctatgatttcgatgtgtgattaancatagtgngaagtatgagtgcgagttgatatgatcatacatgtctnataattgtcagataccgaattatagtgtatcattgaataatatcatctaatatatactattcaggagagtgcgagcgtgtggctgcagtgagagcgtgactgtagcgcagattgaaatacgcanaatgaatanatagacgacataacttatatgatgatgagtgatgagcatgtggaggagacgtgtagcggacgaacgatagagacgtgcatatatgcaagatcagcatcacgacgcatcnagcacatacantngangccagatcntaaangtgtatgtataatgnganagacatataaataagtcgcgcacgaganatncagnagtaganatagtcatgtagcaggacgacgacacncgcgcgcggcgagngnagaggcgnacacagaanaacnagtatangcaatgactaggcacgagcagaanagacgcagtcgagaanagcaggcgagcgacagagagcagtcgtgtacatgagacgngantcagtacgcgtgctncgactagntagtnatcatatgaganatcagtgcgtantgcgtcgattgaacagntagnctctgcagtattgttcactatttcatcatcgtgctctcgacgtctcgacgacctgtantactacgtcgntntnctgtgtatncgtatgcgacgatctnccacancgtacgcatcgtatntactgacgactanatatagncatacttacaatctcgagtctgtnctcgntcacantgntgggtgcagtagantntacgctcnatgtagtcncgctcatcgctggatagtcgtcantgntntntagtgtngttnatactgatacgtctacgacagncgggaacagtntcgacgactaaaatttgatgatatggcagngccgtcgagcntgagagtnatctangtaagtcgaantatntgggagatgcgtagactggagantgcatacttagcacatatntgcgatacgtcgcgtagtaaacagtngtgaagatgtatantacgaganantaaattgtacgagtgtgagtatcatgctngatacgtcaatagcacacacancatcaaccacgcatcgatcgcgcgagtgacgtatatgngactagtcacacatatcgtacgcgattatcgacgtattcacatgtagnactancgtcagctcgacagttatgtcnagcatcacgtagnangctgatcgagacgactcgntgtgctnctcgtagatgcgaaccgtgcggactgttcgcagtgtcggatcgactagntcgctccngagagtgtatgagagctccagcgtgcgtgacgtgtacatgttagtagctgactatatcatgctgacacgatagcgatgatttatatgatactacgngcatatctagtgatagatacgaacattgnacgccgccgcntctcgcgtcaacaagatgagtacgcacgcga

SEQ ID NO: 8764 - DNA, 807 bp, Homo sapiens
  misc_feature (1)...(807): n = A,T,C or G
ccaacctccccgcgtctattctttcccacacagctccttttttcgcccgggcaacttcctttgcaccgatagttctcgcggtttacccattaaaacccgcccctttctctttgcccccaggggtcgactaaaggcagcaaagggaaccagcctcgcgtccgccatcggcggctcccaatgcgacacatgttccccttgttgtgggcgccgtaccccggagcacatcagactaacgcttacgcaaggcccattcattgtaccaaggtaggcaaccatgaccagccatgcccacttctccgcagggcagtccttccgccagcttaagcccatcagcgcccccaaaactctttgttgaccgctgcaaggggcccgaaagccccggcactgtcacaatagttccactttcctggtgcttcctgcagattcgtaactcgggctccggggccagcacagtccagttcattttctatcaacccatcatcccccgatggagggagccggaattctttcccttgctcagcaaccctattttgtgaaaggttctgtgcttggtgccatggcaaaggcaaaaatgaatcaantagagtatgggcccccacactgcccagggcaggttgagttgtccaaagcagcacggtatagttccacaggctgtgcaggaagcagagctggggaggtctcaggaaacttataatcatggcagaaggagaaggggaagcaggcacatcttacatggttcggcattaactcaaaagcccccagcccagaatgtcatctgagacaaggcaaatcccttcttcctatgag

SEQ ID NO: 8765 - DNA, 811 bp, Homo sapiens
cgtttttgacttcgcaatgggaatattgaccatgttcccagcccccacacatctcaaaatttgttttctaaaaagacataacgttatatgccttagggtaaacctcttaaccaatgcaagaattcctttcagaattctcggccctcttaaacaaacaagtagataatgctcattatcaactcatttatcttttccattataataccatcaatctactttcgtttttaaaacccaccccattaacctcgtaaaaagggctttttggcttacttataaaggaaaccttagccacccggtaattaaccaaaaaaaaaaggttaacttggttcacattttccaggctgtcaggaaactttgcattggcagttgctgggttccaaaagggtcctcagggaggtttacacatgccagaaggtaaacaaaaaaaggtatgtcacatggccaaagcaggagcaacaagggagaggtgccccacacttttaaacacccagatgtcatgagagctcactcactcttgcaaggacagtgccaagaggatggtgctaaacatgagaaatcagccctcatgaccccatcacctcccaccagaccccacctccaacactgggaattacaattcaacatgagacttaaagggtacaacatccaaactatttcattccatccctggcccttcaaatctcatgttcttctcacattgcaagatacaatcatcccttctcaatagtcccccaaaagtctcaacctgtttcggcatcactcgaaacgtgcagtttattttgagacaaggcaagtcccttccactgatgcg

SEQ ID NO: 8766 - DNA, 1768 bp, Homo sapiens
  misc_feature (1)...(1768): n = A,T,C or G
gganagnnanaggacagcaggnacgagagaangcaganaangacggannaggaacaaaatgagagagagncnnncnataagaaaannanaccgcttagcagatctgcgagggacacccancaancgagcgcagacccnacacgagcatttcatactcgcacngcgtnancatacctcgcngananactccgcngcgcacncggtccctcgtgctgcctgaccgagagcagctnctctatcantcagtagaggatggcagcncgcagagagaccaggagacgagcgcgcagagtcgcagaacggcggagcgcgctgcggntacagctctctctacgttctgcactcgcgacgctgagtcntgcttgtcgcggcgcntaggtagggngaggtgtgagtgtcgtgtgcgctgtgtntgcgtcagatggcagagagagctnantatgtnaggtcgggcgagcagcggatgggccgcggcgcacggcgtcnctcgcnccgcgagcgactacaggtcgtcgatccacnacacgccgcatggcgaccgccgcgccgcgggtangnancgacngacgcacccgagcagctgacacacncgagtcagcgcgncgtagccgccgcagagcgtacggagngcgnatgaggtgacgcgagtagtagcagagtagtanagacaatatgatgtatanctttattgcagatacctctctctcntcgacgtctcgacacagctccgcgcgatcattgtatataggatctcgtgcgtgcagtgcggntcggacgtgtgcgagatnaacgcgagactncatgtntgcgntagcgatcatcgtntgcacgacgtgagcgagctcgagtgtgcagagatgagggtatgagagcngagatgatggattcagcgatatctacatcagcgcactctccnacacacatcatccactgtacactcatcnatatatttacttactcctaccagctgctagangtacncnnatccgtcgngctgacgcgtggtggatatcggctctcgcgtcgtctgtgtgtcactgcgataccagcagactanagngngcgaagatcagcgtcgctatcactgacggcgatgganananatgtngcgtgacncagaantgacatagtataatgataattaatgtcgtatataagattgctcgatgtgtctcacanagnanatatcacatgaggaagaagagatagcganacnagtaaagagagtatatacgataatnaangatacntgtngtgtaggaaagtagcacgacgacggtgtgtgtatgagtagtactantctatgtnatatatgcacgtgtacatagtatatagagtgtatatatgactgagcagctaccgcggatctcactgccagcangcgtcgtgttcgcagcgcgtcttctcgtcgacatagtcactgacgtcagcgcagcaccacgatcacagtcgctcctgtcgtcncagacgccacgctgtcgtcgcgcgcgagcagcgcgaccgnnctccacctgacntcgcatgnatgtctacacgtcagcgcatcntgcatgtctggtacactcgtccacgactctacntcagacagcatgactaggctncgtaccgatccacgtcgtcggactagtcgnttcggatacagactcantnacgatgtnacataccctgtcagtgctacagacattctgccgncacacgtacagtctctctggcgcaggcgaangtacgagacgagagagcgcatgnacangtacgagtatcgtataag

SEQ ID NO: 8767 - DNA, 790 bp, Homo sapiens
ctttttttcttttatcagtcccagtttttaatttatcaatcccgtaactgccagtaaaaggccccacttgcaagggccctggggccccggaggcaaaccaggaaacataaattgaacaaggccatttctgtttccagggttcccatccgcggtccctagggattttccccatagatcaccagtgttgggggccacaatcggctcctgaaagactatgggaaccccataggcctgggcgggttgttcggaaggtgcgaggttaaccacatttgcacagggaggacctgagaagacgctgatcttccatctgtaccccagaatcctgtgcagggcctcaccataaggacaatggcaagggttggcaccttggcctctggttggcctcctgaatagtgaagtataagtcctgcaagcttattagcatctggagacattccttccagctcttgttgatacccctctgcttgagacgctgagcaattgcttttgatactatgtgatacttcttcttcacgctgtacacctcacgttcaagaaattcccattcttgcaggaaactccggatttcctggtcactccaaggtttaactgactggactgagggcttttctgatccctgggctgtgttttcctgctccattttctggatgtttatggtagtttcagtgggaagtattactatctccatttttactcctgagttttctcccgggagtcttctcactgtgcctgcagggtctggtcagttcctgagttggcggaacactggcacttactctcctctagtgga

SEQ ID NO: 8768 - DNA, 1687 bp, Homo sapiens
  misc_feature (1)...(1687): n = A,T,C or G
ggggggttggagaggnganggggccgccagagtngnggnnaggagcggcgcggcgagcgncnaancgcggcgagaggttgnatcggcgagaangtcgagnnggnngggcatgttnngagggcccacgcgacgcagngnnacgcgcgcgcgccggcggnncgcgcgcgccgcgcggtgcacaacgcaccnnncactacgacgnnattntacagacgaacgtgntccnagcgccgacncatcnagatcgagcangcgtgtatatcagctaatatccgcgcgcgcagaacctnactgcagatgcgacgaggaccgacccaccacaccntagcgtctctcgncgctttacctctactcttcntgaagaanatagcatctaatatagaatcacctaagactattaagcttatatttatgtccgttctctacgattctctatactctctatgtagtatctccagacacacattgagtcatcatganacacagaccgacactcatnagtatngacaccatgatatactccacacctacttctactcctacacgatcacataatncaaattcacataatactatcncacacacatcaccacncgacncgcagcgcgcaaccganagcgagcacacggcnagtacctacacagatcncgaactagctctctaatacgtcagantcagatgagtnaataatgaagatataccanacatgcgctaacnagaaagcccacgctatgctnagataagtattatctcgataatcgacgtcccatctgcgcgtgctagagacgaagncaggcgacatacactaatcgcatacggganaatagatagtgcactacatacacgtaagagcatcagtcatatgtagttttgtgaggccagganagacagattgataatgatatagcataggatacatgtgaacgagcaagatgatatgtnaatccgtacacatatactactcatctcgcactcatgtactctatcctatacctctctgacatntctcgtgttattcgatccagctgtatccgtatntacttccgtttactacactcacactcatctgacatcataaccgtacgacccaaagatgtaatatcgtgagggtgtgcatntctgatgtaatgtatttagtgtgggtgttgacnatcatgtcgatggattcggagcatctcatctcgtacagctacgtcttaatcttgaagtattcaactttaagaataatgtgcagttgtttgtctttcgtatacagttgtgctgatacgtgaacatcgattccatgttattcaagcaacatatatctaagtactacgatgaaatcataaatacaaccgcagacgtagtacgcacgtctaatgtcatggtccgatcgcatcaccaacctgcacatacaaattattcatgaccctacatgctgtctacagctatctctctattncntanctgcaccgaanaccaaagccactacgtcgtaatattagagatatattgtagcacgtagtatatgcgagcagtagatagtaaatatatagttaatggcatctatatacactaaanttacnagtacatctatcatgcacagtatgatatcgatatgtctatcatcatatancnacatcacctaccactcntcactntactatgttatcctcatctccactaatctatcgtcatatatcacact

SEQ ID NO: 8769 - DNA, 665 bp, Homo sapiens
  misc_feature (1)...(665): n = A,T,C or G
cagagatcgactcgctcgcgtcctccttcttgcttttagtcccgtattcatcgcagagagtacgtgtcgtgcctgcggctacctcgactcatctatcattacccttgctccgtccgtcggaggccccgcctcgttgcaggtttttcttaccatgctccctactccatcctcaccacgtatctccgacctcctccgtacactttccttcacgtctgttctagctgttcctctcatgcttctacccgcctcctcttacctgtctctccctccaatcctactcctatctatctcctctctactctaactcctctctacggccatctcttctccgcgccttgtctcctatccactcacctccatttcactcctccgcgctcaccctgggtcctgctcgatctcgcggccgtctcttcccccctcttttcctaagcagctgattgccctatcttcgcgatcagtgctattcactagacttctcctgttgtaccatggccatctcctctttcagattgagcccagtttcccttccttgccacacctagagtctagcaccaaggtgtggtgtaagcctgatctcctcagcctttgcgatgacatgaaaaaggttgggtttgtgtgcgcctctggtggggcctccttcagaatgnccggctctggccnttcct

SEQ ID NO: 8770 - DNA, 1649 bp, Homo sapiens
  misc_feature (1)...(1649): n = A,T,C or G
aaaagagaaatagggnagaaagcangagaaganggagaagagcgaagacgacggcgacagcagagagcggcgngcgcgggaagacgagcnagancggaagagagcacganaggagaannaanagcggncgacagcancgnganncgcgcagcacaaaacgcgagacaaatacacgataggaacacgagacacacacataccaatctagatagatattacagcacgactcgcacgctancacgaacaggcacacagacgagtganaatatagagacacgtggccgcgcgagagagnatatctcgncaccagaggtccaccncacgcgcacgacactcttcgtgcaatatgtacganagtgcatacgcagagtgttcgtgntgctatgatgtgttgctgtacatcactcgtgataagattagtagactggactgcgcaggtgatattttaaatcgatgatctgcacgtaggtggatggcgcgtggcagtatcagtagacggacgtgagacagagagcgcggctgcatcgtcgtgtacactcgaccgctgtcagcggcgccacgtgcagtaccatgctacggcgcgcgcacgctgcgccagcaccaagcgtgcgcgcggcgacagcggctctnagaaacacaacgacgcgcacaacacacatcacaacaccacgcacgcgtacacagatgntacgcacacactggtggataacattatgtaaggatgctngngtattgtaatatagatgttatataagtgtcgaagtagcgcgacggacgacagcgcacnacgcgtagaagtgtggacggagtgantatatagattgtaggtgtagtgtagggtatgaggatgtgcgcgcatggatgtagtgcacgagaatgatgaggagtgaggaacagaatgagcgttaatatgaatgcgacgtacgcacgagcagcaaacacgttctaccgacacagattctatacgttctattatnctcttatctactcgacacantagcctcctactgttcttcactgtctatcgatcaagtcgttgtgatatactagagcattgatgtgatgatagtgnggtgantcatgtcacatgcatgtgatcaattaatgagtgatcgtntcctcgatgtgtagacttatttagagaattaaatgacagacgtggggtaaatgaagaggataagaggcgtgttggagatgcgctggcacacagtattaggtagaatacgnacgattatttcatgtatgtgtcaggttaatgacggcggcgagaggtaagtatngtaatacaatacaatgtacatgcgtgtgcgcgttaggatattgcggcgtcgggatacaaanctcgtgtgaagtatagtggagtgatatacgtggaggagtgtggctagtgttgagcgagtgagagcgttagagttgcgcgcgttcgatgatagcgagataggccgagggtaacggaatgagactcacgtagtgaatgtacgacattccatgagagcgcgcagaggcagtagatagacnctgcgcgacattntgtcatatttacgtgaagtgtgctcatgagagatcggcgtgcggctcatgtctcacgcacgtggcgtgaggcgttaagatattattacagtctcatagggcatatggantactaaagg

SEQ ID NO: 8771 - DNA, 839 bp, Homo sapiens
tctttctaattgtctcttggctcttctaactaccccttatatgcactctcttctgtttgccgcgttcacggcaactaacttcttaaacagagcatttcctatcccacggtgttggcgcgcttcgcacttcactattcatagttatggatcaagttacaggtctcaagcgcttcaacaagttatacttaccaaagccatacgcgcacccaagttccaatcccaactcatgaccatctttgtaattcacattagcactcaaccagagtgatcttgggtaggtggtgactttttggaattctactcccaggcataattcataaacaagataatttataagatggacttctttaaaattaaaaaggtctgttctgttaaagacaatgtcaatagaataaaaatccaagccacaaactgggagaatatatgtgcaaaacacacatctggtaaagaactgttatccaaagtatacatgctgggtgaggtggctcacctctgtaatcccaacactttgggatgccaaggagggtggattgcttgggttcagaagttcgaaaccatcctgtgcaatatggtgaaaccctgttggtacaaaaaatacaaaaaattagcccagcatgtcagtgtgcacctgtggtcccagctacttgagaggctgagttgggaggatcacttgagcctgggaggtcgaggctgcatgagctatgttcatgccattgcacccaagccttagtgacaaagcaagaccttgtctcaaaaaaaaaatatatatatatagtgtatatatacatatatacacatacatacacacaaagagatcttaagagagccgttgcagctag

SEQ ID NO: 8772 - DNA, 784 bp, Homo sapiens
atgttgccaactttttttgctcttaaaaataagatcacaattaatatacctaagctaaatctccgcatatatatttgattgcttccttaaaagaatggatctttagctgctgcctaaatcaaacgattataacactgggactcagggaggttacacttggatacagaacatgtgcagacacacaagggagctacgactcaagccaatgtctgaaggatcccactctgatacacggcttccctcattactgccacttactgaactccagctatgtgccaggtatcatgagacaaatgggaggttgtattttgtctcaggagtattacccgtagctaaggaaggctgtcaggaagcaaggggtaaatttggtaactgggagtactatacacgaattgagtggatgaagatacatgtctacttctttattataattctagatcactaagcaacagtcacattattacctggattcaaaggctgtttccacagcaataacagtgtaaacaaatgaaacaaaaaaaccataatgtggagcctaatggttaatctcaatgactacaagatgccctgcagtcatagtaagcatgtttcttatttacaatcctttcaaaaaagtaatggaaaccatgtgaagatgggagtaagccagaatttcaataatatgtgtgaacctgtaacagggcatgggttgccttaaatgcttgtctgataccctgccacttggggagccaacagctttataaaggtaaacacagcttatttggctttaactttccctggaatc

SEQ ID NO: 8773 - DNA, 816 bp, Homo sapiens
ttctaataaccaccgctacagaattatactttggtgaagtccagtaattcaagtgtttggctaacaatcatcaaggccacaaaaacccagcctctgctcttggcagtatcaggaaccttcatagaatacatcacctttcaaattgcatgttgcaaatgggtcttaggtaaaggtatcatccagacaaaccttaaagatgatcttgacaaccgtcactgttccaatgggacctgataggaaaggattgagtatcactggcaatacgaacatgacatacaaacaatcatactttgcactgaattaaaatacacaggcactgcacacactttgttctctcggtcaccctgaacgctcgccttctgaatccatcccatggaattttaccctttctcagttatcagtttgttcctcgcacacctttttagtattccccttttatccgacgcaccaacaactaaccagagtttgtacttgacctttcctccttggatgttgcccgtattatgtcccttgtacgagattgacttcttccggctttactttcgtgccctcccgcgagtataactttcccccccacgcgcaaaaatcgcttgcttcaactttcttaatgtcccgccattcattacttattcttcttgcgagtttcgatgttttctcgctactacgtcccacgccgctccactcttttctttcgtccacccttcagtagtgttataactgacggaggaccgtcgtcgtgtctgtatgagtgtgcccgccgcgtatacaatgcgaggcccgcctgaattcgatttgacgcagtatgcatctctcccg

SEQ ID NO: 8774 - DNA, 919 bp, Homo sapiens
atgactcgcaacgctctcttaattatccaccgcttcagcccagatatcagcattagaagaaaatcgatgctacgatgtggagacaaaacttccatgaaactcgttacatccggagggaatagactcagccccctcatatccctagcatctgctcttatctatactcgaacacaactttctaaatcctcctatctccctatctgcctaacctcgcaagacgggctggatcacagtaattctttatcccaacgccgcctagcatgctgcccatccaggtcccccgtctcctcccctcactcactctccctctccatatatcatctattctttctcgcacgttcttcattcctctcactctcacccttccctccaccgccctctttccacttcctcgctctctcttaactcccctcccgcattccttacctcattccccgccctatattatgcccttctcctttgttcgatatcctctctgcccccacgtattatttcattccctcacccattcccccccccttagctcacatcctaccaccccatcgctcctgcactcccacctcccttccactccccccccttctctcacctattatcccatctcctctctcctcctccaatatcttacaatcaccctcctcttacctccccaatcctcattccccgcatcacctcttctcccccttaaccgttaccccacccccactactcaccccccgtcctttctctccccccacctcacgatagatttaccacccccgccgccctcccctccattcaccattccctccccctcaccaatcatatcataataccccccgccggcacctccctacacgatattctttaccccccacccactttcatatcgccctccgctcccgttattatcattcccctctaacataatcctttcctt

SEQ ID NO: 8775 - DNA, 245 bp, Homo sapiens
ctgattgcagagaatcaagttggggactctaataccctagaagattctgaagccgccagagaagagctccagtctgtgaaggactatatggatcaggccctctccaacccccactgaacagtgatatcagaaagaaagaatccttttgttgttattgctaagttactataatggggcttgtttgttacagcagttgacttatcctgactaatacaaacctcttcttcacttcaaaaaaaaaaaaa

SEQ ID NO: 8776 - DNA, 798 bp, Homo sapiens
  misc_feature (1)...(798): n = A,T,C or G
cgcccttgttcaagcccactcatcgcatccctttctttcacttcaattgtttcccgcccattcattcggcgccttctccttgtttcgcttattatataatccccattcggttttcaccaactcacatcaacctcgcctcatcccgccaaaatacggttcatatatatgttttcacgttccccgcgcggacatttaacgtttccttagctatccctttcgtcccgactgttttaggtgttctctttttccatcttaaggttgtccatacttctctgctggtagttccaatcagcatatgcacttctgacgatgtgttttgcttttctccccccagtcttatctcatgctttccacagtgatgctattggtgtggagttttctgaattgcctatagccccgttgcatattacaggtttatttttatgattctatattgcgtgccccgagtactttccaacctgcattgccattgattggcatattgtcctaaattaattatatcttgctctgttttggatgcatctaaaatttctccttctgcccgtgggtctgtcttccggagtccgcttgtctttnctttcccatgcgtccttggttctgccttcttgcttcttttttgtttccctttgtttttatgcttgttttcgcgcgttatagccccttgggttcttgtttttgttgccattccntctcttgtccctggtngtttcngttgtttgcgctctccaacntcgntgccgttccgtccaactttctctctttttttgtctcttccctttcctctgcccccgttggacg

SEQ ID NO: 8777 - DNA, 1143 bp, Homo sapiens
catcacactcattggttatcataagtatgttcgcgatgtgtgtgtttatatcgaggcagtaatgctacagatagactttgtcgatgttgtattcgagcagcacttctcactagccggtgtagtcacaaactacagctgctctctgtcgtcacaatagtatactccagtgtcggcgtcttgattatttcggatagcgtacgacgaacattcctcttccagcactaatcgcgcgggtgtcattacactagctggtactcgcccgttgacagctcggatgtattgtgtgaggcataatatatgtggatatacataactgatatggagggcgtcatgaagttgatacactgcaacgtgtgcgcgacgtgctggtatttcagcgtgcgacgaaactcttatttacttgctctttctgtattcgatatgttcacagaatgcagcagttagtggtgttttacagcaactaaatacgatattaattcaatagtgattgtcgcagggggttgctgaattattgattattgtcatttggtacgtactcggtactagatacttctggggaggcaggtgatattatataattatacgaattgttgctttagcgattgtgtcggggagtacctcgaacttcttactctttctcctggtacgactaaaaacacgtagataacactgtttatatgaaacgtgctctatctctgtgcggaagttaagtagttgacggtcatactgtggtatttccacgactactcggtgaagaacgtgttacttgtactctctcgagtagtgtttagttttgatttgaggtccgcattgcgagatgtatacgaaattgggagtggtgtctctatgtaagcatcgtggattgaaatgtgtacctttgccgctcattagcgccacatgttggttcgtgcgcctcaagacttaagccgtcgcttcaccgtatcgtctgtagtattattcctaggggaaaactcctctgtccccgcgggagatagttgcgtgtacgttactgatgtttaaatatttagtgacatctgtgtgatttgactatagtaaagtttattgttgtcgcaagaaagccgttctgcgctttcttctagctcgtgagctttggctgctctgggtctgttgttatcagtgcta

SEQ ID NO: 8778 - DNA, 1124 bp, Homo sapiens
  misc_feature (1)...(1124): n = A,T,C or G
ctgctctcgcctggcctcctgtttcttctctctgtccgctctccccgttgcgccgtatcttttcttggtcgctctctcggccgcgcgctcctcttcttcctttctctcgcccgcgctgcggttttcgccctcgcctgcctcgctgtctctcgcctccctgtcgtcgtggctccgtgttcgcttcgttcccctcgcccgtcgttgccttcttcgcttctttctgcgctgcgttgctttgcgcgctgggggcccgccgcttgcgcttgggcgtggcgtcgtttcgctgtgcgcggccgcgttcctcctccttctggtctctctcttcgctggtcgtcgggcctctgtctggcctcttgctctgtgcgtttgtgggcgccgctggtgctcgtttgggcggtttggtcgtcggcctcccgcttcggcggttctcttcctggcctcggttcgttcgtttctcgttgttgtcctcggttcctcctttctccggtccgcggtgtgtttcgctctgctggggtgtgggttcgctttgctgcgctcgtctttgtctgtggctgtttccggcgcgccggcttctcttgggggccgtgtgcgctgcgttgctctgtcttctctttctcggggttctttttcgtcggtgttgtcgcggggggggtccggtctttcgtgtctccccggctggcgcgtcgtccggttctcgctgccgccctgggcgcctctccggctcgcctgggtgcttttctgtttcctttgtctttctcaacactcgttgcctcgtggtcctgtgttttctcttccgcttgtcgctccctgccgtctgcccggccgcgcgttgctccgtctccttctcccgtccgttcctcgcccggtgcctcggcgtgtcttctgcttcgcccggcccccctcgcctctctgttcttgtgtcgtcgtctctgccttcggcttcccgcttcggtgtgtgcgtgtccgtcccctcgcggctggcgcttgtgtttctgtcccgctgccggngtttgcgggtttgtccccccgccgaacgtgccgggcgccgtgctcctccccaggcttgtctctttttcggtcttgcggtcgctcggcctctccccttgtctctgtcgttggccgcg

SEQ ID NO: 8779 - DNA, 754 bp, Homo sapiens
cgtgagccactgcatccagcctaaactcactagggagattttttgaatggcctgtactctgtagctagtttagcttgctaccaaggtttagcctttctgggtctgtactgaatatcccaggtattcaacagtcatctcactctggctgtcagaacatgcatgcctccctgccctgtacaccagtaacttaaatatagaacagggtaactcctggaccgctgagaacttctggcttgaccctgctgtgaaaggccagtcagagaaggaagaggatgatggccttcggaaatccctggatagattctatgaaatgtttggccatccacaggcaggctctggaaactcactctctggagtctgggtgcaagtgccttgctcaaaaaatcacctcactaaagagggcaggagagcccaatagatgccctcccgcgttttcaaaggggcccggagatcttcaaccggggacggctgctcctttttacagaggcttgcgggggacacccactttttcccatgggaggaaggaagggctgtgtggagaaaaaacccgacccaggagtgttagggatgttactcgatggccttgagcagaagagatgagaacctgtggccgggtttggggccatccccccagttggaaaccgggagggcggggggcttgaggctatgtggaggggcgcgtgtggttgaggtatttggaatgccacggagtttagtatgtgagattcgttgggagtggagcctatttagcgcc

SEQ ID NO: 8780 - DNA, 818 bp, Homo sapiens
aatttcaagcggaggaggagatgaagactggtgaagagaggacacgtgtctatctctgagtcagcggatgaaatgcttttgaacaaaatagaaaaaggagcatggatttctgatgggaataaagcagtggcatcacatgaattgagggtgcacgataaatctcatttctcttcaccatgcggtgtgtgaaaaagtgaagataagtggtctaaatatttatttcctgggaatttaaattctgagcattggaacccagcatttctagactgaaatccaatggtcccatggaccttgtgtggctccatattaccagaaattacctcagatgaccaggacctacctttggcacccgtatttatcctttgtattccaaatgaaacaatgtgcacttgtggtggccttctatcaaccctcttattgaagagatggggatatttttgctatttcttcagaaagagagaccataaaacagagcagcttaggataattttgatggccacccccactgtgccgaagcgagctacacttgaacccttatttaacctggctgaagtgaggctctgactggagaactagcccccacaatgaccccccggtttttacagtgtgggcgaaacgatgacccgcccgattggggccgaaatatcgaccctgctatgtgtgctgcgaggaaactgagaaaacatccgctagctgtaaacggacagatctgtgcccaagtcgacctacttgggggttaccgaaagacgctgggtgttgagataggaggcaccaggtgatctcgaggattagatttgtttgatttagagtggagaaag

SEQ ID NO: 8781 - DNA, 1408 bp, Homo sapiens
  misc_feature (1)...(1408): n = A,T,C or G
tgtgagtgtgagagagtagtgtggtggaggggtagatcatgngtgtgtgggagtgttgagtaagtganatggagagtagtagatatgtatgattgtgtgtagtagtcgtggtagatatgntataaganggtatagagagtatgagtgngatagagtgcacataaggagcatatgatgtgtgtgtgagagagggtgagagagacgtagagtgagtgtagatgaatgagtagtgtgacagagagtatatgagtggtgagtagtagtgtaaagatantgatagtgcagagtaggaggatagtgtgcgagggatggataagatagtctgaatatagatgataggttagagtagagagtgtagatagatgacgagtaagagatgatgatggaggantggtatggaagtgtgnatagtaatatagngagagaagatggtggnggnacggagtggggaaggaagantagtagagagagatattatataggtgagtagtgcgtgaggatggagtggagataaaggtaaggagatgaatgagtgtgtgtatagagatagtgtagtggtagtagtggaagtganggatagtgtgtgcgggatgatggagaggttgtatgggtggtgaggagctgagatgtggtgtgataaagagagagtgagaatatgtgaatgatatatggtagagtatggtgtggggaggaggtgtgagtgagagatgtaagtaggataagaagagaggaattaggatatagataattgagaaatgggagagggaagtgagggagggagagagagataagagtggtgggggagaatggtggtgggaggaatgggtaggaggagaggtgttaagattgagagggaagagttgagtagggagagagaggaagatagtgtgtgggtaggtgagaagagatgtggtgatagtagagtgagtnagaaaaaaaggagaggtggagatgattaatttgtgtttattggaggaaggaggaagagggagaaggtggggagaaagaccacaccgtggggggggtgaaaaaaagagattgtgagggaagaggtagggagggggggagtgtggggggaaatgtaataaagaggtgggtggagtgtggttggtaagagagggagggggagaagaagaattgttggggtataaattatggaagggtaggttgtttgaggagggtatggaagatagaagaagaaaaaagtgtggggggtgatattttgttttaggggagaacacaaaacccctaggggggaggggagggagtgggggtggagaagaggagagaggaaagtaaggggggatggagaagagtattaaaaattttggtgttgtgttgtggggaggaggtttttttttttttgttgttggggtgtttggttgtgtatattgttgtgtgaattata

SEQ ID NO: 8782 - DNA, 375 bp, Homo sapiens
  misc_feature (1)...(375): n = A,T,C or G
cttaaaatgaagaaaaagtatctgtaaaaaaaagcaagtcacctggactgtttgaagaccaaatagagcagtccntgtgggaagtaaaaattattgacaaggtaaactaagacaaaggccagcttacagaacattcaccaccattgtgtctggatggctgagaggatggtagcagggaatccagcacctggttgcccctggccaagtcaagagcccaccagcccccaggatgaagtttggaaggagtgggatacttaagaagaatggtggagctttggaaaaatcactggctaccacaattgaaatggtggttagagacaaacgttcaatctttgggcattcttatataacaagatgacagacaataaataagga

SEQ ID NO: 8783 - DNA, 1796 bp, Homo sapiens
  misc_feature (1)...(1796): n = A,T,C or G
acgcnactgcactagtnganatctgagtcacnttcatcgatatctagtactcgtgcaaaggtagnaacgagtacgacanttctgctaccgcgacagtncagangtcgcgtcacagagcngcgtctacgttcntggtcntcgattgtgcgtcatgactgcatcacgacgtacngnaggaagcgacngttaggtacganctncgantcaccagtcgaccatcngtangaagctcctctgcgacacaggttgatnacgacggcacgntcngantntgactcgantcagatgtaatcataatcgctcactcgnatcanaggcctgacgtacgtcgcacacngcnatcngacgantcntcgncngcgttgacnggnctgcanacacngcagtacncgacgactactcantccgagcnacagncagnctacnctnanctgtacgnccngncttcgaactntcngcatcgagtgaagactgcatcntgagcacngcactaactagagtagccgtcgacatgcgcgatancngtcnangtagacctagacgcgagcctgcgcagcgnatcgagtntacacgctacganngcctanacgtananctcgactgagaactggtgctgtacantcatactcgcantcagtacgcantacgctagttcatctatgtagcacaggctcgttgctgtcgtngcacgcantcagtacgaatgnagtagacgacgcactngagatangtntnacgancanggagtgantacgacgacatagagagannacgtcgacgcagataccntagtcacggatatngacgtatcgtattatagactagcgtgcatnacggtancagcagatgtcancatatnactactcgntatccatgatacagtgatagcagcatacgcgntccgcgnctagcgacgcacgcacgcagcgtcacgatgcacnagtgcaggagagctnatgtcgtgcgctctcatagactancagccgtctactgacgactgtctatatgtcgtatcgatagcganctgatacgagatcatctgcactaagcagcagtgtcgatcagcnantgtcgnacgagtctcgtcatcatcgctctgaggatatcacatatagcgtcactgntcacctaatnccgtccaaccgtagctgggacgacgtcggagagcggatcgcggtaatgcgagcgacgacccaatgagatcacagagttattatcgtacgatactatgatttcccctcacttgcatatcanttaatacgagcgagagctgtgcgtagtcgagacatgcgacgcgcaagacgctatcgctctgattggcagtacgatgaaagcggctacaattatcantgatntcagatgtagataaatcataatcntgtactgtgtagagcctgcgctaatattggatctatatgaaacgacaataaggtcgaatggagtgacctcacagagataagcggagtctctacatgttcacaagctgnctatatctatacagactgtgaagagtaagatgcacggttcacatagttgtctacgctgtggagcacatatgtatgatggatgcnttgatggctcctcnactctgtagtagcgacttagagtgtgcagcagaatctatgaataagtgatcgcgcgaatacactattgtgatgattcacgagtgattatgctcctccagtnatgtaatacatnaatagaagaatatgaaagcaatgtagnatgtctcgcgcctggaaggtctcgcctctctctccgccggctgtgccgcgcgtgagtgcgtcaggtcacta

SEQ ID NO: 8784 - DNA, 1059 bp, Homo sapiens
  misc_feature (1)...(1059): n = A,T,C or G
cgggccggccccacgggcggggtgggggcgccgcgcgcccgccccggggcggcccggcgtggtgtgcgcggcggggggagagctgcacaagagggggggcctcccgggcgccggcgccccccgccacggggagggaggagagacccggggagagaaagctaaggggggggcgcggaaagacgagagngcgcgcgccggcgcgcccccgcgccgccggccccgcggcaccgcggcaaccacaccgcgggcgccgccccgccccccccaggggccccgcggcccgggggggacaaggggccgcgccccagcgaggaggagcggggggcgggggggccgagcgggggaggggggggggagggagggggagaggggccgcgcgcaacagccagccgacccggcgccgccgggccgcaccccgcccgggcgagggcggggggccccaacccacccaccccagtccgggcagccccgcccccccgcaccccgcgcggcgcgccgacgccccgcccccgcccccccccccgcaccacggacaccccccccccgcgcccgccgcccgccccgcacggcgcggcggggaccgcgtgaacagaggtacacgcgcggcgcgcccagcgggggcagcgggncagacgcgaggcgacggagcgggaggcagggcggcggggggccggaggggggcggcgagacacgagcaaggcgggaacaaggcggcgagccggagaggcacaggccggaggcagaggggagagagcgagnacaaggacggcggggcgcgcggggggcggcgagccggcacctcgcgcggccgcccccacgacaccgccgagcacccgacggcccgagaacgccgcgcaggggggagagaggggagcggaggaccaccgcccacgcgcgggagacccacccccccggcgggcgagtcgacncccggcccgccgcgcccccgccgcgcagaccccccggccacacgcgccgcagcggcgcacgccgcccggccgggggaccggcgcaaggccgctgacccaaagcgcggctacagcagggaccagccgggcg

SEQ ID NO: 8785 - DNA, 790 bp, Homo sapiens
  misc_feature (1)...(790): n = A,T,C or G
aactggctcttaaagcctttatctaacttataatcccagcgcatatgaaagaccttaagataatgcccaggatgcattaccactcaaattatttcaggtttactcctttttcctccttgctcaagattatgccataagactgaagaaacttgaaaatctgccctttcatgtatttgagcctgtttngtcctctgaatatacagtctatgcttcttgacaaccctgtttccaacttcgtcattgctccacatttgtgattgccatgaagtaataattttcaaacagccaatgtgaacaaagaagtatagttatatgtggtgttgaatatagtgttcagtacccctttcttatcatttgtaagcggtatcattgatgttggggtaccccactcagatcccaccgcttcaacatgaggtcccctattttccatattctgagatggtgtctgctcacagctgagttactgctcacagctgagtccctgctcacagctgagtccctttaaggacttgtgctggtccagatttgctgcctttcccaagattctgcccccccccagggtcattatgcatctattgacaatgggcaggaaggcaccctctatcttcaattcaagacaactgtaaagggctccctcagctctaaagctcctggcaggatcaaccaaaactttggttacatctaccttatataacttctccccccgccccctcctgcttcccttacctcctcttctttcccccagccactgtcggtgaaagcactacacaataaactgcgatcgccggag

SEQ ID NO: 8786 - DNA, 620 bp, Homo sapiens
gggatcggggatgcgcataatggggcgatggacgggataaacaggaagtgagcgggacgcgacctggaccacgagagcccatggggtgcaccgcgaggggccagggggggggtgagacgctggagggggccactgggcgggggaaaggaaggggcaagaaaaaccctggggcaacgtgaaaggaacggcgggcaggggaacacggggaatggcaaaaaaggggggtggaacaaataatgcgaaggactccacctgcaacagtttgatacgattggggggggggtgggggtatttgatgtagatataacgctgcattggtgaatctacctgatcacggggtggcacagggcaacaacatagcggggtacagatgggccggccgtgggtcacgggtcacaccaaacgggcgagtgggggattgacacagggctcatggaatgtgaataaataatacataaaaaacaaaggtgggtgacggtgggtggcaaacagtgctgtgaatgttgcttgccttctgttctggggtgaattggtggcggagtggacattgctgggggaaactggggtcggcacgtggggagataaacaaaacatgggaaggtgaagaactaaaaataatg

SEQ ID NO: 8787 - DNA, 810 bp, Homo sapiens
tttccaccgctacagatcgcccactgggcctggatcgatgacgatgccaaaatcgacatctccctggcgaatactttccattacccactgctgcggacgatcgtgcaggacaaactgaatatctggatagcggcgatggctttcagcaatgcattgcggaataagatgcgcggaaatggtctggctggcagcgacccgaacttttccgctcagttgttgccccatacgcccggtatcgcgcaacgtgctgttcagttcatccagcagtcgctcaagacgcaaagccagctgctgccctgcatctgtaagcaccacttcacgcgtggttctgtccagcaggcgaacaccagtatgattttccagttccttcacactgtgactcactgccgactggctcaggccgatacgctctcctgcacgactaaaacttttctcctgggctactgtgacgaaaacctttaattgatttaaagaataattcatctgttttgttcatgaatggatgcaataaattaattttatttctcaaacgggaagaggcccttccggtaactaactgggagagtcttatttatactttgggtggttaataaaatacatttccattgccagaatcctatatctagcagggactcctcagaatcttttagcgctgacattaatgaacctaaacgccctgtttagaccatgccagtggcaataattgagggaaatggttgagctcgtgtctatttaatcaagccctaaccaagtggatgttttctttgtgcaaaaaaaatgggaagtttgtgtaacagtgttgtactgttt

SEQ ID NO: 8788 - DNA, 955 bp, Homo sapiens
acacaaaggttgggttgtgaaatggaggggggatagaggttgtgagcgatactatgcgtctagtgtacatcaaatctaccgctaacagttagctggtcgcgaaactcaatttccgtgctggatatattaaaaatagaagagatattctctagatagatgagagtgaagtctagtagaagtgttcagcggatgagtgttatatagggaagttgtgtggttcataaaacatacttcgagatgtgtcttaaagggtcaaaggggaagagcgtaagggacaagagggcgaagcgagttccttccaattccttgaatagggcacgcaattccattcaagagggatctggcgctgaagacgtaagtcacttcatgaaagacgccattttagaaatgctatcatattgtaggttaattcaaacctatgcattctggagagacacgatatgttcgatcgaagcagagagcacaggagtccacacctttcaatcttggttgaaaacagagaggttagagagtcatctgtgggtgcttttccaaatcttagaatttatatagaaatagtaatgaacaataattggcagaattcctatcctagtctcgtaaatgattattttaaaatgatatgttaagtggtagaatattaattctgctccttctacctcaagcaagaagggtaagcagaaaagaaatataacatcccaagaagaattgtagaaatcagggtgtcacaatccaagactttgtgcaagagcaatgatttttaccatatcctcaattttatagctaattactttggacattgcaaaagaaaaatgaatcatagggaatattgtgtagtatttatatttaaattacaaatacatcctggaaagccaaacatagtttatgttcagcagctggattcaaaaataaaccatggtcgcccgagcctgttctttcttgaagagaggaagagaaa

SEQ ID NO: 8789 - DNA, 825 bp, Homo sapiens
cacctgacagtgaaaagagcaatttgaagaaaaacaaaatttatcttcaatgtgaaaagcaatttataaaaatcccgaatacttgccagggagcaactttgacaaaaaagacaaagagtggtagaaaaaatgtaacccagcccacaacttgcaatgtgtgataacatgatgagcctccttttaaaggagactgacatttacacaagtacacaagagcaagaagaaggtctagagttaactgcccaaccattttaactgttcccgagaccaagttcatcaaccacttctctttggatataaatcaactgactcgcggagtcttttaaactagcctccgtgggacacatttcatccgtcatccggaccgcattggatcattcattttaactgcctttctttttgcgaccgatctgcagtagcagcctgcgtaccttattctttaagaacttgattatgatttcactatggctattaggctttcactcatcatttccccgttattaccttagtatttatggcccatacatgtatcttcttcttgcatttacgcagagacctttttactgttgtacgttgtgacattttacccggatttttctcgcgcgtcacttgccgtttagtctttaattattttctggcgccgaccctgttctttttaatttttattcgtcgacttgcttcgcgtcttttatgtatttgattcatgtgtccgacttgtattgtcttagtattgccgcctctttgtccccctttctggcgtgttatttgtacaccaccacatatctcatctctctcgcgcgcgtttttctccgcgcctttctctat

SEQ ID NO: 8790 - DNA, 789 bp, Homo sapiens
tgtaagcgaagtgatcggtcggcgggttgggggcaaagcaacggagaggccccagtgtttcttgtcccacgagtattctacggtggacaccatggtttttttcacattgcggctccccgttatttgatgggggtggggtgtttgcgccccgctctgagagttagcccgtgtttttttttaaacacccccgggatgaggcgcccccgctccaacaagagggctaactgcccctgggggagggcccggtgccggggaaaggttttgggggcgggcccgtgcgctttcctattccgaggaaggaccggccgcccctcccccacaaaaatccccgtgggggtgttcccctaaaaagataaatattggtgtggtttttaaaccctcaacaaaaccggtggggtggccccccacgggggtttggggtgcgaagaggggggaaaaaaacacccttggccccgataagggagggggggcttttgggttccaagcgcctgataagttgtaggggggggtatatcccccccggggggggttgggttgttcccgggcccccttttcccccaaaagaaaaacccttaccctcccggtttttttttgaaaggaaaatttgggtgtgaaacaagggccccccctttttcccgaggggggggggggggtaaaaaagttttaccccccaaagggggtccccggggggttctccccaaagggtttttttttggggttaacccccctggtgtgcccttggaaaggttttcccccaaaaaagggaaaaatttttttggcctttttttt

SEQ ID NO: 8791 - DNA, 978 bp, Homo sapiens
  misc_feature (1)...(978): n = A,T,C or G
cgcgcccggtctgctgtttccccgtctctgcgtctccttcggttgttcgtgccccccgctccgttggcgggtgtggctgtggtcgggtcccctgctgtcgcttgcgttcgcgcgcgcccgcccgctgtccgccgccgtggtgggtggtgttgcgtcgtccgggcgtccctgctgtgtgggtgtgcgtgtggttgcttttgtctgcgggtccctgccccgcgccggctcgttcttgtggggggggggtgttcgcgtttggggtttgcttttgggggggttgttggtcgtgtggtctctgctccttgcgggttgtgtgcgcgctgtctcgcctgggtgtcgccgtgggtctggcgtgtggcgcgtgcttgtcgcccttgttggccggcgttgtgcttggtggggcctgcgttgcgtggtctccggggggggccgtccggcgtgttgtgtgcgggtgggtgtttcgtcggcgtgtcgtctgcgggcggtgggtggtgggccggggtttctggcggctcgtcttcgtgcgggcgtcggttgcgcgctctggtctggtcgtggctgggttgtttgtggtctcggtgccgtgccgggtccgccttctngcctccctgttcctccgttcggtgtgcgcttgcgggtggcgttttaggaattgtgtctgcgtgtggttggcgcccgcctcgccccctcgtcctcttccgtctctgcggtttcggtctgttgcgtctcttgctctcgcgctccttgccgcgctgtcggcgcgctcgccttctttgctcttgttccgtctgctgtgtncctctgtctcgcgcgttgtcgttctcggcgccgtgtcgccgggcgggtgcgccgctgttggcgttcctttgtgtcgctttggtgcggtggtgggggttgcccccggtaggttgtgcgcccgtggcgcccaaaggtttgttttttcttcgcgcgtgcgtcgcgtgggtcgcgttggtctgc

SEQ ID NO: 8792 - DNA, 885 bp, Homo sapiens
taaaaaagagaagcgaccgctatgagaaaaggaggaaggagcctatcgggggaaactgtcttaatatccaccgatacaaccgctgacctgcttggtgaatgctgggatctcttttagagggaggcagacatcgcacaccagctggcaagagggagctggcatgcaacatgccccaataccactcccatcctgccatgcctatgtaataatggggcctcctttcggccaaatccacctttggttgtagggcaacagagcttatcggcgtggtccccttgaatcgggtcctgcggccaaaatcaggatggacactgcgggtagataaaggacgaaagttaagcggaggaatggccggcggatttatgtgccaagaagaccgacccccccctcgtaatagcgttatcccaccacaaacctttccggtggccgagcgcatgagacctgccataaaacgaatccacagtatttacgagcagggtcagactcacctagaagtgtgaagaagaatggtgccgctacatcgtaagagacgaggtattacacagaaggcctgtaaactgactagagaacggagagagtagaagcacggaaaacgcgggatttgccttttaataatgtacgttcgatttgtccagccgaggtcgagaaataggtggtccgagtgattgtaaactgcgcgcctacatatgcgcattagtttgtataaggccccgtacggatggcgttttgaatatcacgccccaccgcgatcgaggaagtttataggaggagatgacccggcggtgattaattggagatcgcacgtgagaggccgcgttacgcattaaatgaacccgccccgcaccttactgctacgcacccgctatttgtcgcccatatcatcat

SEQ ID NO: 8793 - DNA, 918 bp, Homo sapiens
  misc_feature (1)...(918): n = A,T,C or G
gcggggggcgggcctgtcggctctttgcccgtgtcccggggggtcgccgttcgggcgtttgcggcgggggtccgtttttgggctctcccgcccggcttttttctgtcttgcgcctctgcccggggccgggttctgtttttgctggttctgcgtcgcgcgcgctgtcgtcttcgcgctcttgctcgggcctcctccgcctgggcggcttgctcccgcgcgggcggtgcccggcgtcgggcgcgccttcgtgtttcggcgttcgtctgtgcgggcgtgttgggttgtccccgctttggctcctgcgcgcttctggcgcgcccgcgctgcggccggctcggccgggggctgtcgtttgtgttccgtccgctttgtcgtcgtgtggtggcctgctctcctgggtgctccgcgcgcttcctgggctgccgtcctccgggcgcgtgtttcgcggcggtggttcttcgggcttcttcttctgttgggtggcgggcgtgcgtcgtgttttgtggggggttgttttcgcggggtgtggcgcggggttgcggcgctgtgtggcgcggttgctgcgtcggcgtggtttgggctgtcgcgtgtgtcctgtgtgccgcgcggctgtcgtttctctgtccgcttgtcgctctaaaaaacgcctcctctctcggctccgggctcctctctcgcgctcctcgcccgcgtgctcggcggtgcggtcgcgtgcgcgggcgggtcgggtcggtgtggctgcgcgccggtctcgcggtcgcctccgtgcgccttctcggtggcgccgcggggggttcggctgtccgcgtacggtttcgccctctctccccccttncggccggttttctcccggcacccggggcgcgttcccgacaaccttcccggtggcggggcccccggcgcgctgttcctggtcgc

SEQ ID NO: 8794 - DNA, 828 bp, Homo sapiens
gagaagcggaggacaggacaggttaagggggtaaagcagaaacagggattcagtggcgggtgggcatggtgtatggagagtcatagcgagcgggtttagaacagaacaccagcaacgaatggcgttaagtttctattgtttagatagggagagaggcttaccggacgtgtggttgaaagtgggtggagagagggcacgcacaaaaatcgcggcaagggcacggtaggtggctgactagagacgagagggtcggggaggtaggcgtaggtatgtattggtggagagatatgagtggacgaaagagagtagggaagtagagctttcaataggacaagaggggggaggtggggggtaggaggacgagaagttgtgggtgggggttggtgttcaacagtggaataacgtcagtgatggagggggaagaaggggcatactgatgtgggggagaggagcctggcaggggtggggaagataacttgtgtgggcaggtatgacaacaggaatggggggtgggggagcggggaccccacatatttgctcaggctttgtgcggggaataacaagtaggttggttaggtttgaaatagagggggggaagaggcggggaaaagtgcaagacgcgccagccccggggggtgagtcaggatttttttctggaaaaaaaaaaaaaaaaaggaaaaaaaaaaaagaaaaaagaaaaagaaaaatcccccacgggggacctttgatttttccctttaaaaagaaaaaatattatggtaaaactttttgtttttaacccctttatgttccttcccatttaaaaattaaaaacggtgccttttggtg

SEQ ID NO: 8795 - DNA, 1336 bp, Homo sapiens
  misc_feature (1)...(1336): n = A,T,C or G
gctcttgtcgtgtgtaatacccgacgttccgtctgtatcctcgctcngacatcgcgcagtcttaatagacgcctggacgtctcgcntgcgagttgcttgtcgatgtgtattgaatgcgccgagacagatgtngtggcaatgattttcgctcctgcgtcgtgtgttatactcngaggactggtctgctgtgattagtgttgcgcgagaatcgctactagcatcgctgcggttggtgcatgcgttgcgggcgcgctacacgcgttgcgcgtagtacctagaggcatctgggcggtagcatacggtatctagaggcgaggggttgcgagtaactacggtggtgctggcggtggctatgtgtcctccacctaggcgggaactacgtatgcgtgctgnggggtatgatggatcgctctgatcctctctctgtcgtcttacggtgagggcgtcgtgtggcgcgcgcacttctcatctgtcgtgagtggactcgcggtctatgcgcatctatccactctgtggggctgagactgctgacctncggtcggtccgtgtgcggcatgcgacttcacatatctaagtgtagacggtcgcatggagtgcgttcnatcacgggcctngctgcacttcgtgcggaggantactggatgctgtggacagcgggatgttatctgattatggctcggttacagatatgtgtgcggaggtgtgtgatgcgttggtaactggttggctaatgtctcggtgcgaatgcatctacgtctcgtgngctcccgtgtgcgcgcgcatgcgtgcgtgggtcgcctctgtgccgccgcgcctgtcgggttcgtcctgctgctcctcttcctgcgcgcgctcgcggttggtgcgtcgctggccgccttgtttcttgtgtttcttctgtttgtggccgcctcgcgttcgcagtgngagaaatcgcggtgttgttcttcggcgctgtcttgtgcggtctctcggtgctgcggngcggcctcttgggcggcgtcgcgcgtttcggcggtntttcttccccggttcttcacggctcgcngcgtgctcgctcttggtgtgtttgctgctcgtcggctgtgtgtgtctgcgcgcgcctcttcggtttgttctgctgcgccgntgttcgtcgggtgtcctggcctggtttctttcttctgcgtcgcgttgggtgtgtgtttgtgttcgtgtcgtcggcgccgtgctggcggtgtctgttgtncccccctnctaaaaaatnctgctgtgtncgtctcgcggcaccaaccccnntntntcgctctgcttctgggccgtgtcttggtacccgtccgttcacgcgtcgactcgc

SEQ ID NO: 8796 - DNA, 430 bp, Homo sapiens
aagtgctgtcgttagcgcaacccggataaactcactcaagggcggaggtgcgggtgttgcacatatgacggtataacctaggaaagaacatggtattagaagggcatctttatgccacgacctcataagggacctgttgttaccatggcgcatacagtccgtgcctggggcaatgtttacatgatgatcacgcgacgggtacctcgtcattcctctgggtcctaataacacccttgagttgatgtatgagtatttcaactgccatgggggagcttacaaaggtgggacactaaacaaaacattctagcgcgggacaacagtggtttgtgtctcttaattgtaggttcttaatagggtgaataataaaacgaagtgattgggataaatcgttatattgtacgcattcactgggtaaaacggccactggtgt

SEQ ID NO: 8797 - DNA, 809 bp, Homo sapiens
gagacgctaatcaagcagttgaagacagagagcctagggagaataatcaaatgtgaatttgtccagggggactctcgactttaaagagggagagaagaaattgtcacgttgattccactggagacagccttactgttactaaacggcccctcgggatgtgctacctgatttgctctccggcagcttgccttgtcaggggcaatgctattgttattagaatgaataaaacgttgatgcggacccgtcgccttttaggggggcttattatttgatccgcggtactttacttctgtgagctcgcgagaacatgttgcgggccgcgttcataagcgtgctaaatgccttgtctgtctgtcttcccccgtgttgccgtggatctcccctgtatacaattttactgggaagtggcttgccaatcgtctctcctctcttacaaccccctgcttgcgtttccgttgttcttgccgttattcatttttaacgggttttacaatagtaccttgtttgtggttcaccgctgccagcctccctcgcgtgcgttctcttcatcctctcggatccctcaggcggtccctcgcctagcgcagtcctccgtccgccccacacgacagggcatcctcgctgggtggtagagcgccgtggacaatagcggccggcggagcgcgtcacctccctcggttgtgtgggggtaattgacgctgtgtgttctctcacatttttgtaaaggttcgggattaactgttttacatggcgtaggggaccgatattctgctgggcataacacgagcggtgatggatgacgggtggcg

SEQ ID NO: 8798 - DNA, 954 bp, Homo sapiens
  misc_feature (1)...(954): n = A,T,C or G
cagaggtaggagtagcgcgccaagaatagctggaaaccgtagtgatgaaaggcaggaaagagaaaagagaaaaagaatattaccaagcgaagagangaggccggggcgacgtgacaggcaattccgatattacaggaagcaaagatggaaggaaagaagtaccagatggagaatatgtagggagccaataaatattaaaaaaaaaatcactaagaggagttaaccaaatattaaaagacagatgtatgatgaagagagagaaatggacggaaatgatataaaaacaaatgaggcgtaaaagaaaaagagactataggagaaaggaagaatacaagtaataggagctggaatgagggcccacggagacagagaactacatgatgaagggtacaaaaaatctcaacacctgatctagtagcatgaaagcggactagagaaaaaggggcaaaggggaggtggggcagagaaaaaggaaagaggtcaaaaaccataacaatgagatattaatttcaacgtaacaacagggataggtaaggattatgatagaaatcatctgcagaagggaaaatgggcagagaatgtggtaggaaaaaagacacaagtcacgcagatataaggttaatgaaacaggattcaaacccaggcaatctggcgacagagtgctgtgtgcatatcctcttcgccgtgttgaaaaaaaaaaattagataagacttgaaggacataagaaatcaactattgtgtactaatagacattagatcattgatcaccatttttctgtactccaagcagataaaagaactagtgacaataaaatattgctttaaaaataagaaagtttttaagaaatctaaaaatagcttngccnctggcncagcctccttcnctgtgntncnccaaagtntnggctgagtaacaaacgactctttttcgaacgcaaaaaagagaaaaccta

SEQ ID NO: 8799 - DNA, 1655 bp, Homo sapiens
  misc_feature (1)...(1655): n = A,T,C or G
ctcgcgggtgtcgctcactcacgctgcttgcttgtagcctcgcacgccttgccacggcggtggtcgcggcgtttgtgcgggttcgctgctctcggtgcgcggctgtgctgtgttcgtggctgccggtgtcgcgcgcttcgattgtggcgctcgtgtgtgcgcgcctcgctccgccgcgtgcgctccatctcgggcgctgagtgcgctctccgttcngtantatactagacgtcgcatctcgtctaactgtgctcgncgcgctctcgcctcgcgtcgctccctggtcgcgcctcctctcgatgctcgggctctgataatgatatgcactacgctgcgcctcgtcacgagtctgcgttcgngtttgcggcactcacgcctactcgccntcgtgcgcttgtgtcgccgtcgcttgcgcgatacagcggtcgctgctgtctctctgcgcgtcgggtcgtgcgctcacgcgtgcgcatccgcgtgctgtcttcgtcttctccgtcgctccggtgcttcatgctatggaagtcttctcngtatgtgccgttggcgcgtgcgcgcttcgtgtcgtctcccgccgtgtcgcggcgtcctcctcgttcctctcgtcgccttgttccttgcgctgtgtcctcgcctaccctacctcgcccggcctgctgggtgtcgcgttttccgctctcggggtgtcgatggatgtagtgcgctgctccgnttacgctgtctcataatgtcttcgtggcgctgtctctctcgttcgctgtcttctgtgtcntctgcctcgtggtcgcgggctgcgggtgtcgtgtcgcggttgcgctcatcgctgtcctctcgtcgttctcggcggtgggcacgcgtatattctgtggngccgcgactgtntcgctgttcgcggcgcgctnttgtctcactggtcgtgctctcctctgctattggtcgcgacgcgttctctctgtcgttacatccgcgtccnttctgcagntagtgctgtcgggcntcgtncgcgctcgtcagcggtgcgtncgtggtctgttgtcgtctagctatcgctgctcgtccctgtctcgctcgcgctgcgctgcgttggctgtcctcccttcntatgagaagcgtctgttgctgcgtgttgtcgtcgcccgtgctgctgcgtctgttctgccgccttcatgtgcctcggtgttgcgggcgggttgtagatcgtgtggccttgtcgtctgtttgagcgtgtccctgtgtgctcgtgcctgtgtccttgttgtcgtctcggtggtgtgtccccgcctgtctcgttgctgccactcgtccgcggctctgtgtcacgtgtgtatctgctctgggcactctggtgtctcgggtcgttcaccacggctctttcccgtaccggatgatcgcgactggacttcgtctgttacggctgcgatcgtgttctcgctcgttgcggcgttatcgtatcccgccgtgtgtgcctcgtgtcgcgtcttgctctgttgtggcgggtctttgttccgccccgtgctacaagagatcgtgcggtcgcctccgtgtttccgtccgcccgccgaccggcttctcctttgttccttctgcgtgtgtttgttctcgctgtgatgcgtgtcttgtgcgcgcgcggtctcgtctgctgtgttggacgccgc

SEQ ID NO: 8800 - DNA, 1688 bp, Homo sapiens
  misc_feature (1)...(1688): n = A,T,C or G
ggagaagcggaacaaagcagcgacgcatggacgcggcgagcgcaccatgcaaaggagcagcagaggagaggtagaaaatgtacagagaaaggaagcagaaaagcacgactagctatactacataaacacagcacaagaatatcagaaccacacatctttagacagntcaatangcagaaatagagaaattttcaacgaacaaaagacacaatgagaaagaacacgcacancagacagcaagtaattgcgtgagagacngaccgaaggcgacagctacgtctgantatgacgactcactcagcgaacacaacgcctcagcactcactacgacaacacaacagcgcatgttcaatcagacactctacaacatacgatacanaagagacgcacgagaagcgtagaatagtggaagagacaatagatgataagacgagaagagcataaggtaaaacaccgagtagataataagaacggataaacataagtgagacatcgcatacgacgtggcancnancctcgaacgccgcgangcacgcatcaacgaaaagtcacaagacnatgaccgatcatataatntcttataaataacgntcgggagtgcagngcataagagaganacacaagcacgcataacaatacacggagagagaaaaacgacacaaatcacccaccgagctcactgcgatcagtgacaggaagctaagaagagaggatataggtgagcgtccanaagaaaagtangaacatagcagacaacaaagcncacacacagtaaccgacgcacctcaccatgcgcggaacgccacgtgcccgcgagagcgagagaggcgagacgagaagaggcacagcgaagctacagcagaaaagagcagcgcaggccacccgcagaaaagngtatacatcagcacgcaagcacggtccaatgctcaggacgcacaggaaagactcacacaacgaccgatgatcagccagccaacgcacaccgaatgcacaggtaaatagatgacacagcgcgcatgagagagcacgacagagacgacagagancagtacaataagacatacncatcacgacagctcatcagaaaggtaaacatatacaacgcaccagacagtagacacagcagcagaggaacagacaacgcaagaataaacacacaccatcgantgtncacagacacacaagataganacgggtgagcgaagtnngagatgcactgacacgcaacgagcagagtgatcgatactgacgtcacatncgtgcagtgtagcaatacagcagtaacaagangacacgacacgaggacgnagagagtaataacaaaacacncactcgacagtagagatcactagancgacacatcactgaagccaatcactacactaaccaccagaagagcactcactatcatcncacgacggcagaatatactcangctctcgcgcacgtcgaancaatcgtatacagtcggtcgagcgactancgtgactactgtaacntcaccgaagatgacgcatgtgagcgcncacgagagcagaagatagtgtgaagcacgggactaatcgatcgagaacgcacatagtaatacacacaatgcactcgtaccacaacanactgataggcgccgtgaaacgaccggtacacgaacatgatgagngagtanagctanactgagtatgcgcgtgagt

SEQ ID NO: 8801 - DNA, 923 bp, Homo sapiens
  misc_feature (1)...(923): n = A,T,C or G
cggtgcaggtgcagtatcaatgttaggaggaagcaagaatctgcttacccggaagccaaggtccagggataaaaatgcacaggcaatcaagttggcgcgagacgaaatttcttgtaagaagacagattaggcttaaaaaggtggtgactggctcaggccctcagcgggagaaggtgagttaagggccctccaagaggtgttnccttaatttcccctgaccactccccagtcatgggctaagtccaaatcaaaacagccattccccccaccccaccaacccgagaatattttataggaagcgatggaatttttttttttaaaggactttaattttaaaatggtctaccccatgtttggtctttcaagagtgcattgcgtgtggcatgagatgtacatagcttcatgtttgtttttaatgaaggtggggatggaaaaccaaaatttgtcaggtggggatttcaccccagccttatgactcagttttagatttaacttgattcatttaaggttggagtttatttctggctggcaaaatatggcttcctggcttagaaaaattccctcaaaacaaacttgaaaaaagtttgcccacctaaaatggcaacgtgaaacactctacattttaatgagctcattgtaagtgaattagaaacattcaaatgcaatttacttcaaaatagatctaggtgttaaaataaggaacagctggcagtatggagtctcctgatcccaaccaaaggcaggtttgcccctattaaatggtctgtgacttagagcgaataaaatgtcacttttttttttaaacacaaaagcattaagtttcagtgtcgaagagaaaactctgaacactaattaaaaagacaaataaaaaacgagtcggccgaaaattttcttttcatttttgggggttgttgaaagattat

SEQ ID NO: 8802 - DNA, 877 bp, Homo sapiens
ggaagtgtagaacggggggagcgagggggggaagttatcggcaacgactctcttatgtaccccgctacacggcctctggcagtgcagcttatgtcctggtccattgaagacaggggtcatcctagcagcacatcattggtcaggtgaccctcgcatgtgggccttctcaagatgccctatgtaacataaagatgattacctgaggataggcagcttgggaaaccccacctcatccccacttctgacgtggctttctggcaattgtttttttcggggaacaaatcatgttaaacatttttctgctgacaggtctgctgaggtgccagagtgtaaacaaaggcgacaaacgtgggagggataaataggcaatgcggggcttccatactgacactccagaatgtcggaggcaggcatcggccaacagtgcggggggggcacaaaagcatgtcacacagggtgtccaggagaagcgggcaagggaatcacataaatctgtaatttagcctatgactggggttttacctataaagtgtttgggccgttattcttcttatggttcttgtgcacaaaaataccgggcccacagtggggggggaaaccacacgggattgtataggtcgggtcaccaaaaaggtgtaaagcaactatccgggtgccaaacgtggcgaaacgaaattccaaacttgaacagggggaaggggaagggggtgccaattgtacaacatgaaaaaatagtggggttggacgttgattaacagtgttatgcggttgaatgtaacgtgataaatgagaataagacctagcatgacgcgttgtggcaaaaggtacaaatataagggatggggtggtgcccgtaaagaaaaagcctgggggagaa

SEQ ID NO: 8803 - DNA, 726 bp, Homo sapiens
atcagatgaaaagaagaacatgaactggaagcatcttcccaaaagggcgtgcgggaatctacttaacaccttaaagaaattgtatccccagctctcttgagttcgccaaaggactcgagagggctcaacgagtgacatgactccaaaagaagcggaatactcctggcgggagaggatggcacagggtaagatacggtcttcgaaagcggattgtgacgcgtgggggcacacgaggtaaaggggaaatacaaagggtacgggagaacggatgccgggaaagggcaccttaggggaaagacgggcgaacaaacggtgggcacaccagacggagggggagggggggtcaccgggcaaaaacaacgggacgaaacgccggtgcacataaacaaattgggggtggcgaaaacaccacaaaaaagggacacaaaaaattgcaggggggggccaaaaaaaggggtgcgaagggggacgggacaaaaggggaaaggggggaaacagaccaaaatgggggatcaccaaaaaaatgaaaaaggggggtgaaaagggacaggaaaaaaagaaaacgggggggaggggaggaaaaaaaacaggaacggggggaaaacaaaaggaggaacgggaacacaaacaaagggacggacaaaacaaaacacaactgggggggggggggggcatgggggacgggggaaacggacatcagggggaaaaacagggaggaccaaaaag

SEQ ID NO: 8804 - DNA, 1175 bp, Homo sapiens
  misc_feature (1)...(1175): n = A,T,C or G
cgtggggtctgtgatacgagatacttttatgctggngacagatgcatctctctgtcgctcgatgctttcgtgtcgtgtgagtaccgaacgtacgatagtgtgctgtaagtcgtgtgcgaggcagttgtgacgtagtacgattgtcgcattttatgacgttatcgntagcaccgacgcataagtggtcttctggataagcataatatgtataacggagactcacattattatgcgtgtcgcggtgggtttatgatgtcagagagtggcgcgacatatgtgacacgcatgcgcagtagtctctgaagggcgcgagagacagcgatagtggagaggtgtcttggagtacgcgggtgttgtggatcgttataactccacacagatgtataccggtgcgagagatatcaacgatatatcgtacgcatacataacttgtgtgtatagtcatagcgttcatnggtcctgcatcctgagtagtctntggcagcggggcgactgacagtgatggagtctcacgtcgtgtaacaatgagcaccttgcttgggaagcgtgtgggcgcggatgaaccgtgagaacgaggtcgcctcgcacgcacaggccacggcagcagcggcgtgttgatttacgatcactgacacctcggccacaccgggtcgcggcgtggaagcagtatccaatcatagatctgccgcttgtcgtcctcgcaaacacccatgattggcggggtcagccgttagtggtaagtctgggatgtggtggacgacgttcgctctttcttctgtcatgtcggcgcgccggagtcgttgtacgcaactctcccccccctatccggcgggttcaggctagtacaacccgcgggcatcgccataatgttctaacatcaacgagttgacgagcgtaacgttctgcgccgtgtgttgtaggtctcaccagtgttagcgaatagggcgtggtcgctgactgtacgtgggtgagcggggtgtcgatcgtttttggtttagcacgaccccgccccccagagtggagtgggtacgtaacatccaagtaacgccaccggatgtagcgaggccgtgaagtgttaaaaatatagagggtctgtccgtcatgtgaagtcttctctctcgcttctgcgcgtgtcatgtgcgtcttctactcctctcctagtatttaccctcgtg

SEQ ID NO: 8805 - DNA, 815 bp, Homo sapiens
tctttaaccactttcccccccccagtttttcacttgtcaccttgtcatgagttacagtggcttgcatcaatcatttctgggttcacacagaaaatattttgtggtggttgactatcacatgcgagaaactaagtgccctttgcgggtgactgcgcaggtacctctgatttcttgccaaatcattcagaatgccgcaagtccattaaatctctccacagggaggaaaaagttcccgcattctagagagagaatttatgagttcatttcaatcaccacaaatgaaagccacccttaatattcattagagattttacagtggcaatatgcattatctattcatatgcccctctaaaaggccaatttcccttgaaaccttgcatggctccaagccactctttgtagaaacaatggcctatgtccaagtggaatcaggggaggcaaatggatgacatttccttatccattggtagtaattccactaagccactatggtggctatgagtttctgagctttaaaaattaaaggacagatttggaatgtgcagtcgtgtcattgtatcacttctctgctgtcatctgtgaccatatgtcctaaattgaatagagcttttcgggtggcatcacaagagatgacttttgaaactgacatttctttcattgggaaaaatgtatatgttggaaacataattctatgaacctgaaagcttttcataaatctctgcctttctacaacatagttcacgccaacctcatttttatttaattttccctttaaatttatttcttcactggtggagagggtcttttcaaaaatc

SEQ ID NO: 8806 - DNA, 885 bp, Homo sapiens
tgtaaggggtgatgagacaaggcaaggggaggctaactgcaacagggaaatctgttctgcgagaggaacagccaacagcagctccccttcagaaattggaccatagccagattggactctttggcctaagtcagaatcaaataagctgtctgtgacttctgccaaacactggcttgacttgatgcctctcacacccaagaaaaaagggatgtgaactttccatccagctcaagtcctccagctcttgacagtgtcctaccttggaacccagggggctctggctctgtgcaaacagcatgaaaagttgggctatatacctttccgagccaacaaaaatgggaagcctgtggtgccatctgacattgggaaaccctgccggcgcagatggcaaatgacccgctctcgggagcgcggagtgcaggaccgactagaagccgcttccgggggccatcagatgagaaattcggagggtatggccgcgtgccatggtacacgtgtgcgttgtccgtgagcgggggtcgcgggagtggaaagggtacggttctaagtcctgtctgcggggtagttgattcaggaatggtatcttgttagcatgggagctacccgtcgggcgtgtatagctcgtcttgcgctaggtaccttatacgcagggggcatgacgttcacagggaggcgtgggatgtaataaggtgtgccggtaggcacgctggggtgacagatggcacgggtgaattttaggaaagtgtggtaagcgtcaaaaagaccacaacgggtgagaaacaaaaagctcgtattggtgtgtcgctggatatggccaagaccttgtgggtgtgaccacagttgctgtgtgcgtcattcactcggtcgcttgataagggtgggggt

SEQ ID NO: 8807 - DNA, 1787 bp, Homo sapiens
  misc_feature (1)...(1787): n = A,T,C or G
gcttgatgctagactcgtatctgtacanactagttatatatgncgatatattatagtgtcagatacttacgtacancganacacgcggagagactaacacacnancgaagcgaaggacgacacaatagctttaggagtagggaaagagaagcagagaaaanagaggaaaaggttttacnaatagtggtgcgctaacgcacacagcgcgcgncgcagacggagcacactatnaaanaaaanaanaagatcagactaatattatantcgctattttaatgtanccgtcaagnttaacgcacgaccggagtggnggcacacntcgcagcgcatcagatagcnctacagagtctctgagacacagactgcattggaggtcgcgagctgtgaagtgtgtacacngcgccgcacgtattggcggtgttgtctcttctcgtggngctgtgggttcgaggcgcgcgngaanaggagagtaagagatgagaacagatcagacgcatcatggtgtgagggacgagctatcagaagaatactagttcatngtcacatngatgagattattngagattatgttantaggtaaggnaanagaaggagaggtgggagagaagaggagatgtgtagttttnanaagcttatatttgagtttctgtggtgtgtctctgtagctctgtcgcgcgacgcactatgtgtagtattggtaggtaatatatatcntcatatagacgggcatnatacgtgcgtcgcggngctggtagagatagtgagagtgtcactgtaggctccgtagctgtatatgttgtcgatgaggtgactcgcgcgtcttagtggccgatattgtactcatcagtgttaggtgacacgaagtggtaagtggctagatagtcagctgacgacacacacagcacgacaagagacgagccaccgaangaatatgctagtcacatcactaggtagtaggtcagtgtagcgtctnggtgccnangtagagtgtagagtcacgatagtctagtatgattatngtgtgtaagagtatcgagatgtagcgagtgtgacgtgagagtatcacttgagagtgnatcatagtctgatatatactgctgctnatgtcagngtagagtgatggagcggagagatgntcggatgtgagctacgaagtgntgagtgagtnagtacgngagtacagatgntcggtnggtgtgattngtcgcgtacntcgtgcngntgtgattntgtcaggtatacgtgatatgtagntgaatgtctgntntcgangatgtaggtggtagatgatagatgtacncnacgacacaaatgtggtgcgagcatatcggacaatacnactcgcgcgcatgctgntaacggcgtatgagacatgttgtgcgtgagagcgtgtgagtgttgtgtcgactcactgatagagactcgncngttcatgacgtcngcgtcggtgttcgagcgggtgtgtgcgacgncncgagtcgtgcgtatgcgtctgcatgtgatgtccnggcngcagccgtatgtcggccatcttacattgatgtcagtcgagctancgcactatggtatgtgagtgaatacgtctcagtagcagttgagaaccgtacnacgcagaggagangactacgtacacatgtgctagactacgtgaatcgtatgatgancanctcataatcacgatgacatangtatagtcagcatacagacgagnacgacgnnacnncaanctcagntagctganacacgcgacactacgacgtgcgcaanctncgagcgacgctactgat

SEQ ID NO: 8808 - DNA, 778 bp, Homo sapiens
ataacccctttggggcctggtaatccagaggaagggaattggggaggaggtaacaaccatagggtctaacgctgcgaagggggggaagcagggtttcgctggggaagccctgggtaaggcagatggaccactttcagtgtaaaggaaatagatagaaagcacagggatatgtggaaggtataatgctgtggtctctttatctcccctgcaagagttctagaaaggcagctagaggcctcagatatttggaaattagttttgaaacctgccctgtattactttacccacagtgctctgagcccgtcccacaaggacacgcctttttaaggattgaacgttgatgaggcccatctcattcctgtagggcccttggggttcaggggtgaagttaactagagtccaataaaaccacagcaaacagctttacttcctaaggttcttgtgtgtactggctaaaataagggtccttagcccttactgtttccccctgggattcttttgctaacagaattgtccctgaagctcctacctatgacccccgctcaaatttctctgtcagtacagaaagtataaaagtgcatagtgttgaaagtcacggtaggaaaattataatgtcttccctaagcctgagctgtgcagaaatgtctactctgggtatatttgaaagaatgaataaccaaatctgcacccctcaactgtatagagcatggtgcttgacagtcttatacattggtactctctaatgtgagccctataataaaatcaatgatccggccta

SEQ ID NO: 8809 - DNA, 1020 bp, Homo sapiens
  misc_feature (1)...(1020): n = A,T,C or G
cctaccggcggggcgggcggtgcagacgaggggggagggggcctggccgcatcatttttatttatttttttggtgaacggttttctcagcagccagttaccacatggagcatttcacagtttcagggaaggtttcctcattttaaaactgcaagaaaatgctacacttgatgggggttcctaaaaaaatagggcaaccaaccttctacaatcttgggcgtatgacttcacaggcgtaacgcttcgagttgccacattccgccttaatgaccaccggttttcagcggggggcgagtgctgaggtggtttctcggtgccctgaggacattaccgaggccgccttggggtgctgtacttgggcgagctggagatagggctcgcggcgttggggccgctggtgggtccgggcggcgtgcgcgggggggtaggggcgtcacgggacacgcggcgccgctcggcggcgacgggggcggcgagtcggggtacgggggtgtgggttaagggcggagcggtggttgtggtgcggtgctcgccggcgccccagagcgcgaggcgccgccggtgcgcgccggggggtaggcgggagggggggggggcggggagcggggtcgcgatggatgtgtggagtgtaggagtgttctgtggggctagcgccgcgtgtggccggtggggagaggtgtggaagagggatgatgtggcggccgcgcaagctgcgctgtggtggacgccgcgtgcggtggggcataccgccgtggagggatagggtatgagaggtgagggcggtncgagagagccgtgtagaggaggcgggaggtggtggcggggcgttcgtggggtggcccagttgaccgcgtggggcgttcggcgacngagcgagaggattggcaccgagcgcgtcgcaagtgtcgggtcgacccgggaggtggacccgcggggaggaataggggtgagtgcggatatgntaagtgcggatgtgagagcgcgattcttgccatcgctgagaccgtccacgcttaactat

SEQ ID NO: 8810 - DNA, 918 bp, Homo sapiens
ggcgccagacggggagtgacggaaagggaggagagagcgctggtcggatacatgattattatactgctaatatgatcagtttgtttcatgttatccccatttgatcaagaggatgacagtgggtcagagaggttaagttatttacccaaagcggcacatctaataagtgatgagggctggatcccacactctaaggtctttcactccatgccggggaatctgcatactatccctcactgtccctcgtgctactacgacggaggtagaaaaaatctcattgtggggggtggggagaaccgagtgaggttttttggctgggggagagaaccgcgggcaacggggggcgacaggtcgtgctcgtgcttgagcgccgggtgggccgtcgcggactcgggggcaaacaggttggggcggaaatcgcgctagtttggtgccggccggccgtgcgcgggcggggagcagcgggggtggacaattcgggcgggggtctcctttgagcgaacgccaacgggtctccttgtgggggagagaggagggggcgaggtgcctctggtgggcacgatgtctacagtatgtgtacgggggatgaatagaggaaggggacatcgaactaaatttgaattatagatagtaaatgtcatagagtagtaggagggggtggtggcgtggggagatggggggtagtagtggaatgattaggcctgtggctcgaccagtgtcacggtgtgacgtgctgtgtgctcctttcggtaggtccgggccgagggcgagcgtgatggcattcccggagtacggtttcacccgcgcgttgccagttcgtgattggaatgcgtatataggcggtcctgggagatcggcttgggcggaggtacacaccgaatgcatgtggggtgactcggcgtacgctcgtagtgcggt

SEQ ID NO: 8811 - DNA, 186 bp, Homo sapiens
catcccgttggtcaccagtatcaactacttattgaaaatctgccctcacagtgaaaacaagatgttctaactacaatcgcagaaggtgagtaagcatagtaaagacgtttttggaaaactggctttcccacacatgaagtaaagaaataaaaatacagtccatttcttcacttaaaaaaaaaaaaa

SEQ ID NO: 8812 - DNA, 1707 bp, Homo sapiens
  misc_feature (1)...(1707): n = A,T,C or G
acactnctagctgtcgcagcatgtgtantcacatanatagctcgcttagaattcgtatctgagttangagactacacctacctagtcacgctaggtgtcgtgtgtnttatacatgacactcggtggaggtcattgtctgatcgacactgttctgcttcatagtacatatatcatactgcagtcatattggtcactcaacgttgcacaagtgtcgaggcggcatgtaaccagaataatactcacgtcataattagaatgtaaactancacactntgatatgatcatagtatctcgcgagnctctgttganatcactcgnatctggcgactatatgatgtagcactaagagcttatcataagctccgagagtatagcgagcacgnactccactagtatattcgtntactgagtcgcntagattgatagtctgcatcacataattgcgcagatgagcgtatgtngtgttgtgcgtcgtagcttcatcgtacntcatatctatatagtcctctgatagcttcgatctcgtagatcattacatttgagttctcatgatgtggatactataatcactcatatatctaggctcacaatgctcattcgtantctgctgtccctgccgtcctatcgagtntcagatgttatacgaatgtcttcgttcatctagcaagcgtacgtantatagctacgtgatgtgctcagtgcgctgancgngctacgatctgctaccgangcaggcgcagctacgcagatgacattattgctctttgtacatgcgtggattatgtggcatgttcgtagtgtantcaggtngtangcagtntgtctngttgtcatgagcagcatctnacgacgtacgncatgagcncgtctctcgtgctgcctgtntcatcgtcatctctactcgtcacacctctacggcctccctctgactgtggcgtcgctgttgcatatacgtcgtctgngtcgtgtgatgctgggtactatacttgtcgcgatctgtggtgttntagtcanctcncgnataanctatcagtcgacatctncnacgtggcatgtacgctgctgctgngngctgcgtgtgngctgatgatgtctgcagactcatactgtcatntnaactacngtgcgctccnctcactgcantgtgantacttgacatgacggaaacgacananacntgatgcacgtacacatgatgagtgcggctacactgtgttgcgngtacgtcaatattctcgtacgtcgnattacnctgcatgagagtagaatgttcaagcgctctcattacagagcagtcgtactgtcgtagttcagagaaggtaggattgcgcctanctgtgtgtgggtttcgtgtagtatagcagngcgtgcanctatcactctatctgctctgntcagttcatcgcactcagtacccgcngcatgtnccgtcgacnnggtctggtgcattactcctgtcgtcacggcagtcatagacatatcacaaccaatatgcgataattgtagtngtataggcgnctagagagatananatagtcatgtctctcgtagatngtggggttttactggtntcgncgncntntgagcnngcgcgtcgtngcgnangtntctagggtannctagccacaactaacncaagncttnnttcttctcttttctctngctctgctcgcagcgtggtgagtcgtctgcttagtagcgctcgcg

SEQ ID NO: 8813 - DNA, 451 bp, Homo sapiens
atccgcagtaggacaaagggcccgccagagctaaccacggattgtcaccttgatttgtccagtctagcagatatgcagaaatgaattagattctcctgcttatgaacacaacacagaagcaaataagcttgcaaacagcattttccaaaccatattatctaagaaatatcaagcttcatcctagatactacatgctgccttgctcagtaggtgaggaaaagcagaaaaccggtgaagacacgggggggctcttctccagtaatatattcttgacattagaaactaaactctctctgattgagagatatgtaatttgcattctgcttagcttttatttttgatgaaggctatcagaatgcttcaaaatgtaaacatatcacatttttgaaaagaatatgtaatgtgaaacctagtaaataaagctgttgttcttttaagaaaaaaaaaaaaa

SEQ ID NO: 8814 - DNA, 773 bp, Homo sapiens
cgcgtgccggtcggcgggggtgttcggggtcggctttctccgttctggctgctgtcggcgctgtttgttgtctccgggggtgcgccgctctgctcgtctcccggtgctcggttgcggggtgttgggggcgggcgccggggcggtggccggcttgttctgtccgcgggcccgcctcttcgcggtcctgcgcggcctctgccgccggccttgcgttgtcgtttgttcgttccgtgttgccgggcgggccgggtgtggcctcgcggttgcccgggtgtgcgcgtgtcatggcgggtgccgcggcgttctcggggtgcgcccccccggccgcgccgggtggccccctcggggagctgtcttctgggcttggtccttgggcgggttctttctcctctgtgcttcgtcccccccactctttgtctctgtttgccgtctttgtttccggtctcgcgtggttgtcccctccgttctgccccttttttctgcccactccgccggtccgtggggtttgcgtgcggctcgccccctggcgtgctcgcctgccgctgggttggttaggctcagtctttccttctgttgcttctctgtttgtttctccggtttttctccccgcccctttctttggtgtgcttttttttgggggtgtgttttgtttttttctttgggttgggtaccctttttttggttgagggtttgttgttttttttttcttttttcgcgttggttgttttcttgttgaaaaagaaaaatgtaaaaaaagcgaaacaccccaaacc

SEQ ID NO: 8815 - DNA, 749 bp, Homo sapiens
  misc_feature (1)...(749): n = A,T,C or G
cggcgcctggcggtgttgtcaggttctggccgcggctccggggcgctgtagggggaggaccactaccgcgcttcttcttctaaggggctccacgagcgccactcctcgtggggccggcggcgctgtgggtgcgcgcgtgtcgccgccggcgttgggtcgctcctggcgtcgggccaggtgtgtggtgcggccgcacgagcgcggggcgcgggcggtgggcgatgcacgtggcgggggtgtggcggtgggtggcgctgggtgtgtcctcggaacttgtaccgtatagcgcccggtgatgacgatagtggttcacagctctatgtcggctcagtgcggaacgtgctactccctgtgagcgttgggtgactgtcgtcgtgtgggtttctcgcgttgtcgtgcgcctcacccttctctgccgagcctgtcgggtgggtgtggctccgccgcctccccggcgtgcagggcaggcagccccgcggcggtcccgggggagggacgacgcgcgcgcgcgcgcccccgggggggcgccgtgcgagcgcgctcttcccccggccgcacccccgggcgcgccgggggcgggccagttgccgttccgtattggcggttcggtctctactcttcctgttgtcnggaaaagtctttggactggggcggcggacgtgcgccttttggggtgtcttttgcatcccccgtttcaaagtggaaacggtgtggtgttctccctgttcgtatgcgagggggttctttcg

SEQ ID NO: 8816 - DNA, 1423 bp, Homo sapiens
  misc_feature (1)...(1423): n = A,T,C or G
acgcattctgtagagttagacagccccgcaaattaaccgcgttcgcgcccttcaatctatacattcttacctcctaaggaaacccatcagcgcacgcgatacatgtctactatcgacgactctacaccagccgactcgcgatgctatctctatcgaactcgcgtctctcacccgccgcgagtcgcncgaactccacagttagagtctaacttgaataacgagtgagggtcgggacgacgagagaggccggcgcgagagactaacgcacatgacctcgcgatataatatactgcgcgcgcgcgagcgcagtgacgcgacagcaaatctatataataactacagcggcagctatacagccgcatctgaagtcctcagtcgacaacaagcggagcgcgcagcgccgtgacgcacgagagtggacgtccgtccgcgagcactcctttcagcgagcgatctgcggctcacgtctcccagcgcacttacttcataactctcctatgctacacgcgcctgccgcactgtagagcgccttacgacggcgcggcgcgcgcgactcattacgcacgcacactatccttactgtgttcgcacacacagttactcaatatctcctgcccataatacgcaaccgaaactatctattagatacccgcaacgataggtgtccagactccgcgcgcgcactggataacaactacgcgtagcgaccgaacagatgcatactcgcaatcaaactatgctcatttgacactcgtccactggtgtgagtgagcttcacgagagggaggataagaccagggcgtgtaccatcgccacagcaatcgatatgtatattacgacgcgatacgatatctntcagaccccgacgagaccttgcgactgatccggcgctcagactacacgacgcgtgcgtgacgacgcgcgcaagtacgtccngtcggccgcgatagtgacgcttgtcgtcagctagtatctgtagtgctacaatctcangacatgtacacgcancgcatgactacttgctcaatatagcgcgtcgncaccccagaccgacctatctcacagcgactggtcacggcgcatagagcatgagagaggatggtgctgatgnagggcatagacgcaatgaacgaatatcactatgacagtacacacagacgatcgcagcgatgcaccagcaacgaagagcgtaataatgtactagcgctacaacagaagaacaggctcgagatcgagaagacggatcggcggtagagtcntacgaatacattaagaagtanatcgactgccttcatacatcccgactccgcacgcacgaccgggatattgccagcagcatatcgacatgctgagcgaattagagtagtacggagaatagatccagcccccacagtctaaccgcagcgtgagaatccgcgctgcc

SEQ ID NO: 8817 - DNA, 1450 bp, Homo sapiens
  misc_feature (1)...(1450): n = A,T,C or G
caacgaacgagagggcgggaacgcaccaaggaagcgagagacgcaaaggggggttccttgggaaggacggacgggaggggagggttcttcggggggggaaacaaacccagcgacgacaccagccggagcccaaaggcaaagagaaggacagggacacgcacgacaaaccggaagcccacagcccccaccacgcgcacgaccagacgcaggcacgcggacggcgcggggcacgagacgaacgagggcnaacgggacgcgccaaggccgcaaccgccagacgacaggcgcaccaccaggacccaccagacgacgcccgacccgccgccccagcagaaaaggacgcgccgcgaccgcagacgcagacagaacgaccccagaggcccaagcagagacgaacaggccgcgacagcncagagagcagacacagggagaggacgcgacagcggagcgagcggcgaacgcacacacgcngagacgacgcagcaacaccacacagagacacggacccgcacgagggcagggcagacagacagggcananacgaccacagacccgcgcaccnacaagagcacgacagccacgacgagagagncgcacagagacaggagagcggacgacgcggaccgcacagacgagcacggacacaaccgcagacgcggcagaagagcganagaccaccaanacgaacaccagagacaaggcggcacggacacacccgagaacaacagagcgcgagaaggccacangcgaggaggagagaggagggacgacgccgcgcacgcgagggcgacgagcgggcagccgaaacacgagagccgcacgaccaagagaacacgagagccgaagggagagcgcccaccaaccacacaaacccacgagccgcagcagnccgcacaagcggacagagcgaccggaacgccgcacgagaacgaggaagacgacaacgagcacaggcgcagaaagangcangaacgcacacgagcagcgagcacgacgaacaccgacaagcacacgcgagcngagacacangaaaaacagccagacgcagaggcgcagcacaaggccagagcgaagcggacgcaagcncgcagcggacagcagagacgcacgcgacacacgccggcaggaagggaggcacaccacccggagcaaagcggngagccgcaacgacgcagccggcgagcgccaggaagacggccgccgacagcgacgcagcagaagagcgagcgcagcacgacgcacgacacaagaacagcgacccacacagcgagacacgagccgcgcaacgccaggcacgcaacggcaccaacacgccacagcgagccacacagacaaccagcgagacaacacaacaagcgacacacacgcgaacnacgccgagaagaaaangagcgaggcgcagacagagcaacgcgcacgagaaacacaaccgaaccgaacaagaggaacg

SEQ ID NO: 8818 - DNA, 1220 bp, Homo sapiens
  misc_feature (1)...(1220): n = A,T,C or G
ggaggagggggacacgcggaaagcgcacaccggacgggcgaacggggggttcttggagtagaaagaagcgggagggccttttgggggggcgaaaccacggcgcccgcacacggagaagcgcgcngcagaagaggctttaactactcacggcggagagcggaagacgccaccgagcaccgcgaagaccgaagacgaacaaccgacacacgcgtaacaccgggagcgagacgagacgacaggagacgaaagaggcgacgcggaaacgctcagcaaagacgaggcagacaatgcgccgacccgacactacgagagacacagcgcggggcgagagacgagagacggtagggttttgttttgaggcgagagacaacaacagaaagcggcgaggcgaggtacactacgcaagagcgaacgcggaagcaacaacgccagcggacttgagcacgacaccccccgacggaggaggacatacggacaaggcgggagagagcgcgaagccagggaaggagaacgggctaagtcagaagaagcaccgcgcaagagcgaggcggtgagggggcgcggcggcgattgggagacgagcgcgacccgatccgccccgccacgacggcctcgcaatcccaccacgagaagagcagcgcggaatctcccacggcgcgaacggcgacagcaccgacgcgcccgcgacgcaagcngcagagtgggcgaaccggcgcgcgggacgcgtaacggcgaagcccgtgacgagagaacgacgataacgaaccgcgacagcgcgccgagacccacgatcagacgcgacaccccgcatcagagagggagcagaagtaccggtcgcacagcgctcgccgacgcggaggaatctggcgcggagacgcgcggaggcgagagcctgggaggagtacagaacgcgtacggcgcgcaccaagagacaagccacgccgcacacggcaccgcgtacaacaagtaacgccacgcacggaaggaagagcgagaaccgccgagtntaacaagcgcaagaagcaacataagacaagtagaataggtcggcgcgcgcgagcggcacagaaccaacgtacgcccgacaacatcacaaggaccagcacagaagatagcgatccggcaggcagagaggcacgacgaagaacacaaagacagcgacagagacgaaccagagaggggaataccccagcaacagagctggcccgcgcggaggaggg

SEQ ID NO: 8819 - DNA, 220 bp, Homo sapiens
ccatggatggactcattagctttcaaatgagttcttagaagtcttgctttctctatcaccaaaccacctaaatccaaagattctgaagaagaggaaagtgatatgtcacagaatttgccgactagtggtgaggagggatctactccaaagaaactggaagaaactgtaaagaagcagcaaaactatgataaaagcaatctctctctcaaaaaaaaaaaaa

SEQ ID NO: 8820 - DNA, 220 bp, Homo sapiens
  misc_feature (1)...(220): n = A,T,C or G
gggagcgcggggtggggggagacaaaanaaannnccctagtaccccctgggaaaatgtactggtacctgcttatgaggctccctgtggggcagaaacagctgtctgctcaccaagggggagggggcgtggtcagacactgnatctactggcatcttgatcttggattttctagcctctttaactgggagagataaaatgtgtaagccaaaaaaaaaaaaa

SEQ ID NO: 8821 - DNA, 1306 bp, Homo sapiens
  misc_feature (1)...(1306): n = A,T,C or G
gttatatttatangaaaataantaaggcgaaaccagcgtcgcaaggtttttgagangactgtcgcgcggacggatgcgtcttttcgcgcggtggtngtggcggtgtagtgcgggntggtggtcgggagagggatacgtgctgtcgacntgtcgatttcggtgatcgcgcgtcgtgttgatatctgtctgatgtcaccnatctcagttcacgtagtcgctccacagtgtcacgtagctgaccggcgcgacacggaccgtgacggtatctgtaccgcttccacatttctcgtaacgcaaccgttaccggtgtggtcccgttcccgtcaccgtttcgcacactgccttttgtgcgtcccttncgtggattttgtggccgttccccccgttgtttgcccagtccgtgtttgttttaatgtcggacccgtatgttcagaccattatttccaatagattgccgcgtcgccacgcgccggtcgcgcgcctggggtgtgtgggtgtcggatcgttctnattgtgtataatattcagtattttatcgcagacccccttttatttctacaacgtccactgttgtgggtcgcgcgcgttggcgtcaagatccgggggcggagtgtcggggcggtgttggggtggttcagaacagggaatgagtccagaaagttgttggggtgaatgagcggctgtcaagttatgttagttccgccgtgggttgcgtgagatagtgtgggcgcgacgaactgtgccagtttcggtacggggtgggctagatgacgcgtgactgttttatttagacgtcgccgtgcgctgtagcgaaccacgcggttttgttgtacgctgtgtgtggtctcgcgcattatgtgttaggacgaacgcgcgccctgcgcgttcggcggggtggtttgtggtcgtcgtgtgtgcgcgattgtgtaacggccggcgcgtcttgcccacaattcgcctttaaccgcggtgggatcgattgcttgtactgacggtgttcgtcttgtcgcaccaatcgcgtagagtctgtgagcaacgctagggacgtgcgccgtggtatcgccgccgacaaggtccatggccgtgtattgatgcgcggacgtgtggaagcgggtgtggtatgattggtgtatttcctcgtgtgtcgggtatgatgcaggatatcgcgtgttataaagtggtgtggttgaatacataacgcgtgtgtaacagagttcggcacgggtatattaggtgatagcagcgcagtctgtggtncgtgcgggtgccgttcactcgccgccggtgatttgttcgtcgctcactt

SEQ ID NO: 8822 - DNA, 1005 bp, Homo sapiens
  misc_feature (1)...(1005): n = A,T,C or G
gcgcacggcccggcgcacgcacccccgacaccaagacggggggacaacagagaggcccgtgaggggagaacnncaggcacgagagccttgagggggggaggaaaccaggggcggggcgagcgccgggggcacggggcggagaagggcaacggcggcagcggagagaacggcggcccgacgagcagcagagcggacgcagccgcaggcgacgacacggacacgaaacacgagcacgggcagagaccgagagaagaacacgccaagagcgcagcaacacgaccgcgagaagcagagagagcgcagagccgcgagggagaggacgaacccggaccgccgcctcgccgcccaacagacggacgacgcagaaggagacagcggacgggcgcgagccgccaagaacaccggacaccgccgagagaaggaaagacggggcagaaagaacgaagcggaaaacaagaggaggagggggggggacgcagcggagggcagcacccacacggagaggggcccgaaaggacgaccggggagaggcaaacgggaccaagcagggggccaaccgcagaggcgagacgaagaggaagaggcacccaaagaagcgacccgcgcaggcaccgacgaggcagcgacaagaagaacccggcaacgggcgcacagacccgcgaaacgcacaaagaaacacagcaagcaccgaaccccacccgcgaaaacanagagcaagggacacgcgaagcgggagcaggacacaccaaccacggcaacgcgaagacgacgcacggaagcagcaaaccgcgaaaccaccggcggagaagcagcgccgggccaagaaagcccgacgccaaggcacccagagcacagaggccgacgaacgcggcgcacgcacacaacacacagcgggacagcaccacaaagaagagcaaacaaagaagcggggaccaccaacaacgaaaagcagccagcgacaaccagggccanccccgcgcgcggggggagcagcagcncgcacgc

SEQ ID NO: 8823 - DNA, 278 bp, Homo sapiens
agaaataccttcaggaaaggcagttgaactaaattttcatctttattttgctgaggcaatctattcctgccttgctgtaaagctaaggaaagactctctggatgtattaaaatattttcagaaatgtatttttacaattgaaacaaaacaactttctcttaaaaaaagaaatgcttgcttatatttacttgtgagaaagctgtgaagaagttgatcaatgtatagttaaaatattatcttacatgaataaaatttgagcaaatttaaaaaaaaaaaaa

SEQ ID NO: 8824 - DNA, 199 bp, Homo sapiens
  misc_feature (1)...(199): n = A,T,C or G
cccccctctctcttcccccccagnnnnnngggnnnaannaagnnaaaaaaaattaaacaaaccctcctccccctccccttagcctcccttttcactgaaaaaatgtantccccctaaaatccccccttttnnccccaagcctaaggcctnnaatccaaaatnccccctnttntnccccttnnntctcttnntnnngttt

SEQ ID NO: 8825 - DNA, 280 bp, Homo sapiens
  misc_feature (1)...(280): n = A,T,C or G
tcgctatggctactcaagcaaagcngtgntcagtgattactcctgagatgacgctctgctggcaactcaccatcgacaacacaaatgtgacaagaagtcatctaacaacttgaaactataaacaagaaaaaggtatacccatgaagcttaagcaaagaggatatccgtgtagtaggcttcctggtgtttcaaagatcttccagaaaagggactttattatcttgcactcangtgggtgctaatatatactctttgatgataccaatgaaaaaaaaaaaaa

SEQ ID NO: 8826 - DNA, 935 bp, Homo sapiens
  misc_feature (1)...(935): n = A,T,C or G
actatcctcgcaccccaatgccagagagaacgagacaattcggttcgttaatctaggngctggctagagaaaataagcacaagtttccaaatgctaaggggatataaaggagaagataaatgcagcatggggaccagccatagaactgtcatggagtgggaccacacttgactcctttccagtagcagaatcttcccagaggacttttcctaagaaaatgatgttcgtgtccctttcaaaatgacatttctaattgcacctaggaatgggctattttctttaaaaaaataaaaagaaagaacacacacacgacacaacaaagcaagtgagaacaacgtagcacgttgaaccgccgcatcagacccgcatctcatctcggtcttcaggccacggactgaaccgcacgtgtcggttgctcgcggctccaccctccccgcctgtggtgataccatatctatgtttttttatcgcaacctacccaacagtgtgacgccaaccctggagcgggattcacccacgaacctccaccctgcatttctatacgtccctttcccaataatgtaccccctctctatcttcaatgtcgttagagagttcggagaacatacctatcgcacattacgtgccataactgcgcccattacgaaccaatcaccactgctgaactctaaccgtacactaaccgctctactgccccactctgccccttccatacaatccgcttgcctcgcacctcacactaacgtacgccaaccacatacaaatcatgtcggaacagtacagtggtattcacggaccactgaatattaatattcattacgatagtctgcccgcgtttcgtacacctgnctaatctgccctgccacaccttacccgaaaaagtgcgcaccacgtacagacacctaatgctacctacataactcacgcgaggagac

SEQ ID NO: 8827 - DNA, 1045 bp, Homo sapiens
  misc_feature (1)...(1045): n = A,T,C or G
ggtggggaggggggggggttgtaacttcgcgaaacctcttgtggagagaagcaaaacttaaaaaaagacagagggaaaagagttagacggccgaaccggcccaggcggggggggcacaaacgcgaggggcncggcgacggggggcgacgcggggggggcggggcggccagagccgcgcgcggcagcccaccaccacaagcacccccccacaagcgtgaggacgtgaggcgcaagcccggcgcgcgcccgtcggtccccgccgaacgccccccccagcacctgagacgcccacagcctcttgagccgactgcgtgccgtgttgtggggggggtgtggtgcgttcgtgtggcggttcgggcgtgggcggtgtgtagtttgattagtccgaagcgtggcgcaagcgctgcgggtagtggggggggggtgcgtggggcgccgggcacggtcgttggggtccnaggcgattccagtggcatcttactttacaacgcccgactcttgtcgcatagctgctggtcaggtgcgtgtgatgcatagcgggtggtacttcagagataggcggcaggggcggtcctgaggtcgcgtttggatgacgcggtcatacccggcgcgccgtgcgcgactcgccccgccgcatgtggttatgggcggtctgcgggggtagtgatggacgtgggttatgcgagtttggncggcggtggagagggtaatctagtgttgtgcgtcgctatgctgtggcttcgcagtcgcaagtcgtggcgcgcggatcgtcggcagcggttagtgtcacctgcgcgctgctaacacttctcgtcgttacgttgcgttttacttgttatgctgagtntgtagagttacgtcagcatagcgccgaggtcacgtcgtcgtcggcgtgcgctcccacgccgtgttgtaataggagcccagcgtccccatagtagagttgattgtggtgctgggtggagcaggcctcgcagttctgcaccgtcccacatatcacgcacccggcgtcgacatagggcgccgtgtagggaatataatcgcc

SEQ ID NO: 8828 - DNA, 1948 bp, Homo sapiens
  misc_feature (1)...(1948): n = A,T,C or G
cgtccgtgtgtgtctgctcgtgtttgggcntgttctgncgntgcgcgtgctgcgcgcgtcgctagcgcttgctgngtgngcggctatcgnattgtgtcgccggtcgtgtcgtcgtcgtcgaggttgtcgccggtacaggccgtctgctgcgtttcgtcgtgcgtgctttcttctgcgttgtcgctcctctctcgtcgttcgcctngtcgttgcgtgcggtcgtgcgctctctcgtcgtcgntgctcncttgctgctncgctctgtcgcttgtcncgctngcgcgtgctgtggcgctctnctcgcgctgctgctgctgtncgttntttgctccgctgtngtgcgcgtgtcgtgctgcntcgtcggtgcctgtncttnnnngcnccnngtgtcgtcgtctcgntcncntgcgcgctcgtncngctngtcgggcctgtgcgtgtctnngcgtctgggcgccgtctgccgcntcncgtgtgtccngcctccgntcgtgccgtgtgcnctgcgcgcgtcgtcntctgtcgcgcgtctccttcggtgtgccgcgtcgctgtgcgctcgcgtctgcccgtcgctgctcgctttgnctntngtngntntgcntgtgtgntcgtcgtctcgncgngngcgtcntgggtgtcgtcgngctcgggtttgntcgtgtnngttcngtcgcgtttgtcgctgctntnntgcgctngttgttctcgncttntcgcgtnctntctcgtcggcctcngcgngctgcgtgnctctcngtcntntcntnctgtctnccgtcggtgcgtgctctggtccgccgcgtttngngcgcgtgtcgtgcgtctggtctgtgtntcctcgctngtgcgcctgntcctctctgtgcgggtttctcgtgtggtcgcttgctctgcggcctcgtcgtgtcgtgtngctncgctgctgtcgcgctggcgcgcgtgtcgtgctggtgtgtgtgctgngctctgctttcgttgctgtgttntgccgtcgttgngctgtgcgcgtgctctcctctcgcgtgcnccgtgtctgtgcgcgcttgtcgtgtctngcgctcgtcgtgtctctgccgtgntggtcggctctngcncgttggtcgggtgcgctgcgtgcgtcgcgggntctgtcgtgntgcgcngctgtgctcggtcgcgnttgtgcgcggctcgtcgcgtcgnctgcctgggctcncgncgcngcggccgcgtgtccgntcgtgcgctcgctctctcctcgtgtttgctcttgtctgctgtcgttctnggccctcgtcgtncgcgtgtcgcgtgcgcttgctgctgcgttctcctgcngcccgtggcgtggtcgcgcttcttcgtgccttgctggcngcgcgccgngctcgcttcttctctgttcttacgtcttccgttctcgcgctcgccgtgcttgcgtctccctcttgttcctcntcgtggcgtcgctcgtgcgggtctcgtctnctcgctgggtgctgtgggggtcgtcgtcgcctcgtggcgcggtgtgcncctcccgctgcgcgcgtcttctcgtcggtgcgtgtgcgtgtcgcgctcgntctcggtcgncgcgtctccgcgtgccgtgtgtctgtgggtctcgctcttctgtgtgctgtcgtgtgcttgtctctctntcgttgcggtcgcgtcttccgtgcttcgtctgttgntcttgtgtnctctgtctcgtctcgcgcctgcggtggtcgcgtgggctgtctctctcgctcgtgtgtcgtctcttctttcgcctcgtcgcgtctgcggtgtgttctgcctcncctctctcctcaacccnnncntgtngnngtngtngctntcgttncntntcgtgcgcncgcacccccctctctntcctggctcttctgtgtcggttggtcgtcgtctcgttccgtggcgtgtgcgctgctgcgctgacggcgctgtcggggctgac

SEQ ID NO: 8829 - DNA, 1391 bp, Homo sapiens
  misc_feature (1)...(1391): n = A,T,C or G
gggtggtataatattttttttttgtatatatttctgannacgttttatgattttagagattgaagaagaaaattgaatatataacttaatggagagagaccagcgggggggagggatgtgggngggaaggtcntaaccactcnnngaggagagaataaggnagaagggagtgaagggaagaatgagggtgggtgttgtatatcatacttaagtncntgtgngtgtgtgttacttataattatctttgtgtttttataaagtgaaaacagaggcgcgctggtgtggggccagtcgagacaacgacgcactatcgacataattatatacagcanacgccgaagcaagactacgagtggtcgtcccgacgtcgcgcgcaggtgtagtggcgntcgggtagcctagtgcgcgacgaccagtcagagagactaaatcaataagaggagctgcacagtcatgcgtgtgtagaaacggaagcncgccagcggatcatacatatagtcaaccaatatacaagatgatgngcggaggtactggtataangagaagacagttatacacgcttacgttcctacgatgtgttaattattatattattctctcctgtagagnggagagaagaagnaccaaccactcttacgcatatctgagacacgactatcggagagcaagcgaggaattgacaaggagacagaaggcgngtgaggggctcaacatcagagtaccaacgcacgacacgatnttgatatatatatattgtatgtaggttgtgataatagtcnttnatatgtccatgagtatatacgagtgagagatggggagtgtcatgtagtgnnncgacattgcaaccacaaagaaatagcattttggcactcagaatcgcagtagtggagcgcatcacactcgtgtgaagaaagaatttntgtgatagtaaaggcgatgaagagattaaagattagtaagaagtgtgatggttgcgtgtgtagtgactgatctcgatattacgagtagtgtgagtgaagtatgagctaggtgtgttctcaattattacatcagtacatatgctctctatgttgcagttccgtacgacagtactcactctcgttagacaatagtatgactagagtagtagtagaggtgcagatagaatggngcgtaatatcgttcctggttagcgacgtcgttccagcagcgtaccgtaagagcgagcgcagacatagggcgtacgtacgagtaatacgggcagcggagcgcgtatgtttatgagctctgttgcatgtgagaaggagatggccgagangccgtgagattgttttagtatgtataacttccgcagcggatctactagatcgcgtcgagaggtctnatgtaaagggatacaatacgaatatacc

SEQ ID NO: 8830 - DNA, 409 bp, Homo sapiens
catatagtaggactgaacttctgataggttaagcgacatggcacagattacacagaagagaaagattttgaagatcagatgaagtagttaccttggaatactgcagaagaaggtatccaaaggtttaggggtattggaatgttagagttatgatgtaaacctgctcactcacccaaggagggtccagagggtacacctttcaccaggactgtcagaaagaaatttgcgagggcacctcagcatcccctaagtactctaactcgaatcatcaaaacagagagtcacagttcctttgtaaaagtattttaaaaaagcaatttgaaaattgacaaatgctataaaaatttcaactactgttactattattattttagtcctcagcaaggaaaataaaaatttgttctttctg

SEQ ID NO: 8831 - DNA, 711 bp, Homo sapiens
tgggttgttaagggcggctgaccccgccgggggggcccgtacggggtctgtgcgcgcgccgccgaaacgcccccagggggtttgccgccgcccttggggtgtgaccggcggggggcgttcccagagttttttgtgcgcccaaaggcgcctccccccgcagggcttgggggcgctgtattggcttccgccccctctttgggggcgccgggggtaaggttcaccccccccccgccagagttcccgggcccccgaaaggcgcccggcgtggaggggagtccgcccccctaggggggcgccgcatgggggggcttgccttttggaagggtaaggtcccaggggtccgggttcccgggaccgggggtttttgaagaacagagggaaagaggtctcttggggcttcggcgggagagggtttccaagggtttgggggtctcgccccgggaggggttcaggggggccccctccctcccccccgggggggtcaaaggggtccccgttcccccgggctgccaaaaagaaatttgggggggggcctcaggatcccctaaggggtttcccttggatgtctcccacacagaggaaaaaatcctttggtaaagggttttaaaaaagccatttgggaaatggccaatgtttttaaaacttcccccggcgggtaaaaattttttttttggcccccccaaagggaaataaaaaatttggtttttttgg

SEQ ID NO: 8832 - DNA, 720 bp, Homo sapiens
ctctccccgctcgcgcgttcatcagggtccggcaccccctctcatcccctgccctcgcccgcgtccccggagcggcgcgggtcaaagccatgaactttgttcgctaggccctttgggctccctccgcccgcgcacgacgccgttctcatctgcccgaagaggttctcctcggggattgtcttatggcaatacacttgttctcccgcccggtggcgagcgccacgtgtcatcgccgcccgcccccttccgccgtgccccgccccccacccccccccacgggtccggcgagcggggtcccgtgtggggggctgggggtcgggccgccctccctggacgatcagctgcacaggcccaaacatcccccccccccaaccattttccacatccattaacccattctcctcgggctattctcccgagagggttcccaaggttcagtggtctccccccgttagagggtccctggggacccccccccccccccccgtagggtcccaagggttcaccgttcccccgggctgcccaaaaaaattttccagggccccccaacctccccttagacgtttttcttttctcttcctttccaagaaaaaaagttcctttgtgaaaggttttttaaaaacccatttcaaaattggccactgcttttaaaccctcccccgcccggtactatttttttttttgtcccccgccaggaaaataaaaatttgttctttttgg

SEQ ID NO: 8833 - DNA, 206 bp, Homo sapiens
  misc_feature (1)...(206): n = A,T,C or G
gagagggccgcgcagagggcagacagnacgcgccgccccagagccccccagccttaagagggaacgnaccncccnnngtgaacggggggnaaccggnnggcaganncnnggacgcagagacaaggggagaacgcagaggcggcggggacagcggcggagccccacgccaccagnaggggaggacaagaaccgcggcgacaaagacc

SEQ ID NO: 8834 - DNA, 470 bp, Homo sapiens
  misc_feature (1)...(470): n = A,T,C or G
aatcatatctttggacatatcctatataaaacaaatacatactgataccgacaggagacaaggaaacactgtgtagaagagggcagttccctggcaaaggcctcaccctcaagtccggatacctgcggtcctaaatgagaacaggcattcctgttttcacacccaaatgctgtcttttggcctgccacacccnctatcttgcacccatataaactctgaatcccaagcttcaganacagaccagcaagccagcagaacagcagaaaacacanaacancacangcagagaaagggagatgaggaagaacatctgaatgcagagaanagttcaagctaggggcacttggagaggagtcttggcncgctgggcacnccgactctganggaggatcgcttcccaatccattnccctttgcagcttctcatccattccttntgaaagcaccttcaccattcaataaacctgatgc

SEQ ID NO: 8835 - DNA, 1528 bp, Homo sapiens
  misc_feature (1)...(1528): n = A,T,C or G
gccgcggtgtgtgttggtgggnagtagtttgtgntacgtggctcgatatagcgtagatagagtttgttttgtctgcactctntcgganccatatatatattagggttttattgttatatgatatttatgttgtgtgttntgtggtgccgcttaagacatcttatagtgtctgtatattatagttatagctgatatntacatataatatatgagtcgctgaatgaaagtgatacgatatcagccagatacatgngtcgtcgtgttatcataggtcgggcccatacggtgccgtccgagtggtaacccttatactcgcgccgagtatgtgcgcgatcngtcctggctcgcgcgggcggtgacagaatctcaataacgngctcgcatacacggcgcacccatcagagagaagtcacnatgcgtacgccgcgccgagtggcaggcgataccgcggtgacagccgctgcaagacagactacgactgtcgacgaacgcacacgcgtctccttcatcaacccatattacttgcgttgacaccacgcagaacggcgcgcggtagagagggtcgtgcgggtggtttagttgtatggacgtacggaaatatggttgtatgaagtgattcgtgtgacatagtccacaccctatgcatattttctccgcggggccggcccgcgacgaaatcagatacgccaccgcccacgccttttattatcccccccgcccatacccactccccccgtttttgtctcttcctccttatacggaactacgcggccatccccgagagtctagttttaccgctactcttccttgtttgccgcgatcatcggaaccagcaaacgtcggctccggaacaagcgattaataagttaggaggaagacaaaggagtactaagaatagtatgtatattattcgcaatcttacgctcagtatctagaccgcactgacaatcgaacgcacagatggctcggtataccaacgccgcccagcggcgtgtggccgccgtgacgcccccgaacgtatatgccagttacacctcaggtatcttatcgcgcaaaatttatttctcttccccaccattatataaccacgtacacacaatcactaacaaaaaaacaaacaccttcgaacatcatctgcccgcacgaccacgctcagttgaacgctctaatacactccccccacccgccccgcaccccattataatttcctccatcccgtatccctacacattccataccccgcacccgcgcgcctcgctacctcttttcaccattcgtccctctcctccgttatacgcacgcttaatatttatagtcatcgtttctcgaatgacgcgaaatttatacgttaatgccatatcgtgagaggcacgacggattttttggcgtcctctcgatagtcgcgatctcggtgtctgccctcgtcgccgccgtacggccgccacgatcgccgaaatcttcccaagtgtaacgacatacgccgaggccgaaccacagacccggacgtacactgaagtcactctcgtct

SEQ ID NO: 8836 - DNA, 1355 bp, Homo sapiens
  misc_feature (1)...(1355): n = A,T,C or G
cggtaatacgatcagcagaacaaataccgatcgcccatcacatccatctggttctctcnctcgctccgcgtagacgattcctatcatatatcactcataatactccgcactcactaacctcacacgtagtaagttgtacagctcgcaatgtgnacacatattgggtgtagtagcatactaccacacacacatgtctactatgtagtaactaatgtgagctatatggatgctcctctctcccagtgtaatacactacatatanacaacacacgtgacctcttgaccatgtngtacatacacatagtacctacacagtatacacactatctactcgcgataggtagacctcgcaatacacacacttacagacacctgtactcgatcaccacctctacacattgtacacacttctctgttggacacacatcgcacctatgtcgcagatcattgacattatcggnagataatcgtacatcgaactcatctacagcgacacaccatgactgaacctattgtgtaaagcacttctcaacccgttgacgtgtatttggacaacttaaatatgcgatggttgcattgcttcactactgcataacaataaatacaatatcctggatcccttaataatgaggcacttgatgtctgtnttgcgaaagtcttgtctgaatggataccgtatttgaatccctatgtcaaatngcacgggcgagtaatacttataattagaatactcatcagacctactaccttgagcctgttaccttgcacatatatataatgatcaanacgggccgttcaagagaataacaccagcacctcaccatctgtgcggcgtagtatacgcgacaatgtctagttatacacgccacactcatcatcattcnatttcacgtggcgtatacttatatgtcctaatgtattttccaactcattatcatacacatagataatgattataagtagtgttgtgttcactcttactcactcttctattacatggagacgcatgctntgtgttgagtctaatacctctcacactgatagttatcttccacatcacaaactcgttacttactcagatacatacctcacatataatgtatacatcctctatcttaccaataatgacatttatatccgactataacactctcacgctcaacacacatccgtatacatgtgatgtattcctcgagcttatgcactcatcctacccaaatctcatcgccatgtggattctcatcntatctccacgacatctattatcttatcatgactatacctttcgccagtcagtcaccatatatatatgactctcatcacgctgtantctatgctcactcaatactcccgct

SEQ ID NO: 8837 - DNA, 889 bp, Homo sapiens
  misc_feature (1)...(889): n = A,T,C or G
gattggtcagaggagagaggtaagaaggacagtgggtgtgtggatggggggaaggaggggggcggggggggtagatttgtnatagagtgaagagagagagtgtgtgggagagggagagtaaggagcgagggtggaggtgaaaatggtcgcttctataaagggggggaaagtggaaaagaagaggtgccgaaggagaatgttttttaagtgttttggaagaggggggaagaagagaaaaaaggagaagagtgggagggaagaggggggggggtatttataatcgcttgttgttttgtttgaaaatggggggcgggaaaaaaagaaggaatattttggggaaaggggggaggctgtttgggataggggggaggggttttacacaaagggagggggttttcgttgggaaaggaaaagacgggctaaaaagggggggggaaatgggtgttttttaaaaaaaaagaaaagggaatttttttgggtgtttaaaaaaaaaagggaatgagaaaaattttggggagtttttgggggggaaaaatctggggtttaaaaaatagggaagttaaaattttaaaaagaagggaagaagtttggtttttaaaaaaaaagaaaaatttaaagggggaaaagggggcgattaangntaattttttaaaaaaggccaaatgaaagaataaaaggccccccccataaatggaataaattgggggggggggggaggggaggaaatctaaagggaaaattcccttttaaagggaaaaaaaaaaagaaaaaatttttttggggtttttttttagggaaaatttggtaaagagaaagggaaaagtgttttatttaagagcccacctcaaaaagggggaaaaaaaagggggaaattaaaaaaaaaaaaaaa

SEQ ID NO: 8838 - DNA, 2461 bp, Homo sapiens
  misc_feature (1)...(2461): n = A,T,C or G
aaagtaagtgagaggatgagacgttgtgtattcggtttcgtgcgggaacgccacctgtatgtacatattccagtcacatagcgcaacgcaccacgttggcncttccgcgggaggaccgacaagagagacganagagaagccggttttagcagaggcgcagcagagaggaggcaactagggctgggtgagttcgacgtcagcgntcagacgaggaagaagaagagtcgagagagtggcattacagcacaagaacgngttatccacatgagtccgtgtgcacgtgcggtctcatgagtacagacaacagtgacgcatnatgagagtagttgccgcagcgccacgcatcgcgcngtagtacgtgcatgatgcgatgtcgctccatagtcacgtatccctctctgtatnttcgtcgctcgcgtccctggacatagtacttgatacgcanccgccaacnngctatttcgntncnataagtatatcagacgcatcccaatgcacaatctatcagctacgcncgagtgggtcgtggtgttcgcnccgcgcttgtgctgatctacctgatctctcatgcagtacgcggatatantgccgcaccgtatgcgctcaatantactatgtcactccgatagtgtantcacgcangctatctctcgcgcgctgtcncgntnctgacntnatatcantcacgcactcgtancgcgatcgaatgtctgagtaatgctggcgagcgctcttcgttntnatcgcngtgcgncaatcgctgatgananagtgcgtnctcagcgacgcgcgcaggagcgacgcgtnatttcgntnctcnctgtgagacgtatgtnagcgtcanctcncntagtagntgtagtgcgtcangngacgcgatgncagacagtcgtctggatcgnangtactcncgcntcagtagngaggcgcgctactcatngccgtcgatcngagncagcncngtcgagntgagcngatcgcgtatatcagccgtagtagagtngacatgaatttcgcggcagtgatcagcgatgngnnagtatcttcactgtctgtgtngttcagtngccagcgnatctacgcagagtagttgntangnagatagtagggtaggactccgngacgcagcntnngactagtactactggcgatgatgcgtcgcagcacgacgacgntagcaggaatcanactcaactagcntancggangtgtcgnagatgactgcgtaatatancangacagagtcgtcgtcacgatcgcgtacgagcgncnaggagcagacggacngcagtnagtnnctgagctanatcgtcagcgacngcntgctgcgcngcttgatnanatctgattgaggtgctgaccancgtcntganntcgcgatgacgacgaccgagcgntacgtcgggcngtngtnctgcgtntcnncgganganattgcnatatnatctatngnctgtcggnatcatactgcgggnagcggctacttangtactnctgcngtaganatgcgccgcagtatgcatgtngnncagcgagccggtacntcgtcgtgctancgnacntcgcgctgcactacgtatancctcanncgatattacngtatnnactnacgccgnctgntcnnatactncangtccgnnctccgncgtcgnncgnattatcncagatnagtanntnggttngtnctgcagcgagtgatggcttgangatnggncgcngangatngaatcanctgcagccgntntttgntcggacncgntntnacnggtnngatcgtcggctgactagntagantgagtnatntcggcgnaggtcgattncanatgctgtnaggccnagngctgccgaagtacntgcatntantttcngcgtcagntgacagcgncgtngatgntantcagctaggtatgatatcgancatcgnacatgncagcagcnacgtcgancgaatncnntnnntccagtacgccnntgatnatantnnaaagtncagctctgccngacgancgattgngctngtaactngaccgaattngcacgatgaggcggannctnacgtaccnagncgancggcatnntgngactncnatcgatgtancngannatcagttggantactgcagcngncanacnaggantanaccnnngaagnttgccgtgacnacnncatgacatacgcgttatgatctantacggtaatgnnattagntganctgacgacnntcnntacancatgatggtcagtgntcaannncnnatcntncngcagactnacgtacgantccntgcngcngtcgtaaactcgnttantgantacgtaanntcaactnccgaccgcgacgtaattntaantgngacangttancngaccnatnnacagtantgnntatngtcacgtcgnagcntnacnacnncgncntaagtntgcatgcntagctgnnatcgtncgatcganncncgg

SEQ ID NO: 8839 - DNA, 879 bp, Homo sapiens
catgcgcggcacgtgataacgcagaattgacggacgtggagagccgtcacagcaacgcttgaatccatcgtttatctcccatacgcatattttgtaggctgacgttttttcgcgtgcaacatactactgtttggataagagtcggagctctattcactgacacgtgacctttatcagaggatgccatggtggatttaatctggcatgctctctcctgtggggctgaggagctttatcttttcccccgatgaccaacatcactgcgctggaattatcttctagtgagaacatataccgtcttgatgagggattatgactgttctgtccttgaagctgttacctgatgctacttgattctgttaaacatatccaacgtaccatgactcctgtatagagtgaggactaacatctctgtctttccgcacgagcagctcactctgactctggctgccttttacgtctagccagtgccttaaaggactatcccactcacctgaggtgaacagcccgacaccagctcagtgtcctgacaccgatcgttccttaggtgtggctgagcgaccccacctcagtcatagctgagagcccgggctctcaagtcttgatgtattggaacctgtgacaggctgcgaacttataggccagaagggggctgagcctgcctggagcccgccttgttgatgcttttcaaaagggcccgcccgcgtgagacaaacctataattcatcctcaaccagaggcgcggaacccgcccgacttatccaaggccgaagtcacccctgcatgtccgtggtccctcccttgcccacccttacgggccagggtacagttccccctcgcctccaggagagagggcttagctacttaaccatcgttcct

SEQ ID NO: 8840 - DNA, 1034 bp, Homo sapiens
  misc_feature (1)...(1034): n = A,T,C or G
aatttaaggnaaatgggtgacggnggggggagccacgggcgcagtcgggcaggtacgggcagcaagagaaacagacagccttaaaaaaaaaaacaaaaaaaaaaaactcagccgccacgaccccccccccccgccccgcgacaccaccaccacgccacgccacaaggccgcgcggcgagcgggccccagaggagagcgagcacccccccgcgggaccccgcagagggaacgcggagacgcaagaaaccaagcggacaaaaaaagcgcggagaagaggaagaggggggcgagcccgcccgcgaacccccccgccccccaacccgccccccccccacgccacaccccgagcccccccaccgccacccgccggtaagaaaaaccagcacccggcggaaaacctccccgcggacgggggtgccccaacgaccacaagggggagggaagcagggacccaacggacggagggagcgcgcgacccccgcgccgcgcacacccaggccccgcgcagacacagaacacgcgaaccagcagcgcacccttcaccaccgagcggacggcccggcagggggccgagagcaaaaaccgaggcaccagagagggaccgcgaacaggcctccacgacgcgcccgaggccgaaggactcacaccgcaagcagcggctgccagacacaccgaaaaacagatcccacggacacgcccgccgagacgagcgcgcaaggatgagagagcgcgggacgacgagccccgcaggacgccaagacggcgtcccagtggagacaanccccaccagcccaccggcgaggggagagcgccccgcaccacaggcggcacgagccccacagaccgcaaacacacggcccgccaaacaccagaacccagcgcccggggacagtgaacgacgcgcacaggccaggcacccgacaacagaaagcgacacacgccccgacagaccaacgaacagagcaagcggcccagggaagagacgaagcggcggggcgtggaggaaccacgaccccaccacccccccaccccgc

SEQ ID NO: 8841 - DNA, 1486 bp, Homo sapiens
  misc_feature (1)...(1486): n = A,T,C or G
aagacgaagaagtagtgagaagagatgtgatgaagaggaaggaggaaggatatggatgtagttgtacaatggagaatggagtgtaggtataataggtataagagngggagaggagataggaagatggagtcataggaagagagagagaggagaataagataatagaatacggatagaaagaaaggatgtggagacatagagatgagatgagagatggtanaatatataagaggcgaggaagaagtaggacggagagaagacggaggagtggagagagaacaggaaagatgaatataagaaagtaggagagagatagaggagaaaaaggtataggtaggaggaagaaaggtgagtaatagggctggggagtgaagaaaggaatgagaggggaggaaggagagagagaaggagaaagtggaatgaaagagatcgggaggcaagatatgaggaagatgatagagtgagaagggagtgaagaagaggaatggaaggagtggagtgagtggatagaatgagagagagcatgataaggagagatgagagagagaaggtagtagagaaagaaggaggtggataggaggagagaggaagtaaagagtngaatcgggaggacgaagaagagaacgatgacgtagagaagatgaagacaganatgatgaaggacatgacatagatagagataagtagtntgntgcgtacatagagagaagatgaaagctgtaagtagacagacattaacatatgcagagagatgcaacaattagantgatactagggagagaggtagagtgagaagagagaatagagaataaagataggaggacgggagagagagaggatgatgtacgtaactgaggagtggtgatagagagtgtaggagaagtggggagagtgagtaagaggagcggagagaggaggaagcacgagaagagggagagagaaggagtgangagatatgaagagacatatatgtgtgtgtgtctgataaaagagaagaggagagaagaagacanaaaggatgagagtggtagatggagcgaccacacgcgcngngaagcgtagnagagagagagaggagtggatgtgaggtgtggaaggcagggagganagatatngagagagangagtgaggagagacggaatnaaggagagagtggtgagggcaggtggcaaggggacgagacgagaggaggagaaagaaggtaggagtgggagaagagaagagaaggtgaggctagtggagagggaagggtggagaggtgaggtgtgggtgaggcggagagtaaagggaggggaaggtggtgtgtgtttgttgtgagcangacgcgggacaccccaggagagagaggaggagagaggggaggagaggaaaaagaaaaaaaaaaaagaaaggggggttggggtggttaaaaaaagaggagattgatggggcggaagttgggtggggtttggtagttggcggganggatgaaaagaaggagaaaag

SEQ ID NO: 8842 - DNA, 847 bp, Homo sapiens
  misc_feature (1)...(847): n = A,T,C or G
ctgcgcctggttctgttgcgccgttcgttctccgggtggcgtgtctgtcgggtgctgtttctcctgtctggtgggtgtttgggtcccgcccccttcgcgcggtgtggcgtgttccgctctttctcggcgcccttcgtgtgcgtcccctggccggtcctcccgctgcttcttcgcgcctggtgccctcctggtgcctcgtgctgtggcgcggcttggtttccgggcgtgtgcctgttccgcgggtggtgctgctgccgctcccctcctgcgttgcgtgggcgccgttctgttgggtctggtggttggggcgctgctgcgtggctcgttgttggtcttctgggcgtggttgtgtcgttctggatctccgcctcgtgcgtcccgcttttcctggctgggtggtgttgttctgtcctgtttggtcgtcctccctcgtgttggcgcagtgtctgtccgggctttgtcctggggcgggtttcttctcgctcctgtgtgtgtgatctcgtgctttctgctgtcgtttttttggcccctgttctttttctcgcccgggtccgccgttttgtttttccttggtgaaaaagtgctgtcttcgtctccccttcgcttggctggcgtgctccttctcctctcggtcttttttggcttccgttcctgtccgggtcgcttctttctccttgcttgtctcctcctgctttgctgtggctcttttctttctgtcgtgtttgggcctttgtgtctgctttcctgccgtgcccnnnnnnnnngtgtttggtttcgccggccaangcggggggtgtttactaccantttttcctttgtgtggcggccgccccccccgcggcttccc

SEQ ID NO: 8843 - DNA, 1327 bp, Homo sapiens
  misc_feature (1)...(1327): n = A,T,C or G
ttttttgtatccaaccccaccaccccaacagcgcgtttattaaaaaaaaaaggaggaagagtttttcgacttagcgcggagccccgtcccgctccgggctccaccacgttccgggcaatacttctataagccgatacatgcttgtcgatgccagggacggagctgtggaactattgactcctggtgcttgcgatcggttggattcctgtgccacacatttagctctgtcacaaaccacacctgtgccgtagcgatggggcgcgcatggtttgcgatgggagcataatccggcctgtcggcatgatccgggtgtccgcatggagaaacccgcgtggggtgtgtgttggctggttgcccgcggtgtaattttttcgcgtgtcgctgcaggacgcaagagcaggctagatagagctggtgggggggacgctggggggtacacccaggccttttgttcccacctcccttttttcaacaggacagtacacacaacatccgagtgctgagtgttccttgccgcgacgtccggtgtaacccctcctcttttcctcaccacacgacgctgccacggccagttctcacaagcgccacctggatgaggccccacccggcgcccgccgactcccgtcacctgcgcacggcacttcgagcgtgtcgtgtaacagagcgtccgaattaccgagcatcagaaattacaaagcgcggcggccccgttgaatcccacaccggtttttggataccgaatgactcctgcgcacccacggtatttttaccgaccccaccctctgtctcattatccgccccgtttgtgggccgctgcgctctatcgcatagtttcttcaacacgcggccccatctacacacccgtctcctcgacaaccagcgtttcggatcgatgtgcgttcacgcctctcgtggcgggcggtacaggcgcatgagcgcgcgcggtgttgcgggngagtgttgcaggaccgaatctcgcgagggggataggaccggcgaatcgtttcgcacagcacgggtgtgtacaagaagcagcacaacactntttgccggcacgcgtggtanacactgatcgtgcgcgtgattcacgcacgtactcggggtcgacacgcttatcgcctcnatattcacacgcggtgcactcggctcgccgtcgatntctcatttccgcatccgcgcgcgtgtgttaatcgcagacgntccccgccgacgcttgagaacccgttatgttatacacacacacgcacgccagtctaggngtgtcgcagattacaacggtgtcntctataccccgtcggtgtcacgctgtgatactcaacaccncggt

SEQ ID NO: 8844 - DNA, 875 bp, Homo sapiens
  misc_feature (1)...(875): n = A,T,C or G
cagactgtatacacagttgacccttgtacagcacaacaggactgcagttgtgcacttctatgtagattctgttcaacaaagcaccgatggaaaatacagcatttacaagatgagaaacccgagtacacagaggatcaatctttggtataacacgagttccacaaggctaactgtggcatttgggcactaagtaaaaactcctatgtctttgaatctccatagaagatcgtgaaatagtgaagaaaaggagtttgttggaatgtggacttgtattcaaacctgtttgtgtgcccccctcttgatttcttaagcagccaaatgcctcatttctgcatactgttattcttccttgggcctgctgctctggaatttttgactctaatccaactgcaactgtgcaaagagagtagttttaataatagtggaaacatactgttattattcaaactttacatcatcctgaagcaaaaatatttgtttgtaagatacagccctttgtaagcccacattatctaacactctattcttaggttcaattagcaaaagcacttgctttcttttcaggggttttctcacctttctcagctagatcacttcctaaactgtattcttcaccatccttccctcctcctagccaaataattttaagtctcaagaaagaactctntgggttgtatttgtttatggcaagatcaagtttgcttattctttctgagcatcctcaaagtgtggcttttttccaagcttaaatgcaaaataatggatttccgtggtttctgcatgatccatttaagatttgaatgctatatttatacataaatggaattttaaatttaattgaatattcctaaattattgcgtgggcaaatagaaaa

SEQ ID NO: 8845 - DNA, 739 bp, Homo sapiens
  misc_feature (1)...(739): n = A,T,C or G
cgtcttctttcccactcccatacgctaaagtttccagtcctccccgatttggattttaaaaaacttaactcgggagggttccctttttctcaaaagaagagatttttggacggggttcaagaaagccctggggtccaagaccgcccaaattggacatttcccataattggctttcttagaaattaccggaggtggtaaaagaatggggggggttcctgaatatctaagaaggaggtaagcccaagtttataggacccaggcaacttgctcagattatttaagaaggtatagaatgtgaaattccattcaaccctacttttcatagaaaaacagggtccattgagtaaactgcgcttgtcacataatttaaggttaggttattattacattattttttaagaaagttagaaattttttgattttgaaatggaagtaccactccacaagaaccttaaatcatccccaaatgggccccccatttaattaaaggattccatttttttgttttacattttcattaatttanttatgccccccccgccaggccacttttaatttttattgaacatgaataaatggataaatgggtatttaacaaaggctatacgtaattagtagcctttaccaataaattgcaaacaagcacctaantggactttttttcccatttgaaaggttaaattcctcccccccttccttttgagaaataaaacttcatttgtgaaaaaaaaaaaaaaaa

SEQ ID NO: 8846 - DNA, 1031 bp, Homo sapiens
  misc_feature (1)...(1031): n = A,T,C or G
cgtcgagcaggcgacgtanatagtattgctgacgcgccgctgctcggctccgtctcgccacgcgatgccataggcgcgtgtctgccgtcnaccgatgtacgctcttctggcctacgccgatccttcatgcacgctcgctccgtcgtcgatatgatttgatgaggatattgagggagcaggacggagctgatgtgttaatagtatgttacctacagtgctgttctctgctcctggttgatcgagtcgctcccatagattggtttattcttccactctccctactactcatctggctcggtccggcgccgcatcactcgtgcctcgtggactgttcacaagttgtgttgtctcgtggtctgttgtcngggatcattcgttgctcatcagttctgcttgcgtatacggtggagactcttaataaccatagtaacctgattgtgcgatgatcccgatctccatcaccatacctataatggtgtatgagtggttatgtatgtggctgctgttgtgctcgcacagcgacgtaccgtctgtcatctctgcgcttattggcaggcattgctgtatgtctatcatttatatgtctcacttgtcagcttatgtgctgatcagtgtgttcttctctcctcttatgcttcggatacgatggaagtacgactcgacgctctggtgtttcgttggtcgctgctcacttttcggccctatcgccgtgctgtattctccgcagctcttcttctccattgagtctcttttttgggcttgagatagaccgcatgcccacatcctactattgtgccggatcattagaaataaaaacgatcgactgtggttttgtgtgaagctttgtgaatcgtcaagtcgtcatgtcccatctacgtgcgttcacgtattgttggtagcctatggcgtcgtgatcttcgacacgacgcgacttagatagtggttttacggctccttgtcgtcggaggcgtacggcccctctcttttctcatgaaaaatgtgcttgttgtgtctcaaaaaaaaaaaaaaaa

SEQ ID NO: 8847 - DNA, 1265 bp, Homo sapiens
  misc_feature (1)...(1265): n = A,T,C or G
ctgctcatcgtactagtattcacgtattctcgataattgcccggcatacgccacgcngcccttcgtntggtgaaactgagcnagaacgcggcgcttacctcccagnttccaaccaagcaagcagcagccgcgggcacactacatcttcgcactcatcacctaagtcgacgagcgagcgtcgggcgaagtatctttcgaccctcccagcgaaacgccgaattggcatcgtcaaagcacagaacctcgagcacctctccttacccgcattactcgtagtcatgaaataacatactctcttcaccgcgcaagaacagaacaatagcaagaatatatatgctgctctatccgatggcgctcatctagccgcgctagcgaacctccaccgctggcacccgcatttcctctctctacccagatgtggattaagatgcctcacgcacaccntctgcctcctactcgaacttccgctccgacgcttacgtgtactgtatctacgcttcgccagcacgacagccggccactcatcgtctcatctacataacggtcacgttaactcaccgcctcatcattccaccaccaatttcaggcctgcactaacccgtcagcgaaacacgacacacatgttgacgtcatacaacggcccacctccatcccggtccccctctacccttcaaataacagggctcttcgttctacatccgacgtatctaacacaataagcgtaacacgcgtcccctctctgttcctgacgtcaccaccacatatatctgctctactctctccacattaccgtctggtctagcttatacccctctcatttagtgattatttatccacacgactcacgcctcgctcgccaccactctctataacttatctctcacccgctacatctctcactttcttccttctcttgctccatttcattgcgctaactcttcaatcgtttttctcatccacttacggcgaacgcgctcggctctattttacatacgtattataggtctcgcacgctacctccacactaatattgaacgtatcatctatatacacaccactgaccccgacgtcctcacacacacctctcatcaccacaccttatctccttcatgttccttatcacatactatcttattcttctttgttgattaccacacccgccgtcttcctccgcctctcgtccactactcgccatctccataccttcctccaccatcatctcaaacaaccatagcacttcttagcgatggcttatcttactactt

SEQ ID NO: 8848 - DNA, 718 bp, Homo sapiens
gcctttccctccctgcatagcgtctcctcatgcctcgatcccgcgcgcgccgattcggctcgacatcgtctcacgcctcccgtcggcggggtaatcgacccccagcgcagggcggagattctttggcggcagccatgtcggcggcggtgccgcttttgcgggctcttctcccgtccgcgcggcagcgtctgcttgcgtctctttgccgatcgctcgccctctccgcgtccgccctgtccgagcctcccgtttttggtcggcgggtgtgttgccgcggcccccacccgccagtcgcggggcgcgcaacccctttcccccctcggttgtgaccgcgcgatcttcctccctctttctggccgccggatgttggtgactttgcgcgggttgtccatcctctcgagcctttatcttttcctgtctccccccccccgaccactgtgggttctccctttccccctctgcgagggaggcccttctcccccgtgcggggccgccttgaacctactcccccccgaatggcccccccctccgttctgcctcctcgcccccctcccttataaaaaacggggtccgcgccgcacccctttcttttttcttggggccagccccctccgggggggggaccccgttccccctttccaggggggcggtggtttgttttttttgggccgcccccccagggggggcgccgggcggtaaatcagacccggccccggcc

SEQ ID NO: 8849 - DNA, 895 bp, Homo sapiens
  misc_feature (1)...(895): n = A,T,C or G
cttctagcggaataaacatatactacgcatcacaccatntcttgagagtacaagaagcactctctcgtcggcgcagacagccctcatcataccacgagagctgtgcgcgctccccgcttccaccacagagaggagcaaaaggcagtgaattgtgtaacaccaaacaaacaggcgatataaagagtattccggggaacaggtgtataacacatccgcaccaaaatactgtgggggcgcgggatattgcgcaccacagacaggggcggtgcggcaattatccacaccccactcgctcccaatcatctgagaaaaaaagggggggaggttttctccccccttaaaaatacacaccaaccccacctctaaagaanccacaaaaagacccggccttaataaagggtgggcggaggagcggcaaagtgggcccccccgcccaaagaacagaaaaaggtgaaactcccatttttccccacgtgaaagaagggaaaaacttttccacctcctcaaaaaatagggaggggcgaaaaaaaacaccacattttggggggaagaataaataaaaaaaaaattatttttgaaattaacaccaggggccggaaagtggcctctcccacttaaaaaaaaaaaggaaacccacgcgccccggtggtataataaaattttccaaaaagggaacccctggaataaggcccccatttctcatttttttccctggggattttgcccccaaccccaaatataattggggtaaggggcccatgccgggggaaccaaggtccaagttccccaaggggaagggggttttttttttttttttaccccccccaaaagggggttttggggtcaaaaaaacaaacccaaggccgaaaaaaaaaaaaaaacacccacccaaccc

SEQ ID NO: 8850 - DNA, 799 bp, Homo sapiens
ttttgtggtctacgtagaggaccaaataaaaacagagaaactcgccacagtgattttccttggatcccatgatgcccagatagctctactttttccttttacctttcagaaggtgattctataacatgtaaaagacagggtttatcgatggaccaatgtccaggaataatggaagaatacacctactctatatttacggaagaattcagccaaatccgcatgtattcattgctcttattcgtgcttagctttctctactgcaggagcatatggtatgatgaagaacatattatcttggattctagtattcagtataaggtattatgtcattggacgccttctatagactctctggatataaactttctctatagcttaacgatagctaaatgatgcaaccgtgtctatagacgcctagttatcgctaccattcttatattcacctatagttgtattcttaatagatttgtctatcaagtttgtattgatctctccaacccttagaatgaacctgatgttcttacttattccgtcatagtgactagcgttttcaaatctccgttgtgaaagtgcaatcgttgttcttttcaacaagtgacgtttggaactcgggactctctatccttattttgccaatttctaataatggttcttcttaatattagcatactgacaccacgcacctgctgtgttaataaagacaatttggtagtaatctttgtcctttataactttcctcccgcttaaaaataatgtcattgtgttaacataatctcgataccgaattcataattcatag

SEQ ID NO: 8851 - DNA, 1349 bp, Homo sapiens
  misc_feature (1)...(1349): n = A,T,C or G
attttccttttccttctttcattcatccttttactcccacttagctgcaacgactctctcattttccaccgctacagattgaaataacagacgccatctctgatttttgaaagcacaatgctcgcagaatctgaaatagactgagaaccccccttcatctcgcctgcgtagtctagaatatattagataaatgacaccaacctggcatacacctaatagtgaaatcctatatgtcgcacttgatcattttataagagttataatcatctgtcaaattcgaaattgcacttcaccgctactatagacaaaggtatacgttcttatagagcactacattcgcatgtcgcgactcctctccgttcgttctcctccctcggttcatcgaggtccacttctctatatactatctgaaacctatcgtngagcatcatacagaacttctngccgcacatccttaccgcgtcactgctactctancatcaactcacttactatctcatctcaccatgtcacacatcattcgcactaaccttgtacgctctacactctcctcgacccactctcctatcaatacgtgatattacttctcgtactctctactatatacgtcttgttattctgcatcatagtgcaacctactcatctctcccatctatcttctctntaggctcgacncaccgttcacacattcgctactcacctgcgcactgtaacgtgctcactcntctcatacttcatcattctttcgtgtactctctactactatgatattctcacttacgttctctctatcctctatcatacgtatcaccctcacatatgtcgtctatctattcacctcttaacatactttctcatgtttgaagtatatatcaatgaactacaagtacccgtgtcccattctcttacttcactcctcatttctaccttcttaatctgtcgtgcatactcgtcctctacccctcgtgctcccaacatccatccttagtaactcatctcccacgctcctcccacatcttcttctctatcattcctcnactctcgttctcttcttactctctccttctcacgctccgctcacttctctagactcatanatcttnctcttatctacctcttactacacatctatcatatctaccatctctccgtacacctcacaactcatgtaacgtccatcgctcatcgatactctatcaccgatcacgtgcattatcgtatctcctcccgcttctctcttatcttccacacatcacctcgcacctcctacttactacatcactcaatcatcacttgcntcgcttaatctcgcaccactcatctcctatcacgtgctccacacactacag

SEQ ID NO: 8852 - DNA, 882 bp, Homo sapiens
atgagtggtaaaaataggatgtggcgaaccccgcactctaagatcagacagcctcccatcatcggatgtaagtcagaataaatattataaaggcggtgaacgcttttagtatgaagacgggcgaaaaatttgcgaagatgtgtcggaagaggttactgggagacctgtatattcgcaaactgcggggtcagagtaataagtacgatatgacggggtggttgaaatgcctaaaaagattgcttggggagccgatacgaaatattagcaagccgcatgcgaggacttgttttgccgacaggaacaaatcacaagtaatatggatcaggctagtcaatcgagggcaattgaacacgtttagaggtacgactacgaataacagtgtgaattaacagtacgcaacaggcgatggagggtatgatcagtgcttgcgaaacagtaaatggacgagctcagcacaactgcactcagcaggcacggtctgagatcccggcagtgggaatatcagtgtttaatggatcctctgcgaatatgcctccactatgccaataggtattcgcatctctatctgcgtggtacttgttaagaggaagaaccaagtgaaagagattcaggcttgaacagtatctcaaaatggtttattgagtaagcagtaaatcttatagggagactggacttctatcccgtgcagctaatgccaaaagccttgtgctaatcagtaagcacttggtctgtgaacacagcaaatagatgtctgccggcgtttcgtcaggaccttgagcttgcatatgcatgcaatgaccttgtcataaaggaaaacaataagcaccgatgcgaccaagggtgctgattgtgcaccaaaatacgaaagagaaacaaagtaag

SEQ ID NO: 8853 - DNA, 384 bp, Homo sapiens
tgtgtgcccgctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagacgcggcctttcttcctttggtaggaatggcctgagttggcgttgtgggcaggctactggtttgtatgatgtattagtagagcaacccattaatcttttgtagtttgtattaaacttgaactgagaccttgaaaaaaaaaaaaa

SEQ ID NO: 8854 - DNA, 100 bp, Homo sapiens
caccaatttcagaggatgatgtcattggacaacgactccataatacatgccagttatagtagcatccccacagatccaagcttaactgttctcaaactgc

SEQ ID NO: 8855 - DNA, 807 bp, Homo sapiens
gttttctgtaacaacgcctaaaagctacctgatcacacatgcgggatccaaaccacggggcgtatccagtgatttttctaggcatataagcctaccctgactaaatggaagccgcacgctgggcttttatcacaacgcttacttagcttaagcattaaaggctctattattaaaccgcttacacagcttgaggatgttttaggacgcttggcatatcacctactttcgcgaggaataatatatagttagcgctccacactgaaattgtttaaacaacatgcctgaaccatttctaatgaatactaggccttaaaggaaaagatcatacattcttggcgactacatatctgcaggcacactccaaaatctattgccaacgatgcgagggaaaggtccaaatctgacaagagatactgagaccagcccacgcgtttgaccactttaagctatgccttaccagacaaaacagcatgcatttttccattagaggtcatctcataagacttatttactaaccgaaacgggaaggtgagaccctctcttatcctataatacccacacgaaccggacattggtggtggtctcctggaaataaaacttcctcggaggcccagggaggaaaatattttgcacccgggggtcaagggagcattggcccaagattcaccatatcctcacctctggccacaaacagtagtatttcaagaaaaaaaaaatcccagttcattgggtttttgagcaaacaacttaacctccctttccttaggaaaaaatctccagtaactttttggatacgcaagccgttgc

SEQ ID NO: 8856 - DNA, 365 bp, Homo sapiens
  misc_feature (1)...(365): n = A,T,C or G
gattgcggaacgactctcttatnatccaccgctacacagaaaagaagatgaccatcttctcctgaacaaaattatgaactgtcagaggtttcaaaggtaataagttttatgatgcaagtggaagaagaaccagaagtaatgatgagctagaacttatcagagatttccttgaaatcaggacttggtgtttataagatgggtctgtcccaggcttatgcatgacagctggtgatttgttagttgcatgcagaggacattgctcattttgggcctatctacactcaaaaccaggaaaatatgctgtgaaaatttgctattactaacgtctctaataaagttttaaaaaacgaanaaaaaaaaaaaaa

SEQ ID NO: 8857 - DNA, 425 bp, Homo sapiens
aatataaaggttaaaatatagaagaaagagaaaggctagctgaagatctttatgtacaccgctacacagtgagactccgtctcaaaaaaaagtagaaagcacatcttcattagaaattgcttattttgtgattccagttaagtgaattgaagtagagtgagtatgtaaaaactaaatatatgaaaaaagtatgttacctaaaacaaaatagttaaacaatttcatcttaatttcaaaagtaatgcttttatgtattattcacatttatgcaatcttgtattagatcacaaatgtagttctaaagtgtgtgtagtatttgagctaagcttttatattacctgataaattagaatattactacgtcttaaaaggcaagaaaaaaatggttagtttattatatgaatgaaaagagaaataaataagga

SEQ ID NO: 8858 - DNA, 730 bp, Homo sapiens
  misc_feature (1)...(730): n = A,T,C or G
cggaacaaatgaaagaaagaaagcatgaaaaagaggaaagaaagaggggggtgttccaagatggtcgaataggaacagctctggtctgcagctcccagtgtgatcgacgcagaagacgggtgatttctgcatttcaaactgaggtacctggttcacatcattgggattggctggacagtgggtccctcaccagggaagctcaaggagttgggggatttccctttcctagccaagggaagccgtgacagactacctggaaaaacgggacactcccatccaaatactgcacttttcccaaggtcttagcaactggcagacaagaagattctctcccatgcatggctcagtgggtcccatgcccacggagccttgctcattgctagcgcagcaatctgagatcgaactgcgaggcagcagcctggctgggggaggggaatccaccattgctgaggcttggtaaacaaagaagctgggaagctcgaactgggtggagcccactgcagctnaacaaagggctactgcctctagactccacctctgtgggcagggtatacctgaccaaaaggaacagacaacttttggcgacttaaacgttcctgtcttgaagttctgaaagaagccgtgggtcttccggcatgtgggttgaactctgtaacaagcagactgcccccgtaggcgcgtccctgaccccgttggacctaactggtaaccgcccccgtatggggccact

SEQ ID NO: 8859 - DNA, 230 bp, Homo sapiens
cagaggatgggatttcaccctgtcgctcgggctggtttcaaactgggggacttcagtaatccacctgcctcggcctcccaaaatactgaaattgcaggcatgagccaccgcacatggcctgagagttgttaaagtgatgctatcagaatcctgaggccaaaatcacctgagatcatgccaccgcactccagcctgagcgacagagcaagaatatgtcaaaaaaaaaaaaa

SEQ ID NO: 8860 - DNA, 1070 bp, Homo sapiens
  misc_feature (1)...(1070): n = A,T,C or G
atagcggatggtattagtgcggataggggagaggatatttgtatgggtcgtgtgagggtgaagtgatagtaatgtgtattgatntgcatatggtaatgaggtggtgaatgggtttagttttgtctattccgcgggtgagtgtttattggcgttagtgtggagttgtgtgtagtgagagggggttgttgtaagagagggtttattggtgtgataagatgtgttatatggtggtatataggagttagctgtggttgtgtagtgtggggatggtgggtgatgtcgtagggggttgtgagggggataatgttattgtgacgattgacnttatttggctgtgtgaatatgaatattagaatggggtggggtattatggggttattattcaattatgtgtatgattgttgaggtttgacggaatatcggtaatatgttgttaatagtagggtggatgagaggagtggataataatggggtgtagagtggatgaggagggttattgtgggtctgtggagactggggaatataatnttgggaggtatggttgggacattgtacacttggtaacttgaggtgatggtgtggtaatgtagagggagagaaggataggaattgaggtgataattgtgtgtaataagtagaagtttgaatctcaattagtgaggggtataggaggtttaaagatatatgaggaatgtatttttttttggaaatatgggagagggagggaaggctccctccctgtaatttttagattgggaggaggatgtttgaatggagaggaatattgttttatatagtaagaaatgttggtagatgatagtgtttaaagggggtttattttatttagagagagaaaaaagatggtaaacagggtagggagcgtgataaaaagagttttatattgtgtttaagcgccccctgccccgagaggagggaaaaaatagggaacggtttttaagaaggggggagggattctttttgttgagtaatatagaaaaggtagaggggggagggtgagtgtttgggtgggtgggtgtgtgcttgttcgtggggtgtttagcgtagatgca

SEQ ID NO: 8861 - DNA, 795 bp, Homo sapiens
  misc_feature (1)...(795): n = A,T,C or G
tttagagtttggtgtggtatgtgttagtgtggggggggttagttgttggtgttagggagggtgtggtttaggggttaggggatagaaagaggtgagcgttgtttttttttttaaaagaatgttttgagagaggttgtttttggttggagttaagaagatggaattggtgttataaggggttaggggtggtggggaagtttttttttgagagggggaaggatttatgttgaaaaaggagagggaagaaattggggggagattgtaagtaagagtttatttttttagggtttaaaaggttttgtggttttggtttgagggggagattttggggggaagaggtttttgtaaaattaagggattgaagggtttggtttgggggttttagggatttttaagggtttttttggggaagaattttttttttaaggttaatttagtggggtgtgggaaagataaaagttttttaaaggtttttgaaatgagggaggtaaatttttttttaattgtttaggtgagggttttcatcagttttttttcattttagggtggtgnatagaggggtttagtattttttttttatttnaatttgaggagaagtgcccccccattttatttatgagtagaagaggttttaaaaggtgtgaatattaagaggtaaagttttgagggggtttttttaaggggggtttttacttagggaatgaaatgtagttaggagttgattaatatttgtgaaaaaattttatttaggacccccttactccaaaatttgtgaataaagaaaggatatttttt

SEQ ID NO: 8862 - DNA, 794 bp, Homo sapiens
ctaattttcagagaaagaggtagagctagtgtcgatgttacttaataattttatgccattaagtgtatctggaaagaaattgttttattttcaaaaggcaaattctttcaacaggaacattgaaggcatattttaagaaaattttactgtcattcagtcaaatctatatggtgatcatggatctgctaaaggtcagtttttaagtttggttaagattatggggccagttgcaggcactctgggctagaacccaactccaccctttcctaactatgtgaactttagtaagctacttaacctgtcttcattttaattttcccattgtcaaaattggaataatgaaagtattctgcattatcagggtatggtggaacaataaataaaacaattcataaaagcacttataatatctggcacacaggaaagattccataaatataaggtatttgtaaaaaaataattgcataatcaaatataaacgacaaacaataaaaaatatttaactagcccccaggcgggcgggtccctttatgaagggtaattaaagatccttgtttactgatccatatggctcagtcattttgtttgcgcacaacggatcaccctcattaaagggcggtaatcgggtttcccagaacacaggatatcccctgaataaaacatgggaacaaattgcacattaaggctcgaatccattaaaggtgcccggtgtgagtatttcaaatgatccacccctcttagatacattaaaaatatcactttaagttaagggtgtgaatccatgtatactttag

SEQ ID NO: 8863 - DNA, 818 bp, Homo sapiens
  misc_feature (1)...(818): n = A,T,C or G
atcagagaagcctgttatggtaccgtggcaggagaacaggagatctcaggagaaatccaataattaaaccactttgcctggcaagtaacccgttggaagatggttgacctctttcagttggtgactgcattactcatttaaacaattatacaggagaaaaaagctggaacacaatcatttttattgaacaaagtttgcagttcattaaaggctttctggctcccatgtgcaagtgctgaccattacatcacgcgccctgagggttgtactagaaaagagaaaagaaggcgaaatcagcaaaaatatatgcgtcttcctgacttggaaaaaaggtacgataacgtgaaaaactcttgtaatccatgaaagactcacaagcattcttgtcgttataaatttccactaacttttatttataatttaggaattgctccccaaggggcagttctcccctttttgtgggttgttatctagtataactaatcaattttcnatttttcaatactgaatgtccttagagacagtggatataacaactacgttggagtaatcaagtttgaattattaataatatgtaaaatacatatatataaatttggcagaagtccatatatatgcctatatgcataaaagggacacgtattgggtgtttacagagagcgcccccttctatcacttacaatacaattgtgttttaatcaacgtgggacctctccggtaatgtgttatatttctcggttactctccatttatttatagaggcctatgaatggtcccattgtctttaagctcaatgtgagtgatatagagtggagagt

SEQ ID NO: 8864 - DNA, 794 bp, Homo sapiens
ccatatcctgttctgttgttggatttcattcttatactggttgcctcattataagggacaatttggacacagagacagaacacatagaggcaacacgatgtgaagaggcacagggagaaaattgccatctacaagtctgcaccatatccttccctcacagccttcagaaggaaacaagtctgtggacaccttgatgctggacttagaggcctccagaactgtgagacagtaaaattatactcttcaagccaattcaagccaatctctctgatgatttctgctcaggtctctttgtccggaataagtttgtataatcgccccaagatgctaataaaggtgtggtggtgatgggagacaagaaaagatagcccattcttatttttgccttttaaaatttcagtactgggacatttcttccttgaaaaaataaacttttttgttgacccatacaaaatggaatgatagcagtgcccaccgtaacagagacttcatttatttcaccacttgtacacattttcacttcatgtagacatctgattgttctatgagagattctatgattgttctatgagacccagctatatttatgaagatgaatattatttaaacagatagataagattaaaagagaagatagactgggaaaaggatacatttagtatagatttcggggagtttgaagcaggcactatgatatattctagatgtttatttacttttatactttttctttccaccattctcccacttcatctacaggttttagaaactaactattactaatagttgccact

SEQ ID NO: 8865 - DNA, 755 bp, Homo sapiens
  misc_feature (1)...(755): n = A,T,C or G
atgagtttgtgatggggattgggaattattagttggggatttgtggaaaggtattttgagagggagtttttgttattgttttaggtggttttaaatatatatggggaggtgtttgtgttttttgtggtagggagggttgtgggtttgggggggttgttttttgaatagagtgttaaaatttttttatgtttttatttggagtaaggtgaggagggggggttttagtttttttgtttttttaaaaaaaggttttttttttggacagaagataggaaagggttttgttgtgaaatgatttttgtttttgtgggttgttgcggggaaaaagggaaaaaaggtatttttatttttttttttggggggtgtaagaaaaaatttggaaaagagagttttttatttttttgataaagtttttttgtttttttttggaaactttttaatgggtttgaaangtggggtttttgaaaattttggggggaggtgtttttttgtttggagttttttttaaaaaaaggtttttttggggaatttttgttgggaaggggggttttttttggggtttttttttgggnaaaaaaaaaattggggggcccccttgtttttttgttggtttagaaaagaaagaaaaaaaggggggctttgggggattaggtggtttgggggttttttttgggggggggggggttcaagaattgttaaaaaaaaatttttttttttttttttttttaaaatttttatttacaacccaaacacat

SEQ ID NO: 8866 - DNA, 1048 bp, Homo sapiens
  misc_feature (1)...(1048): n = A,T,C or G
cggcggagttggagctaagtggtctgtccgtgagcgtgaactttggcgtggacagtgcgaagtacacgcttgtacacatacgacacgtaacggacgggtgaaggaagcggcgacgggataaggtgtatattttcgttggtgcgaagactaattgcggcttgccgatggagcttgtttattcagaatataatcgtggcgttctgcgggaggacggggantcattggttggtggtgggcgcgactatcgagtgtcgtgggatggtgtgactaatgaacattcaccaacgcgtcatcatcgaggtgacgtgtgatatcgtcttgataattgggattagaactctgatttatttctgtcgttttagttttaggcggtgnatccgaatgtgtactgttctctctgtatggcgttccagcccgctatatagttgtgagaagatttgatagagtgcgcccagtgcgagtggctccctcatttctccgtgtagtttaatcgataaggggttgcggcggctaacgttcctggatacatcagtactgtttgtgatccacaccactgttttatctccactaacgtgctctgtatgtaatcaatgttgtcgcacaaggagcggtattctctccatccgagttcgtctcttgcgtcattccacagatatgtggttgtggcgctgctgttgttcttttgttgtctctttacgtccgcgagaggacggactcgacgtgtcccctccacggatgctttgtggcccgttactagacccaagtatgtgtttacggatggtgcgccccccgcgtccacgttgagaaaacaaataatctcgctgtgtcctttcgtctgggccaacaagagccagacggcaagaagagaaagaaaacaaggagaggaaacaggagggaagatagcaaaaagaaacaaaataaaataaaagaaaaaagaaacaataaaataataaagaaagaatgtagcnagntggcgtgccgaagctttggngtgtttnttgtatcttgtatcttaaatagaacatgtattataggtatatatccttgt

SEQ ID NO: 8867 - DNA, 601 bp, Homo sapiens
gcaaagaacagaaaaaaatatctgaagaaaagaacaaaagatctaacctttattattcatggggcaaacaggattgcacagattggctttcgtgataaaaagaggaggaaaaatggcgccccccagattattattatactgaaatgggctttcacactttatgaagatccttgcgtacaagattaagcagcccatctaacagagaagtatggttcgtccacgacgtcacagcaccgctgaccctacatcaaaatatacgctcgacggcgccgcgttacttttaagggagggcgacaacactgatcctcccttcttgtctatgttagctttccgccgtacagtcgcgctgagcggaatacgccccgccccgcagccgcatcacgctctctcacgacctcggggtcagatcgcacccatcgtcagcccagaggtcgtctgcggccccgagaaccgagaagatcgcactactgtcgttccccactcgtccaaccggttgagtattaacaaacgactgagccgataacacgggggtcgccccttggcgttaggacgtcacccgttcgcctggagataactagccatcgctcacatgcccgacgtt

SEQ ID NO: 8868 - DNA, 450 bp, Homo sapiens
  misc_feature (1)...(450): n = A,T,C or G
cagaactacttttgcaaccatggagaagttccatcccacgtctgggcctcaacttccacctgcagagtggggcccttacctctgcctgagcgaagttcaccagggccttccctgcactgtcctgctgggcgtggaacagccttgtgcaggagtttggggagccaagccatggccttcacttgctgggtgaaggtgggaaacttaacagcttgcgccctgatgcctgcccttaagggcttgtaagtgattctgtcagatgttctggtccttagccacagaagaaggaacagcagagccacccgtggccgctcagaagtctgcctaccatacttgcaaacatccaataaaaaaacttcccacctgtgttctatttcagcacannnnanaaanaaaaaagaanaagaaaatgataagaaaaaaataaataaaaanaatagganggtttggggg

SEQ ID NO: 8869 - DNA, 607 bp, Homo sapiens
tggccttgaaaaatgacaccccacattcctggagcggtactggagccaccagagtgagcgagaatgaagctgtttttaaagcctcattcccaaagatttgtcctttcgggactgtgctcgtagacctgtctggtaatactcatggaagactccacatgcaaggatcgactggattcgacctgacttggagatttactgggttctggtatttacagaaatctctggtctatgcttacatcacagccaaactaaccaagtagagacttcatgtgccacaaggaacaaagagtacagactgttgagaagtaattccaaagaatttttacataaaccaagacgcggcccgttgccttggatgagggttaattcatgatccacgctgacttactccttagcgctcgtacgataagttgggcaagcggggatagatcactacaagggaggtatacagtaaatgaccgaattactgggtttacccaggaaagacttgtggacctaagggcgcataacgcccggaaccggtataaggcgcgtcagctagcattattaataaggtccgacgcactaagacatgtcaatacttatgttgagtcattaggccaatctc

SEQ ID NO: 8870 - DNA, 862 bp, Homo sapiens
  misc_feature (1)...(862): n = A,T,C or G
tgacctgtctgaacaagaatctataactgacatattaacaacgcgcggagcgatcgtgcctagacatcttatagagacacactgagaccccacactttcaactattccataatagatctcgctctacatcctgctccactctctatacgagactagcagcacctgctggaccctgctagtggacaccattgcctcacagctcatgaccaacagaccaaagcgtgagcggatggccagacagtggaccaagcggtacgccacataggggcctgctgcctgccgccccgggggacctgtgcaagcacattcaccaagtgcatcagcagccctgcccacccctccagacctaggctcttattttcctattgttattaaacgcggaaccattttgggatggtatgttgtccatcttaccatcccaggtctttctgccccccttactgtatggcacgctctctttaatctctcattgtactcacttgctgatttctgttgaccttgaaagagttggggattatttcccacctcatcatagatgggaacttttgttttcagggcaaacaatggcggagctgaaacaggcagagctctcttacaaagctatagcttactgcggggggattggttatcttgctgccgtttatgcgaattctgattaatgtttctttctatggatcttggggaaaacacgttcanaattatctcctcccacctgcttaaatgacgtggttagggttaatgttgttgactggacgcctttatgcgaggggggcagcctactggaaaaaggcttttggacaaagcttcgaacaagaaacctggctgtttcctgagactctggttataactaactcttgaccgt

SEQ ID NO: 8871 - DNA, 818 bp, Homo sapiens
  misc_feature (1)...(818): n = A,T,C or G
aaaagagatcatgggaaggcatatcagggacggagcccacgctgagggcgcattctgctgggctttcctacagtgacctcaccatcaccaccaccaccgacaacgacatcacagccccgacctcaccatcaccaccaccaatgacaacactacagccctgacctcaccatcaccaccaccaacaacaacgacatcacagccccgaggggaccatcaccaccaccaatgacaacactacagccctgacctcaccatcaccaccaccaacaacaacgacatcacagccccgacctcaccatcaccaccaccaatgacaacgacatcacagccccgacctcaccatcaccaccaccaatgacaacgacatcacagccccgacctcaccatcaccaccaccaatgacaacgacatcacagccccgacctcaccatcaccaccaccaatgaccacgacatcacagccccgacctcaccatcaccaccaccaatgacaacgacatcacagccccgacctcaccatcaccaccaacaatgacaacgacatcacaaccccgaccttacaatcaccaccaccaatgacaacgacattacaagccccgacttaccataaccaccacaatgacgacgtcacaggcctgaccttccctcaccccaacaaggaaaacgactttccaggtccaacctcccttaacaccgacaatgagggtggttaaggcccgacctcccttaccacgcacaataaaatgactttaagggccggcctcaccgtgccaggcacataacctcgggcggccgcttncctttgaggaggtgaataag

SEQ ID NO: 8872 - DNA, 522 bp, Homo sapiens
  misc_feature (1)...(522): n = A,T,C or G
aaaacctgacgattagaacaaaccacatcctcaaatctgaanaggcagatggggtgggacagaaacancttaaatctacttacactggaacataacccactgtagacacatactggtcctgcataccaatgaaactacttatgccggatagtctgatggaccccacaggagctgactcactaaaaaatgcagtttccatatactgggggggtcatctaccctactctgacaagtcaacaaccccaattctccagcccctcaccctccatgatccccttaaaaccccaggccagaactctttggagagatgggcttatcggctcctctcatcactttgctctgacccctattaccattaaactctttctctgttgcgaatcaaagcgacctaaagaataagaatctcacctttgtaaaataaagttgaacgggtgctgggcggtcccctttactgagggtcaatccataaccctcggtcactgactcggtggcccccaaccttgggttcttgcaacgagacac

SEQ ID NO: 8873 - DNA, 408 bp, Homo sapiens
  misc_feature (1)...(408): n = A,T,C or G
tgtggtatggttgagatcgtattggaggggagnnagggggaagctagtctgcgacgactctcttatctaccaccgctacagactgctgtctcatgcctgtgtactagtactatcatttgatttcgggggttctgatgtccaaattggagtaatgacaccttgagaatccctcactctccggattccttacatatgcaacagattgctcgctcacctctgttggtctagcacgaaaaagactaaactattgccttatgctgactaaacccgtgattccacttacctctgtgaacgggggggcaaaccaacatcatggaggtccgtgaattgaagtaggagcctctaccactcctcctaccacagaactggtcaggactctatatatataaaaacaggtgcagcctgctg

SEQ ID NO: 8874 - DNA, 467 bp, Homo sapiens
  misc_feature (1)...(467): n = A,T,C or G
cgcacgggggnggggggggggtatggcatttattacactctgcctatcctggaaatcacaagggggggcaaatatatccaaccctcgtcaatataatccacacaagccacaaaggtcatttcgtctcgtatatttcaagggggggcttccgatattacaacttctttactggggccctcggtgtgtcttcatcgtcaaaaggatctgacccgtgcaaaacgtatctcggctcacgtaaaaaaggccaattatagggtggcctgaatttatgcacctccaaactttgacggagctacaagattaaaagtgacggacatgtttgccgggaaagggtatccgccggcaaattaaggcaagtaaaggttgggaacttagggttcgggggagcgacgacccgggccaggagaaatttataacggatggagaaaacgggaatccgaagggaggggcgaaacggacccctagtt

SEQ ID NO: 8875 - DNA, 815 bp, Homo sapiens
  misc_feature (1)...(815): n = A,T,C or G
tttataacccctcttgctatcctgttaatctcatcnnaggggcgtggggcataataaacccaaccccctaccggtcaatatacataacaccaccgaagcgcaccaaatgtcctcacttaccgctcatcatctataattttccnggaactggggggggatttttcttgaccangctaaatcaatntncaatctcanctcactacaacctcgacctcctgggttcaaaggaatcccctgcctcagcctccctagtagcgtgggactacaaggcacacacccaccacacgctgggtaaatttttttagatttttataagaaaagacggggggtcaaccatngtggcccaagaatagggctaaaatcttcttaaaccttaatgaacctgcccacacccaacccttcccaaagggttctgggaatatacaaagcgcctgaaccccaccttcgaaccctgggcgttgtctaggtttttttagaagagggaggggtgtnaagaactgtatttattaaaccttaagttaaaagggaaaattttctttgggccccccaaaatcccttagcttaaagggaaattaagtgggacttgtaagaaaaaaccttgtttctatttatgaaaagtaatcccccttgttatgtgggggaaatgcatattccttggtggcgcccttgtgagagcgtatttaaaggccaaaaaagggcgcgctttgtggctttaaccgatttggggccggagagaacctggcctgttaaaagtggttcccacttttttaagaagaaccgggagctgtatatgtggtggtgagaggggctagagg

SEQ ID NO: 8876 - DNA, 566 bp, Homo sapiens
  misc_feature (1)...(566): n = A,T,C or G
aggttgtgactaacaatactannttaaacacttttaaatacaactccgtaataaagctactttccaaaccactcaaacttagttattgattttgacctataattttttattttatcctaggggggaatctatcaatcaaaaaatattacctatcttctnnatacctttaaaacancaaacaaaacatttcaggattaaactactcttctatgatcattgtcctcttgaactaacattttttactaaataactcatatatcctgatcctctttaggattatccaaatactttaatcagaatttaaaaatattacccttcctttttctcagacttttcaaacaccagggccgaacaactaactttatttacaataatcataaaaagattcccttttactcctccgataattttaccttaaaggccgaaaaaacctcgatttaccaccttgtatctttcaacctgtcccaaaaaaacccctgcaagaaacagtctcttccgttaaccctctaatcgtgaaaattataaaccattataagattcccgagctattaaagaaggattgttca

SEQ ID NO: 8877 - DNA, 268 bp, Homo sapiens
  misc_feature (1)...(268): n = A,T,C or G
cccagatagcagcaatgaagaaatgatgctanatgggaacaaaggnagggggggttacaaaanannnaaanactaancccctcataccananatntnttttatttatanntnaaaaaaatatanaatattctccacccaatnccttccttaaaaangataaaacaantctccttatttcctttncaaantncttcntacaggggggggcaanttnttatgggattccttctaataagatctgtgatgggtggctgggtgccccgggca

SEQ ID NO: 8878 - DNA, 359 bp, Homo sapiens
tgggagtgtgggaatacctcaaccaggttatttttggaaattgggtgatgcggcgaacccaatggtggtttggccctgggtgaattgcgggaattatacccgggccacatataggaaactttaaaaagtggttgtgattggagagaccggttcttgaggcaagaatttttcagggtatttaaccttgttaagagaaagtgtgaggagtgccccgcgcggagcagagctgatgtggggaatgtttagtttgtgcagacgttgggtgggacgagaagggtgatgtgagatgtcgatagagaggattaaagtgggtccacgtgagtgccgtaggtgtctttatgttgggaagttggtgagag

SEQ ID NO: 8879 - DNA, 425 bp, Homo sapiens
  misc_feature (1)...(425): n = A,T,C or G
ttttatcaaaaataacttttacctcagttgttatcactaatctatattgactacccttcataatatctctcactataataccatgccacaagatactttcactaatacctcaaaaattcattacctcaagattataattatattattgtaccacaactacactatctattaatccgtctacaaacacacaaatattctaacttcaatactaaataatccctaatttaatactatcaacaaaagactagatagaaaaaccttaaaccaatcaaaaattatacacccgctcatccaatcttaatcacaaactatatacaatgtagtaaacataataaaataaataataatttatggagatgtgattatttattttcatcctgctcataagttgagtattgatatatataccatatccatanaatatg

SEQ ID NO: 8880 - DNA, 415 bp, Homo sapiens
  misc_feature (1)...(415): n = A,T,C or G
ataattatattttgtttttttttatgaaacaattaactcacaacttttatttaccccctcaaattactgcaaactatacagccaatattatccggtaggatctaaaaactacntncaacaaataaaactntaaattcttggacctcccattcccttaattcctcccaagtagaacaactgtaattttcaacataaataccatcaataaccacacaaccacctttaactccttccttccacccggtggggaccanatttcccactatcaaaaaaaaataaacccactttctcctttttatccccagaacaacttaaatatgttaaacgccaccattctttccctccaattcaaaaaatccgattgatctactatcaaaattcctataaaaattttaaatatttaaaaaaaaaaaaa

SEQ ID NO: 8881 - DNA, 738 bp, Homo sapiens
cttaagacgaaacctgaaccccaggacttatcccaccttcatcacaaaacccttttcccactatccatcaatcaaaaccatcacactcaacatactactcaaaaagactctacctacacattcataaactctgggaaggacagacccacactttaatcactcaataattaccaaaatacaccatattttccaagaccaccttattctacatcatcaaacacttctaactcgctccatcccttccttgcccattacacctatacccacagattaacattttataaataataatacaccttaacccgacctccttccttatacccatgctaattcttaatcctcgctcactgactacatactctcgatcattatcatttttacaaccatatcctttcactcctaatcggacatacaaccatccccttaaatcccaactaccccaggaaccatacatattaccataactcccactacataccctacaaccctaaaaaccccgctattttctcttctttccctatactcccccccccttacagctttacaaacttaaaccctacttaattatttgcgacactccaccctactatcatataccagatttttccccttacaactacctaaggcgctctattgaacctacctcaccacttacctatctcttacctctctttccctaatgaatactataccttttacactaaatacacttaagcacaaaattctggtatataccat

SEQ ID NO: 8882 - DNA, 805 bp, Homo sapiens
  misc_feature (1)...(805): n = A,T,C or G
actccctagggggtagggtggcataaacaaactanacccatncatttnctgtcnanctcaaacacatagagctccctgtgctggggatttggcaccaaagggaaagtctggttgtatgcaagcacttgaggtaaatgatcctgtgggggcaanggctggggtgggcatgttggggggggggganattcctagggtggtgaaactcaaaaaaaagcctttcggggatagggatgggaattgatggggacagtcagggaggcgggagcaaagccttaagagaaggggagtggagaatctggctcactcttttgggttcccaccttgtgcaaggttcttaagcttctgctggggggggggagggggaggccttgtaaagggaccaggcttgcacaggcgcctgggctggtgaagggaggtgagagggggtgtcgggggccacaccaataggggggggcccagagggggagaaccgcgcggggtggaagggggggggagggaaaacggggcaagttgcaataagggggagaggatggtgggtggaaccggggggaagaggaaggattagataggggttgtggggagaatgcgggatgggggagcgggtgggaggtgtgcaccgtgaaagagaatgatgatggggggagaagaggatggacgcgcgggtggggtggggntatggagtacgattgaggtggctgagagggcgtagaacgagagtaggagggggcagggtgagcgagaatgcagaccatagtccccagtggggagggagaggagtggagaggaggcgcgggggtatgtgctt

SEQ ID NO: 8883 - DNA, 832 bp, Homo sapiens
  misc_feature (1)...(832): n = A,T,C or G
cgggaaaatcttgcccgcaggtattgatgacatacttccatnnaaggtcaggggccacaaaatcttccactcanttcanctcaacctnaaagcctaaaaatccccccatanacaaccaactccttcttntaagccataaaancatttngaaaaacagcttgactaactctttcactgcacctttaaaggcatccctccccttctgagggggggcacacattaaacattttggacatataaatcaccctaaaaaacctctcaaaagttccaaaatctttttggatgggcactgtgtaaactaaaccaaacccacccttttatttaaaaaatttttctgctacataatagctttaaaccttagccccatacaacgtatcttcattaaaggaattccttaaattccattttctctttggttaaaaacttgtccctaaaaaatctcattacaaggttcccaaacaaataaacatttgaaccaactcaccctaaaaaacttaaatactcccaaaacctagttttcaaaacaaaaacaataatcaatgcctaagaaaataacacccgctaaacataacatggcttcctaataaccattatattccaacctaaaaaaagacttaatattatttctttccttaaaacaagaataccattctcaatatcatattacactaacattaactgcaacataaccaaacgaatcctcataaatacgaaacatatataactcatcaatacacctatacatataagatcataatctcacgccctttctatattctattaccctttcaaacacaacacacctgcaattcacccatatttaaacacatat

SEQ ID NO: 8884 - DNA, 798 bp, Homo sapiens
  misc_feature (1)...(798): n = A,T,C or G
ctactctcactctcaaaaggtttccctcttattacctaatnaggctgtcccggctggctacacccataaactcctactgtctaaacaccactgccaaatctgcactttatttgcgaaaactcactctgtccccatgcccgtgcacaaatctgtctccatcctcttatccgtctgcactcaatcactaaacattctactatatgcgtggggggataacaactgtgtaaaacatattaatatcctcattattcacaataagatattctaagtctccacgaataaaaactaattgaagacaaactgaaatattttaactaatgcttttcagactctctataccatactattaaaaccactataccaccctgcctatgggtcactttgtaaacatcatttaaccattaccatattcattaataaaattccttttcctctccttaagattacaagccatttatttgcttctacaaaacccggcaaaaactcaaaatacaactcccttcaccagcaaagctccttgccttcttcttttttgcctcccgccaactttctcataaaagtgaccttatctacaaaaacctcccccccccttctcctgaactcgttaaaacccctctcataatacacccccacaaactttttaaccttccacccactagctcatacccctttgcacaaaaaaacactcatacctctcgacactctccacatcctccgcagtccccgcctctacaccccacacagatccacccccccccgaatcccacaaaactctttttataccatcccctgaccccg

SEQ ID NO: 8885 - DNA, 842 bp, Homo sapiens
  misc_feature (1)...(842): n = A,T,C or G
tctcttaatttccaccgctacagttgaaacctgaaggcatactactctctggagttnanaacataggggggggggtgggagaanaaaatnanncctcanntgtgcatgggaggaagggcattggttagcaccttgggaagacatgcagctgatggatgaggaggatgctggatggctatgctgagttggctttagactctgctcaccagctttggaaatgggtaccgggggggggggcaatatcctgggaacccctccatgaccaaattcttcagcaaagcatttcaacagggcagcaccggggcatggggactgatggggtncacaggtggtattatgggcttacagggaagatgaggagtaattaagggactgggatcaataacagtgttatattggaaggggatgatgtaattttctaagtgagagagggggcacagatttttcacatcatggagagtggtggggatgagcataggggggtcgaagaagctactgcatgtgttggtgggtatagaaggtgaaagttttgagcttgtgtttacctttttggaaaggggagccgtggctaggggaggcgtggagggggtaaggggagggtggggtaagggcggccggaagagctgtgcctgttgcgaggggattggagggggctggccagaggggcccgtgggaggtgggggggggcgcgcgcgtggggggaggcggtgggggagcgggaggtggcgggggggggggggacggtggagtagtgcggatgggtgggtgggggccggggggcgggctaggggcggcgggggggggcgtggggctagggggtagagcggcggcgttgcgagcgg

SEQ ID NO: 8886 - DNA, 899 bp, Homo sapiens
  misc_feature (1)...(899): n = A,T,C or G
ccctcctccgcccctgggtttatgggggggggggaataacctcatgctctttattaccaccctcaaattaaaaccaaactattccatctttcctaaaccanatagggcctgtgggactaataaaataannatgccctgcggttgttttcaaaactgaaacaacactccacaatgtatctttacataaaaatacacttgtataataagtttttttttttaaagaaattgcatgtatctgccttataaactttttcattcatggggggttctttcttcctaatctgttccataaaaaaaatttctaacttattgttaatcaaaatnattattgaaataattagtactttcatatgataaacattattttaatttccgactccaaatatgtacctctttatttttaaaccatcaccattttctattaacatttttgcattttatctacctactaatcccaaattaccttttttttttaaaattcctttttcaggcaaacccatagtattggatttacctttcctaaaaatttccagttcaattttccttaaatttaaccacgtcatttaacccctttcttttttaaaaattaactttggtttatattttattcccaaccaaaaacctattcttttgtttttccaaaatcttaaaacttttatacctttcttaagttgaacctctctttaaaattatctctaaataaaaaacttcttaaaactcgctctttttaccaggtacaacagacatgcgccttgtaaacctattctctaaccattactttttcttgtaataaacctctcttttaatattttcttttataaatatgtaacacctattttacccaaaatcagctctcaattcatatagctaagagaacacgtcctttagatttctatact

SEQ ID NO: 8887 - DNA, 777 bp, Homo sapiens
  misc_feature (1)...(777): n = A,T,C or G
cttttttaactccccgccgcattcatattacaataccacaacaacgcatttggcggaccattaaaaccattataatcacacaatctttcttcaaaattttaaaccctttctaaataacacaccactccaccaagatctacaccaattaaaccttcaccaaactcacactcacttcttctaatcaatacctccacgattggcaggggggcanatatacanatctcaattaacacatcattcttacaaatcttcaactattcaangaatactactacacatcttttcatgattcttttcaaattctgtcattcctatatctccaaaccctcttacctcgaacggtatgctaaactccaaccctctccactatgcctccgatcatacaaaaattaatgcccttctaacccaacttttaaaacaactggaaaacacagcccctccctcaacttacatgcaatacatcacatctctttcctcagacatcgtaactctcaaacaattttttataaaattaaaatttccagcatccaaataaaattccccngttaaaaaaaagaaccaaaactaccctcaattaatacttttaaaacacttttattcgacaacattttaactcctaaaacctttctatattagcaaaaacataaatcccacgacctaccccctaaaccaacaacttatccccaaaataaaatcctaatattgactacaaaatcaacctaatacatttttaccaaaaaccacccaacccctcatatttacacttgcactcatttc

SEQ ID NO: 8888 - DNA, 1169 bp, Homo sapiens
  misc_feature (1)...(1169): n = A,T,C or G
ctcacccttatatacttcacatataatatatacagaagagngggggagagatatttaaactgcgcaacanactgctgctataatattacancacccgcttacacctatncccctggactttcccccgntgccgttgtaaaaattaatcttaccnntatacccnnnnnanngngcgtggacacagtggtggggcgccacatataaaataacnaatnatataacccctccnnaatacactcatcntcttccaccccgtgcttgccaangattataattcacgcnaatttaacacccatcccatgcccctgtaaattgcctcctatcctcccataaatctatattctcttccaactttatcatcccccccttccttcccangtattatctaattctttttcaccctnctaacccttggagggaggtgccaatattaactacctcannaatcaattaaacaaaaatactccnccattatcttttaaaaancctctttaatctaatatatcttttatacccttataataactatatttactattactcattattttatccaatatttctctatctctcaaacaatataatcatttttctcttaccatcctttatttttccacatcatattcancaccataactcatcttctcttactatctattctatattaccattattcatacattataattcttctttcactcccaacaatatacataactaaaactcaatcaattattagtaacataaataatactttacatatctatttttttatgccacattcatcttcttattttcaaccttattactacactttctattatatatatattcacctacactcgctattcattacacctcttttctttaatatactaccacatatatatatatttttagcatatgttattaatatccactaattacaaacacactctatataaattacccatcatctatcactttttcctatcaaatctaccacatatatttatatacccccagtctgaacccttaaatattattattcaatttatacatccctcattattatcattattcattaacagtcatttagctatttactccttcatatttctacttaattacatttattacttctcctcatcttccactgttatattaacactagtttcaatacacttctt

SEQ ID NO: 8889 - DNA, 872 bp, Homo sapiens
  misc_feature (1)...(872): n = A,T,C or G
cgctatgcgcacagaggccttcctgctcttggagggacccangtgggtccgggggacacacataacaccaatantcctcnggcccatggagatcctccacctgttgcctagtaacattggtggaacacttcggggaccttcaacctgatggggggagagataagagacaaattcagctgagggctgttatatttctcaaacanaggggggggggggattaanccacctcgcacctatttcctacaaaaacaccccacaaatttcanttccttaactccggaaaacaaaaaaattccaccccancctctcccattttctttccaccccaaaaaatttaaaaattcaatcaccctcaaaactctcctctctaaaaaaaaaacaaatttaactttcataattcttttcctccacaataaccaacaataataaactttaacaccctttaacttccacattcaaaaaatttttttaaaaacacccactcccattaataaacttacttcccatatcacactcacaaaatttctcgtcaaaattcaaattaaatttcaatcctttttccttcaataatataacttttccctttccttcaaaacacttaaatcatactcctatctcaacactatatacctcgatgcaccaaacatattattaaccacattgggtccgcgcggatgtctccgcataaagggtgggcacagccgcagacaggtcgggttctcgcggagcgcacgggaaataaggccggggatgtgggggggtgggggcggcagggaggggggagggtgggtgttggattgggcgggggaggtgggaacgcgggagctcgggcgcacgggggggcctggagggtgcgggccgggggtgggagt

SEQ ID NO: 8890 - DNA, 931 bp, Homo sapiens
cagcggtggtggggtgggtgttgggaggggggggggaggggggctaagctggaaacggctcgtctgatttacgctctcctaacaatgaagcatgaggataagcagagatcctacaataatccataatggggaggggggattgccaacacaagttggaagccgcatatttggatcttcaacggatactagagaatgaaaaagactgtggaagagactgaggaatataaagaagcacgtgtagtactggattcagggagggtagaagcctgcaaacttttcttttttgggggggggggggcattaaatcctgagggtgcatattacaaaccgtgatttgtggaccactggtgaggtggtcaagtggtatggagaatgtggattgtttttactcttgatacataaatgtgacgtggagatggtttaacacgggagggtagatgtgtcgagtgatggaagtaaaagggagtgggggaggggttggggagtggaggaaggggggtgacgaagtaagctgtgtgcggtgggagcgcctggctattcgatgggggggggataagggggcggggctgcgtgcggtgggggtggatcgggctatgagagggggaggtctggttggggaggatgataagcgcggagagggggtgggaggggtgtcagcggaggatagagagagaataagtgggggggagggaggtgtgatcgcggtggaagataggctgacggggtgtgaggaagggggatggtgtactgtaaggccggagacggaaggggagcgttgggagggtggggggattaatagtgcataatggggaggccgggagcgcgaaggtacggagaaaacgacgaggctggagcgcgctacgcgggagggtagacgggggcgagcagcgcgggcggcagggcgagaatatggggcaggggaggaagaggt

SEQ ID NO: 8891 - DNA, 868 bp, Homo sapiens
  misc_feature (1)...(868): n = A,T,C or G
atgggtctattcgatggaagagtttcagctttattcgtgttatgggcctggggggtgggtattaattactttctgctctttcattgggtcctttcctggcctagaatcagctgcctcaagtcttttcccaactctttcctttcaggaggggcctctgtcatgcatatggggctccaaacttctgggcttgagacaatactcgggggggggagggctggctgtcatgggtttgaaattaaaattcctggacccaacaatattcccagtggctaaatggcaatgggttgggggcagaatgtgcaacacacgaggcttgcctggaagcctagcttaggaaccctcagttggaccctggttgggaagattccccttgattggtcagcgttggggatgaagacgacaagggcgcgagaggcggtgctgcgggggcgaagcagttgggccctgtgggctgtttgatggagtgaaggggctgtgctagagaatggcacaacatggaagcaagttgtgcacaggggcccgatggtgtcgggaggataatgcgaaggcccctgtcagggatgctgaaatcggacgaaaacagagaattaatatcccaggatcggagggggcgggagagacggggaaagagtcgccggtggggaatattacccgcggggacgattttcgcgagaatgggaggaatgtggtgtacggaccccagtagtgaaccggaagaaagtacgccgcgtaatagggtggcgtggaaagggagattgtacctaggttgggctacgaggcgctggggagggcggggagcagagattnagagcgaatgtgacacacaggggagggtgcggggagagagtaggagaggaggagaagaacg

SEQ ID NO: 8892 - DNA, 339 bp, Homo sapiens
  misc_feature (1)...(339): n = A,T,C or G
aatgaatacncctgcagtccaaaggagaaanacaaantannnnagggggangggggggggcctannaaaccnnctnncccacccttcccccggccctaaccctttggcagtctctggcgcctggggatgttgccgttctctggggtgctctggcangggctccgggagcaagcagggggatgtgcagaacctgacgagaggctgcgccttctggagtcactccctgggcacttagtgggggggggggaaaaaattactccactctctagggaacagtttctgagtctataaaatagggataccacccaccttgcagtttattgcgcaaataaataccga

SEQ ID NO: 8893 - DNA, 697 bp, Homo sapiens
  misc_feature (1)...(697): n = A,T,C or G
agggattactttcctcactttggttatatcctggaagctatgaacaatgatgcttcttcatactcttcaacctcatcatgataccttgcacgaagcaggagctcaactaatttgggttgagggcggggggggccaatagtgagcaaaaaaggatgatatttgacacttggcattgaatatctgagtcatgagtgccacataactacagctatgcaccacataatgaggtgttactcaacagcagaccacattatccgtggtgggttcataagggcttaaaggagctggaaattcttaccacctcatgtccccagggagagtgcaacattttggtgcttgggtgtcgcggggatgcgtgcataaacaaacccactgggcgtttcaggtgttnaaactggagcccaacgcgtttgggcagacgtaaaactcaagatgggggactgagtggcattgggaaaaaggagggcgggtggggtggggggggtagggtgtgggggcgtgggggtggcggtcctttagaggggggagactaggagcgctgttccttagtgtgtggtgcggatgtgtcaggcaggggcggtggaaagaacttaaagggtagagcgggattccgaagagcgggggagatgagagaaaggagtgcgcggatggggcgaggtcgtaggacctaatggtcgcggatgggttggcgagggcg

SEQ ID NO: 8894 - DNA, 818 bp, Homo sapiens
  misc_feature (1)...(818): n = A,T,C or G
ccacagtttttaccataacatggtgagagggactggctaacaagggggtgggggggtggggataaccaaanaaaacaccttggaagctggttacaggatgggtccttttttttgcacacacaagtgagacttttacaccagaacaactccttttttaaaaaggagctgggtgaaatgaagctgagacctactgggctggattcgggggggggggcaccaagggttcgagacctttcccaggatgcgataaagagtttctttttcagcaggggaaaagagaaaatgtgggttgggagacccaggaagagggggggggagtagctgtaaacaagtcccatttacgctttggtatatgctggggaagggatttagacgggttaaaataatttgaaagaggtgggggtggagggagtttgttttagtgttggatgaggaggaaatgaggggacgggacgattggcttggggtaggctgttgttacaaatatggggggagtgggttgctagcgttggagattgagggggaggaagggcggagagtgagctcgtggggtgtggtaggaggggtgggcagcttggcggatgcgagggatggatggtcttttcgttgtggtgaggagtggtggggtggggggggggggggtgagtatggggggagggggggcggaggagtatggagagaggtggtgtgtgagttacgaatggagtggggaggatggtgtagaggggggggacgtgtgttgttgtgagtggggcgtggtgtgggggctgtgagagacgtgatggagtgtgcgcgcggcatgtagtgtagaactggtg

SEQ ID NO: 8895 - DNA, 1526 bp, Homo sapiens
  misc_feature (1)...(1526): n = A,T,C or G
cagtatgccggatatagaccatccgactatacaacgacggtcgagtcgcagtgtatatatggttccatgtgtaccactgcgcgtgctacagcacgtggcgttaatatcgcgtctctgaaacagaccgcgcgcgccgtcggtcgcacgactcgtaccgctatgatatgtccgcgcatgcgcgcgctagatagtatcattcagtaattctgcgaactcatgtcgatagtatcatagntngtattacgagtgattgcgcatgtccacgttatatacaacgtatagtatctatagatnatgnagaaacgctccatacaacggtggtttcgatactgcatatangatacgatgtcggtatattctggacgttnagagcgtcaatacggatcaaatctatgcgtctctggacgnacgcgtgcgtagtctacctcatgatgttggtgtctcgctatgatnctttcatattcgccgtccccgcctcagccgatctatagtgtcgtaaactgtgacgcgtcggaatcatattgcgagtgacgcatcgagcgagcgcggagcagatggtatacgcagcggantgtgacacgtatcacttacgtgtcacgggacatngattatgatgcgtgtaagtgtagcgctgcgtatgtgtgatgattatactcgatacagcgaatactacggtgctgttctgcggtatagaaacaatgtcggtgtagtgtgacacgctgaatgagcctttaggcgnacaggtcgtgcgttgtactaacttactcgtcgtgacatcactcggtcgggtcgatgantatatggacacgctggcccgacgtcggtagagcagtgcgtgcggagttgcctatctttacatatcgttgatggctgggcgaaagtgatcagaagaacggcgccacaatgatacaacggcatcatagtcgcgtgccacgcgacgtatctcgtgcgcacgcacgaccacgcgcctcgtataactaccgccgcgcccggttgngctgcgcgtcgcggattagcgcaagaataagagcatctgagaccgtatcatccatatgccgaggacagtgcgactcgacgacaacactagtcaatcaacntagtactggcgtctncgccaatatacagcgatctcgtcgtcgacgagactagacactatgcgcatgtcgcagatatggcgatagatacaaantcgttgatagaggattagtagagataccatcgctcgcatgtgattttcagtcgcgtctcattgttactctacgaaatctatcagcattcaatcgctttctaactcaggcaggtgacatcgattccctgcagcgggtgggtcgcagcggtagactataatgatatcttgttatgttgcgttggtcgtccactgatactcagtctttatagtcttgatggttattacgccacatcttcagtttataacagcttcccttccacatttgcttatagaatacgataactctccacaccacagcttgagtatatcgcgctgcgaagcgcggtctgcgcgtgga

SEQ ID NO: 8896 - DNA, 1829 bp, Homo sapiens
  misc_feature (1)...(1829): n = A,T,C or G
ggcagttcgtctgctctgtgtgcgngagttcacgctcgtcgtgtggtcgtatggcgcgcgcgtctcgctggctgagggcggtagctgtacggtcgagcagcttctgtctntcttgtctggctatcgcgtactactcgctacgcgcgcngcgctgcttcctctcaagtgctctgcgtaggtgatagggtgcatactcagagcgatgtnccgttgtgcgagtcggtcngtcgccggtcgctctgcgcgttcgtcggatagcttgcgcgcgtcgtctgcctgctcgtcgtggacgagtctatgtgtgttacgtggcgatgactcggtgctgtgcgcgccgagncggcgccgatagagtcggctgtggggtgtgttggcgtcgcggcgctctgctcctcgcgacgaccgtatcgntacgatgctgatatgccgcgcgctgcatgcgcggcagctgactntgcgcgncgcgngatactcatgcngggcggtgtacgctcgcgcgtgtgtcagtgtcatcgcgtgntncgcgctgcgcgctnangacgcgtacctactcgcgaccactatctatcgacgtngntgtggtgtccgcgcggtgctgtcaccgcgctgtcgcgntgctcgggctgtatgtgacacgtgcagtgtgtgtgtggtctctcttgtgctcacgcgnccctcgctgtatcggtcgtgtctgagtagtgaagtatacttanttgtcgtgttgtgcgttgacagtcgntngctgctagcagcgcgtcgtctcgtgtatcatntngngcgagcgtggcgtatagctgctcgcgcgcacgagcgcgcgtggtcgncctcgctnggttctcgtgtacgcgtntgcgtgtagnncacgttcgctatccggcatntgcgctgcattcgcgggcgtnggctngtgcncgatgtgatggtactcgatatatgtacgtgatatcgtggtacgtgcgtgtgtctgtggtgtgtgcgtgtctnccctgttctacatgtaggcttagacgctgtgtncgtcgtcctncggtgcgcgtcgcngcgncngcgacagagtctctgtgtccgctctccttgagcttgattgcgcgtgtgtctcgctgcgagatgcgtcatgtgtgacctgtagtcttgtctaagctgcgcggcgtgtcgntcgctgcctcgcatgcgtgctacacgtgatggttgcgagatgtgggcgcgcgctggtagcgcgtcgtgccgatggtctctgtgcgatcggtcgcatcgttggctgttcgctcngctgattggcngctgctgttctgatngctccgttgcgagcttgnatcgtgttctgttctgtgctgcgctcgactctgtncggtgtatgaggtgcgttcatatgtactgcagcttgtatgtccttcgctccgcgcgtgtcgccgttcgtctgtgcagtctcgtctctctttgtcgntgatggcntgatgatatctatggtnggctgtgtnngtctntctctgcctgtctgcgcggtcacgtccatcctctgtctcgtgcgtcntgntgagntcgncgggtcgctgcgcgcgtcgcgctgtgtctgcctgtctcangcgtcgctctctgatacagccgtcagccgtcgactgtccgcgcattctcgctcgctctctcgcgtagacagcgctgtcgtactcgncgccntcntncgctgcgcgctctgntgcgngcgaagcggacnctctgtcgtcgttcctgctctcatctccgtctcggtgcgcttatcgcagctcatctgnttcgtcactacagtgtcatagngtgtctgatncgatcctgtgttcatgatgtgtgcg

SEQ ID NO: 8897 - DNA, 968 bp, Homo sapiens
cccggcgcacaacgagaaggagaggagaggagaaacggatacaagacggaggtcgacgttgttaagaagggacgcgtgcagatgcacgtgtgacttggaatcagctgaacttccttctctgacctggggaggggtgcggtgcatgtatacttcttattttactgccaataatgggaactagctgccaagttatgaaggaaaaagcaagttctgacccaaagaagcttgtcggcaaatactctattgacttttcatttggggagctaggcacgctatgaaaaaggaagggggggggggttcattgtgggatataatttatttaccatgggcgacagttttgcagaatgggtattgggaaagagcgcacaaacggaggatagcgatcttaaggggaaacaccgctaaagaatccttggcaagacggggtgaaagacgcccttaaaggatgctaagtagcgatcaagagctgggagggaagagctcacaagaaaagagttgctgtgagtggaaagggatgcaatctggttcgattctggtgaaaaaacataacgtgacgcggctggtgggctggaaggaatggcttggtggtaacaagattgggcggagatagaccggaggcggcgcggtggacgttgaaggtagggtaaattacacgatctcccgctccatgactccggtgtactagagagggtgagagtggaggaggagcagggttagcgtctttagaaagtgaggtagtagcggtgtacgccagaagtgtaggggagttcccaggagaggaacatgtggaaagaagggcgcgccagagaggcaatggtcggggaagaaagggagatgaccgggagagtgagggggggatggtagccagatgtgagtctgaatagaaggataagtgtaagggggagggcgagatgccagctggatgtagagaaaatagtgataccacggtggaaccggtgaaagggatg

SEQ ID NO: 8898 - DNA, 737 bp, Homo sapiens
  misc_feature (1)...(737): n = A,T,C or G
ttagattgaagcangtaaccaccctccccacccacttttttaatatttttttttaaaagaagtttctgaantcctatagaagttccaaaattagctcaaactttgtaaaccctgaacctttttaaattgccaagcccaaaaattcaaaacacatacttttatttcactaaaaaaccctaattctttttaacaactttttctctttttaacaacaaccttttgtattttccccccctaaaccatttatttatatttttttcactgtttccgcctcttttcattgttatttttattctcaatatccttttatgactctctttctaaactcatattataacaatattttataaaaattttacatctccatctcataattaatactttttatctacccaatttccttacaccttactattttcattaatacctacattttactccttttttatattacacatacataacaatatagtatttcatactatctatacatctctatatctctaacattctatattatctattatattaccatattaatatttcacttatattattctacctgccactttctacaaaaatatattancctattgtccaacanatacaactctataaccatctttacacaacaatcatatataaaatcacatactaacatacattaaatcattcagnattcctatactaattaantatcctatacctatctcctcactatcaactccaatcaaaag

SEQ ID NO: 8899 - DNA, 875 bp, Homo sapiens
  misc_feature (1)...(875): n = A,T,C or G
gatagctgcaacgactctcttaatgtccaccgctcagcacttatccttgctggcaccatgtgaagaaggatgtgtttgcttgggcttgtggaatcattataagtttcctgaggcctccccagtcctgtgaaactgataccatctctgagctggacatgagagcagatgaccccaggaacccttggaagccatcttgcacatggaaaccgagtgatcactgggatgcagccaacatcacaggacggggggtgggcaaacatgaagaaccaacagcaacaattgatgttccctggcatcatctcagaaccactgaatcatcattggactctacattaatgggcgccaatgaactcccattttatgtgagaaaagttttgcaaactatgcatctgacaaaggtctaaaatccaccatctataaagaagtgtagcaaatttgtaaagatggggcggcccccttattttttgtttttttaacaagaacagacggttgtgggggaaatacttttgtccccccaacaaaaacccaaaaatggcggcgcatctttaaaaataaggagaatgccacccaaaaccaccttgatatactgggcacatacaacccttgtatgggggttatntcaaacggtgttacaaccaaaaaatgttggttgaggcccgggggtgttccgccacagatctttcccggtagaggggaatgggggtttcaccccttggtgatattccacccgtggaatgcccaaagaaaaaaaaccgggtgtttttgccactcctaagaagaataccagagcatatcccctatggagtttaatacgagggggcatatataactttggacccgggttgaaatgggcccattgtttccatgccggggat

SEQ ID NO: 8900 - DNA, 1542 bp, Homo sapiens
  misc_feature (1)...(1542): n = A,T,C or G
aaattttnnnnnnaaagtgaannnnnnnanaanngnnnnnaaggnnaattagatgttnnnnnnanngnggagtnnnnngntnnanagatgangannnntnnnnaanngtatggnannnnnnnnnnnnnnnnnnagaggnnagntnntatgnnnannnataagtnnnanattagaagttnanatagtgnnnaagtgttgtatgttnnnnaagatagatgtagatnnatgacgataangaggatgggagtngagatgatnnnnaatgtgtgtgagtgtgtnngagngatgtgtagatgtgtnnctatgaatgtgtgtnctctgtaggtgatatgtgcgcaatcgtggtnagtttatggtncacncagagttgttcatatgaggttcgtgcctcgattacngtcatcaggattgtntntagatagtatnaatactagatcagatgatatatagtgatggttgantaggacgtgatggtaattgtatgtgnaggagggaanatagtaggtgntctgcaggggaggtcaagcagnagtggtgtgnttctgcnttagagtncgcggnnccccgcagagtatgcctgcagncgtagcgccacgagagacganatagcacgatcggcgctctgtctgcagagcgacgccaccacagggcgagngcggtcacagcgcgtctcgcagcnctcgtctccgtgccatatgccacgcgtattgaagcttacggtaggtcgggtccgcgctacgtcggatgtgcaccaagctcagccacnnnngccgtccagccgcaccgtcgccgcgnccacgtcgccgcgtctcactcnattcgcatccgtcncntctctcataccgcgtcgcgnacgctgtcagtacgggcnagcacncgtgtctgngtgcgatatgnatcaggcagctgactactgtctcgctcgctgtttatctgcgtgtcaggtgcactagtcgctcnncctcatggtgcgtgtgcccgtccctgtggaaggtatcgtggtcgncntgcagtgaggtgacctgtnncgcgctcngatatagtgtgnncgacnagcctaggcaattcgagtacgananagactgtcagcgagtcctctctgcatatattatacgtatcaggccnatagagtgctancngacggtatgtcgncncgtcgtcgacacgcgcgagcttgntcgatgctacagtatgctcnantnnccaccatgctctcntagtgtgcacgcctacatcgacacgatgacctcatcacgtactccgtctcaagccgcacgctctacactagtccacngctgctctgtcgcgtgctcgtcgcacgncgcaatgagcgcgcanacacctctatccgtacagtagcttcatctagacgtcgctgcgatacgccgaggcaccacggagcatgagtcgcgcgtgcgcacgacgacgactgactgtcncnacacagtnatctgcgctcaagtccggtgtctcncacggtcgcgnttgtcgtacgtcgcgtngcagcgctctgaatgangnccnacgagcatgtgtccnncg

SEQ ID NO: 8901 - DNA, 814 bp, Homo sapiens
atgctggatatcatcgaaaggacagtttgctgaacatcttcttggagctgggggggtccgcagtacaaatcctaaccatccagactctactataaattctgataatgataagataattaccgctggcatctgtgctggtttatatcccaaaggtgctaaaattctactaaattcgggtaaaaaaagaaaaatggtcaaagattacagggggggccgatggccctgttgctagtcatcctaaaactggtaatgtggatcaaacaaactttcactgacaactggcttatgtatcaactaaagataaaaacaagctgtatatacttggttgactgggcagagggctccccatactggctattgctttttggagggtgcatctcccatcataaggataagcgttgagggaactatcgctgaaaatgagtgggtcggatgtgaatctacaatcggaattgcgccatttgtcttaggaaaggcgagaggggctataggttcttttcgaacaaaaggatggagtgctattgcttgcagaccggcatgcgctaattccgaagcatggggaggttggaggctttgtagagatggaacaaatcaagggaggggcttcgtctaggaattttctcacaatgccgagaggggtatacacgttggcggtttttcggggagggtccacaaagccgtgataaagccacattgaggagggggaagatttggtgtgaaggcgaggctggtgcattgtattttctttgtgggagggagagtgtgcggttggggaagagactaagtggcacgtcaatcgtatatggtaggtctg

SEQ ID NO: 8902 - DNA, 1393 bp, Homo sapiens
  misc_feature (1)...(1393): n = A,T,C or G
gagaaaggggagagggaagngngaggaagagagaggganaggagagagagaagggnaggaaagggaagggagaaagaagagaaaagagaaaagaagtgtaggnngggggggaggagagggagagagagggntgagagggggagagagaagagaantagagaaaaaggagagaagaaaaaaagagagaagagaaaaggagttgaagaggagagaagagagaaaaagaaaagggangngnagggagaaagaaggataggatagaaagatagataggaagtgaaaataaaaaagaaacaatagnagacacggggaggngtgaagagaaaggagggagacgagagacagacnaacaggcggcacaaaggaacaaggaaaaaagngaggagatcatagggtaggagagaggagagagagagagannaaaggagtaaactgagagacacgnnaatacagcagagggtggagggaaggagacggcgnaagagcacgagcagaccacgaaaacgaaacacagaaacgtaccggagagcacacacaaagacncgcacaccaacaaaccaaaantaagcaaggngcgcgcgcgcgaggaggcagaactcgcaggactccgccgcctgcgcaccgagcaggcgcacgcgcgtgcaggagagcnagnccaggatgcgaagcaggacaacagaacccgccacggcgcgagcgcgcagcaaggacgcccacctcgcgcagccgactcgcgccgccagncggccagcacacacagaacaacatacaacatgncgagaagtacaagccagaggcgcgcggagcgcgtcgagtcagggagacangaaaacaagcacaaataagagcagagatacacgaagagaactaacatcagaagagaagcgacactgcaggagtagagagagtagagtcgtangagctgcgtcgagagggtgaaggaggagaaagagcggnanagaacgataagtaatagggaagaatcagacacacatagagctgacgacggagcatgcgaggaagccgcagagaggganntaggcgcagtcgcaccgcacacccaagcggacgcgncncagtcgcaagagtgcgccactccatacggcaagcgcgcgccgcatgaaaagagctagacacacctccgaccccacgacaggagacacgagaacaaccccgacgcgctgcacggcacagcgagcacagatactcacagccgagcgagcagaggcggcgcaagaggagtctcgccggagcggaggcggcacgcgcaggggagaacgaggagtgagagcaagaggagaagcggtacggcgacggccacgtcaggagagcgcgcgagagacactgcgcgcagaaccaatccggatcagagaagaacacgctcgagcctccg

SEQ ID NO: 8903 - DNA, 1151 bp, Homo sapiens
  misc_feature (1)...(1151): n = A,T,C or G
atacgtggactgctacttctattattcttcgtnagagcgtatacgttgctgctatcaggcgggttatcgtctatataatacgcatttacagctggcgggtgctaccatcacatgctggcaacgcgcgcaacgcggcnccaccacgcacgatagcttcagcgacgcatcgctcgtatatatctgcattgtgctcgccgaatattctgttagtagtagtgcttgtgcggcacttgcctnacgctggaatctgtatctatgatgcctgcgtcgattaacgcggctatcacacgtcccaaatgaccagcggtctatcgaagcgattgcagtgcggagatcgcgtatcataatatacgctataaaatgaataacggtcataagatgactccatatatccgtgcatatagcaataccgtaatatcggaataggtatcgagtgacatcatcaagatgacattgcactataatcaataagcagacgccgcgcgaggcgactcagcatagaccatttatacaccatatggccgctcccatgcatacctcgacaccgtgtgacagccgtgcgcgctgttactaagctccgcataagcggcgcatctaatgtaagatgacaaaggtggtaacggcctgcatcgcacaatccttcactgtcgtgctcatttgggtattcgaataggcaaagctcgatcaccgcttctctccgagcgcatgcggtgtatacagacagtatcggagatacgtatagcctctacttaaacagctcggtgatatcctaaataggggtagtcgtgggttgtgaaagacaaataagcaaacggatctgcgataggacaggggcgtacattactcgagaaactagagctcttatataagtctaataatcttagcactcacaattctatcgcacaccaccatcgagtagatactctatatcatctataaacatctcagaaactatttactttggcgctcgtcgcgacgtgcttaaatatagtctccggacgcacgaaagttgtgcaagcgattaccgtgatagattatctatcatacttacgtatactcaataaataattcatatatgagtctctgaagaagaatactataatgttataaactgcgtcgatttttcatcttgtgatccgtaatagctcttt

SEQ ID NO: 8904 - DNA, 820 bp, Homo sapiens
  misc_feature (1)...(820): n = A,T,C or G
gtcggttccctcggataagcacctttgacgtttccccccccgcagggcttgcaaaacaaaagaggtatcgcatctgcccctcgcctatatggccattactgccaaagcacgctcccaccaggtgaattaatataatgggttccgggcccncacacgccgacttcccctcgcgggctcgcgcgcccaccgaataccagccgttcttttggctcgaatgcacgtgcgtcctacgcccacagtctctacttccaacgaatatggttaactgcgtccccactctctgttgttacccctccgcgtcctaaccgggtgcgttaaccagccccctgcacctccccgctcgttcccaatgggcccccgcctgcgcgcnaccgattttttcccggcgctccatccctccagaggtcccctctttatgctgacccccccgtgtttatatgtcccgccttttggccccacatgtatatttactcgtttttttcattctctccccgccgattcgctgtgttggtaaatggtggagaagccaactctcccccaataaaagaaaaagagggggcgccgaccaaagttgcacacgcccggtgtcccttttttataatttcgcgccccatatcacaggtttttttttcctcgtcggggcaaaacgttcttggggttgaaaactatcaaagaatagggggtccgggcgcccttccccccgaagtggcccaaaaagagcaacacacaaatgatcatcagcatctataactcccaccagcgaataaagagaaaaacaaaaacagaaagacaaaaaacagcaataaatgcggatcggcga

SEQ ID NO: 8905 - DNA, 807 bp, Homo sapiens
aaaagtatggtgactcctgccttaaaagatcagaaaatttgcgagtggtgggggagaggagcttacccaaaataaccagaggcttttcagccactgggatccaaagactatgctatccctagaaggtggagaccgatccatgcttgaccatgtgagcatctgcaggatcctggacatttatcaagcctgtcaactgacaatgactggggggggctgcaccaagagccttggccagagacaccacctcccaaggggcctagtgaactatgagcattctcagcgtgtaactaggacgccggagtatctggtccagtcatgctgaaatgagcattagacccagaatactcatacagttatagatatgactgcctgcgcttttagagacattcttgttcacacatattgtgaatgcgtagaaactgttgatgactctgctattgacaacatgtcccccaggctatgagggagtgggagattcgctatgggtatttcttcggctctcccactcaacggtatgcgagacgatgtggatgtatagtggtttcgtcacataaccaagcctgacgaaggatgggactgaggggattacctgcgtatttgtacgtacgtgtgaggagagagaaatagttttgtagtggagtatagcctatcgcaagagttggatattaagcttgatagtggggggccagttataccttgactgaggtagattatgaaacaggcattagtgaatgatacatcgtatatacgcgtgccaacacgagctaggcgtaagtaaagtactctaccaagtttggcgattcgaga

SEQ ID NO: 8906 - DNA, 1153 bp, Homo sapiens
  misc_feature (1)...(1153): n = A,T,C or G
aaagaggaaaaaagagannaaaagnangaaagaaaaagagggngaaaaaaaatgaanaggaaaaaaagtaaaaataaagaagtatanaannaangaaaaataatgaaagtttaaagttnaaaagatgaaaaagatggaagagaaagaaatagaagaaagagaaaggggttgaaagagagatgggtgaaagagagagagggaaaatcaatactagggaacgaagaggttgggtcgatagtgatcagaggttaagggaggaggaagtgaaagcgaacgtgcgtaaagatagagagagagtgacgattgacaactagaattatatttcgattgtggtccggcttgttgtttatgagagagtncggctggtngtgactaatacatattatatcgtaacattatagtgggcgcgtcagcttgagggcgctggcgccgtcatcgtccccgtgatcgctagttacgtgcccaccgcacgccgcgcgcgcagcggcaccacgcctacatcttcccaccacgataccgcaccccgcgcgcgatccaagcagagcgaaatctatagcgcacacgctgcgcgcgtccgcgcgttcagtacgcttcaaacgtcttcgcaccacgccgtcactcccacattcaacctcaccactatttcttaccagattcnctcacctgttctaattctcaatcatcctgcgttatatcttagtatgtccgttctaataccgtatactacgctactggtatctagtgcgagtatctatagattggaatgtgncggcgttatgtttcgccgtccgggtagagcggtagaagatcgtagtaatattgatttnanccggcgatgtgacgcgctgagcttncatgtctctcccactgtcgctctcgccctctatacacccttccgagcatctctcactgccaccacctattctgcgtccgcccgtgtacctctcgtaccatagaacgctactagccactcctcgatacgtcgtcgcctcactgcgccnngcgcagccgcctctggacgccaatcacancatcgcgtgcatccncctcgtctgccatcacgtcaacgggagtagagactccgaaatcacccatgtcgtcggtnacgcctcatccgcagccacgcacccaccctaatacacatagtatcctc

SEQ ID NO: 8907 - DNA, 631 bp, Homo sapiens
gagtggttgctctgttacccaggctagagtgcaggggcatgatcatggctcaatgcacccttcacctcccgggctgaagagactctcccacttcagcgtacctgagtagcccgggactacagatggataacatgctagatgtgtaacaaggctggagcgggaacatctcacacatgcccgtgaacccccaattaccacgcctatgaactacaaaaggttttaagcagattttaaatgaacccagttgggtccctaggatcctccaaaggtgagtacatacagtgtgtgttgtctttggggggggggatctattgatgaaccaatgaatcgtaagctgaaaaggaagcaaatgaaataagatgtgatggctggccgcttaccttgtagggagagtgtaatcgataatgcctcgcttgactagcttacttgcgcttcggcagtgcgggtggagggaggcggtgtgctgctgactgagaggggcggaggtcaggtggtcccgggaataccgggattaaccgtcggaagaacatgtgagcaaaaggcggccgtgaggtatcatccctagaaaggcgtcgtgtgtgctcgtggccgacactcaatcgcctgcaacgtggatgaggcgggcgggcgg

SEQ ID NO: 8908 - DNA, 748 bp, Homo sapiens
gcgggcaagcccttcgggtggttttggggataacatggggagaaacacccgcgggttaatcgaggggttttttcgggcgagggggggcgtcaacaagtttttattatctcgtcgaataatggtgtgttccctggccagtgccgacattgtggggcatgggttcttttttttatgaaccgcccccaaggagaaggttccttttttcttccacagggtggaagaaaaaggggggggttgtggggttcaaaaagaattttacttctcgggggtaaagaaatttttttgggttaagccccagagggattgtggaaaataagggggcggccgccccacggggcggttttttttatttttataaaaaaaaggagggtttcccgctgttttcagaggggggttttttttcttttccaatgggaaaggggggatctggggatcctaaaaggttggggttttaggggggagcacccctggccgggtttttgattgtttttttttaaaaaaaaaaagaccctgtgtcacgatgcgggtgttcccaaaggaagaaaaaagatcttttttcttaaggggaaagggagggggacgccccccccccaattggatagtagtgaagggggttatgttaaacaaaaacctttaattttgttccttttccaaaaaaagggggaagagttagggccatttaagccctttttccttaaggccgagtttaaaaaaaaaaagggggtgggttgttccccccccccaaccc

SEQ ID NO: 8909 - DNA, 956 bp, Homo sapiens
  misc_feature (1)...(956): n = A,T,C or G
gggtgccgctatgccaatacgcattcgggctagtctcgtctgtgcgggagttgtatcgggttttgtttctctctggtcgcgtttgttaggcccggtgtgacgggttgagtgtgtgttgtgggtgtattatttgtgggttgcttgtcacacttgcatatgcttggcggtcgatcaccacgcctatgatacgtgtattgggtgggagtcctattgatgtggggattcttggtcttattattgggtattttaaatggggggcgcaggggcggggatatagcgttcgtgctgttgggttctcagctctctgtacgtttgtgtgaacaatgtgttatgtgacgagcacagtttactggttgttctctttgttttattttgcggctggtttgagttgttatgatgttttatttggtctattcgtagcggatcgttgtgctgtttaatgtcagcatcgtgtgtgttggtgttgtgtttggcccctgctccgcggggacggtgtgcggcttgagtttctttgcgcgaagtgcgcgccggagttgagattttggggttttcctcttggtgggtcttaatgttcgctttcttgtttttgggtgatagggaaggtggaggtgccccactgaccccttggttttaaaaaaaggaggcgtcgttttaaataccaaagcctttaagctttgtctccttgtgccagaggccaggggggcgacagtttagggcccttgtgagccccttttcgcttcaggcccggtttggaagaaaatccgcggggggcgcgttgttatcaagaagaaaactgaagactttatataaagaatcagaaagaagagagagaaaggaaaagaagaaaaagttgtacccaatnacagacatnnagcgagngtangccgtgccaagggcttttctttttttttttctttgtttaatagtatgtcgctctttgttggttatttgtgttc

SEQ ID NO: 8910 - DNA, 843 bp, Homo sapiens
atttgctttaaccattaagctgtccttgttcattcctgggcctaggctgaactgaccttgggaagaaattcaatttatggctcaactctgaaagaaaattgataatagtcctttccccaaaatacccctttcttgcctggggatcattctgtctttgcaggactaacaaattagctacaagataagaaattatggtttagggatcacgcagcctctggctgcaagagtctgaacctccccaaattgctcctggggataacaccactattgtaaaacctaagatcagtgcttgagctattttgcagaccctgcactggatcgatcagcggacaccacccagactggtaatctggctcgaccagttctgtgatcccacccaggaacagaagacagcaagttgtcttcaacaccctatgattccatctccaacctgaccaatcagcactccacactcctgaatcccctacctgccaaattatctttgaaagctctgatcccgaaatgctctgggagactgagttgagtaatcataaaactctggcctccagcacagctggctctgcgtgaattactcttcctccatttcaattcacctgacttgataaattgactctgtctaagcagcaggcaaggtgaacccattgggcatttacagtttcactctttttagtctctctctctcccaacccttccaccaccaaaaaacactttttatgagagaatttatagtgagaacttacatctaccaaaattcccaagagcggagggattggatggttcttgcaggcacaagaatacagattctgaggagggagggctgcttagcccaggaaggtggaagtg

SEQ ID NO: 8911 - DNA, 848 bp, Homo sapiens
  misc_feature (1)...(848): n = A,T,C or G
caacaacaaaaaaaaaaaangtataagcccctcaccctccaaaaaaaaacaaacctgttcatgtgtttgttttttgtttgttattacaaaacaggcaaaagtgaaaatatgtgtatgaaggaaaacatttacagtaatctattattgaaaaacatgtatttactaaatgaacagtaacctaagagtaaagtgtatataaagcctacactaatgtactaagtctttaaattcactaaccactcactccctgataaactaaaacaatctaacaatactataagctaaatatatttatagggcttcttttaaagattttactacatattataatacaaatactcattcaactaattaaatatttatccttatatattaacgatactctctattctctttcctttcttttcatccctccctttaccctctcacaccatactacctataaacaactctaatccaccaacaaccgcatgacgactcggcctttctgtataacatttactttataaatatataacagaacataactaataatccgtcacaaatttgatcatactatatcttacaataatataatatattatattcaagttataacttatgttaaaaacatttaccattaatatacgattccacaatatcttaaaagcccgaataaatatcccgcaacaacaacaataacaaatagcacaagttatgtaaatctaggcccctataccactattacctccctcattctatattaacttacttttaattcaaatacataacttactttaatatatttaattgcattgtttgaaaaataacctaatctactacccctgaaatgttaaaaantcatatat

SEQ ID NO: 8912 - DNA, 765 bp, Homo sapiens
attcttcaaacactaaatataactcataatatgcgtatatatttactgccccccccaatgggcgccgactcttcagattaagacttccgggggaataaatccccagtctcccaagccgttcacaagcttactaggagcatctaactccagcctcataaactctgcgttaaaccagttgctatataacaccctgtatcctgataataagtcatcaatgcaactgttgcccaatacttcggaagcgatttatatttcgtccaggtcctgtgatctcgcccagcctccattagcgttgtgatattgtactaccttgtaaagtgcatgatgtctgtaacccactcctaatcgcacacttcctcccctttgggaatccctaataacaacgcgctggtttttacggcttgtgaggcatcccgaaacctacaaacatgtgatgtctcccctgtacgcccagctataaaatttccctcttttgtacgctgtccctttatttctcaagccagctgacgcttaaggaaaatacaaaagaacctacgtgaatatcagggcaggttccccgatatgttatattcatttttttgcttccatgcccatccttcaaatgtatttactctaatttaagatgaacttctcaaaaagttctgcttttttgtttgctcttcaacatatatcatgtaacttattttatgaatctcaaatatgtaccttacgcttctgattttgaaagtgatatcacacaaaaaataaacatagaatcggcctgaa

SEQ ID NO: 8913 - DNA, 165 bp, Homo sapiens
aaaaccctgggtcaatctggactgctcttccttacagccacctgaagaagacaattgaaaacaacaaatcctttatcttggttttatatttttcttcacctttatttttttttctatttctgtctgttatcacaccaagaatttgactgtttaaataaaaactga

SEQ ID NO: 8914 - DNA, 353 bp, Homo sapiens
aacaaagaagaaaaaatttcttttaaagaaaggccaaagaattattatcgatcttttctttcgacattcctaaacaagaacaggcctagatggtgtcattttcaattcttgtcctaactgattttctttctatccatctggcttaagagccctttttggtgctaaggaaactcatagaataagtttcctaaagagcttatgaaaaactccaagatcatttttttcaatcttcaaaaattaatggatttataaaaatgtgaggagaaaaaagaaacactcaaaattagaaatggcttcattcaggaaacagatacaaacgatcaaggagagtaacatgatttccccccgaggcc

SEQ ID NO: 8915 - DNA, 863 bp, Homo sapiens
  misc_feature (1)...(863): n = A,T,C or G
ttagtctggaaactctctcttaanacttcaccgctacaacactatggaaatgatgctagacaaaaagcaaattcgagtgactttcttgttcgagttcaaactgggtcttaaagcaatggagacaactcaaagcatcaacaatgcattgggcccaggaattgctaacgaacatacagtgcagtggtggttcaagaagttctgcaaaggagatgaaagccttgaagatgaggagtgtttttattgtccatcagaagttgacaatgaccaatcgacagcaatcactgaaattgatcctcttacggctacaagagatagcgctgaataaattaacattggccattttacggtgattttgggctttgaggcaaaatcggaaaggtggaaaagctgcataagtcatggcctcacgacctgagtgagaaaaaaaagcatgaggggttgccttctcttattgtacacagaaccagtgaaccaaattcttgatcgaaatggggattgtcaacacaggggtgtgcttttatacactgaccattgtataaccaacttatagtctggaccggatcagtagtctttaaaagcccttctgaacgccaacattagcgccaataaagtggcgcactggttgtgtatgggatcgtcagtgctaatacactttatcttcgatagtaccatcaaagcctgtccatttgaaagtatagtcttcaaattcatgtcatgccctgatgactgaatcgcttgcacgccctatcgcgaagacaaggggtccattatttatgttagaaaggtctgcccgacacatgccagcatcgaagaaacaggatttgttacccgccctatcgcgtacactccttgaagacgtgagg

SEQ ID NO: 8916 - DNA, 618 bp, Homo sapiens
ggtcaatgagctcaccaatatccctttgcaaattctccaaagagagtgtctgcaacctgctgagtcagaagaaaattttaactctgtgagatgaattcacacatcacaaagcagtttcacatgtagcatcttcctagtttttatctgaggatacttggtttctcaccttggccccaatgggctcctaaatatccctttgcatattctacaaagagattgcttccaacatgctgaatcaaaaaccgttttacctctatgatatgaatccacacatcacaaaactggttcaacgggtaggttcctgctagggtttatctgggggatattaaatttttccccatttggcctcaaaggggtcacaaaaattccatgggagatactacaaaaggggggttctaagtggctgaatcagaaaaaggtttacctttaaaaaagagtccacccttaaaaacattccgcagatgggtttttgatggtttacggtgggagagacggatttaccataaggccaaagggtgacaaatgatcttaactatacccaaaaaaagggttcctcctggtgaaccaaaaaggtttcccctttaggtaaagcccattacaaagagggtgacaatcgtt

SEQ ID NO: 8917 - DNA, 965 bp, Homo sapiens
  misc_feature (1)...(965): n = A,T,C or G
gcgtgggtcaaggaggggggaggnccagaaaaancaagagttaactatgtcggacgcagctgttttaatgtagaaatggtggctcgtgcagaaaaatctttcaaattttcaaacataaaaacacggagtgggggattcctagtagctaatatagttattgcctaggtgcttatatagttaggaaacctaattttgttttgtttttttggttttagagacacgagtctcagcgtctgtggncccaggctaggagtgcaggtggcggcgatctctggcgttactgcaaatctccgctctcccggggttcggggggggttttccttgcctcagcctcccgaaggaacactgggaccacaggcggccccggcactacggccaggggctaatgtgtttgggtttgttagggaaggatgggggtttcaccggttttaaccggggattgtggtcatnctcctggacctcgtggtcccgccccgctcgggctcccaaagtggttcggattacaggcggntagccacttgcccgccgggcgtaaatctatttttttaaccagcttggattcgccgcgccctgcatagccaaaattcttagtaagggcgctttctcgccttaggcttattaaaaatgtgccagcttacgggagtcaccntcggcaaagatttctgaggaccgtccataggaagagtgaaaggtttgagtgagccacgagctagaggtaagatccctgggggtggtgaggacggagttatgggtcncagtacggtatgacggtatacggtggtgtgtggtggcgccccgcggcgtggggaggatgtggggggctnactcttgtagagaggggagcttcgtccgtgtgtctttaattcctcctccgcccgggggtnttgtcccacagttgttagtgtttaaggggaggatatcacaccncacagtgtgggtccgcaacgcgtgggggggggnatggg

SEQ ID NO: 8918 - DNA, 1417 bp, Homo sapiens
  misc_feature (1)...(1417): n = A,T,C or G
gnnnnannnnnttaatanntnaataantnaaaaaggattntannaannnnnnannnnaatanaatttaatgtnnnnttaaacnntaaaaaaatattncnatactaganntgnataaaaagtnannaatataagnaatgtnaataaannnnntatgtgaggataaatagagtnnnacaaatataagaggtaaatgacagtgtagcatgncantctgtgcatatggttgcactggcgtgctgacgccgcgtcgcaggctgtgcgtgtcanacgacgagcaccnactttaggtacagtattccccataagaagcggtgcttctcnctgggtgtactcgaggccaatacatatngataggaagcgtcaacnaatgcagtatagtaataattaggacanaanagatgtcgcacagaccgtattacgtacctcgttgttctcgtcccatatgcaagaccacgaaactccatcactcctcaacacaactcaagcacgcaancagccaatgtgagacacaagatagaaggtaacgagaccagtcgagncacaaataacgcaagagagacagtgagtaacgcgacctatgtctcacncacacgacacagcaacaccaccacactctgcgccgcaccatgaccacacactctcatcgaccacctcgcctcgcatcacctcggcacgcaactctctcctacgatttacatcgtcatctatcatgagaactactctcttacatactgctcggcgcgcgcccgagtcgcttgtccgcgtcacgtgagtgtgctacgcctgcgtgctggtcacacttacaacgcgctacctatccacgctctgtcgcatacgatacatcgtgacctatgtgttgactcacacctcatcgtcatgcttagacgccagtagtgtgtaatggtcgtnacctctcgctgattttatgtcacctcttgtatctcgttcacccattagtgcaatcgatcacgactgtctcatacgcaagagatagtcatcctgtgctattcacactctgtcacttcgtagtgtgcagcngcgcgcggagagcgttagtgtgctacacgtacagatgcagcgaacatgattatggtcncgcctccnttagccaccgtggtcaccggcttcgnatattgctaccgctgtacgaccgctcgtcttctatctntcgtgtagtctctccnccgctatctcgttcgcgacgctcgcgcgaactcgtcatcccacaatggcgtgtttcataggccgacgcgagtcgccctatcggattcgtcgcacgcacgcgaatgccagacgcattcacagctcatccatcatcgcnccgcactgtgcgcgacatataggtagtgtncgatgtgacacaacgcgtcgttagcgtaccttaactccactgtctttcgcactcagcattcncct

SEQ ID NO: 8919 - DNA, 857 bp, Homo sapiens
  misc_feature (1)...(857): n = A,T,C or G
ttatacacatagccattaacattcagtctctctatctaacaatctttgattgggtgtgctcaaaatcaaaactaacataatttcatggtgcctttcactgatgcccaacttacttcttagacgatcattgatccccaaacattattaattcctaaagtctaagagggaacagtcccaagaatatctacagaaacttctgcagcatccaggggggggggaatattcaacttctgacatactatatttcccctaataatggggaaacaccatatcttgataagatactaccatatcttcatcttgacaatctcataaaatacgtgcccggaaaactnatcaattacaatggccagcattatagaccctttatcatgaatttcataaattcccccgattctccaaatcctaaaccaaagagaccacaactgacccttctcacccctacctcaaaaactacaaaaatcttttcaaggatctgcctaaaaatactccaagaccctcctggaaattcacagtaaaacctaattcttatttctttcatgtaggaaaccactgagaaaaaagttttttaataccctaatcccagaacgacctgntaacctttcaagttgctccactggcctcacacagccttaaatgggaactctaatttccttatataaaccccacttctattgcctacctaagtactatgctttacngtaaacataaaacagcgttctcaagagacacccgcctcggaccacctcttaactcttttgaagacaccttatatttcctagaacccctagacccaatcgttccacattaattatcagtgtgaacatccctttgcgaaatatataattacaccgaag

SEQ ID NO: 8920 - DNA, 802 bp, Homo sapiens
cgattctaagcttgactttggcaattcccaacgctacacaaatcaggggtgggatggacggatagctcccatttttcagaggactggcgctgaactgttgcgagtatattggaaattgaacaaacgccctttaaattctctcgatgagcaagaacgggttaataatgtgcaatcgtatgttctaatataagttaaaggtccaactcatgaaggaagagaaataacctgtcatagttatctcatgacaaattacaaaagtgctcccacatccccacagtatataaaggtggagaaagaatcgtttcactgcctttcacaatcaaggaagtcaccctcgcgagcacaacacatgaatgtgggatcgagaccccactattcctgttcagaacctaagcttagctctctgttcgcaggcccaatcatgtcatggcacctgtaatagattatttgcatgactgcaaaacaatacggtttaccgctggattatcatgagaagttctcagccatagaaccatatgactatacgggacaggtctcagaatagattgacacatcatcatacaggggataccaaactcttagaacattcagaattgtctaaagggttctatgtgctatatacgatatcctaacagctgataacagggtctgagggatttcacgtttcacctctttcaccaacggtcttaagattcttacttggcgattcttgtggtaacataacagaacctggatggagttaacagttaaaggcgggctgaaggctaaactggacaattattgtagacccttgggaacacta

SEQ ID NO: 8921 - DNA, 1753 bp, Homo sapiens
  misc_feature (1)...(1753): n = A,T,C or G
tnnnannttnnnngnnnnnnnnnnannatatntnnnnnannnnnnnnnnnnnnnnnnnnnanannagnanntattnnnaattgnnnannaanaaaaannntnnaaaattaataatnannnananatgatannnnanntannaatnagntatntannnnanntgagtaagnaaatnntaanagtatnataannagagtatataanangannatatagtatgannnnataatagtatganaganataaaaaantagttgacgagtatatcataatacaatagacatctctagtntntnagttatagtatattcnnntctgtcnactacgtatagtntgnngtagnatgtntgnncatgnatagagatagnagaactgatgatgtagtacgtaganacatngactcagtagtgataagngagacgaaangacagtgatccatngatgctggatacactatganatcnactgatgtangtagtagtanntatnnaaatnagatgtantatagatntaaatgnagatataagccnntnacnananagagtgaatnacataaagataaatgtagnagatagnantatatagttgcgataaattagnaaacgagtnatatagctccagancaatcagtagtagtgtgcgtcacttactgacgacnatnatgagtgtgntctncgactaactnccgtacgcacagtcatacgttgcagctcaacgcaactgtcacagtatacatnnctacatctacatacaccaaatagtctgctcatctgttcatgcactntacatctatacnacttctatatacctgctctatncttaatttcctacacataaccacctcacaccaacgcacgaccntcacatatactgccgctctctacgtcgagacgtaagcctcanctncgactacatctcatcttctctcttgctctcatccattatcaatgtgcgcttcccgacaattgtttgtgcntacntcgagcgtcattgtgtcantgacgtatacagtagantnagtacagcgcaatcantgaacagtgtgacgagtacatcgtatgaatagcccgacgaactaaagtctcgtcggtagcagtttgtagtagctcgatgttcnanctaagagtaaatagtagtagaagatcatagatatacgtcgnnccgctctgctattgatgttaggatcgcagcgctccgcagtaagacgtnacggntatatgcatcgttactacatagaacgcgtctagtaatgtantnnttctcgcggtcagccgccacgcgcgtcgcgcatcgcgtgacatcagcntcgcatcncattagtcatncttctcgtncctcgtgcttgtcgcanctcacacacgtaatanaccaacntncatcnancgctctatcnatacgcgntcagtagtagtagcncacacacaccctatanatcctacnacatcccacacagtatcccaacgtcnatgctgtncgtgcacggtaccacntncctgatcngtcgntgtgtaagtgtntacgccngcgtcatctgacgcncncnatgagccacgtttccgctacgactaagcggctgcagacatcacatataatgtngatcgagaactcatctcaantgctgnttccttgtacgatacgcancngtacacacngtagtacntgctgctnctcgtatagccnactctgtagtctgctcaactncnantcntctctcgtcactatgtacgagcatcatacgtgacagcntncagag

SEQ ID NO: 8922 - DNA, 842 bp, Homo sapiens
  misc_feature (1)...(842): n = A,T,C or G
cccgaatgtataggagatgcaaatgaaatccgctccagacctacagtgggggtaggcctttctctgacacactcctcaaaatccttccagacttgacccactattcaccacggcagcacatcaccttcatagggaagaacagttccaaacatcagcgaaaaaaaaacaccgcatctgcaaagcatattactactgaacctatctatggggggggcaactgtgaaatgttgatactgctcatcaaagctggacataagcaggatccattccattttcaaagagatggagtctcgctctgtcatccaagctggaataaagcggcacgatcttggcttactgcaacctctgcctcccaggttcaaacaatagtcctgcctcancctcccaattagcgggactacaggcatgtggcatcatgcacatctaatttattgatatttagtacagacggggtctcagtatgtcggtcaagctagtctcaaactcctgacctcaggtgaactgcccgcctccacctcccaaagagctcggattacaagcctgagcccccatgccccggccagagaatatttttatacctaatagtcaaacgaaggaaaagaacttctaaaatggctaaaaaagtatcaaactcttcttagtaccatggaggggcgaccttaccagaccatctgcaatggaaaacgaagtaccttggatataaatgggggctcaataaaaattttgcttgaaggccttggaataattgtaaggaaccaataaacccagaatcccggcctgttaccttgaaggagaggggaaataaagagaccttcgatccctgactgtggtgggcgtggggg

SEQ ID NO: 8923 - DNA, 1233 bp, Homo sapiens
  misc_feature (1)...(1233): n = A,T,C or G
aggttgaaaaagaaaagaagaggaggganggggtttganagagagattgtggataggaattatgaaatggttagattgaggagaaggaggatgttattttaaataggatataangattgtgaaatataagagatagttgtggagattttatttttttttanaatatatatatcatatgtnaaaaattaataattaatgcctgtttctcatgccctatctcttctacttattgtcctttcactttntttnctgtnctcnnncgcntgtcctcncctcttntctatatatatatactgttactctgtgtcttatcgtcactccaagtatganatactcattttcttctaacgtagtatagcttacatatacttataaaacgacccaaatagantcgttgctcacaacatcattgattctgactaccctccatctcccactatccatctcgtctcactcctctccctttcttatctcctctactcctcattctcgtttcactcttcctctttctcctcccactcttcttcttcttcccttaccccctctccacccctccccacacccacttcctccctctcctccctcctctcctcctcctcgctcttcctcttctttctcctcatccctccccttcttcatcactcctccctctcatctcccctctccctcctccctacatctccccttctctcctttcttctctntttctcttctcacttctccctctgccatctctcttctatactcttctctcctcgcnccgtcttctgtttcacctccttttatctcctatgctcgactcttcacgctttcccttgcttgtctacacatatacctttatcttctctcccacatccttccttatctgcgcgtcgtctcaccctctccctcctcactcttcantcccttctctcccttctcactccgctaccnacgactcgtctcactatccttagtaccctctacactactctgccnctcctcatactctacacgcatccgtcctcctctagttcttctcccgcttatagtcgttaactaactcgcgcctccgtccactcttaccgctcccgtcctaccctcttctccctcctctccctccttcctcttctcctncactctcccgctcgctcctcctccctctcttttttctccttcacacctctctcaccttcctatcccactcttctcccgcatcatcctcgctcccacttatctctctcttcctcccct

SEQ ID NO: 8924 - DNA, 919 bp, Homo sapiens
  misc_feature (1)...(919): n = A,T,C or G
aattggaacaaatagagcggaggagggangatcagtaataatgagccatggtgctcatacacgacacatcacacgtatcggagcttcttagaggatggagcggccagtaaaactaatccacatcgcgacgcaatagttatcgacattcgtcacggaattgacgatcacttgagggtcgtgggaagaccggcaaaatatgatatgtagtacaacggcgctcgtgttgacatttacggcgtggagcacgagactctatgctttctgctcgtcgctgcatggcgtggactgggcgccgtgggtaaaacataaggaaaattcgctgtggtcgggggctggatgcggccagaggaattcgcggacgacaaaagcgccgcgaatctcactgtgagggttttctactacgattatgttacgagcggcgctaccagcctattgtcttgagaagtattttcgcaacacaacgggcgatgtaattcagtattcgccaaaggcggggatatgctgtgtataactctaggatggtgtcttcggagggaaaagatctctcgggcacacaagtgtgtggcttgtacgcgaaagaagagaaacgcaccccttataccgaatagtgtgtgggtttttccccgccaaacaaaaacaccgaggggggtggcgagtccacctcgaaaaaaaaaaagagtttttttttttgatatacgaaaagggggggttgttaccccccccgccgtaaagggaaggatgggggtaaaaatggggggggtggttcactggggggagctcagcacattttaaaaaaaaaacctttttttccccgcgtaaattcggggttgttaacgagaaataaatttttttgcaaaaaggggaggttttggtggcccccccccccccccgcggaaagaagaagaaaaaaaaaaaaaaa

SEQ ID NO: 8925 - DNA, 638 bp, Homo sapiens
  misc_feature (1)...(638): n = A,T,C or G
cttgagtgtgctggatgcggatgcattcttctggacagacccttacagtttttatgtgtttcctaaacaggttcttgactattgacggctgtggaaccaggaaattgtgccttggctaaggcctgttccttgcgctaaatgtgcattgaccacgaagtctaattgcctcactggttttgttatttataatatagtggatgtacagcacgcattttgtgtgtgcaatgtcctgacgtctgcctgagtnaatattcagtgtttatccagaagtttggggtcgcttgctagaggcccgggctttacgcctttcatgtctattgcccctttggttgatcatggctggcttccttattgtattctgtgacagggcgtgntcatatagggtcagggctgcctggaaggttgtatcaaggtactattcggaaggaattgaatatgatgcgtggtgtcatctttaactgtcccccggaagcccgtgccccgcctctatgtttcagatgcactcccggttttcttacaactaggactttatggaatccgtggcgatggccgaacatggcgtgccttttgtctatgtgtggaatggtgtaacggagaactctggagggtgaccttgctacatctcctgaggcttcgct

SEQ ID NO: 8926 - DNA, 815 bp, Homo sapiens
  misc_feature (1)...(815): n = A,T,C or G
ccttattaggcaggccccacaaatagcccttgactaagccctctccactcctaaaattccataacccccaagttttaatgccaaacctggtaatgttatttaaaaaatagggatcatccagcccccttgtgtttgcagtgttttgccatctgcctgaaaaacatccagttttatccagaggattggtgtccatgcctagaggccgtgacttagtatcagggttacctcacgctttggtatgaccaatgcttagctcctaatttcccctgtgcctgagcctctgcttttaaggtcagcctgactaaaggttgtcaaggccctcccatgccgggaaagagaaagagcctgtccctgatccataatttttcaccaatagccactgcatgcctcctattatccagatgatgtcaccttgatttttacaagcaaaactttatagaagctgagtcaaatgcccacccactaactccccactcagcccactgctggaaagtgtgggattggaaaccaggtggaaatgtgtctttctctacatagaaggtgtcttattggtctgaaggcctgccctcccacccaagaggccaggagaagagcccagacccacacccaacaccattccaggagcatatgagtggttgcatccaagtcctccctactgcttggctgtagggagataacattgcaaaatgcatggtgggagatgtgaanttagaactccacacacccttacccacagattcttaaaaggttgctattttttactccttttttgtattttacaatagtcgtaaaaataaacttcgtatgcggccagg

SEQ ID NO: 8927 - DNA, 812 bp, Homo sapiens
atgcctagtaacagcttgaagtacattggtaaattctgatcttgtctacctcttcataagaccaacagtaaaactgaggctccagaggctgtgggatttgctcagggccacaccgccagaagtagatccagccatcctgactcagaaccagccagagaggcctgacattgaatgtcagacactgccagggagaagtgggtaatctaagctcccaatgaccccattttacagacgtggaaattgagactgcatgactcacccaaagcctctggatcagcaagatacttagctgagatctcaacatggagctgccaaaccccacctgttgtgaagcacctacaaaagaggatggtgaaaaaccctccaggctggacacagggcctcctatagggaccacagggtggagacaacccttggacttgggctagaagactataagaccctatttaaaccatggacataatgaatggtgtatgatcagcctgttcccggagtcccagtctgacactatagttatgtgccgtaatatggaccctcattgtgtactatgcagcgccgtggtggggtgtagtgcacattcgctcccgcattagagagccagtttgtaaaggtaatcgttgtgcacccacgcatctcctgctctcgaggacgttgcttggtctgtgctgggaaggatgctaataacgagatagaccgagctcacaaccgcctgtaaattctcacactttcttcatttttgtcatgtccggtgcagctgcccgagccgtcaccggatcacgagcaacgcacatgacatcataattaagatcaag

SEQ ID NO: 8928 - DNA, 142 bp, Homo sapiens
accaggcacagacccgattacagcacaagaaaaaaaaaaccctatcggcgacgactctcttattttccagggcaaaaccagtctagatccttgtgcaggaaaagcccacaatccaaagaggactccccccccgaccacgagc

SEQ ID NO: 8929 - DNA, 1588 bp, Homo sapiens
  misc_feature (1)...(1588): n = A,T,C or G
tctaatgtttacgttatagttgatcgtgttatggtatacgttagttgtatatgactacatnagtggtagaagtgatnaagtttgcgtccaatacgtgagnaggacgaggtcgagagtgaggacgtggttttttttgtcatcacgtcgtttcaagatatagatggttcngtcgtggcgtctgtactnagtactactgtatgtctccttcgttgtctgtgttattaccttcctcntgcaaagtgagcgtgtgcgttgtacatgtacgtgtctaatcagtaacgttcatatctgtctagtcctcagttgacacgccgctggcctggctctacggcgttgtcgtgcgctccgtatgttcatgtagttctgttctgtggtcctcggtctggctgcacacagatccgctgatcgtatctctgttccattgtcaactactctgtctctgacatntactacgcactgcatagcacatcattataatgaggatggcacatcagattccatcttgggaagaagttttgctatttttcataccagtgtctcgtcttcgtgtagctgtcattattagtcttattatgtgattatttaagtntatttagtgcaatacatctcgttaagaatgagagtaagtgtattagatgttaggactagtgtggtgattattaattatattagttcgtagtcggtcgtagtantacttatcatattagtatgtctgtgtatatgggttaatcctagaatacttctgtgcgcaatgttatacgtgctcttcagctgcagttgcgtatcacgatcactactatatctagtgctattactcagtctattttatccatccacttgtcgatcaacgagtgtgtgtgtctattgttaactagatttattcttttgttacgctctctttgattgaatatttaacgtgtgtgatatctacgttctcgctattcgtgcctctcataagtncgtctgtcgcgaggacactaccgtatcctctctgtactgacatgttcactgtctatatactccgcatgtgacgatgacgcggtaatcttcgcgtgcganagatagtgtgtgtgnatgatgcgataacagtgctgcgtgcagtgctcgtgctcatgctagacgggagtagctantatactattgtgtcgaatattggtcgtcatgagacgatatctncgtcattgtggtgtgaagtcgacgttaagtgctatgcatgtntcgtctgatactgtcgatgtcgatcttgttgtntagtctgattgcattgacgtgtcgtctgtgtgcgctgcgctatgtagtatgtgtgntcttctgtgtgtgtctcatgtcactttcgcgtcgatcttgtcgtactgtcgtatcgacatcactctngagtacattgtgctcgnctttgtatatttcgttcggctatatccgtgtatagtcttgtactttcttgtactcactgtgtctatantcgattcgactcttcctccgtagtgcagttgcgtgtgtagtatgagttgactcgtgantcgacataatatctnttagttacgctatctntntgtacgatatttgatcttatgctctatgttgtgtctct

SEQ ID NO: 8930 - DNA, 142 bp, Homo sapiens
gaaacataggtaatgagatgctgctgcccattttggagaagaatgtgttggaaagctgttaggattaaataccaatttgcaatttgttgggttaaatagtccagtattactttaaagtcaccatcacataaataaaaacaga

SEQ ID NO: 8931 - DNA, 821 bp, Homo sapiens
ccgtcctaatacgcatgaagtggagaacgcctagccttgtaggacggacgatggaggactaaggtgtaattggatactctaaccgacccacactcagcgggcctaaaacctcagcgaattgcctgccacactagctagagcgaagctcatacctgatactgaagatatatccgctaacatccacaccatagagggcacccaaccaacttaatgaattggagggacaaatcatcatgggcgcaaacttgaacttatcagagaaaaaaacagggtacagactctattttatgctgtgctcacacactactgaaagctcctaccctgcggagctagcttgactactaactatctgtggcatctcaagagagctcctcattggtctgtaccttagtctctacatcagtgaaacgcaggcagtatcacctgtctggatgcatcgccccacagagctgctatgaggcatcccacgagagaaagacttgttcctgtgttggcaactaacttacccagatgcatgcagaaccaactaaaagaaaaagggtgggaatcttgaaaggaataaaacccgcaatgatctcttctaacacctcactcaaagacagggactggttgacaccgctctagaaatggatgaccagcatttactgaacctgttaacagatcgatggaatgttatgtaccctgggcacagtaatcccaagaaggactagggcctcctccaatataggggaccaaggatcaccctgcaagggaacactagaagggaggttttccaagggaaacagtaattcaatcttaccctgtttcaactattggagaat

SEQ ID NO: 8932 - DNA, 1357 bp, Homo sapiens
  misc_feature (1)...(1357): n = A,T,C or G
aaattttnnnnnnnnnnnngnnttnnnnaagaaggtnnnnnnnannnngnnntnnnnnttatanntgnnnttttttgttnnnnnannnnnnnnnaatntattgtatnnnnncgattnaatatattgttnntgatnnnnnnaaattagnnnnagagagaaatgtttagtanaggaaagnagnaagaatnnntntgatatgaggtnagagatgaagagagatgcagaacgagaaaggagtaatgaaagaagagagtgaagaagagtgagcgaaagagtgaaagaaaagagaacgcgaaggaagacgaagaaaggtnagtatgggatnnacaaatataatgtnntcaaatatntgancgaaatctagtnnaacgaataaaatnaagaatttgttcgttatgctaatnaatgacacccaccatagagagacacagaacacacaccagatnnagaacaacaaacgtccctagcccgcgcacgcacgcgcgncnccacaggcggaagcaaaaccagcacgatacccaccaccggcgccgggcgcaagacctcgccggccgctcgcctcaactcacagcagcgcgcgccaccgcgctggacgcaacggcggcgccggagcgggccatccgcgcccgcgcagacgcgctagagacgcggaccgagtctcantcgcnaggcgcgacaagacaacgagagatgggtagtcagagactagatgtgtgcatnactaagtaggagtaatcgtatcgacntagacaatcagacgagagagtggtagtatactagggcnaacggaagagagtagtcatgtgcaagtatgaaagaacagcatgagttagtacgatataggagcatagaatacatatcatatgacagcagcanngtgcgntatgcgtgncagagagacgtaganacacacaataacaagatgananccttattctcacactctctgaagagatcatatatagactncgaccacatcgacacgcagcgacccacagtaagaagntactagcacacaggtgtagcacaacgtacgcatagacccaccaaacagagcgagcactgccgagtatcgatcacagcgtcgactacagcgatccgacacagcacgcgtcacccgacctcgacagnacacatcagccacacacagcctctacacgctcacgtgccacgtacccgtcgcacaggacncgaaatcagcaatcgacagcnacacacgatcgcgagatcgagatgcaccgataacgcgcgtggtgntacgcacgtgtcgaggtatcgtacccgccgcncacaggcgaccgcagagacacgngcaactctaagaagtacgagantgccgacacagaagagcgnccag

SEQ ID NO: 8933 - DNA, 1331 bp, Homo sapiens
  misc_feature (1)...(1331): n = A,T,C or G
cacggtgatgcgagcaaactcactgaatcatgctgactactgtccggatcagtccgngtatgcgtgaagtacacggcgccgccgccgagcagaccgtcccacaatgactgctctatgactatgatgagcgtctcttaagttacgtataatagctacggcggatctgtaggcgccgagaagtagnctggcgatctcgggtagcataaactataacgcatgnattataccacatgaatggaccatctcacatcagcgntaatatcaccagatatgacaggtcaagtcgttcacatatctggacagtgtgatcgtgaaccgccgacgtantacgctatacaggctcatacactctttctccgcacggtatacgtcagcaacatgcagcgggcacggttatgtgtatgctatgtgtgtggtatatacgtatgcacagtgcggactgcctggcgatatgctgagtatatggtagcagtatcttcaattgtaaccgcctacgcacataatacacacagtgtgccgcggcgagtagatcttcgataatggttcgggaacaagaggcgtgttaatggagctatagtagtagtcaatataactaataaggagcatgcancatgtcacagcgcccttcgcgctccgcacgcagcaactaacatcggtcggtgatgtcagatgattatatgtcttccactcgccgaacttcgatacgtgatatgaaacacacatggcaccaatctcgacagagcgcgcgatacactatgtattcggggatctacgacttctatatcgcagctgtgataaacactgtattgaagcaaaagcaagactccaacgtatgacttggatctacaaaatagtgtcacagctaaaccatgaaaggtcgggcgtacatacgcagaagtacgcaggtgagtgcgatggtgtgctcggtcgcataggtgcaccgaacgccgcatatatgggagaagagactataaactcactatcgcgtaggagagaagtacaatatttgtcgcctgaccgcaatggttcctctattatggcgcgtgttgcaaaatgtcccgatttagcactgctgtggcgatcgaatgctagcaggtcgcatcnatcactcctagagcagtacagtataggtaggtgttgatgctgtggttacacatgggataggctcccatccagagctaatgatctagtgatcctagcatggcacgaaaatacagcgctattatagatctcgtnaatgacttccataatatcactgaagacgccgagngttgctgcgccagaaagtctctgctttgtttctgtgtggtggtagataatgatataaggat

SEQ ID NO: 8934 - DNA, 1440 bp, Homo sapiens
  misc_feature (1)...(1440): n = A,T,C or G
cggtctgtgacgngaagtgcttgatcanactatcgcatacctgtctgtgtgngagtgctgctagcgtntcntgtcggtggtgcgcgcgncgtantcgagcgcgtcttgcgctgctgnantgntgatcggacgtgcgcgaccattcaactcagcgggactggcctctcatagactgtcgcgtcgtgtcctctcatncgtatctntactcgctagttctctaatgttgctatttgcgngtgagagcgtagatataatctctcgtgtctacgttactntcgtatgctctggatcttatgaacgtggcacgcttgatattcnggagagngtattgactgtcgagtcccgtctgctcactcttgtcggatgcggtagtgtatgctctaggtcttcacagtatcaatcacggctacgctctcgtcgtcgacagactcgcgactgactcactatccggcgggattcacttagccactttaatacgctgtcgtcgtcatctcttattcagatagcgcgtcagtgatcttctgatcgattcatctatcagcgaggacgtcggtctatcgnccgtgtcgcgtgtatgcggttgctctggtgcgatatactctcgctgtgcttctatcgctggctccgatttcctacgtgtgctatgcttgcgttattttttcggtgcgcctctgcatcatttttcctttgccggccgtatatattgtgactcggctctgggtgggcaagtttcgcgtgctctgttcgcctgcgttcctatttgtctgatctttacgtcctcgccaggtccatatgtatgatatcatagcgagctgcggtctgtgatgttagatcgcactgtatccactcaatgttggtgtgcaccgcgattctccggtatcaacttgccctccacgcgtgtgtcgcgctctcgctcactgcgtgtgggacgtactggtcttgtacgaagggtggcgcgtgcctgtgtttcgtgtttccctgaccggctttagcgcgcggaggatgctatcacgacttcgctacctcgttatcggttcacggagtaacgacgagcacactgtacgcggccacctggtcgtctcacacttggcgtggtatacgttgtttgtctagtgtgatctcaacgcgtctgtccgccggcttgggatgacgtatagtactctgagcgtacgatatgcttgagcgctgcgtgcggttgttcgccgtctcttgattcattccctccgttttcaggtgtggcacgaggtggtcctcgcatggcgtgtcgctacgcgcccgacgtcccggttcgtgttcgtccaccagcgtatctgaaaggtgcgtgtgttctcgtntgttggctgtgtgtgcgaacaccgccggcgtgtgtccgctcgtccgcgttctactctgcacatcccttcgcttactagctttctagtacgaggcatgctggtctgg

SEQ ID NO: 8935 - DNA, 213 bp, Homo sapiens
acgtgatgtaagaaggaaggtacattataaattaaagctagtcctgaggatggcaaagcagaaagatagaaagagcttggacctgttatgatgctgttgagctgtgactctaccaaccctgagatcccacctacttctagacttttaatgcagaagtttttcactatagcttcacactggaatttcctgaactgttaaaaaaataaattgaga

SEQ ID NO: 8936 - DNA, 1378 bp, Homo sapiens
  misc_feature (1)...(1378): n = A,T,C or G
ctagtctcgtacgccgtgcgtagtctnagtataagtacgtcgactgtnagtngagaatctactgtntntcacgaacgcggtgtgaggantgtttcgtggatcttatcgcgtcacgtggtntatgtgtgtgagggagtagcgatctatctgnacgcgcgaggcacatccgccgacagacgcgtatcggcttttatacacgcgtcatcttgatatcatctcagtcgcgtcgaggcgagctatactgtagtgcgagacttgncggagttgcgcagccatgctacgttaganaggagttctatacactnatgcgaggcatcggacagggcgcgtgcgcggctctctcgttatatgtgtagatgtagaagttcgtgtctcatattgtatagagggtcggtactgctaagagcgatcaggaggagcaatagcttccgaggcggaatataacgcgactatttccgcgtgtcacggtctgtgtatatagtgagtcattcactcgattacggataataataacgagtgtatagtctgtagttcgtcgcagtcagtcancgcctgctacatcataccgcatgtctgtgttcgtgacttacatgcgacgcgttatgtgtgaagtaatgaagtattattattatacatcaccgccacgagtctcagtgtctgtatccgctatttcatgccgactatatattgacaatcttacgccaaacgtcaagccttttatcgcatgctagtctgcgcagccactttatagagccagaggtggtgcgatgcaccgttgggattaaattataatatgttaacctcggtggccagcgggtcagaagatacgagtccgtggcgttgacggaggatagagcgagtgggacgggcgtagctgatgagttgatnctaatgagtaaatgttaagaagtagttgtagatcgtnctaacgcgtacttaatggagtggctgtcgcatcctgtataactactcagtcatcatttggtcgtcatccggtgtgcgctacgatcgcgacactgtcagtgatgttcataagtatggtgtgtaggactgtgcgggcggtcgtaatgcatgtaggcgacgcgagcagctgatctattgtgcctaacccacgcggagacgtcgcgataatgtctaatcttatcgtctatcgtacgcagtagctattcaccgcaggccatgtggttcaaatctatgtccgaaacgcggcattcgcgtctggccggcgacgcgatctatttgcgctccgtttggtcgcaggggtctgttctccgcgctcgtctaaacggttcggccatgcggccgggaggaaggtcgttgggtgccatganatcggccttgaatacgtaaatatcggctactgttaggagtagtgttc

SEQ ID NO: 8937 - DNA, 1075 bp, Homo sapiens
  misc_feature (1)...(1075): n = A,T,C or G
gattgncantgcagacgacntcnttncttaattataccacnncgctacagcggaagtctcgtgggcacatgcgatacattactctgactggatcgaacagcacaaggacgtcgtatcgtgtgcacattatagcacccgcggcgacacgtacttgtagccacccttggtngngnagatgcgacgtaggtcgaacagagtgtacatatgagtgcatgtagtacgctcgcaacaagggcggccacatgactacgatggaaccgtggtnacccntgactattgctctattacgtnttgcntattcaattgtagcgtttatatctttgcgggagtcactcagagcgatagatagaactgtaaaagagtagatccgtctgaagcgcacatcactgtattgcgctagacggtatttcgcgcaatgcttgtcaacaacatgaaactatcaccatagactacaaccctataccaccagagactggtaaccaaaatggtacaaagatcctaagacactgtttagggacatatagtcgactggatgagaacttttaggtggtgataagtgtcccagtacaaaaaggatgtatactgggaccacagatagaaacggtatgtgttgtagcctcgccttactttgtattcggtggcacttgctgggcctgcgggcaggaacaatctttatggtaccttattatgaaacataattccgttcaattatctacttaataattcatgtgcattgagaggggagaagagctaacatatcttctattcacttcgtttggcccataggaggatattgctaaacctccagataagaggattatattgccttggggcttgtgtttatgacttgccggaaggtgagccctttggaagtatttgacaaaaatatcatcccatcggtacctactcctctcaaggggaaatattaggaaacatctggaagacacgtcaccctcaagaacgtgcataatatttttgcctagtactaagctctttccatgaactgtaatttctataatgaattaggttgcgaaactggaagttttgatatacggctggataccacttctttgtg

SEQ ID NO: 8938 - DNA, 1552 bp, Homo sapiens
  misc_feature (1)...(1552): n = A,T,C or G
aggagggnnnnnnaaaanggnanggnnnannaacgnnnannnagannaagnnaagaaaaaagaggaaaannaaagnnaagagaggnnnangnannnanangaaagnnnaaannnnnntaannngaggnaaannnaanannnnnnnnnnaaaaannaaaaattttacgaggnnaacangagagtaaagaaagagaaanntaaaaacagagaaaganagaagagaacgnannaaaaaagaagaaaagcattgagaagaaagagacgcgcganaaaagggagngcaagaagcaaggagnnnaagagagctccgagcgaaacacgacaaagaaccaacgccaagacgccgcaccacaagaanaacacaacgacgcccagacacgaccacagacacacaaacgagaagagcgaagcggcagggaaagagaggggcaggaggacgaagcaaacagagagagaggcaacnacagacggaaaacagagaaaagaaaagananggacaggagtgagagaggaagaaaccacaatagagacaagcagaagaggcgcggcccacggagaggcggacgagagacgcagaacacaggcacaaacacaagacaaaccgcaccagaaaacaacgcaccaaaccactacacgcacacggcacncaagaggaacacaagaagacacccagacacacgaccacgtcacaccaccacacgcacaaccgcacagcacgnccacacacaccacgacacccacacacacacgcccgcgccacgcgccggcgcagcgcgaggcgcgacagangcggaggaacgccacncacgcgcccggccgcgccgccacgcggncaaccccagaaccaacgaggagcacggagcgagagaaagacacagtagcgcgacagacaggagcgaccatgcgcagagatacgcgcacggagacgcggcacgcggcccgagcggcgcgcagcgcgcggcncgcgaacgcgaacgagcgcgagcggagnccggcacgcggagcggcgagcanacgcgcgcactgagaagagcgggcgcagccgcgaagcgnaagacgcacaacacgagcacagcgtaagcaaacggccgcacagcagcgagcacgaacgagccggcgcgcaggacgcgactcacacacaccgacaccgcgagcgacgncgacacggagagagcacagcgcgcgagagccgcgacagacagacgcgccagacacgcggtgcgcngcacagcacggagangncacagaggcgcgacggcagcacagaagcgtcgcgccgcacagcgcatcagcgagcgcggcagaggcgcgagagcggacggcggaggggncgcancaccncgacacggcaggacgagagccggcacagagcgccngcgcagaggaggagcgcgccaccaccngcagccacganccacgaggacagagagatgacgagcgagagacaacagagagacgggcgaggacgagagagacgcncnacgcgcacagacgcgcgaacgagctgcgcgccacgtcgacggacgacggcangagccaggagagacatagg

SEQ ID NO: 8939 - DNA, 810 bp, Homo sapiens
ccgctcagaagcccagagtgctgccctaaagctactatgtctcatgtacccaatctctccatatatgagtgtatttaagctttggacccttccagaacaagtccacatgtgcaaccaaactccccctccaaaaaagcctcaactagtctaacttcaaaaaaaatcaagtcattctactcttcataaaacctctaccaaagatgagattcacaattatgtaaacgtttatttgcacagaaaatgcttaccaaaatattaagtgtgagacaacataaactgtttttcttcttgggcttatcttcctcttttgcatttcacacaatcaaatttttaagagttttacaaagcataataatggcaccagcaatgctgaacacactcttttgagagatactgaacaagttgttgggacttagatattacaacaaaaaagctcatttatgtatactttaagagttttaacaattttgtttcttaagcgttttaacaattttagttctaaatatcttttatatgcatgactttggaattttcaggttttggacaggataagtcttaagacaaatttttactggatgtttttctaccactttagcttttgaattaacctgggagtcaaaatatcacagttagggctctgtgactctgatgaacttcaaagagaactggatgtaggaaatgctacagcagctatttcctagctttcccgctctagcttattaaaaaccaaatagtgtaagccagaacaggaaacaagggggaagcctcaggaattgacaaatcaattgggccggattgataaggctgata

SEQ ID NO: 8940 - DNA, 874 bp, Homo sapiens
gggtgggtcgacaaacaagatgcatgcatgaatctagcgtcaattgtgtacgcaccgcatggatcgctcaaatcctcacatatagccgtcaggtataattatactcatgacttcgattatataccacattcctaatagcgccaatattctatacagtaaacgtcaacggtgtcagcgcgacaaagtatcagtcagtattagaatattataattaaggtggcgagccacgtgagcaacggaatatagatagagtaacaaatatcaacaataggggggaattaaacttgatacagttttaaacaaaacgccggtcggtagttcaaaaacagatcattcatgacgatacacttgatggcggattaattaggagataagaagagtgataagtaagcatataagtgggtcgtcacgaagaatactgactaggattcttttgggcagaatgagaggcggcctagataagatgcggaagcaattgggattgcacaaaaatttttagctgtcgaatcgaaaaatcgggtcaattctcaatagctagatattagattatgatgagttattctttggatggtacaggcagtctactatcctgagttgacccacagtcggagtattattcaatgtgccaatacgtggttttaattctagacacaccaagaatgattcaaatctagtaagtttctcatgaccacaaatatactgggtccgttttgggtgccttgagaatactcttataaaatgagcctcccaagaaagctccagccagatttggacaaactctttcccctgcattgaaaccaacctaaagaactaaaaatccacagaatcacttattgcttctttactttgaaataatggaaaaatgctatgctaa

SEQ ID NO: 8941 - DNA, 898 bp, Homo sapiens
aggggtagagcgaatccggttggaaggtgtgtgtaaccagaaggtccaggcggggggggcgacgcggttcgaatgaagatagcccattcggcgcgcgagcatccagcagtgagctacagaggtaggttagtgccctggcgcgctaaaacccctatccaatggattagggctcgagcgcctcacattgacaagcggtgtatcggacaacaatctacagatgcgcggggatgatacgcccactagacgaatcgaccagctggcctttacagcccatttgccaaacagctggggaaccccaggacaaggaacattctttcatcacagcgtggacattttccaggctacaccactcggtaggtcaaaaacaaagtctcaataaatgttcaaaaattgaattcatatcaattatcttctgaccacaatgcaatagatctagcaatcaatagcaagaagaacttaggaaactacacgaaatacatggaaattaaatcacatgctcctgaatgaccaatgggtcagtgaagaaattaagcaacacaacttaaaatttcttcagataaatgataatggaaacaacataccaaaacttatgagatacagcaaaagcagtgtgaatagggaagtttatagcaattaatgcctacaaaaaaatagatctcaaataaacaacttaacattacaacccaaggagctagaaaaacaagaacaaaccaaacccaaaacaagtagaaggaaagaagtaataaagctcagagcagaaatacatgaaatagagactaaaaaatacaaaaacaatcaacagaataaagagctgattttttgaaaagataaacaaaactgaaaaacctttaagcagaataagaaaaaaagacacaaataaatgcggaggcgtcctgag

SEQ ID NO: 8942 - DNA, 400 bp, Homo sapiens
gacatggatgaagctggaaaccatcattctcagcaaactatcgcaaggacaaaaaactaaacacggcatgttttcactcatagatgctgtgagaatgggtagccatcgaaagcaattctgttcatcagacaagagttcttgctatttacaccacatctgcagtgacttcctccactgaagtattgaacctttaaagtcatccatgaaggttgaaatcaacttcttccaaactcctcataggattgatattttgacctcctagccataaacgacaaattttctgaatgtcatctaaaatggcaatttttctccaaaaggttttcaactttgcccagatccattacaggaatcactgtagcaaatatatccttaataaatgtacttggaaaatagaaaaaga

SEQ ID NO: 8943 - DNA, 1943 bp, Homo sapiens
  misc_feature (1)...(1943): n = A,T,C or G
gatcgcgtatgatatctatcgtataatgcatcatnctcgtcgactagcantnctactggtntgnacgctngagtctgacgtgctgcgngcgtnctcagcgcgncatgnatcacgngtctcttctcatncgtnangcggatcgcactcgactcgcagtcagcgcgtcactagcgcctctttactattcgcatacgtcntaatttgacatcagctnctccactccatatncggcactgacgactgcagtcgctanacancgagactatgatgtgctatgcagtctcacttcngtctacacgtcatatactctgacagggggcggggggctagtgtatgnaggtcgtctgtgatngcaagcaatcatataccaactcacgactctgcgctgctctaccgatacngtgagatcagtatctatcacactactctcngccggcgatctactgcatctntaagtatncagacagtatcntcgcaaatctgatcgtatcatgatcatantgagtcgatatnancgctnctgntcccagcgagatngnactgngnatacgtcgatcgacnctgatgcagacctcncncnanacgctgatagcngnatgatanagagctctcgctgctattcnctgctatactaatatgtacgatcatcctgggtagtgcnctcncacgtctntcgatgactaatagtctctgtcncngtggtcgacaggagaccgagggttgggtcgcagtcagtacgatnacacactcatcacnctactacgnagcacnatgcgccgactatgagtctcatctcgcntgctcagcnacaactgaccancnnatatacgatgntcatnancgtcgagagcagcnactgagcnagctctccagaagaactgtcgcacgacatatgnctgacgcatngntagtcactacgaatcgtgcngctcgcacacttcacaagncnactctcacantagtctctggagacatganaagtacagactatcgntcgntcgcagcgnacagcggaatantactntgctcactcncgatgcgattcatagtaagnatantcgatcgatgcgacgtactctgctgcgtcantatgcgattnacttcagcttcactgcgtgcctccgacaagcatcccagcatacagtcattgattatgactacnatgtctatcttaataatgtacantgacaacaccgatccncgcagtcacacncgtncgtagcntanctgtcgtatccgcagtccgcactagcgctactacgtcgtanactcnactgcactgccgaccagcatatgatcagctacacacatctacncganactagtcatcatcatatctantgatatagcttgtactatcattctcatagtatgatcgactgatcgcacagcatcgccgagacagactcgctatcaaatcatatatagcagctacatagccacttcaagctcactcatcctaccgcgtctactcgagtgtgntcgtgccgangcgctcgcacacacagcgcgacgtagtcacncntgagtacgccagctnttgacgctcatataagcgacgatcgtgctgagaatactagcaatacagcagctncgctctcgcgctatatgctgtgatgcacacatgcgcgcacnantgcgtctctatacgcagtatctacatccatcgcacntctgcactatcagtactgacatggacanacgtatncgccgaatcatacgcgantcgagcatcatctantganccgacagtnagcntgnangntcgcgacacntnatctctaccagtatacgatatngtagtcgattcctcntctnttntactattatactactacactgtcntacanacatntactgcgtgtctttctatcactatatagtcgcgatatagcacatgtgtcagtcgcatcgcgcgcgacagcatcacgtgcgatcnacgt

SEQ ID NO: 8944 - DNA, 1139 bp, Homo sapiens
  misc_feature (1)...(1139): n = A,T,C or G
gaaagaagaaccgctgtaccagacgacaatccacacaccccgaccccccttaacagtgaaccacccatcaaatttgtccccgatacgcgtgggtgcaagctccatctcaacacgatgcaagccaatgagctaacgggccaagacggaaggagccgagatccgatgcgatcaactgccaactcacgcaagccccaccgccacccccccacccacacaaagcgagaccacgcccctaggccactcgtccgcagccgtcatactagactagaatagtacgagacacagatcaagagagaagtgggacgcctatgtagtccacgcccagctacgtcaacgtctataagagaaagaaagaaccccgcgcgtcccggcgctgggtggagtccagaaccgccgggagtaatgtcttaggtcacgatatagggttggacgcgtaggtccaaaagtgagagggcggcggcgatccagaaacctgccagcagaaacagaagagacaaaacaacatcatcccatatggaccagcaggaagctaattaagagggcacgcaaagaccagttgccaacccccgccacgtccggccccacattccgtagacgtgacgcggacgcgtccagagcgggcgggaataagcgagccacccgtcacggggcagaggggctggaagagagtgggcacttgtaatccacancccccacacgacacgcacagaagaacagacacgacgccacctacctacctctctgccccgtaacatgaggtaaccatcgccacaagcccagaagcgacctcatagaatcatactccatccgagcgagagcggtaacaacccacgaaacagaccgataggagaggaacncgaacaacatatcccccgcgagcgccgaatgaacgagtgtggtgtacnccacgacaccgcactcatctctgcagccgcgatagagcgagacgtcgtcagggtcagtcacagagagaggagggagacgaagggcgccacctggcctgtctactcacggtccgctcacagcagttctcgtcaccgagaccgcgaaaagctcnccatcgcccgaccgccggacgctacgcgctgtgctccctgatggatcctgcgagactcgcccgacgaatgagaagatgnagg

SEQ ID NO: 8945 - DNA, 399 bp, Homo sapiens
gaggtggtggttatacgcatgtaaggaaaaaaaaaaacttccgtggtcacagcaaaccagaaaggttacattgaagcagccatcattgacgtgccaggcgcagaaggagccgtaggtactttcactttgatacattagtgcctgggagaagaagccgcaggtgcgtgagaccacaagaggacatatgatgcttaccttttacgaggagctgagaggagcatttgtcattaccggctgtcacatatgactattgaagcatctagccatctcgagagagtagctgatatacaagattgtctggcatccttagcgtgcaaagacgtacatgtgtggacttggatgaggatatcagagtctgtgaatgggaatgagaaaaactattggtctccttagctctca

SEQ ID NO: 8946 - DNA, 236 bp, Homo sapiens
agatatgtatctcaagagcactccacaacaaagattctgcctgcaatcctccacttcaaggtctgttccaggaaacctgtgtaacacagttatgcatagagtggtcttaggaagctgactctaacatgaaaatttagagttggatcttttgctgacatattgaatattcataagagcatatgatacatttgtctatcataaacatgtcatttcaaaaaaccctaaaaaaaaaaaaa

SEQ ID NO: 8947 - DNA, 1835 bp, Homo sapiens
  misc_feature (1)...(1835): n = A,T,C or G
gccccagttcggctgtgcctcagagcgncgtacgagatgtactgacctcgtgtctagttggcgttgcctnaccaccagcgatctcatagctcgcgcagcgaggcactaccgatacgcatcctactactcggtctctgtgtcaacggggctagcttgatgataggctnatactggtcgacaccgatcaggtaatactagacgaatctcctggcgatcacagtcgatgagcagaactgtctcncatcccttctacncgcatgtacgcgtctaccgcgatgacttacatatgtctatgcacggnnctagtcgacatagacactcgcattgcaactattagatgcatagcataagcgntatgatcgacagtcgagtgtcaggtgatcacgtctcgccacgtcatgtacttcgcgatcctctcgcgcatgcgtccgnagtgcgntgacgtgtgtgcgatcatgtgagcacggcgctcagctctcgtcgatgtgctgcgtgcagctgacgcagtgatggctgcatagggnctgggctcagtgcgncgtgcagcactggcctcgtcgnaacgcgtatcgcacactgtctagaccgcgtctgtgatcccagcacacncatgacgtgtacactgcaagtggngctgagtgttacttcacgcacatcaagttgtcaccgcgcgtccagcgtcatgggccgtctgtaacggcatgacgtntatccttgcagantcagtcacgcgatgtcgctcgtccagtctgagagtatgtgaattntatatgataggaggcncaacnacacgccgcgtcgcgtagtcgacgctacgcgtggacgtgntgtctctatcatctcatgctgagctcatcagtgctggcgtactctgcagtatgcgcgntgcaccgcggcgtgtcagtnagtacagagtcagggngcgatactgctgcccactgcgaccgcacncgtatcatatttcgagttgtgcagtacgacacactctgctagcantcgactcggacgctgcatgtgttgagcgtntactatgtaagtggagatatagtccgctgcggtgccttctctatcgcggtcatggtagactncttgtgcgtgatggtgtgtcgcgagtctgcgcgcnctctgtgtgatantgcggagggtatactctacgtgacacgagtcntcgcagtntggagcgcgttatgacgcgcgtactacgatggtagcgtgggagtgtctgatggtancngtgtcgantagtganggtaccagcgtatcgctcgcactcatcagtggtggcgagcatgtgtcncncnttcngnccgcgacggtcgtctcgctacgcgacacngtgctgcgttgtcgtcgatgtgcagcgncagcgtcggtnagagacactgcagtgcancnagtcgcagacgcacatcgttctctcgtcgatctactcgtacgtcgcggtcngcgangataattnctgctgtgtcgacgctnagctacgtcgtnntctagtaaccgtagagntcnagacnacgtagtgccgtgtgtcctcggtgatccgtatcgtcagctgctngcactgtgtgcnnncaatcgcgagcatgctgacgcgcgacctgacgtggacgntcncatgacgtatgcactccgttgtgatatcgtcggaagcgatatatgcgcggacattgnacgcagtntgcgtgagncagcgagcgantgtgcangtgtgactatacggacgagtcgtncatacgtgatgatngtactnantcatgcgatagcntgagcgtcgngactcgcntntcgtgcntcgtctgngctcngcttggcgctcgctangntggcngntgact

SEQ ID NO: 8948 - DNA, 1742 bp, Homo sapiens
  misc_feature (1)...(1742): n = A,T,C or G
tctactgtatctatatatctgctagacgtctagactaaaacgctgtgtgatagnagagagctgctaagaccagacattgtgcacgcagactagtnangaacagtacgagatatgatggtatgacgtgccgncacatacgtgtagtctatgcaattgtaccgtgatgatcanatgtgagcgatctatagtatatacgtatactccgatttaatacatgtgctctattgaatgatatatctatggtacantacctactgtgtctactcgtgcgnagcttagttcgacagatgctgagcattgcactgcgttcatgcacgtgtattgtgttgttaacgctcggcatctactgtatatgttcgacgtcgacagatgagtcgaaggcacgtcgcgtctacgccatnacagtaggagtatcagtgtangagacgcgacgatgaangaananacgtgtagatagatcgtatagtactgagcgcctntgctcgcntggtgtacgcagaagatagagcggtgagagcagtgcgcagagctaatgacccacggcgacaacactcacgacgcacgccgcgatagcatctattctatcgtatcactatgagctttccatctacgacgtgtntatatcatctcatgtgtctatgtctgtgctttcatcgacatcagatcgtctctgtgctcgattcatcaactaacatctctagctcgcatcaacntactagtcctgctgcacaatacaacaacttcccgactcggatacgatgatcgtagtnagacataataagagcgacgtacgatcgncagcgcatgtcactggtcgtaactatgtctttattacttgttacgtgtgtgctcctagtatgacagtntattctgtcacacgcacgaacgccgcatataaatcatgcgttattcgctagttctgtgtgcatcactaatcatgtctcttctcgcgcgcgtatgtggctctcagctcatttgtacaatagcagtagtacactgatctcatcctcacactcgtacttcggtcttagacactcatactggctcctgagtgtgcgtgtgagtgtcttcgctcaacgatcncattcgttagcatctgcgntagatctcgacgtacgcgtgcttatatctatttcgtcaatcgatacactcgacactacgtcgcgctatctctgtgntactgttacacttcgacacntctcatgtcacacaggtggaactcatagtctaaaagcggcagagctatgataccggatacgacgagagagtatgcatgagtgacgatacatgaaacgngctagagtgatataagaagagatggacaatagtggagangcatacgtgtcttacacgattgtcgtcttatctgattactatgctccgcgtacactgaatctgacacatactacctctgctgtagtgcgtacagtcatgatatcgntgaacgacactcgtcactacacgcgcgtgcatgatctagcgtcgcactcgcagcgcgncatacntaacatcctgtggccgtcatctctcgtgatgcgatgtatgcaactcactccacgatncgtattacagctncagtcagcaagcagacngacgcgagatcaagcgtacgtaggatgtacgaacagacgacgcgtgaccntcgcgttctacacgcaacacgcgtctcgcgaaacgcacacgcagacacatccgagagacgagtgcgacggtgtagtatgagagagacgcgaagtgagaag

SEQ ID NO: 8949 - DNA, 1236 bp, Homo sapiens
  misc_feature (1)...(1236): n = A,T,C or G
gtcatgtgatttgatacacatgtcctcagtatcntatactcataagtgatcacatgagtcaatacatagtaattggcgcaacggcattatgacatctctgcgtgtgtcaggtgtaggcgtatncgtcagatgctgtcaacgacgtgcgatacctacatatataatatagacgattnnncactgtagctcagtcgcgcatcacgcctataagtgaatgattatgttgtcatttgtggtcgtgnatgtcccttcacgcgaccagcctacantgactccgtatagtgaagcgagtcagaccgtacgtacgtgccatcagtcgccaactgatgcttctcagactcgtacgcgagttataatagagatgctagtaatagtacgncacgtgagtagaggacggcggagtatgagtacatgccgtgcacgcgagtgaagacaacgaagatcntatcctcagatgtgatcaagtcgctaatagtcgcgcacccagagtgtgtcagcctcgcttcatgtgagacatcgatattgatgatgtacttactgtacatcgcccgtgtgcttagccnatcttcttgtacttcagtctggtccgcacactcctgctactccagcttcataaggtgatgagataagataaattgtagtctgcgatctttatgccacttctctcgacatggcgagtagcgtccgaagatcatattctttgctctaataatgctcgataatgtctcgagcgttggccaaccccgtcacgacactcctatctctccagcaaccgcatcgtatcagtcgagtctgactccgcacgagcgcaaagatcgtccagcatcgtacgcttattgatacgatctcaactcgacaaatcatcatcctatagcaacactctcgcatgcgtcncaagctgccctgctcgtgctctaccgtatgcggacaatgagtgattgtacgtataaagtggcaggcccacactccacacgttcgctacagcgtcttattagcgtacagggtgcttgtcatcagcgctctcataacgacatgcgctcgcgatgtaataacgctgcgctcgcccacgccgtgttattacgggcgcgcggctatacacgtcgatacggagattactgtatgtgaatggttactgtgttgactcgtaactncgcacaatacgatncgaagganccacgactactcgcagcgcgcgcatccgactgtgcatcgcttgtacatctatgtctagcgtct

SEQ ID NO: 8950 - DNA, 1102 bp, Homo sapiens
  misc_feature (1)...(1102): n = A,T,C or G
cccccaccccccccccgccccgaccagagcactccagaaacagctttaaaggaaacaaaaagaacccagctttacgaggcaggnaccaaggccgacgccaggaaaagaaagnaaggcagaagagagacaaagccaccacgggcaggggacgaacgccccaccggacgcccacaacaagnaccacccagaanaagaaccacaggagagacaagcaccagcacacaacaagaggacccaaccggcacacaacccccaccacgaccggacgaagaggaancgaagcagaagagtaagaaccagaggacaaagagaagcgcaaacacaccctcaagcgaaggacagcaccgcgcagatcagaacggccgggggcccagggaagagacacaccccccgaggggaaacataacagacagccaggaggacagctacagacaaaaagagaacaaaaaagaatcccctcgcaacaacacaacgcacactccaagacacgcacagcgaccaaacaccacccaaatcaaaaagcagacagccacggaagccacgacacagacaccacccgagggcgcaagcgcggcggagcaggacagccgccagacgcatcgccaagacgacgaaggaggcgccagagcgggcgaaagccagcgagaaagagacagcagcggacnccaacagagcgcggtgcccccgcgacacaagccccaccaccacgcagcgacgacnacgacgcgaacaagggcgagcggccaacgacgggacggggcggcaacgacgcagggacggccgaagccggcgcgcagcacccccgnccgcgagccgccggcgagacgggacccacaccccgccgcggcgccagagaccgcggcaagggaggaagcccgcncgacgggcccggcgcacacgcgccgacgcagccagggccacgacacgggccgggacgggacagccacggacggcagaggccncgaaggagacccagaacggagccgcggccgcaaggtcccgcgcagctcgccgccagagtaccccggccgcgcgganntccgcgcacgcgagacccccagagcccagccgcaagaacaggcagcaggaccagacggccgga

SEQ ID NO: 8951 - DNA, 1375 bp, Homo sapiens
  misc_feature (1)...(1375): n = A,T,C or G
atactacacacgtatcacatgactctagacattctcaagcgataaatntatcttatgtcgtctcggcgatctgcagacacaatactttctagcagattgaaccttatccaaccttatctgaattattttactgtntacccgatcatttaccacttctctacttttatctctccatcaactccaactctacatactaccatcacatcttattcccctacgagaggcgcacgtgatagcacgcacgtaacataatactctcgagtcacctatattagtaagcattttataattaccactctatgagtagacaaaccaggtgacatccatagtccctatctcactcttgttaatttctgcacacattacatcgtcatctccttcatctatctatgactattgtgtctctcnttctcaccaactcatgatgatgccgtctattccagctgattttgttcaatgtatgcactatctattctcaagccgtgaatgggggggggtgactgtattttaacgatcctccccatccacataaataaacacatggtgcccttaagtgtcaatgtactacgagcgtctgacatcctgacacgcaccacacctcgacgtcataacccaacaacatcaagattgtgagtgagcctcgaccgctcactcgtacagttagtctctgacttaacaaccttgattatacacctctaattttctcatgaacagatttcattaacatttacgcacttacatttcantccacaatacattatttatacttatcacaactaacgtcgtaccctcatacattactcaacctctcgcagctcagtcgacattgttctacaatacctctcaattcatcatatgaacacagtattgaatcacactacgcatcaccacggccttagcagcatattattctacgaccacgaaatcaaaccacacactgcaaagcgcgacatcatactatacaatcaacacgcccgcgcacaaacctacttnactatattatacggacgtctaattatggaagctaagctacttcacgttcatcccgtattcgatcttcacaatagtctaatgacatcactcttatctctcatctcctcacctcttaatattaagctcccgaaagtctgtccataccgatacctctcgcgataaatcctcgcccagacacgcacccgatagcgaattatctctaaatccacaacgcaaacaatagttagtactaacgcgtgatacccgcagattgacgcgggtgaccgcacatcgccatatctgacgcgctacacttaatttctcctctatccgtcctctacactgagttaatcttactatttcgatccttatacatgtgtagtataattataacccaggtcga

SEQ ID NO: 8952 - DNA, 1144 bp, Homo sapiens
  misc_feature (1)...(1144): n = A,T,C or G
gcacaccgccaaccaccgccgccagacccaaagacagggnccaccacggacgccggttcngcgcggaagacgtcgagccaaacaaacggtttacagacgccggcaaaccggagcaccggnagaggaaggaggcgaggtcacggttaacgagaaagagcaagaggaacacaccagagcagaagcaaacnaccccgccgaccaccgagaaaggcgccccacgccccaccgccacaccgagccaggcccagcaccgcggaagcagtcaacccgagcgacccccacaaacgagcacgcccccccagcgagccgagtcggcgacggcgcggcgagggaaggacaggccatctttttcgcacgcagagtccgcccacgccacccaagggcccccgagccacccgacaccgatcgacacgccccccgccacgccnncacggagacggacggaaccgagcacacaatacgcggaggcgagctgtaccgaggcgagccagagggcaaggcaagggtccgaacgcgaggcacgcccggcccccgaccgtagccaaccagcgcgaccacacacaccccaacgcacaccccccccaccaacacaggccacagagcggcaggccaccccgacacgggcccgcgcgcaggcgggccgccacagcgggggnagggacaacagcgtacggaaggcggaagcagtgtacgggcgcgcgcggcgcggccagnaaacacgaagtgcagcccgcaccctacatggcgcgcgagcagtggaggcctcggctgactacagccacgcgcggaagaacacgaggcgcaccacacgacaggcgatatacaaacagcacccaaatgcaggctgcgaccagcggcgcagcgcagcagcgggtccctgtccagcgcgtgtcgcacgcgcgcgcgacactacgaacgaagaggcncctaaacgaagccgacaggcgnaacgcgtgacaggaccgagcggcgcgacgacagctggagcgaccgcacgcgccgcagcactccggcagagacacgcacggcgttcgacgcgcccccgagcccncgcccagagcagcgagcagcgnanacacccgacggccactccgggtctagcacacagacggcacgcgggcgcaggtgcgcaacgctctgacgg

SEQ ID NO: 8953 - DNA, 154 bp, Homo sapiens
  misc_feature (1)...(154): n = A,T,C or G
ccacgcgaattagcatatggaggtctgaaatgccgggcgtcacaactctttacagagtcggaaaacttcagcgactctatcaaaaacancattcggtttttccgtaatgtcaataaatacaccctctgacaacgatctgctcctttcacccccg

SEQ ID NO: 8954 - DNA, 1117 bp, Homo sapiens
  misc_feature (1)...(1117): n = A,T,C or G
agaacaacagaaagaaccaagataaaaaaaaggagcaaaaaaaattgttttgaaaactnnaaaaagggcccttnggngngggnaacaggggggnggggggggaggggccgcggcgcgcagccggtttcggcagggcccgcgcacaaggcgaaccgggcggcgaggagacacgcaagaacgcancaaagcgaaaaacgacaaaccgaacgccacgaaggaaccgcgaggacaggaaagcacaccacccaacacacaacgccgaaaacgacgaacagacaaaaacaaacacaagacagcggacagaagcagacaaattttttttagaagaagcaaggccaacacacgaaaacgagaggggaacgcaaggagacaagagaaggagagcaagaggacacacgaaaacaaagccaaagagagacagcagcaaaaacaaacgaacgaaagatagagaagcagacaccccaccagcaaaagaccaaagggacaaaagagaacggcaaaaaacaaagacgcaacacaccgccgcaaagnagcgaaccanaggcgcgcgagaacgcgacgaaccgacggcagcgacgagaagagcgaacagaaagacggcaggaacaaggagaacgcgaaagagtgaactaaccagcgagccggccaggacgccgggagcgccaagatggccggaagcataacgagtatgcaccgaatccgtgagagcgcgaaggtggcgaggaggcaccaaatggtaggagcgagcggcgaggtagggatgatgtaagcacgaaggagacagagacgaggacaataggtacatcccacagaccctgcgccacgagagcacgcagtggacttcataaagaacactatccagcaacaaagtaataagcgaagatgacgaatgtacgcagcccatgaacgtagaaaaacgaaaagatnaacccgctcgaaatcgcgaccggcatatcgcaacagagacagagatggagtggtagcgaaccatatagaacgaaaaaaacaacacacacaaagaatagcgaagacgccaaagcaaccttgatccgaggtcggcaacgtgaggttacaggatggtaaaatgcggcactcggacaggacacccgtagaaaag

SEQ ID NO: 8955 - DNA, 825 bp, Homo sapiens
agaaacgcgaggcgacaccccgaggggggggggggggggcctgggggaaacagcccggttagcggggaacgcgcacacaaggccctaacaaggaggacagcgggccaacagcacgccgccagagatgaagaacacaaagcaaaccggccaacgaaacaaccacccgagggacagaagcgaacaagcccccgcggcagagcggagaacaatgacacccacggcccgacagacagggtcattttgctggacggggggccgagagacaaacgggaaccaagccacgagcccgtgaaagcaggaataccaaccgggcaaaaaacgaagcaaaaggcccagaggggacaagagggggaccgaccaccgccccagcccaacagcgagggagacccgacgaacctcacggaacggacgcaaataaacgagaacgacgcggcagcgggcgagccggcacaaggccccgcaggggccgggagaacgggccgcaccagcccacagcggcccacgcagggaacacacagggaaccccgaaaggccggcacaacggcaacgaccccgaacgagcggcaaaggccggaaaaagcacaagaggagcgcgccaaccacggaagcaacacaaccaccggcacgacagagcgcagaggggggaacccgaacagcgcgcgaaagagccgcgacccaaaaaccagggaagaagcaacagcacagcaccggcgggaaccggacggggagacgaaacaagggacgggcgaaccccacagagggcagaggccacaacgcacgccgaacaaccgagggcggcaccaccgaggacgcagccgcgccacg

SEQ ID NO: 8956 - DNA, 209 bp, Homo sapiens
  misc_feature (1)...(209): n = A,T,C or G
acccgcccggccgacagcgcgcagacgacaccccccggggaagaccacggcncaccgatgcctgcgctagagangacagccaccgcccaccgccctgnaancngaagaaagaaccccacacgccacacgcgcccgcccaacgccaccaaccgcccgcccccccctcccacccccgcggacagcaccaggcggcccccgcaaaaagaaca

SEQ ID NO: 8957 - DNA, 303 bp, Homo sapiens
cctgatcactcattgcagaagaagctcactgccatgccagaggggcactcaaacagctctgcaaggaagtccctgtgataagcaactgaagactctgccatcggccatgagagcaccaccttggaaacagattcttcagccttagtcaaattttcagaagactgtatgtccagccaacttcttgactacaatccctttatagatcccaagctagaacctcccagctaagccactcctggattcctgaccctgagaaactctgtgagagaataaatgtttattcttgccttaaaaaaaaaaaaa

SEQ ID NO: 8958 - DNA, 1056 bp, Homo sapiens
  misc_feature (1)...(1056): n = A,T,C or G
gcgcgcgcgcgaggggacaggacgggcgccaggcgcacaggagcgcggaaaggagggggagggacctcgagaggacgaacgaggggggcggggggttaagggaggagggagaacaggaggcgacggaagaggggcacaggagagcggaccgacaaccaccaggagagcacgcgaacagccccgaccgaggcggaaggaacaacgggggggcaagcgcaacacgagccaggagcggccgcaaggacgcagcaacgggaaagcggcacgcgccacgccaccaggcagccacgcaacacacagagcgcgcggacgccacacacgccaacagcgacaagacagcgtttaaacgcggacgcggcagccccggggcaagagcagagacgagaggcgacgcgcgagaccgacagcacagacgcggaggacgcgcacagcagaggaaacgcaacgacccagagcgaacgacacaacaccgaagcaacgcgaacaaacagccgagcacccgacccgggaganagcagcggaagagagccgccaccaacaacgcaaacgaagaaacacgagcgcgaaacgcccgaggcggaagcccccgcgccaagaacgccaaagcgggcgaacgaaggcaaaaggagacacggaaccgcaccgcgagagacgcggagcaanggcggcggagagagcgcgcgagcacagacgacacagacgcaaaaagccaacgcagacaaaaacgacaagacacgagaagaggacaaacaaaacagacccgaagaccggggcaggaagaagaagagggcgcaggggcggaaaacacgaaacccgaacgacacggacgaagacagagaacgccagcaagggcacgagagggagagccgacagaacgcccgacggaaccgcaaacgcggcgcgacagaacacaaacgaccgagggacaggagcgggagaaacagccacaggaagagacgcacgggagagagaacgaacaaaaaacgccacaccccaaggccaggcagacgcgcgacaccaaacgcccgccggagcccgcgccgacagcaccaggcc

SEQ ID NO: 8959 - DNA, 655 bp, Homo sapiens
  misc_feature (1)...(655): n = A,T,C or G
gaagggctgctgtacacctcctgctccagctttactcttcatgatgccctgctcgtttctagtcggggcacatctcacactccatttgagaggacttcaaaaacaacccaccagttcattgcatcagtggcccttcatcggttactcatagaaaatattccagattccaagtatgtcaagaatgcatttattcttcagggtccaaaatataaatggattngngctacatggtgggttgaggataagnncctatggctgncagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatctttccaacttttaaactttatcacttgtgctcacttatgtagaatgtataagtacattttgagtccaaaatttttgaactacttcttttgggtagctgatttcatggataatattatttagagtaatttgatgtgatgaaacctaagacagagcaagcacattggggaaagctttggtttatgaactaatgaaaaagcagaatgaaaaaaaaaaaaa

SEQ ID NO: 8960 - DNA, 1300 bp, Homo sapiens
  misc_feature (1)...(1300): n = A,T,C or G
agggagggcggaaagacgcagaacagagaaagaggcagagagaaacccctgcntctgtnnaanncgnngaggggcgctcnggggggaggaaaccagggagggaggaangaggagcgccaaacgagaacacgccagttaaacagcccgacacggcgacaccggcgcaccgcacgcagcacacggggcgagggaccccaccgcaacgagcagcacaaaagcgcaggggagcgacccaagcgcgagaacgcgcgagccgcgcgagagagagcgacggagacacgaccgccacagcgcccacggcgcnaacgcggagcagccggacagcagcaaagaaccgacgcaagacaagagagagcaggaggaagaacgagagaggagaggagtattttttctntaggagagaggacgcgaccgcggaggaggacgagagagagcggaggcgacgcgccacgccggagcacgacgggacaaccgcaccagcacccggcaggacacgacgacggagcgacggggagaagagcacaacacaccgcaaccgaacacaccgcaagcgacgaaggacgcgccgcagcacacgcaaccaagacaaagcagagacaagaccgacagaccgacacggaaaacaggaacggacacgccggacagcgagaccgcagaaccgcaacagcgagagacaggacggcgcgaccgacgacgcggacacgagagcgagccanacgcaagaccaccggagacgagccaacgacaagacgaccaagcaacaacacgcgacgcgccaagaganagagnagacaaagagagacgggagccgcaaccacggagaccacgcataaccgcgccgaacggaaacacaacgaacaccagaacgagacgagacgaaaaaagacaggaccaacacagacgacgggcacgccacgaggccgtacaagcggacgagcggcccggggagcaccaggaaacgacgagagaaacagaagagcaacaacgggcaaacagaacgacacaggagaacgagacgccgaacgacggatgagagaggcggacagggaaaacacgcaggcagacacgacgggacgccgcacggagcggcgataagcacaccgaggagaagggagacgaggagacggacaacagatcaccagcgcggaagccagagcgacgcacagacacaacgaccaacgcgagcacgatcgcgggcaagacagcacataccncatcgcgaaggcggcgacgtcgaagagaccgagggagagacacgagggcgtgagcagcgcgacagcagacgcaagcaccacacaaa

SEQ ID NO: 8961 - DNA, 1233 bp, Homo sapiens
  misc_feature (1)...(1233): n = A,T,C or G
ccccgagagcgaccaacaacgccaagcgcaacagacacacacaaagagagagagacgggccgcagcgcagcttcangagggcgangacccgacagcgggagcggccctttgaggaaggggagacaaacccagcacaaccccacaacacgcgaacccgcaacacccagcgaagacacggagacanagaacaccgcgaggagacggacggacaaagaacgaacagaaccaacaacgacacaccaacgacgagagccgaccgagagagcagacaccgacgacgaagaccggaagaccagcgcagccgcacacagcagaccggcagcacagcaaacgaacgaacacgcgacgagcagagacgcgagaagacgaacagcaccgaagccccagcaaccaaccacgaggcgaccacgcgcgccgcgnagacgacagagacgacgacccggcgagcgcgagggcaaccgagagcacgggcgcaccgccagagacaccacaagagcacagccgagcgcncgngccgcgggaaagacacgngaagacgagagcgcaagaaaagcacagcagcggacacagaagagaagccaacagcgacgacaagagcagcgacgcaaacgacagcgccgagcgacgacgaccgcaccaacgacacgcacacacacacgaggaaccaacccaagcaggcagaacagcacacggacggcccaggcggcagcccaggaccactgcgcgacgagcgcccacgaacaggacggacacgcgcaggcgcgccgatgagcgcgcggcgacggaagcacaaaacgaccaaaagcggaccgcccaccaccnacacaaaccgcaaaagcacacggcgccccagccgcacaccaacaaaacccgaacggcaaacccagagacgtgcgacgcccaaagacaggccgacacaagacacagccggcacccgacggaggcgcgcgcagaaaccgacggcgcgcgccaccgagagcaccacgacgtaacaacaagagagccgcgcgagaaggaacgacgaggccaacaccaaaaaagcagacgaaccccaccggcacaggcaacggaggccaccacaagacaacacgagagcgacagcgacacggacaaccagcagagcgacgggacagcacgcgaccagaacgaagataggcgcgaacggcagacgcagcaagcgggaccacacaagcagccgaccgcacgacgcgacgaagaccgcacacactagcg

SEQ ID NO: 8962 - DNA, 523 bp, Homo sapiens
  misc_feature (1)...(523): n = A,T,C or G
ccccctaggcccccccccccggnnnnnaaannnnanaaaattccccacccccttgcctcgtttttaatggttcccttctttgtggcccaaacccccccccttcctctccccaggccccccccttntatttctnnnccccccctccntntttnccctttttttttctcntnnncnccccctctnnccctttccctttnntcccttnttccctcccccccccctcccctcttncctnnttnctccccccctttnnnnccttttttncccccccccgggtgtggggggttcccttctttcccttttnccccnnnttcccccaataaattnnnnnncccccctcctntttncncttttcnntttcccttttccccctttnccctttnntttccctttcnncnncnnntctttcnncncnnccctccttcttccctcccnccnnnctccccccttttttcccttcnntcccccttttccccnntttcccccctctttnncncccccccccctccttttncncttttct

SEQ ID NO: 8963 - DNA, 884 bp, Homo sapiens
  misc_feature (1)...(884): n = A,T,C or G
gggccgcgagccgggacaaaaaaaaaagagggggggnggggtctccagcccagactgtgagaacagtaagttcaagatgtcagaggccaggcccccccctctgctcgggcagcacacaactgggaggctgggggggggactnanatacnatnacannnccatcngggagctgctcagcgctggagtggggggaccaacatgaaactcactgacaaaggaaaagggctcttcctcataacctcgatccgaatacactggcaaaggcaacactttgcttgggggggggggcccanttctgggaccactaaaaagaaaatttagagtaactccagatttcttacatggcatctccagaagggctctggggttaaggaaactagggccttttaaatgggtcccacggtgtggggccctaccatctttttttttcagagggaggattgcattatgggattcggggggattttttaaaaatagaaggggtaatttgtttgtccggaaaaaaaaaaaagaagatggggcgtctatcncctctaacngagagaggcgtgttcggggggtttcccttgggggggggggggaattcgagaacccggggcttaatgaactgcggtggcctggggggggttggggtgcgggaggggggatcggcgtccctaaaggggggngaggtagggtttgccccaacaagcgcgggaggagccccgggaagggaacttgtaatcgaagggtcctgcagaggggcggaaccccgaaaaaacggcgcggagtttgcggttgtgccatggggccccccccctggggtacccgcgcagaaatggccgctaatgctagagggtgggaacccctggggggtggtgggaggcgccgcgggtggcctgggg

SEQ ID NO: 8964 - DNA, 1193 bp, Homo sapiens
  misc_feature (1)...(1193): n = A,T,C or G
agggagaggaggttaggaacgatggaanatcatatattctgtggaactctccatgctgtgagttgtatcgtggtgtgcattgattaatctgttgactcttggtanagatattatgtgnngnaaagtgcgctgtggtactcttagatttgtgangatatatctatctatgnttgtgttgaatgganctagtaaatatannttgatgccgctctctcttaagcagagcatggtnnggtgggttctactgatggcgtatgaaggtactctagatttcgtgaggcgggggagcgggagaggnnggggattcacgcttctgtgtctcttattgnatgatgagtatggctgggaggtggagttagctgnagcgtgangttgccaganatgctgggtgctgggttaccgacgagcgtacgtgaagggtagttaataacaaaataattgatggatttgggctgtnnagaacaactcagaagactcggtgagtgggggaggaccgcggagtggctgagggggggngggaacatgtgtattatttgattgcatttaatattgtatgaggttatctgtgnnagtctgttctctnnnctcttcttcttgtttctgaggaacaatctcgacntnctttgagtgatttttgttttgtataatantnnttactatagagaggtatttgttagtgtttattatatctcttgtatcttctctgcagccccttnnacatctttgnatctgcatgaatgtaacatgaatttcacaataactcaatataaatatataatctatataaatctatatnnncatataaagtgtataaaagacactagttcactagaatagaagggtnnaaataatataattacgaaaacacgggtatgtaagtaanacgtatagggaaaatatctgtatgtagngggtatgggctgtgtttcttctttggggacagncatgaaaaacttcacacttatatatattnaactttatataaatcatcttnnnnctgaattctctgtttantcagtctttantttnnntctgtacgtcgcggtccggtaagaaaactcgaantcatataataannnatataantctattttaataattatattnnatttttatatcactataattcttatccaacattncctcactcatttattatttnaacttctctactctatacccctcaattaccc

SEQ ID NO: 8965 - DNA, 1385 bp, Homo sapiens
  misc_feature (1)...(1385): n = A,T,C or G
ctccgggtgttggtagtgtgtggcgcggagttatggtgggtctctattgttgcgttctagttcgtcctttctgtcgtgggtctggctgtttccctttcccctgcctgtcgcgcgcgcttggcccgcgacggtatcgccgcgcggggtttctaatttatctgcttcgctggcgactctcacgcggatgtcgttgttgttattgtcgcgactcccctacccgcgggttcgcgcatcggcgcgctggattgtctcttcttcattctatgtgatcggaggatgagtcgtgtcccgcctggcacgccctccctgatccctggcccttctccgctcggtgcttcggtgcgcgtgcgtgtttgcgctagagtcgtgcatgctttctcctgggtgcgttgtcgcgtggcgctggcgtctctatcccgtggtatgcgtgtgtgctctcgtgtgccttgtctcgtatctggtgccgccgtacccgctctctgcgtccggtattgattgatggatggtgctcgctgcaggcgcacgctcctgtcccggttctcctccttctctcctgtccacgctggcctgtncgttgtgtttctgtcgttcgttgctcgcgtctctgtcgtttgtctcgtttgctccgtccgcggttgcttgtctcttcggtgcgctcctcgctgcgtcctttgttcgtgctatttctcttcttgcggtccttgtccgtcgcctgtcacgtctgtttcgctcgctccaatctatcttgctgtgtctcgctgcgctgcgcgcagagaggcgtgcatacgccactgctgccgacgcctnctcttactttatncgtcgcgcggtgtgctgcatgtcgtcggttcgcactctgtgccgcgcgcgtgtcgtatgcccgttcgatacgtcttcgntgtggaactctcatgtatgtgtccagtcgtaagccccaccgcctgcgtcttacacgtctcgctgcctcactgtctcgtcgcgtgcgcgcgctatcgcgcctgcggcacgttgtgatcgtgctcgcggcggtacgctttgtgtcgttcgtggatcgctcgcgcccagttcttgataatacgtctagtcacgatacacagcttgtgagtgcggtcgcgttgtcctgactagtgcatccgcgcatgttcgcgcctccttgtcttcagcttntgtgcgcttgcacgacacatcgtnttgagtggcgtgatgtatggcgtggtagctgtgtgtccgcgctcacgcacatgcctacgtcntntgtgcgggccatcgcggcgagatgtcgggtcttgcgcgtaccttctctggcctctcctcacatgtctcgctcgcgtcttgtctcctccgctcctgctctcctcgttgtcacattctctgtgctcgtcttg

SEQ ID NO: 8966 - DNA, 1328 bp, Homo sapiens
  misc_feature (1)...(1328): n = A,T,C or G
aagatcatatatgttaagagataccatgtttgttatcaaatgagaccgacaatctatactaataataggtagcatagaaagtcaaataaaatcgnactacgttatgtatcaatgctctacgatantctcacagtgtactcatagtagacacatcgcttctggactcctctctacatattgctatatactatgtagtactatactagatcacatccccacactagtactgccccactctcctcctctactcccacgtgcaactcaacagctgctnncgactgtatgcatataacatgtcctccgtcatgtatcgttctgcacacnatttcgaccactcgctccgcatcagcttgctcgatttggcgttcctcgagctcactcctcaatgncacaggagtaccntatattattcatctgaagagtgtgcgngncttgcgcgccaacgaagtacgctcagaccaagtagtaagcaaaatatgactagcgactgagagtatagtttacaatgagaggtntctggataactacctcatccacatagtgagagatctgagggtgagctctagcagagtagcagagaccagagagccnatcctagctcactttgttactcacctgagatcatgaccagcccctctgtcacggtttctcatccgcggttcgatattgggtgattaagcgacccggtcctccgtctcactacaccacgctataaagctttacgctacgaggccaataactaaatagatcgcgcttaccgcaatcacagatatatcaacaaaagactggaccactccnacaaccgcgctacgtgcgctgtgtgtcagcacgcaatgtataatgcaatctcattgtaaacttatatnagcagattacggcactataactcgatctctcgcccgtcacatccgcccacagatcaccaccgcctacacaggacggcaagccgcgccctgcctattgtcccacccacctagtcaagaagacgacagtctgcnttctccttgatattgaccagtgcctctctcgtaatgtgatcgcactcattatgactataacatgagttagttaacttgagtatacatcaaagataggntcagccgagtnacgcttttcatgactctgcggagatcattcatatagcatgnagaagngcacgccgagcgacgagaatgatcgaatggacagtaccgcagacgatccgcgacagcgcgaatcgcacacaccacacgacctgcatcgggtcgacgttaggagggcgatgcaaggtcgccacaagcacacactctagatctatcaactcagcgtacacccgtgcgaggtagcgg

SEQ ID NO: 8967 - DNA, 1708 bp, Homo sapiens
  misc_feature (1)...(1708): n = A,T,C or G
gctgcaaatacagtacaatagaagatcgttcagtatcgctgcctgttgcgttagactagggtagcgtgcgggttatgctcctcagcgcgactagatcgcgagatcttatcatcctaccgaactctcgatctattttatcatcgacgtactatggagcaggagtcgattctttatccgtagtaatactgactacgagtcgacgcagacgagagtatgatacgtgcgcggcggccgcgtcacacttcgttcgtngtgctcaccgtcacgtacaccactggctcgaccttngcacactacgtgatacgtgatgcacgttgaggcgatgcacaggtgagtgtcgtagtgtaagtgcgaatgagaattgagcacgtccgcacgcttacgagcggatatggacggccgagctagagatacgtcggcgtcatgtacaacaggtactgcggcttcgtcgtgcgtccactcacttagtctcgacggatcggtggccgagctacncgacattatnacatgngcaccacggtacgcgtttagcaatcaactactcanttcaccacgctcggacaccgcgcgctgagctgtgcgtcgcgctatcaggtcgcatcgggcgagtgctctgctgcacgcagacagagcgcgnagtctccgatcgcgaccgacgaggactgagagaacatgagtgtgacgtgcgcgtnantgatgtaatgacttggctgtcgcgagccacgntatccgtatctactcaccacacatctcatggngacagccgctcacgcacntccaccgcaccacgacactcgcacacgcagacgcagcacgcgaccgccgagcgtccgctgacctacactgatacatgacggcgtatcgaagtgcagatgtgtggcagcgncgcacgcagcctcgccgcgcgccgcgaagcagtgatacaagcaggatgacacgttaagccgattagtgcgcatancacactacgtcgctctatgcgactnacantgctatgtcagtatagtctgatgcgagcgtgcgtagatcggtcgntgngttcgcggcagcaaaacatgtccatgtcggnanagacacgagtgtatggagccggctgnacgtgcaggntgtntgtangtatgtgatgtgtggtgcgaaaacacagcgtcgcacgagncctacagagtctagcgtatccagatcgtaccgtgtcgacatagatagnagcgacgtacgtcgactgtgactcggctaggcgtatgacgcaagncagaccgagctgatatattctcntaagacctgagagncacnatgcacgntcggtccgacagtctcgcgagctanacgcacgcgctcgacgtacgtaccttcnctacacgtncnttcgtgntgacattacatcatctcnctcgtgtgtacaacgacancnagcatgcagatgtnatgataagcatatgcaacgcgtgccctgatatgcaatgtanactgaacagctccaatgatccggcgttgacagacgcacgtgtgtgatgacatcnagngacgtcanttccacgctgtgtcagtcacgcattcgtctccacctcacgactacgtatagctagtgcacacatatanagagtctcacganagcgnagtagcgcgctgtangatccactagtgtcaccactcagatgcacntgcgtgcctgtcttctngacgncatacacgtctcgatcgctcgcttgtg

SEQ ID NO: 8968 - DNA, 1330 bp, Homo sapiens
  misc_feature (1)...(1330): n = A,T,C or G
ggagcgagggcgcgagcagacacccaggcagaggcagcaggacgaagacgaagcgcagacagagacagncctggnagnngggnangaaccnaagcgaaggcgagagccctgnagagagagagagaagaacccacgacgcgcccgcgccacgggagagagcagaggcgacgaacgggcggcagcaccggaagacggacgcacgangcggagagncngcgcggcgcacgcgacaagcgaacgagngacgcagacacacaganagacgagagcgcgncaccacgcgcggcagaacacgacgcganaggacgaacacacgagcacacgagcaagccagcaccggngcaacacgcaagcaggagcagagagagagaagacgcaagaaagcagcaaacaaacgcaggaggggacgagccgagcagcagagacagcgagagacgagagagagagaagagagagngcncgaacagaaacgacgcgagacnccgcacgggancaaccggcgagcacgcanagcngagaccaagcaaagcacgcaagcgagaggacaaagaacaagggcaaaccagacgcnagcacccacgacaagaccaaacacacagaaacacggaacgagaagcagaaganagacaagagaagccgagaggaggaaaccacgcngaagancaccacaacaagacgccgaagaacgggcacngaccggcgcgcccgcaggcgccccaccaagcacccgcaagccacgacaacaaggcgcagaggagagaggagaagaggagagagagagagcggaggaaacggcagaagacagccagcggcaaccaacgcgacagcgcgcaggagacgaccgcgcgcgaagaggacaaacgaacaacacagaagcgcgacgagaacgagaccaaagcgccggacgaacgaagggagccagcgacgcggaaggcaagaacagagcgaagagacgcgcacacagaagaaaggagaagcagaggcgaaagagcgaaccgaagccaggcagcgcagacagacggaacacaagagcccaaagccgggccacgaaccggacaccacgacgcagcgcagganagcgggccacacgaaacgcggncgccggcacggcggggaccgcagacgggaagccaccgaggacgccacancgcacccgaggggagcgaagggcaagacggacacaggacgaccacacaacagcacacgggacacgaagagaggcgcaacancgggcggagggagcagagaaggacaagcagagagagagagaggacacaggcacagcccaagccagacccaccggacacacaaggcagccgccccacaaaca

SEQ ID NO: 8969 - DNA, 1409 bp, Homo sapiens
  misc_feature (1)...(1409): n = A,T,C or G
accaccacagtacagcagccccaagcnanactgacagcacgccgcgcaccgcgcgatatcaaacancgacgcagacgacgaccngngggnagagagcggcgcgncnctccagagagcgagggaggaggaacgnagangccngcgccgacgagccttattactgagnaccgcgcagaccaccacaccgcacacaggcgggagcagagcacgccagagacacgcgagccgcaggcaggcncggacgcagcagaaacganggcacgacagccgcgcggggagcacgagggaggcgcgcaccgcacgaagagccgaccagacaaggaagggcggaggagcgtacacgcccaaacgaacgcgacgagacgcggcggagagaggcgcagcgagcgnacgcgcacaccacggcgcgagcagcgacgccgcgccgacgggcgcgcagcgcgccgcgccgaggccgcgagagagccgccgcgccaggccggagaaacacanacagcgcccgcgacgcaaagcacccgacacagaacagaccagacagcccagggcgggcggccacgcaaggaccaataccgaacacaccccgccggaccgcgcgcgcacagagaccggacggcgcaaagcgacacgcgacggcccaaccagcgcgaccacgcggacgcgcacacagagcgcaccccggccggcgagcgagcaggaggcagccagcacagacaaacgacgcaccagcgccggcgcaacagccgacaatagcacacatagcgccacaagcgcccgcacaaagaacgccaaaacatacggggccgccaccaagaaaaacgaggacgccgcaagggacgcacatcgacgcagacccaacgcacgcaaaccggccgccacacccacacacgcacccgacaacacagaagacagcagacgcaggtcgcgcaccgaacccgcggacgaacccgagacgacgcgggcacggaacaaagacaggaacactagagcacagcagccgcacgccggagcgccgcgccgcgcacagacgcggagcaggtagcgccgccncgcgcgagcagcgagcgccaccacgagcgcacccccgagagcgcggatacgcagcgccgccagggcacgcctaccgagagagacaccgacgganggcggnagaatatgaggacgcgcacagagcccgcacccgcgcgcacgtgcgcgaacgacagagacgccacgcgctccacgacagtcaaacaaagacacaccaggacacaacaaacagcacaacggcggcgagaccgcaacacgaaccaactccgcagccacgccgcccgcccgcgacgcggccagaacagcgcggcggcgccgcgagaccgagcatcggaacncgacgccgcaccgaccgctgtcacgccagaacgcgagcagcaggg

SEQ ID NO: 8970 - DNA, 530 bp, Homo sapiens
  misc_feature (1)...(530): n = A,T,C or G
tacgctggtttacctacctattacaacactaatttccaatctaattggctctttccccggtggggataaacaaaaantccnnctctctttcttattnnattttaaccatntccttantcnncttcctccttccancaacccatatctctttatctttctacggggggcccaatttagtnntaaaaaaatntttcctcncnccccttcncttcctcactaatctaacacaactcctncttttataaaatcttatattcaaacctttttaaaccttatncttttatnctaaatacataaaaaacattaatctttcctacttaatctcccaaaatctttttttaatttaaaaaaatcctaaattcaantttattttctatntttattctccttntctaaaaaaacctaattcttantctttnttaaatattnnatnatcccccccatacccttacttttacctccctaactcctccccttcttaaaaaataatctatccctcatactctcctcanctcctccaaacaataatc

SEQ ID NO: 8971 - DNA, 1165 bp, Homo sapiens
  misc_feature (1)...(1165): n = A,T,C or G
attattttatcactttaaaacatcaattacatatcaacttctcatatattacgttctctcaaaaccataacaatatattacctatgcaccatccaccttcctcacagcctgatatacaatatctctgttgctggcgtgtctctaaaaacatacttcacctcaaccatacacattcccattatcttcctactgcctatccaccctcttcctatcccatcatctaaaccatactcacccacatcccccccatcctcttcattcattccataaataatctatatcgacatatgcctttaacatcaaacccaccctcttaccctctctaccacctgatgcgggatttctcacatccacagtagccgcccacttacataaaataaattccaccaaacatcaacacatatcacaactcataccacaacatccatcacctttattcactccttatatccccatcctctctatattctacccacatatcttctctctacacgctacaatttcctccacataacactctcttttatattattttacacttatatatctccatacctcatttcttcctctatcaccactatataatccatcatataaataaatataatctcacctttaccacacaanacaccttcaaataattcacccatcacttatcttaccacatgactctctcacccctaccaaactcactacatactctaccctcttatatatatattttccaatctcctcccgccacaaccactattttataccattaatctacaacactaacaacatgctttctcactatatttctatactctctatttcaccccctctttatcttcatacacactctattctactcataccatattatataattatttatcanattactgctcccattttcctctactatctatacttacttacactcctattcataccattcacctactatnagatcacaccacaatataacatatcattaatcaccacaaacttatatacaccatatatcatatctcccatatacacctcaaattacatcctacccttcaacataaactcatcatctatcatcatatataatatataatcgcacgacccatcatacctgcatatattcatcttacctatctcctttccaactatccgcacaccaccattattatag

SEQ ID NO: 8972 - DNA, 1391 bp, Homo sapiens
  misc_feature (1)...(1391): n = A,T,C or G
cangtatctactctgtacgcatcgnttctacgatccgcagtacgctaatcgcctctcgagtacagatgcagcggagcggcgagaggactctcgatgtcatatcgacgctcntttactagagcttcaatactgatttacgtctgatggagtntgtctacattgcatgngacnactgaggtgcggtggcatggtgctgcgtgagctacattgtcttatatacttcgttagaatatgacaagcatgtgtgccgcacgacgtttatatctctaatcacagtacacgtcctattaacactcttcattcttctatctcacccatccggcgcgtcantatatcactgtcagtgacttatacgctgcgtcgcagtcgtgagacataactggctgtctcttatgatctgtatcgagttaagcgcgtgatggagccgtgtcgtagttgggtgacgtattgctaacagcggtgcataaatgtgagcgagactcgttggtcctgaacganacgtatatgagtagacnatagtctgcttctcgcctcgcctatatacgaacgacgttcttacgggcttactaacgggttgtcttgcangtgtaacttatgtatgacgctacgcatgatagcattatcacattctatgatgcgacatactagcctagactactatcgttgctgtctatgacgctcggtacaactgtgcgtaacgcatatgctgttgtncgctagcgagctgatatgagagggcacgagcagcatgcgtatgtaactagtgatttcactcatcgtcgctgcggtgtacggcagtagcactcgtccacgtatactcgagttggtcttctgcactctggtacacgcatgtgtgtccgattacgaagttcgccgacntgtacagatgtaagagaatcgtgtatgttgcagtggctctgtcatcgcaagaacgatgcgcaggtgtacttaatttcgcctgctgtcacgttaggacggccgcgaccgntcgtgagagacgtgattttgttgtaccggggttgattattatatattttctgataataataatctcgtagtgttattagtcctaatcacttgtgtttccatcacgtgcgcgcagctaggacggctgagcgtctcagtttacagcagtattgatcggggtttctatgacgccacgagaacacaagtatatgacctggttgttggacctgtgcgtttggtgtgggtgggtataaacttatctctgctaaagagatgtgtttctttctgcacaaaccagacaggaacatagagagatatgtggtcttctgtttgcgctctcaaagcgtgtcgggagttgcttgtttgcccccctgcagtgaggcggtgcgctcgcctgactgtgcgtatttgtgggaggtcgtcat

SEQ ID NO: 8973 - DNA, 1621 bp, Homo sapiens
  misc_feature (1)...(1621): n = A,T,C or G
catagcgtagctgtacgtcgtctgtctagatctcangacactcatcgtcatcgcactatactctcntcgctctncagtccagcatacgtcagtagagagacgtaacacagcgattgagagagagtcngctagagcgtgtatctacnggtcactcactactcgcagactgctacntaccatgagtgntcagtatctcacaagaanctgagcgacgtggagcgagacggatgcaagtgacgcgcgtgctcgatgcactatcgtactcactcggtcanacatattatcacagaagatacgatntgagatgcgtcgccatatacacttatattcagcattcnatagattcacgcagatccactactctcgtgtccacgacgcgcactggcgcgcggtcgagactagcgatgacggcgctcatgtttcgcttggacgttagacgaccttgtgacgccttctcggtcgacgcagtggatgtancactattcgtcagtggttgatgtcgaagatgaagacaatagttgtatttagtanacattgcnagatgtagtagatagtgagacttacgtcgactatgttctatgagcatgtggcacctatgatatattctagcattatgatataatgtgttgatcatcaaacttatcataataccgatacactgggtacgatntagggctggtctgtccagtgtgcgctcgctgattcacacacgtcctctatcacgttgtatttctcgctacgtccagtgatatatacgtatcaatatcntagnatgtcaccgcgtctncnattcccatctcccgcactcactccagcatcgtacgtacacgcgaaatgcgtagcgatccactgagtacttcgagcatgcgcgtagtgtcatcgcgacgctgatcngntcgctgcagtatctcgctgctggcgttgtagtcacgcgctgtgtcncgcactaccgatgacgcagcgactgctcgcgtcgctgacgacatctcactccatcgncactccgtcgacgacattacacgcgccangcgccgtggcgtgttgtctgcgcgtgataccacatcggaggcgtggcgtcggcgcgatagtggtgatangagaggatgagtagtgtgctgagtaatggtgaagtgagggagntcacatatacgaacgnanggaccgaggcgcccaggtgtgtcggtggtcttgagtcggagtgcgtgttctctcgcattacantgactcactcttgncgctagcgacgtagatacgctgtcgtagaggcgcagagacagagtngtactgagacacagacgagnagagacagagactcaganctactgatacagcgatagagacatagacttacgtagatatacagagagcgacgcgtatatagatagacagagacacagacacacagacagagagacagaaagatagacagatanagagagtgagatnagtgcgtgctcttnctgctatggtgccgacttactcagtctgaggtngtgtatgtttgcactggactggacatcctagataatgatatcatactatctcatattagtataagagnatgaacagagtgtccanacaatacatnagtcggtgaccgccgtcgtctgtctctgctcca

SEQ ID NO: 8974 - DNA, 1545 bp, Homo sapiens
  misc_feature (1)...(1545): n = A,T,C or G
cgggcgagtcangatcgcnatctcgatagcgtcgtctgtgatggatactcagacgtgcgagcactgactcgactcatgtcgcgtacgtgtcatacatactcangaaccactctctcatgcactcggcgactctcgacagatgtgtngacatgcactacgtatatcgtcgancatatacatcactcatatcactacttcactgtagtancgacacgtnagcactcgnacgtcctncnattacgtacgtgctgaggatanatcncgacgatcancatgcatcngtgctactangcgagantatcgntgatcagaccgacgnttagagacttcagtgtcgattacggagcgatgaatgcgtctgtataatantgatatagtgatgtgtgagcatgtcgccgttcgancgacgtagcgtatcgtgagtgtacagattatgaactatacatacatacgcggtgatctctgctacgctgacgtacctcangttgctcgtctcgtgtanctagcacgcatcgtcgcagataggagctccgcgcactccgctatcgctcgcgtcntgtctacactatataaacttacggatcgatgagngnttatgtctatcgtgtcatctactcacattcgagtcgcatggagcgactagttcacgctcgntcacgactcatctgtggttcgcgtgtgtgtntgtgaagagacgtatagatgtgagtcacacnatacntacacacgcgancggacatacttatacgncgaccgctcacatctataagtatagcnctatatacagattcatcgatgccagtttagtgaatcgcgcccatcgtctacgatagcgacnagtatatcagaactgancgatacgctgcacancgtcgcgtgctgtcgtacgtacacgagatatcacgatgagaggctaccagctcgattgngttggcgtattcgtcaggtctacgagtccttgctgctacgtntacagctacactatctattaatgatagatatctcacaagcgtctgtcatgctcgctgagacgacgcgctatactgatgtcaagatgagtcgtggtcttctcgtctacgcggtgcacgctcatactagacattcgttagactacagatatatccgtcttgtctcncagcgtcgtacattcgtaattcacacgcggaagacacancactgcgcattgattctatctattctgatgttgatactataaatctttatgcatgtgatggcaccgcgatagataggaggatgttcatatcgtacaccagtgcagagagaactagcacgatggcgacgcccggccaacgtgcaccgccgcaaacagcgccggaccgacgcccctttttttgagttaacgaacgacacgcgccaactattatgcggcgctccgatacacacgatgagatacgtagggggctcctgtatcaggccggtgatatattgtgcggcgtggtctagatgtaccaaaaggcctacccgagggttgcgcctagaagctgccgcctcgtcccctgcgccctgctcgctcacaacgtccgc

SEQ ID NO: 8975 - DNA, 1580 bp, Homo sapiens
  misc_feature (1)...(1580): n = A,T,C or G
cgcctcgtggtgtgtctcgtgtgtctctctctctcgtcgagctcagtactgctcacgtaacnaactcactccggaggatcggtgtgggcgacgtgagtgtagagcgacgcgctgaagtcgaagactcacgacacgctatctatcacggtcgtatacggcgacagacggcgtgcggtctgcagagcgagcggcgacgtggtggcggtcgtggtcggcgacgtagcgtggggatntatgtgtggcgtgtgatgccgcagagcatgcggctcctgtgtgcgatancactccacgtgccagagcgacgangctctcggtgtgtcgtggatgtgcgcgtgaagttagtctcgtcgctcctcgtctgatgcgctcgcacgactgcgtgacggactcgagcaangggaattgaggtcggctncgtcgntctcccacactctcacgtgtgtgtactgtgtncntacatcgnnnanagtgatctcgtttctgcgtgagtcatgaccgtctgtctatgttgtgatcagccattcgcgatctatcgtgtacgagtagagtgactatgatagatcatctctcatggtatcctagtcantagtggancgtctccgcagcatgcagtgacgccgtnggagcatcatcgcanntaacgaacagagtcgatactcctcatcgacccgatgctggcaagattcgtgggacatggatagtgtagaggagcactcatgtatattcatcagtgtattgagtcttctacttcggtgcctgcatgagtaggtcgtctgtaatgtagaagtatctgtgatgagttactgtatcgaggcgcgctgtatctacctacgccgaccctanagactgacggcgtaggtgcgcactcntgcgtctnagtgtcgtttgtgtccacatntgtccactcgtcagttgcgcgtggagacgtccgatcgcgcgttcgtgcgctactacgcatccttcacattatagcaacacacgccgaacgcgcagagagaccgctacgcacgagtcggttggtcagtgtacttagtacagtttgagcggctgcacagtatgtctcagtctcgtcatagtggatatgtagagggagaatgtatgtgtacatanaccatctgacgcacctcgccactccngtgagctccgcgcccgtagaccttcgtcncctangagtgagcacgcatgatggcatggtgtagagtagcgtatctcgtcggacatgcgngtnactctgcgtccacattggatgncctcggcgcacgtatagnggcaaagtacacanactaaaactctaacaacaatatcgagangnagaagagatgaaactaaggagcatcggccgatgttaagactgatcgtcgcggaccgtggggcaccgcgcgcacgtggctatggacacttcctgcgacgcactctgcgccgacgcgtccgttantggactcagcagagcgacagtccatatgccacgatagacgcgacgtagactgattaggatgactgcaggaaccttgtcgagctaacgatgcgtccatcggacgcgaccttacatgaatcgcacactctgtcgatgtcccacacgg

SEQ ID NO: 8976 - DNA, 1519 bp, Homo sapiens
  misc_feature (1)...(1519): n = A,T,C or G
aagagaatagagtgagagtcgtgtgagtagagtagaatgatggagaagtcacgatcatatacgtgctcgcgcataggactacactatatactatgctactcgttcgacgacacagatcantcaagattgagtgtgtcgactntgncngnnngctactgnatgagtctctgtcgctacacacgctgcgagatacgtgagntaatataaagttgtgatatcagntagtgtagatctcaaaacgcagngctctctatgatngnaattctgagtcgttgtgtgctgatagacagatgagagtagacgtgcagagcacgagatgtggnatatgtagacgcaccagtcaacaaggtaganagananaaggtgagtaatgagcgatgtntgctgtgatatagtcgagacttgattgctgctggtttaggtgtnacaggagtcagctgcnatagacgagtaacgggtagcgtgatgtgtgtggatgtncacgagagatgtatntcgtngtancatntacagangtcattacgagacgtataanctaccgatcagtacgantnggtcacatgcactcaccatgttacgctcactattgatgcnacacgaaangagtacgacgtaacgactagtngtcagagacgatngtgtggtngnanatatgaagcgagatgatgcacgccgatacggagcagagacgagagantgacanagtatagatgagatcgnacatcacgatagtggcgtagtgtcnacccatatganagngcgcgcgtaatgtacgtaacgcagatgcagatctngatcgacactatgcggantagctgtgactacgaacgcatgctgatcagcaacgtctgatagtcatatgtcantataccacacacatgataaggtgacaaccgcgatagtgangcgtcctattgtagtgtagtaagtcatgcgctcgaggtcgtgggtggtacgagctcataacatagtacgagaggagaggtcggagcgcgtagaagtgcagcgatgcggcagacaatgatcgagagaggaacacgaggtgtttgcttgctactatgtcaccgatggtgtatcgttaggtggatgtgatcagtagtgctggtgtagatttgtacatggcagttttaacattgtaattgaaaacagacatgaaatcagtagtgtcgcaacatctagaaggattcaacgattaaccatatatgtctcatacaaattttcatatatggtatgnacaggaggacacctagtacgggctgaggtcggggttcgtgagcggaagccggctgactgccatgctagcgacgtacgagtcgtcttcagtacgagtgcgaaaacttaaagtggtgaagtgaggggcactgatctgatgaaagtatgcactgctaatattgcgtgaaatcgtgaaaatagggttcctgtgttgacaaaattgcggcggngctgggtttgccggtggaagatattcgttgttctattgtctgataagttatgataaatttttatatttattgtacgc

SEQ ID NO: 8977 - DNA, 1560 bp, Homo sapiens
  misc_feature (1)...(1560): n = A,T,C or G
agtggccgatccgaaacancgantctacgagagcgcgagaatatagagagatgcagcaacaacacgatgtacgtgagaagagagcacacgtgcgagaccagaacgaaggagactcctcactctacgacatnatatagactatncttcttctgctncgcgatanatcatatcatctagcgagcncgcgcagtgtntgncgtagagaacacnaagtagcgcagtgaatcagatagaacacggacggtcgattagcgangattcanccgccactacgacaacgacgcgcacgcgancngctcacgtacgnacgcgaacagtctagagtgagtaatnaccttacgatgagtggaagtagatcactaggctacgcgcgagacacgacgaggcacagaatagacgattgtataagtctgatatannngctacatganagacgnagagcagagctcaactcatgtaagtacatctcatcctctagtnnncctcgatcgtgcgcangagcctcacagactcacatgccgccgtattgtgattcataggnacgcgtagtggtgatgatatcaacacaggagagacaacaatataacacatccacgacgcgatcagcgtacgcagcacagtgtccacgcgatngcacgcactcatcgatntgcgcncaccttgcacaatcaccacatcatnatcagtaggtgntcagtgatatggtgagagagcatgcactgtcatgctcacgcaatgactagagcgactgtcgcttcgaccgtgtcgctgccgngcctaccagtatttaacttctgggttgtagtatcactcacactgngcgacactacaatatgtatnanccattgggccgcggcgggtgcgcgtgtgagggactgtagcgaggcgcgcagccgagagagtgcgncgtgtgagagaagccacctagtctcagagaagcgggngcatcgcgagtgctactggtggcgagactcgagggacgttcgtgtactgagctcgtcgtcacgcccatcggccctctgngnggagatnacgtatatactatgagacttcaggtctgangttatatgccctaagtcgacagactagnaacactagnggagccgtaangggtaggaggtgtggtgtgttgtgactatagtgcgctcatggacgtagggagtaacacatgtgagcgcgcctgtgtggacatcaanaganaggcgccagtgactacgcgcgcgacggagcatggcagtaccctgagaanccagggagtatactgttgggcatggtatgcatagatacgcatagaacaacgaggcgactccgctcgcatagccgcacagnaccagtcacgatcgtctcgtcacgtagcgcccgtgacccaagataccgatccagccagccgcggcgactgggcacgcgccttgccgcctgtgtgtacgatctacggcacgactcctgcagagaacaggtattataacgtcaatatgtcaccactacgatactcttacagattatccatctgaaacgtcactatgaccacatctatctcatatacactgttactcacactat

SEQ ID NO: 8978 - DNA, 735 bp, Homo sapiens
  misc_feature (1)...(735): n = A,T,C or G
gcaactgagctcgatatacatgacgtatngagtgcacgcggataccacaatccnctctgtatatacgtacgtctngtgtactcatactgtctcgatccttatcacgccgtgagtagcgtatgcctgagctacagtggctaggtctagctcgacagcgcagcgtagtccttagatnttatactctcgatactgcgaagcgcncncgagagactangatgtcagatacgtcgcagtaggcgcgtgtcaatgattcaggtgcggntcggncataccgntagatcatantnctgatactgatatncttatcagagactctgtgtaccgcgctcgtacggacgatatcgtcgcaantntcagtcgcgattgcatacgttcatgtcntagagagtatgtagtgatatcagacgagattgttagagactcctcgatgcgtcgtcaatctgcgagctgtacagacagcntgatgcacgcgtactgatcgcacgtgtgacgncgagagtcgtagtcgtgtncgttagtcgtnctctgataatntgtagatgtagtagcacanggatagtcattagtatntatagtcatatagatagactcgncgcacgacataagatcgatgaggaccactatcgactcacagacacgacgctgcacacgtatactcacgacgacaacgtacacgctagcgtatnctcacctgatcatcgcttagtgacngacacggttcgntaattacaactt

SEQ ID NO: 8979 - DNA, 2457 bp, Homo sapiens
  misc_feature (1)...(2457): n = A,T,C or G
ttttacccccaaaaaagaaannnnnccccccccnnncncccccccttttctctctcccccccccccccccccccnnnnttttttaccaccanaacctcaaaaggctaggctcgcacctgnatggtncgcaggcaagaaaaaacgcacgctgtaaactatcgantcatgatttttctgctttacattaatcccaactcaatctttttcaacacccagatccacattcctctctcaaatctcttaccgcgcgtccctttcccatctaagtcatagttcacctcgttaacccaattgtcctcccaaatatctggtttaatcgctcccactatttcagaaagctacctatttctacgtgcttttaccaatcccattgatatctccaccctcgtcagtccctaattgcaacaaacccatccagccccacttcgctacaaacattttctccaaccctgtatgtctgtcaaaaactcgcccaaaacccacgcccctcgaaaggcccttaggaaataattttcttctctttttcttactttccacctctgtagaaccaaccttctttgtatatgcttaaactttacaccaaaatcaacgcgggccctttcccaattttttctcacaaacacagtacccccacaacacaacctattcctcccctctctatataatcctacgctccacctcccacctccttctcatacgacgtcacatccccatcatatctatttaacataaccacccacctaagcctctcgcatctccctccctttccttctccataagaagttcacctccatttcacaaacaatcaagaaaccccgtacacaaccacacccttatcttggcacccgccctcgctctcactactcctcctcccaccccgtcatatctatcctccattccccacgcagaagggcgcggctcttatccacatattagtgtctgaagttgcacagcaatctctcccccccttccctgcatcctacacgcccgagtctttgcggccacaccccactcgcacacatctcccttgacctacacctttatcaccgtgtaagtcattccaccgtcttatctcttcctctactcaccactatttattatgtgtcgnccttcatctttctaaatgcgtactcgtgatggctcaataacctcaccacatcctacacccccatcgacacacacgactgttatntacaaatctacaacacgtcacgctctccgccctggtatcttctatatactatcaacagactccgcngttgaggcattatcccctcacagatttttcgntcccccacccccgctccaatacagctaccacacctgtctcatccanagcggcgacctacgcttccgctctcactatcacaccaaccgccaggcggacacgcacgtacgccacctacaccagacacggcgcatataacgcccctacaaatcatgtctctccgatagacattctctcccacgtcaccaacactgattcatgttgcgatactaaattctcccaccaaaaaagttcagagagcacatccctcccattcccccttccccacaaccccccccccccgccccacgcatatcctgttccaactgttggtcggcacccatcccctgtattacatctttctacctttccgctattttctctcattccaaccgcactaacagtcactatcgctctacccccccacacagtccccctactatgtagcgcgtcgtctctgccctcactaacgccaccacctcctccgcctttatcagaactcacgcacaacaatcgcttatcgtatactctttccgnctcctccctattgtaagttcatacgaatgtctgcgctccctctactcatctctcgttcccaaacccttcagtttcctccnaccacatcncantcctcttccatcaccatcctctttcgtctcggtcattctctgcgtacacacccgctntcatcacgncaaacccgaccccccccctctcgctttccaccacataacgacaacgctcgcacacccgctctcccacttgtatcacgcactcgtccattttcggaatattcaaccaccatcactnttgaaatatcttaatgcgtcttatcgtgtctctccctataacataacttgcgcgcatcnattttcgacatcatcgtccacttcccactcactcacgaaccactgagtaatagcgcgcgccnaccnacgcgctgcatccacatacacggccactactgtggtacactctcagcgcatcccctccgagagatgcacatcatccccanacaatgtcatagaatgatcgtcctttttcccccaataccccgcgcaagtacggtgtgtatcgtccatacaacccaagataatctctcggcagccctactcgtaccactcgctcttctctctccgaactcctctaaccttcatcgcccttcccctgtctctacgcacgtcagtcgc

SEQ ID NO: 8980 - DNA, 584 bp, Homo sapiens
  misc_feature (1)...(584): n = A,T,C or G
atccgtcttagatacacacttgaccaatcacaaaaacatcgggtcatgaagtcatctttctgcaatatcctgagttcaaataaatcttgtaagtctgtctggtgggaaaataaaatggtggagtacagaaggcaacatttgtggagcaaatttacgaagaagtatcaggaatacaagtggaagattcagcaagctgcttcttctaactgcaactcccatctccacccaatgcaacacagacttgctaaactggaattttttctatttgaaaaatgctctggaacttcaaccttcaagggagagagttcattctctaataataagtagatccatgttagtaggaattaactaatttttttacacaccaaaaaaagtattttggactcccaataattttaaaaacctacataaaaagatttacatttttgaaacagaagactatattgattttgttatgacatgttgagatactcagagatatattttatagaaactagtctagcgaagatcaataaattttgaatgtattcatctcanaaaaagattgtgaaataaacatggattgcctatcaaaaaaaaaaaaa

SEQ ID NO: 8981 - DNA, 1676 bp, Homo sapiens
  misc_feature (1)...(1676): n = A,T,C or G
tctgagcacacgatctctgcaccgcgctcatactcttactcngtctgagtcgtcgctcacgtacgtgcacacacatgatgtatcactgcgnatatgactgtcgtgncgcagancacggacgcgcagagnacgcagatggctacttctacgtttcagtgnctctagctcgcacgagtgtctacctgaggagtagtgtgcntcgagcgtatcggttcncgcgagtgcgatctgcgccgacactgtatgagtgagacncncgtttatccacagcaccacgcacgattatgtattatggagctgcgccgccnnttgatgtgtgttttctggatgaagtgntgtcgttcaatgtacgggcatgatgagcgncaggctacgcgcatacactatcacatctagtatcgtggcacgtcacgacctcacttgatctgattactcgtcgtccgtcgacctgctcactatngtgacagtgcgtgcaccgtcgcgcgtctgagtgctgttctcgtatntctgtgtgccccgattctgcgacgactcatgcgggcgacgcgncacttgccgatatcgtctncacgtctcgtctacgctatctctaccaggactggacgacgagtaacactactgacgtcgcggcanatgcaggtacgggntatgacangtcgcctgctagtacgntctgtatagatcntatagtactcnacgctgtcatgtgatctntagngtcgcngttaagcagactctcactgtctctcactcgctgtctccacaccttgtcatacgtcacgctctccgcactcgtgctcgtgtgnatacagattgagctgcgtaaggtagatatgagagctngcaganngncacgtaaggcgctgtcgacatagatgtgatggataagggagtctgtctaatgatctacagaggaatatcacgtagtgatcgttcgctaacagtgacacgctgcgatcacgcaatgggcattctntcgttctcgagtctgcttgctcgtcgatctctgtgcgcgcactgttgccgtgaccgagcagcgtactggcttagcgcgttcgctgtcgtactnacattctcctcatgttcctgtctacatttgacatacgatacttcgacacttctcatgtgtatagtgtgctagagaccggtaggtggagaggttagaaccgtagcccgtgttggctcggcagcaccgcgtgagagatatgctcctctatgtgagggctctgctactcgtggtagcggcgtattggcctgcgtccggttgtctaggtgacgatcgcaggatcaacgtcttttgatctggtgcactgttgacggagtacctgatcatgttgtatagtcgccactataatcttctacgcgtgctttcgacgcagacagtgttcgccgacgtcatgcgcaggatgacngatcaggacaacagttccgcgctcgtagagcgtggagcgagctgaggtggtgtggacacgcgcgctcgcgcgcgtctcgcgcnctgctgtcgacgaagcttatggcacgtctgtcgatacgtcnagttntctgtggtagacgtcgcgaacagtgtgtgtatagcacacgatctcagtgagngtgtgcgctggtgtctattgatnacttccgatctacgtngtgtcgagcacanttctctcatcgctctgcgactcatgcgcatt

SEQ ID NO: 8982 - DNA, 1654 bp, Homo sapiens
  misc_feature (1)...(1654): n = A,T,C or G
gtgtcacactgtctctcgtaggcgtgccgtgcacatcagtcgcggtcgtatctctcgagctaggtctagcatgagctccacacgaccgnacangtcacgcaatagttatacatagccgatccgcgcaccctatatagatagtctgtcgtgatatatggatgagtgacatagtgatacaggtgagcgtatgtgatgactgcgctcacccgcacagtgagtgtatgagttgtagcgctcgcatcgcgncactcttcctgttctctactgagtccgttcggncagacatctgcgtgtggttactcattcctcgagcgatcacatacgtagcatatacgtcgcttntcgacggatacgcgcagatatggcatgtctttntncatgaatgtatatggatttattgtatagcgagttgtacgcgagtctcgcgtagagcgcgcgcaactagccaacgtccacacgccaactcaccgggagacgcgcccgccgtcattctctcatagtaccatcagcgctncacagccggagcatcgatctgtgctcgcagccgcgggcgtgtcgtanaggctcaacagcagcgcagcgtcacggtgtgaagagtgcacgctcgcgaagtccagcgcacntaacgctgcgctaacgacttcctaccgagtggcgtcgtgactcctctngagcggcgcgagcgcagcagatcggattggngcgcgtcgagtaggacgatcagcgtggatgcgattgccgttgtccatgactgatgcacactacgccgctgctcattgtgatgtaatcacttcgaccagacatctcccgctgtcgatcgtcatacgaaccacagctctcctcacgacgactagcgagtagatcactagtgacgctcacacgagctcatgactgagaggcgatgctcgtctacagcactgtcacgagttgccgcgcatactgctgtccgtcgcgctatcctgccccatcagtcctacgacgcgcatacggtgccagcacgggagtagtaagtgcttacgtatgagtcgataatagtggagacgctagtccgaactagtgaacacccagcacgctagaggcgccgattctcggccatcacatcgcgctcgtcggtctatctatcagccaaattgcgatcgctgcacgcgtccttgcgcactcnacgtctgatactagcgcacncagctcgtcattatagtcctgatcgtctcagatagtcatgtataagaaaaggtagacgatatttanagtcgcacgcagtgcacgcgcacgctgctcggactagatnatcgcngtgaggactcacacagcgccgtaccacgcatgcgcaggcgtaggctctcgcgctcgtgttgtaccgtactancattccacatacaagcgtagagtgtgagcgcggtacagtccgctgagcgcgcgctatcgagggatgntcatcgcacctgcggcntgactccgatctctcttactatgagtnangntgacgtagcagcatagananantagtgtgacggaatgagtggtgcgtgatagagtggnagtngattctcagattncgagatgtaagacgagtactcgtgaggacgnncaagacacgaagagatntantctntagattcatntaaatgatatgctattatatatacgcaattta

SEQ ID NO: 8983 - DNA, 797 bp, Homo sapiens
ttttcggatcttgaaattcgctgaatgggaaagtatgaggtcttagagcggaacgattccttgagattatctaaacgccggagggtatgagaataaactccacgaggaacatgcgataatccagaaaggatttctcacaatcctgagaaggatgcaatcggttttatacaagaaatctgggggtcctccacccgtcagataaaaagcaaagataaaattgggtgaaaaatgggacagacaccaagtaatatgtctcttctccacatttgggtttgatgaatcgggatttctctgcaccccatataaaattaggctggagggttttcaatataaatcttaaatctacaagcatgcatgtgttggtgtataattgaagttagatattaacttaagtcaccctgtaaaaatgtttggtaatttggcacaacatatcttgagttgtttacacagtcaaaatgtttgattctttataccagcttatgagctcaaagtacttcagcaaagcctagcctgcatgtcattcacccaaaacaaagtaatggcgcctcttttattattttgaccgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaaaaaaaaaaaaaaaaa

SEQ ID NO: 8984 - DNA, 533 bp, Homo sapiens
  misc_feature (1)...(533): n = A,T,C or G
aggggngaaagcctttttgnnnngtgccnnnncggcggggnaaaannnnggcctagnatgantctaagctgactcgtcgngnaaacggcttganacacgtnnngnntactgngngnagtgtacnntacatgnntacatncanannatggnacnncaatncatngtgcngntttctngcgagggtagtagttcatatcttttataagananntcatcnnntaaaatnntttcncttaagaagtgatccannagctntgcgatgggtgtcaggggtctggggtagtannatataatggattgcgnnngatattttngattatggcaccaatnttaacagaaatggcnntgattttgtatntaagaaaaagtagccncaaacaaancagaaattttggtggnttttggttgtggannnncncagacnnccaaaacttcatttttatcttcatatatacaatngganacccatggtggggggacggagtaaaaaataaattttttttttgtgggagggccctccaaaaaaaaaaaaa

SEQ ID NO: 8985 - DNA, 737 bp, Homo sapiens
  misc_feature (1)...(737): n = A,T,C or G
agctctaatttgggcaacagaaagaatttaaagaaaaccatctggtccagctgcttcattttacaaaatcaaggccaaagatgacaatggcttactgaagaccacagaagtagttagcaacagggccaagactacaacaaatgcccagtgttttttccaccattccaccacaactattgtcacatctgagcctgcagattttgagactttttcctaatacccgtccatcttcagccactcaacttttctgcatctaaaattgatttcaccatctgtcatactggagaactactaagactgctaaaataatgtcttcgtgcattaatgtgctaaatgctttgcatatgttatttcatcaaatcaacagaaggaaactgcaatttacagatatggacactaaatttcagaaagtctatatatctttcagaaaagctgtttcagaggtttcacagccaatgtctctaccaagaatttgaacccaggtctaacttcacagtccatgctttttccattatgcaatggaaaaaactttaatatggccctaatcttaagtttgccaaacattntgctaccactgatgtcaaactcctctggaatctttactaagcaactgaaaataaactccattcccttcaagctacggaacttcaatataatgtctgttcagatctgttcaagttctgctttgacttgtcctggttaaataaatccagtttcaaattccaaaaaaaaaaaaa

SEQ ID NO: 8986 - DNA, 1341 bp, Homo sapiens
  misc_feature (1)...(1341): n = A,T,C or G
aaattggtgtagtaaatgcgtctcccgtagcaatcggctatattgcatgtgacgtggcagtacgtattcattacgatattaactggcgaagtttaggacaagcagatgtggtaacaccaactaatgtatagttgtgttatatatgagtacccctgcgactcgcatgtcactgggcgccgcccgagtgtaaggagctcatatgtatatatgtgaggtgcgaggaggtgacgcatggcgtcgtgagtagtgagggagcagtcgtgagagtggggtacgtgcgtatacgctgtgtaggcgggcgcgaggcccacgacacacggccgtctcgcccgcgtgaggggttatatagttgcagatgcctctctttccctatcccacgtcccacacgcgcccggtacaacgactacgaatatttacgtctcggcactcaatcgtccgtatcaaatacacctctttatcgtatatatattgtttgtctcgccgcgccagcgtntcatagtgatggcttacacagtgcgtatcaaatcgagtacggccgcctgtccgcgttccgtgtgtggagcgctgcgcgatgcgcaatgaagcggtaagaatgaatagattgctgtgtaacgatcgcgttgacacgccttctgattagtttctgtgagcgtagagtgagtgtgacgtgatctgtgtctaacgcgcctagtcaatctcacatggcagagccagcagcggacgtatcaccatccgtgctctatctagactgcctatatcactcgatctgcagcgagttaatggttactctgtgagcagtggtagttctgctatgatctatcactctatgtcgctttccgtgaagcgctccgcatgctagttatattcatgccgacaggcatcagtgctgcagacgcctctaactatatgcgcgtcagttaganagagcgtgtcggtagagacgaagacatgatagagagactgatgcatatcgcgcacgttgatcgcgcgcgcgtcgactcctcacgcaacgcgtacgtcacgagcttcgaggcgtatcgtccgaggtctcgcccgtgcacctgtcacgctcatgtanttgctcactacgtgaccgagagcacggcgcgtgcgaagatgtccgtgaagagcgctaacacgcgccatacaccgatctatataattggatgatggcacagtggtatgagcgtccggagccgatatgtcaagtctagcagcgtacgcgagacgagctcagaacgtgacgtagtgtacnaggcatctagagtaccggcgactgcgngcagagagcgagaagagtgtataaagcgcgtgtgtgtactgacgtcgccgttccaatgg

SEQ ID NO: 8987 - DNA, 100 bp, Homo sapiens
agtactgatgaaatctccatctccagcatttcacccacctcagaagtacaaagatagaggaattttacatcctaaacgaggtactgaggaccgatcagac

SEQ ID NO: 8988 - DNA, 185 bp, Homo sapiens
aagggggcggagggtcaggaaccaggtgtccgagtaccatagattttaacggcaaggcggtctaattggccaatgatagaaggataaggtccttagagggcgactgagggtcatggcacactatggacgattctagtgtcaatggaggatggcgaggacagaggctggacggcggtagtgggggc

SEQ ID NO: 8989 - DNA, 1172 bp, Homo sapiens
  misc_feature (1)...(1172): n = A,T,C or G
ccccagcccccacacccccacgcccacgccgagcccaccccccctttccaggaaacccacgccccacctttaagcgaggaaaaggggaacgcaggaaggacggagggggagagaaggcagaggcaaaagagcgacgccgcgagccccaacacccccccagcaccaggcccccccacgcatcagccacgaccaacagcccaagccccagcgcnaaggagacgggcggaacgcagagacagggacccagcaaagacgacggagaggnacacaccagccagcccaccgagacaccacagagagagcaaacccgaacaacacaaaaagcacacgcacccccccccaccccccacccgcccaacaccaggcccacgagagacgaccccccacacaccacccgagccagcaccncacaagaggaagaagacgcccggcgaggcgaaacggtcaacagcagcacaccacccctccgcgccgccacggaaccacgccagaacgagaggacggaaatagcgccgaggcacaggcagcaccacacacaacccaagaacgcccgccaaccanacacaagacagcacgaccagccacgacgaacgagacacaagggagcaggagcagcgcacggacccacccaacagcacgagcgcgagaagcgggacgaggagcgacacgagtnncgcgagcagacaggagcacagaaaagaaggccgcccagcagcaacccgaaccgcgcacaaccggcacgcgtcncgcagagacagagggncgagacagcagaggagagggaccggcaagcaacgcgagcgagcgcacacgccccagagaggctagcgacgagacaggctncnagagaacgaggagcgaacccagccacgccccgccacaacagcacagccacacgctccgaagccntaccccgagccgccgtccagcgcgaagacccgcggcggacgccgaccagagaacagagagcgcncagccgaccccagcagcccacagagcgcacagaccgccaacgccgccacaaccaccacagctacccgcacgcccaccgacgacaccaacctcagcacacagagcagccgaggccgcaagcaagacggcgccacancngaccgagtgcccggagagagnccagaagacagggaagacagagcagagcaccacgccaccca

SEQ ID NO: 8990 - DNA, 497 bp, Homo sapiens
  misc_feature (1)...(497): n = A,T,C or G
ctacagatatctatagctgggtatttaatgaggtcccttcctttgtgggggggacagccggggggtcatctcccangagggatggggggtttatatttataaantccaaacatcanatgtgggcagctatatttgtctggtgaaaaacacagtgacgaatgctagagtccttagtcctccaacgccactcactctgcgtaatgatggtgtgatgggagaatatgagccgaaatggggggggcttttcctttcacggttacanctactaaaggaacaactnttaaaatggaatgctttncacttngcaataaatacatanaagggagggtgaagaaaactgcttcactcaagaagggctctggttatcacttgggggcctttctaagaaatgtcacaattatggaaaaaagaaacatcttatgaagatgtctaccctctacctaaagaccaatctggcacccttatgaaaataaactactggcctcgttggcctcaag

SEQ ID NO: 8991 - DNA, 1853 bp, Homo sapiens
  misc_feature (1)...(1853): n = A,T,C or G
aactcactcgncnacagtgctattctgcacgttatccaatggtcaacactcacctcgcctctcagtnnncacacgcncactcgtgtctacatcgttgtcctgatactacagtaacacacacctcgaccacgtcncctcttcttactcntccacatcatcacttcactgtcatatctcattatatacctnctcaaatgttncctacataacgtnccacccactccnatctcttctctacctacactaacctggcgtcaacatactgttatggnnnatatacaaatacaaatncactgtctactcctctttcaacatttcatgtgttnttatatggtttagtagatatatgatttctcatgtgtcacgcnncatatctncatatcntcnaactgtgtcactatcttcaatcagtnctanactcatccactattctctcactttccactgtgtatctccaatttgagtactgtctactgtatactatcacttcnctccacctactgccctcgtactcacatgactatcacacgtcctctgctacttactatatatctcacactactagctgtagttattagtgagnnnantaactntccacacnacggctgacctactattcnaccgtactctantgtgatcttagtataacctancnactactactcactgcacnacttactactatatctcgtnactgtgcnacttcgtctcgtatgactcacgtgatatgtatgtctactgactatatctgntctctatacaatctnattnctactatctcatttcnacaaatctgtccagttacgtcccncctacggctctcctcactactttgatatctatctatactatcantatatactcatatacatgctgatatattcgcnagtgagcgtacagataatgcgcagttacggtctctcatagtgtcgtatcagacacactcatcatcccactcncgtcctatgtctagtctatcttcatgtatactactgcnctgtataatcatgattntcgtagatgatgtncatatatcnatatatagatcatacnctactatgtacanaacacnnccacgcatttnctntcntatnctactcttctactatcgantacagtcagtactatgtgatctacgatctcactccgctcacactagtagtntactctatttnagatancntcgatacactcactnacacanacactagactttcgtncaatgacatgatngtctagctgtacgtacgntcctatctacatgtgcacgctcanctgcatgctcgtcctctctctntgctnanctcgatgnactncgcttctncngcctacgcgctacgaatatactcacgtctctacgcgcactcacctctcagncaccactctatctcgtatataagacatacgcnactcactatgtatctaaaattatacacacacatactcnntgtattctctacttactagatgtacgctctatcttttcactctgtctctatcgagccactatactcatgtaacacntctctacgacaccaatacatatagctacaacnactcctacctatacttcaacatannaccnnacggatgtaanttcctctctcatacactgcgtcatgttaccatcacataagtgatactaatatgatatatataacatctacatctcgcaccagtctctacactataatacattcgctcctctacatcagattacatagcagatacnactntncatctatagcagcgtgctacactagcatcattacctacattatgtgattactcgatctatacttgtgtctctacatcgntccacgtcgtctgccactgcgtgcgtatacagatgg

SEQ ID NO: 8992 - DNA, 1752 bp, Homo sapiens
  misc_feature (1)...(1752): n = A,T,C or G
gcacgcatgtgcgtgctcgaaggctcacatgtatgtcgagcatgttcctnatgctactaggtcagcgaagtacgatcgtcgaagcacancatgctgcttgggcactgcgcccttgtctcccttgacacatgccaaacacgatcaccgatactatggactagcgcgtctcacgcgctcctcctagtgtcgntcctcgtcgtagtcngcatnctcaatgacccgtcgacccagccagcgtcacactgttcgccgagccgcgctcgcaacagatagcaatctgtatagcgcgcacacntccagacgacagttgtgcagtcgatcttatatgaatcgtatcgatgacgcagagagtgtaggtaactatagtcatctagttanctatatgatcgcactaacgttgagcatgtgcgtatgttacgacggctctcagtagtatatagtgcatgacgtagacgtcatagcttcgctagatattcgaggctcgtacgatctactgctatagtagacgctatatcgagtntagtgagctgcgtcgcgattcgtcacctnntanatggtcatatttgacctcgttacagttgtctgatcatgacgtagacagctagtagtattgntactcgtcgcgagngaagaatgatagtgcatagtcgtcggcgttgactcgncatatatgatagagtgttctgtagcgatcatatatacttcgctcttataactgtgcattatctcagacctnntgacggatgtgtgacgaagctgtgtgatgtgtggtggtnnnctcagtgaagagaggacgcgagcgcatacgagagagagtagctangngcattgatcgtagagagagcagacgacgncggcgngtgactgcgtcgcaacatctgtccaggccggcgctgatacgnacagcggcagagtgntcgtcgaccgcacgtcaccgcgctcgtctgttcacgcgagacgngcacgctatagcatctgacanctctcagcatcgttcntctatgtgtgcnctgtcggtgcgagctacttgacggagttacgcatcacatagcatnctcacacntatatgtatgtcgcactagcgtcttgtagaccctcctcctccgtcatcacgcacagactcacagcgttactccatcataacggtcgtcttcgttaacctatcacacacgtccgtcaacgttcacaccangtcttacgttcgcagcaacagctgccgcactcgctgagctcgttatagnactctcgttccaactctatcacagacacgacgcatctatcagtctcatcacagtctcagtatctctcgtaccgtcantatcgctcagtacntcnctatactcagcacgactntcantnacgcgtcnagatgtagctacgtcgacgcgngtctctcgtcgtactgcntgtcgtcgtagncagtctcangtctcacggtacgatcgctgcttctcgtantagncgactcgtancgagagtcagactgctgcgagaagncannnttcatctcacttgatgtactctgtacgctagcgtctngtnntctggcgtatctgnanatacgaaccaagtgacgcgagtagttcgtatcatgtatgacagtcagantcgtcgagatngacgtgatgagtgagtgactgccgaccncgncgagtacgtntgacgagatntagtacagagatctgtcatacgatctagctatatntatatagatattacnttcncatcatcgctacgtcgtgntnatntgct

SEQ ID NO: 8993 - DNA, 1920 bp, Homo sapiens
  misc_feature (1)...(1920): n = A,T,C or G
tgtagagtgtgcgatcgtttgtaaggagancgagactgcgtaagtcaggtgtgcagctacgtgcgataggtncactcattagataggtgcgcagacgaggccactagatcagtagtgnccagctgcgcacacaggtgactcggtcagcgtgcctccctgctgcgtcctaccagtctactncagtcantgaccctgctgcactgtcatctcatacgtctacatgtggtcnacacgcatcgcatctccctacatgctcacgctctatcatcacgattgcatcgcgcgagcgacaganagtctcncagcnagacacaggaatagctctcgagagaactctgtgatgcacncggatnngacnnnncctcatgtatctggtgataggcncgcntgcgtggagcgtacaccngatcngtcgntcgcagtgactggttngagcgtcgctagtgtgcgcgcaccggtgtgcgatntagacnngtagctgcagagtggatgtgtctatgatgctctacgattaatcagcgctgnagtgtgtctcgacagtcacatcacgcgtgatgctgcgacgacgccgtaccgatgcgtacggatgagaagcgcnacacactagcgcncnctgtctgactcancgacgngcgcgacagtgtcgcagncanatgacantcggctacgcgnnntacatcgagtcgctgcaggtgatgatgnctcgcatagacgcacacanagcatcactcattnanatntnagctgtcatcaggagcatatntatgantgacgcctgangtaagactacgtgtgatcgctntcgttatgctcgtctgtgngnacgagtgaagtggttatatgtcatgtgtgaagttggacaccatacaccagtgcgngagatgnctgcgagacgtgtgtggaagcgagcttgtatgtancacgctatgcgatcactcgagctcngatcagtcgngncgcgcgcagcggncactgcgtgtgcgacgagtacgcgtgcgcggcgtggcactcgnaggtgacgagtgtccgtgntcctaacacacatatgtgatgacgtcgttcagagttgcgtcacggagcncgtctcatacgnctgacgccacatcnatagacataaggagtcacgatctcgngagtgcgaggccgactatgcgagactctcaggcgntactgtgatacgangnaggcacgactctctagtgctaggngntcgcgagcgtgcttatggctgtactgtggctgatcgaactagtagatagtctgtgccgcgtgcgatcacgacnatgcgtgncgtgntctggtgtcgtatagacgggcgcgagcctntcgcgctgagtagcgtagacgtcgttactcgtgagctgcgtcagcaccgctgatagagngtagtgtgagagagcagctgcatcgacgtnagatgagaatnagtatgcgctctctgcgttcctcgcgcgtgngngtatgtatcgtncagagtagcacgctacntctagcgacggcgatagttatgtactcattgtccacntagtacgttgttagtgcagttncgangntagcgccagacgncgctgcgtcacntcgangagtgttctgcgtcgncnacggaacgacgtgcgagatgtgagacgatgtcgatgcatangctaggcatcgntgcgcganatgctaggcatctgcacgtatcgtctatacgacgcancgtcacagcgcacagtcagcgcanncaatgtaacagctcgcntcagctcgatcgtgatctatgctcgtcagtccagtcgtacgactcnacnggtatcgcacacgtgccgcangantngctagcgttaccgctcgcacatgagntggcgtgntacgtccattagcagatatcgtgtncagagtggcgagctcancgacgctcaactcgagcatggcgagcac

SEQ ID NO: 8994 - DNA, 104 bp, Homo sapiens
ctccttcgagaactcatagaacggaagaccagctccttggatgccaacgatcaggtggccatgggaaggcagtggcttgcaatccataagttacgaagcaaaac

SEQ ID NO: 8995 - DNA, 100 bp, Homo sapiens
agtcttctacattcatgctgtagaagctatgaaagtcgtgggagactatggagtcaacactgcaaactcaagcactgatacgtccggagagcacttgacc

SEQ ID NO: 8996 - DNA, 1682 bp, Homo sapiens
  misc_feature (1)...(1682): n = A,T,C or G
ctcattgtgtattacgcaacaccggtagtacgaaagcgatgacggnagcagtctgagtagtagtgcnaatgangtagctnanacgaagacgtagaagtgttggcnncaggggtnagataacaagatagatacgctaataggtgacagatgtcgtgcgctagtcttacgngtaaaaagacgntacacatngagtggncccgacggctaggagtcggcatagtgaaagagtctnnncatcagcatctaacaacagccccgatgagtcaccagtgctatatgctatcgctacctcacagatgcatgcgtgacgcnctcggctagatgtngnccgtcgaggcaataccacgcacttgttgagtggttcatcgagtcacgcgtacagactctcgttggaaactgcagtagtcgccctcccgacggtgcccatcgangacgtcatgtagaggctgcgagcttcgcgagtgccctcgaaggactgccacccggcgcacatagcgatgatagagacncttgctcncacactatagacaatatattatatatatatatgtactgaactnnaccgactgagacgtactcactcgatcgnntcttctgagtcagactgttgnacgcacgcgtacacgagactctcaccgcacactccntctacagatgcatcacgcgtanctgcctactctctcacgtgcgcgcgtctgattgtctcacgtccagagtgtctncncgcgctctcgcccgcacgcacgtctactgagnncatatcgttgtcgcgtgactacctactctcataatcggctnctnctacgagtcgatcgacgttcacacgcccnatctatggcgcctacgcgcccgcgcagcncactgtagcgaccgtatcgccgcgactgcttnnacacctggctgcaccaggcatcgacncgtcacagcacgagcgcnacgtgngatccanagtcgccancgacgtgtgtacgaatagtgtggtatctgcgnnctgagctttatancacagtggtctctcgagtagagtatntgatgatgtcgtcatctcagtattcattgcggntcactcacacagtcgccagcagtatatcgcacgatacgtcatacgaagacgcagacgtccgtgcngctgtccggcataccgtnaacacggagacgttatcagccgtacatgnttcaacgttctccgcgcgcgaggcacgcacgcacagcgcgtcatgacatcgcacgtctcactcctcaagccgtacacgctgccgaccgcggcgcgacgcgccactcgcgcgtgcgcgccgtcagcgccacgtactcaccgcacgtcgntctatcatccatcnccacgttacatgctcacgcangatggatctnctgcaacggacgtgtcactcctgacactgagcgctctcagacgctcgatacacgtctccagacgatgtgntatacgaccgcacgcacgcgcgccncgctgcgccacctgtctctactatgcaccgcatcactcatcagactcatgntgtcgatagctagcgtcacatccgctgntcgacgtcgcgacgtcacactcagtgtctncatgatgagtatgcgtatctcncgcgctcgtgctccgcnancaactcatgtcactgcgatctatatgtctagtaggtacacactnntaactagagcgaatgataaagtcg

SEQ ID NO: 8997 - DNA, 1173 bp, Homo sapiens
  misc_feature (1)...(1173): n = A,T,C or G
gcagttagtatacgacctttgtatctgtgaagctgcgtcttctcacgacacgtcattggtggaaggatctgcctacagatttacgccaagcgtgggatttagatctgttccatttatttttttctaattcttattgtcttgttagtagaggtgacggacaactattgatattattcttatatcgtttgtaaactgataagttctatacgcgcccaatagtgtactacggcgaacccgctgcgcaagagtgtactgggagggacaggataaatactatctctgttcattctatgcaactatctgtaagcacgccatgctttagctcgtgtcatgtagttgattatgtgtattggagtgagcgagttaaccttctatttattcttgtccttatcttctttccctgctagcgtttattataaacaaataatatggatgtattacatacgtgtgtgaactatctgccagaacctagaacacaagaacaacgtactgcgtcgtagtaatactacgacagtgagccctattgtcttatgtattgttccgacagccgtgatgtacgaagtttcagtctctgtagacagcatcgctgtacatatcgagactaatgatgagcgtcgtgttcggctctaatcgctcgattatctgcagtcgagctataaatcctgttacgacgtactcagactaatatcgggtacacaacgaccgtgtcgcgtggtcgtgaagtattggtatgtgtgcgcattctcagttattgtactactgctatgcatatagtgtgaagggcgaatagatgagtatccaggaanctctatatatgactatctcgtcatgtgcgacaggtctacttaatcacacgacggagtccactcgggcgtagtcactatatcgtctctactcatcgtctacgcggctcgtacacgtcttcatctaccctcgtntctaccaggtctgactggtgctgtgcttctcgtgtgcgtgtactagctagtctccagtttatcgcgacatactacttatatactcatgttcatgttcgtcatctgtcttctcagtgntctctcttctcgtgaatcatgctaggtcagtatntcgctgtcgtactaatcactagttactgatcaggagatgatagagtgtgcgtcacagctgacgtgagcgagtatgctgatagag

SEQ ID NO: 8998 - DNA, 179 bp, Homo sapiens
  misc_feature (1)...(179): n = A,T,C or G
cgcgcccacccacgcgccgaacacagcggcccaaccggagaaagctgagcggcacagacncncnnacttaaccaccgcaacagacaaaggaccagggaaacagnggaancccagcanganggaaggggaacagcgcncccagacagagagcaaggcggcccaggngcagacgcagacgg

SEQ ID NO: 8999 - DNA, 1104 bp, Homo sapiens
  misc_feature (1)...(1104): n = A,T,C or G
ctactcccccacccgtccaatattttagtattccaaaaaaaaatttaaaaggtaaacaattgacccaactttacagcaaagcaaaccccccaggacaacaagccagcgcacggaaaagaccaaattatgtacccattatttagcaacaacccaatcatttggaccaagaacacgntgcctacttgttgtatccattatgtcacattcctgtgctatgatccgtgactttttccattcgcgaaccatagcgtgagttggttgtctaagtacatgcgctccgagttgccgtttcgatgacctcttccgataatgttttttcaaactgctntagtaaccctagggacagatcgcacgtagtcctagtgatatattagtaatgagacgatttaatgattggtcccaggaggtggccgtcacagaggagatgatacattagagtatctatgcaccttctatttacttcatactgtcctgtgccgacatcccaatccatgttagatggatactagcactttatcatattgttntattagntcccctcacgcttgtgaatgagagtggaaaataattgactagagatcacaatcgtatgatatattcaacattcagctgctggcacgtctaatgtccgaatggtatacagagagacgaccaatacgtatatccctataaaggcttccntcttcacagattgttcgatttaagaccgccaactcgaaggtagagcataacaataatatatctcactccgtattatttggttcatagcctaggttgtcatagggtttgtncattgttttgatttcttgntgcagtacaccgccattgggattgttcagtcacgtgtgccatgttaaataatcgccaacctgtagtggtccgagttatgtacnctgttgcaagttgtacgctgcgctcaggaggctcntagaatatcatttctgtcctacgtaggtgctgcaagttattcntncgcggtaccttgtgctagtagcgatagtnacacggtagttacttgctcntgtgatagaggtagatgcgtcacatatatagtagcgaaggcgcagacacgtcagaactgagagtagcactcacttcattttt

SEQ ID NO: 9000 - DNA, 274 bp, Homo sapiens
cttgtgtaacacaacattcaatggttatacagtgaaatttgggagtcattgacatagccagcaatggatacaatgactgttggaactagatacatctccttactgttgggaaaagtgagaattcctcaccagcaagaaggatagttgtatcttataagggtggaaatacagagttatttacttgttgtatgaaagttgaaatgtgtgtaaaagggtgtatggaatctgatttgtcagaaggaatgacaatgacattggtttaaaaaaaaaaaaa

SEQ ID NO: 9001 - DNA, 1650 bp, Homo sapiens
  misc_feature (1)...(1650): n = A,T,C or G
taagtggtgnaaagtgttggttatgtggagctgttcgtcaggctatgtgttaggnntactgnaaatagatcataagtggtctaatgctatggtattgtgcagttaatcatttcacaattattatgtncgtgtgacgtgatgattcagtttaatggcnaatctnaattagattttacgtgtatgtgnnncacgtntgtcatcattttctcggcctcgtatccatgtgcncagcacagtacgtgtgtncaacttctatatcgtacacactatagtcnctcatcctccaatctgttattctgctctgtgtgacttcttggttctatagatactatgattacatgcgctcctcatattcatcttctgtggtgcatatcttncctcgctncactccttataccttctatttttagttctctgtgtttgtatacgttcgtcnnntatctgtcacctcttctcctctctcatctgccacgctctgatcgttccgtgctnctgtcttggtttattcttctacatctattgtcttgtatacctcnncctaatcaccagttgcgctatctcctctcctgttcgcttatgtnctgtcactcgcccgcnatctccttctttcctttctacgctctatcatcgcgctgtctgacttcggaagagtntcatcttctgtctctctctcgcgtctctgctcctatctattctctctcactcgccctctgtaacttcacgcttccctactattaccaatagcatcatagtctctactcctatacnattgcttacatagtgttgctcgtctttctccgttgtacatcgtatgatgctgttgtgctgtttgatgttntgctggtgtgtgtctcctctctcactgcttctgtatctatctgtacgtagtgtcttagtatgcactcgccgcgtctcgtcgacacgaatgcagtcactcgtgtgatcgncccctcatgtacttatactcttcatctattgtcatcgtcactatgttcagctctcantagtgcgttccttcacatctgcgaatatctctggcacatgcttctcgtcctcgctcatcgtctctctncttcactatgcgcggtaactcntccttgctactnctcatatctccgtgctgtgtgtcgcgtcatcatgtctatcagttcaccangtangctacacncccacagagatgctaggactctcttagacaccacgatgcatgcgcgancntcatgcctactgtcgtcactcatatatgtatagcgtcgctcgttctagcactcctggtcatttatccgcgtcttattcgttgtgcncatgtgatgctattctagctagcgtgatcagctacacttagcactcgtagcactcatctacgctcatatactctcgtntacatgtctcgnncctgctctactgatattgcgncgtcgtctgtncatctgctctgtatatgatgtgctatgtctctatctctctcgctacntacttatgttcctagtcantctatgtgtatatagtntggncttctagtcttctgtcgctgtctctctctcattcttnttgtgtantcatcnctcatggttcatcgtgtcantcatagttgtatgtatcatttctaacatgtgtcgtntcgtaactgtacatgcgcactctatatat

SEQ ID NO: 9002 - DNA, 1421 bp, Homo sapiens
  misc_feature (1)...(1421): n = A,T,C or G
gcacgaggtaggtcacactgactacattagtcgttaggttcgatcgaatggtgaccagtcggtcatcgttgaggcggctacatgaagcggtataggtaacagagctgaggcacatactgagagcagtcaaggttctagctccatggactgcctctggactgtgtaagagcccgctcggtcacgcgcatgcaccgacgctgagtagcgaagcgacngatcacgcacgagtgcgacgcaagtgagtgataagagaaaggctgcntcaanacagtgagtatgctccaagcacacgtgcgaatgcgcgttctcggtnataagtgnatgtgcgcatgctgcttccactatgatgtgctcgtcgagcatcgtgcaggagtctaccaattcgcgggtcgatgatgttgtctcagcgatgtgangttgtgacgcaagaccgtagcgagctggcactaggcggnctagctatcgtgaggctgaaggtcagcctcgacgtagtgctnnaccagtagcgcaagctacgagcgtcatcgctgtctggacgtaccagcaccactaacgctagcgcgcgtacgtgctctgtagtgtgctacgtattcnctgcagaggctgccatccgaccaggcgaagatncaactaagtacacgccacacatctcgcctagcgcgcacacagatctgcatgagtgagtgtgtacgcgaggatgagcgtgagagaggagtgtggtagattacgtgatcgtatgagagtgnattgacgctgtcgtacatgtacgtggccttgtataacagagaatgcgctggagcgtgcgtaggctcacgcagttatatcagttagatctcgcgtatcgncgatgcactcactatgcatncgcggccgtgcaccgtgcgtgagatgctctgtagacgcatgcgctgtagttatggtgctnaggtagccgactgctgctcgtgctagctcggctcactgctagcgaagactctagacgcgacgcgatgcgatcttctactaactctgctgctgtcatcgcagtgttcacggctcacatactcgcgacagcaggcgcgtcactgcttggtgcatgcgcggagtaacgctatcgtgtagtaggctgtgttgctagagctggagactgtgacaccaggtgcctctatggtgacgctagtgtcnatagcgtggtgagtcgctgctgtcgagcgcacctgtccagccgcanctgatcgccgctcgtgaataaacggaatatagccacgccgccttctcgattcgtctatctacgatccagcgtgtcgcagtccaacgtgcagcgcctcatgcagacacgtacgagcgtgctcgacagtccacttacgaatgtacggtgagtttgcattcatatctatggagtagagagtagttcagtagaggcaacggacgtgttccaccag

SEQ ID NO: 9003 - DNA, 191 bp, Homo sapiens
  misc_feature (1)...(191): n = A,T,C or G
aaccgacccgcggcggacagagaaggaggcggccggaaaaccggaaagtgaagcggcaaccganccactcacttaaccaccgctacagaaaaggcagagggaaggagcaccgcaccnagctgaagccccacggggaaggcaaagcgaccaccacggagcaccagcacacggaggaacgcggccgcgagccc

SEQ ID NO: 9004 - DNA, 822 bp, Homo sapiens
  misc_feature (1)...(822): n = A,T,C or G
ctgaaacctgagttaagaggtaggagtcagtccctgaaaaaggataatgctgtttttcttgaagtaccaagaaacctaaggatgaagaggatttgacaatggaatggcatctttaatcagttgtgcttagacaagcaaatgactttggaatttgaggtgaagacatactacatgatatgcagcaggatcacagacaaagatggcaacaggggctggagataaacttttatgatatgtcttatgcttactattgatataatagatgctctttgaaaaaaaatgcaaccgtgcaaatgtatgaagagaataaaatgcaccaattccgcctcactgagataactgctgttaaaattttgatgcatttttttctagtttttttcatacacacatatgcattaacaaaattatatacacattcttgcagtctgcttttttatttgatatcatagcagaaatatttttggaagctntatttttaattatattttgatgagagggagagatgatcanagggaagtttgtgttagttngagaatatctggtccaatatcttccataaagtangatgatgactggctgtgtntataagagagacggagaacagggaccactctggattttaagtgtcttggggactgatacgatggctgtgttacccatgggggactgaggaacagactgacttaagctgtgcttatttttatatcaagggggacctgcgactggctttttgctagctggagaattgttggtttttataccagaggagaagaacctggaagaaaagaattctaaaaggtttggctgggttctaccaaggaa

SEQ ID NO: 9005 - DNA, 1118 bp, Homo sapiens
  misc_feature (1)...(1118): n = A,T,C or G
ctgtggaggaggttcagggggttggtaagatagcttattcattcgattacacatctcttgtacgcggattatattgagggtttattattctggttgacacgatatcgcatgttcgtgcactggcacagcatcaaacacgcgttgaagcaagaaaataataccagaggagccgggaatgaagaatgcaagtgagaagcggagataactccgaaattatatgacgccatggcgcaaccgaaacgcactatacaacagccggagactacgtcaactaggcttgattaatagcaaaatcccaagtaagtaacaacagaatatagagaatttatataatagctgcatgtgattacgtataccatagcatgagagcatatcgaggcgacgcacaagcgatccgcgcgattaatatactatcacagacgagatgacgtattataggtacgcagagaaaaggaagagagataagaagataagagtgaagaatgacggagtagaacggcgatgtcgatgagagtgtgatactgtctgtggcgtcgtcgtctaagtcgacggggacgagagtagacgtagttgcgaaggcggaggagcctcatttagatagagccgcgcggatgcactaaatcatagataattgagatcgtacgtttagctgcgttttcgcttactttggcgtttgtcgtgatatatatatataccactacaacggacatatcaaacagactagcgagattgataacgatacgaataaacaagtatataacaaaattatttatcaaatacactagatctgtgccagaggatacataggatcattgagatagtaggtgtatgctgaattggtatcctatataaaagatcgcagagcgagagacgttcacgttgacgaaganctaagcgcgtcagcggagtgttagtgagcgggatcactactattagaggctcctgtcgcgcacgtatgaaaaaaaggtcatagtgagaacgtagctcactgcgccagatataggagagaggaagagaacggagggcgtgttgagatgtgagttcgcggtcgctatgggaggggagcagcgacgcgagcgtggaatctgtgggtagatcactattataatactgacaat

SEQ ID NO: 9006 - DNA, 1912 bp, Homo sapiens
  misc_feature (1)...(1912): n = A,T,C or G
atgtggagctgactcgacgcggggatctcgagagcgagtgttagggtagggggtgttaggtncgtcgatatccatacgataagttctctccagacgctcgctacaacacaggagaatgatacagtatattcatctattaatatgaacaaactataagatatgtagaggagaaataagtagattagagacgttgacttggatnanaatatataggaggatactgtctatgagngtctactctagcacaaatgctactgttggtatgcatgtgtatccgtcatgaatgctgttgtcgtctagaataggagttatcggtgtatatatgatgatagagtatgatgtgnacagtaatttgttaatgtatgtcctgcggcgtggggtgaggtgggacagggagagggagatgcacgtagngagacgttgactggagcgctagaggaggggatcacgtagataaagaatacagagtgagagagaagacatgcgtgtgtgacatactagctgagagtgcgttggatgcgagtagtgagtancacgcacgtngntagtcgcatctactcgttgnncacatcgtatatacatcactatcctatagtgtgacgacacagctttgtgntaagtgtagtctatagtatacgagtaagcaatagatagagactagagagagtgtgagtgtgcagcagcgcttagttntntactagtatactcatctatatattgtcgatgtcatcatcgtnacacgtgcgcnttcaccanacatcgtgtgtactntngataacgcagcaatgcacgcagagctgtgcgnntgcntgaaagcggagtgngtatgagtgagcagtgatagcatgcagatggtgacgaaagatgagctgcagtcgtgagactgagcattaacgtgtggcgagtgtctntatcgcgatataatgtgtgtagtgacagtctgtgtcgctacgcgcgagtgacgantagtacatgacgtgtggcgagatagagcgggattgacagccgctancangcgagactgggaggtgcgtgtggtgagtgaggtacgtaggcgnaggtgagtagatagtgacatctgagcganagacgatgcngacagctgagagacgaatgcgacatagcatcnacacacgacgcgcttggagctcaatgtacacacncgnngcgagagacgacagcgacgatatnatgtangncatnantnantgtgtantgtatgtatagagatatcgtataatagactatttcagtcgagtcnntcgacacanataatgaacgaatgacatgatcacnacntactcagctgaganagcgacangantaaggatagcagtgtgagcggtcgctgcgtactgcggaacgtgagtcaatgtaggagagatgagtgagatagagcacgananagacgnagancatctgtcagcgactcgagcatantntacgtattaatagantcacgtgtancnatacgannacangtgctcactctgtcactgctgtggtgncgcgtaggtgtgagngagctgcgntaacntaacatgctgcaagatnagcgatngctncactcatgngacgtgactgtgagacgtgngcagtgtcgcgtgacggcnctgtcntaatgctcgtaggcatacagtatatatactgacactgtctacttgcgtgatctctgaccgtntgactgatcgatagtgtagtctatcaatatngtgcatangtggctgtgtancatatgagtgacgcgactcagatgacagatctatcatcagatcagnaggatggtgtgtgtgnggtgataagagccgtctgcatctctcgtagagtatagagctactggagagatgagtgagtctagntgagagtagagtgtgataaggaactcactcgtgagagtgtgcgagggtgatga

SEQ ID NO: 9007 - DNA, 1909 bp, Homo sapiens
  misc_feature (1)...(1909): n = A,T,C or G
gctcgtcgctgctgttgtggngtcctgcgtctctgtcagtcgtcgngttgngggtgctccgctggcgcgagcccgctcgtcgntctcgctgatctgcgtacnttcgcgcgcgcgctcctcttcgctgcnctgtntccttacgcgtgtgtgtcgntgctgcgtgtctctcgtgtctgtgcgctgtcagagtgctcgcctcgcgtctgcgtgtgcgcgcgtcgtcgcccttgctcccgtcgntgtgctggcatantgctatgtactgttgcttntcngcgctncngtacgtctgcgcgtctcgcttcagtngngntcgtcgcatntcgcgcgtcgcatcntcttgatcgtgctgatagtntgtntgtgtctcgcgccgcgtgctgcngggcgtgcgtcgagcatctcncgcgcggtntcgtcncgtgctctcgctctctctcccgttcgtctctgntcgcncntcgcgtggctgcgtgtcgcggancgtgctgtncgtcgtactcctgcgctctgtcgctgctgcgcgctctcgtcgtcgctccgtcgcgcgtctcngctcgctgtgtgtgcntaggctacgtgtgngcgctgtgctcggcccgctgtctggctgccctgtacgtngcgtgnttcgcgtcatctgtcgctcattgtctctcgncttcgcgcctctcttcactgtacgtcggtcttcgctccgtgtgntgtnttgttgtgtgtgcttgtctcgtgtcgcttttctgcgtcgtgctcacncccgctgtctgcgctgcgctccgcgttggcgcctcgaccgtgcgatgcgcgcgctctcgtgtntgctctagctctctncntctctctgcttccgtgcttctcgtgcgacacggtatactcctctgtcgcgcttcttttcctctccgtcggcctctccgttgtgttgctgtgcgctcgcgtcgngtgctggttgcgctctggcgcctcttgtcgcgtcgtgcgtcgcgcgcggctctcgtgtcgtcgtgcttcttcatatccnctcgcgncttctatccgngcgagcgcgtgcgtgcgtttcacgatcggttgtttcgctcatctgctntctcgttcgtgcctcgtcgtctggtcgnctgcgtcgctactntttactgcgtggcctcttacnctcgtctcctnctngtgtagtctcgctctgcgcnctatcntngtgctgcgtcatcttatgngtcgtgtcgtgctcgtcgtgcgngctcgtcngctctctttcgtgntgtgtcgtcgcgtnggaatgcgcgtgtggttgctgtctgngncgtcgctctgcgcgccgcgtcgtgngngcgttggtgcgtgtcgtctgctgcgcgttcgcgcgcgcttcgctcgtgctcgctcnccgtctgtcgncggcgtgctgncgccgctgncgccgcgnccggtgncccgtgcncggctgtctctctcgctcgtcttgncntgctcggctcngtcgcgcgtgtgttcgttgtgtgcgtttgcgcgtgtcgtgcgtgcgcgtccgtcgtcctgcgcgctgtgtcgcttcntcgctgctgttcgnctgctgcgttctcgtgcngctcgtgctgtgtngccgcgcgtcggtcgctcggctgcggcngcgttgctgncgcngcgngngtctgttcgtgtctgtgcgcgcctgcctcgtgcntcgcgggcgtcttgcctgctgtcgcgtcgtctcncntgtctngcgtcgtgtgtcgtgtngggtttttcgtcggctgcggcgtgcgtagaagcgcctcctnctctgctctctcgntgggtttctnccccggcgcgtggagcgcggtctctgttccgtcttcgtgctcngtcgctctgcctcgtccttctcctatgtnttgctctcttccgtcnctcgccctccttcatcgtctgc

SEQ ID NO: 9008 - DNA, 1156 bp, Homo sapiens
  misc_feature (1)...(1156): n = A,T,C or G
ctcacagtttgttactgccctgcatgtgtcacgtaccactgtgcccagcgcatcgttcagcacgctatagcaacttccccgtctctcaaccctccgcgcgccctctctcatgcnctccttntccctcgccccccgttctacttccgtctcctccctcgtcctcccatgttgtcttactgtctncgagctaagtgctctggtacggcagatggttgaattnncttcttttgtagactttctcatacttctctttgtcgctcgcactgctgactgctctaggctactctcccctcggtacggtgcgccgatacgccctcggccgagtcttgtactccgcgcgccaaagacggcggtaacaatcgcatccggccccagttcccaagtccccccctggtgctctnacccgagtaattacagcccaccaccagcccggctccgnccccccgacgcactgtgtccgcgtgtgctagattcnncccagccacacccaccgcgtgccgtactccatgacccgaaggatcctcatctgcactgatggtatagcgagnatcgggagggcgcgatggaagagtggtactccacgcgagtgatatacgaactgtcagacgtaacggttatccgtcatctagttcggagttgccgcggagcgcagcgctcgcgtattctacttcttagtttattctccccactcatgtctctcacacttacacctctctgctactactcaccagcacgcaccatccagatcgtaccttcactctctcttctattcagtctcgtacactgctcttgtgacatgcntcattgtatttgtcagttcagttgcgcgtgtgccgagatttncacgtaggtcggtcgctaggatgttctgctcctgtctcttgtgtattgctcgttcctgccctctcaccctctcgtcnccgccctcactccttatccccttccaactcacaccttcacgctccctcgagctacgtgttagacacaatgagtgatagctggggnnnactcagagtntcacaggcgagtagatcgcgctacacacgtacagcctctcgcgtgactccgcggcccgcctcagctttagcttacgcgtgacgtctgttatcaccgcttggcgtacgtggctctcgccgtggacgcgtactttgcccat

SEQ ID NO: 9009 - DNA, 209 bp, Homo sapiens
acgagggaacgacgagcacaaagaaggcacgccagccccgccccccccgcggggtgaggggggaacagaccccgcgggtgaacgggagagaaccggggacccacgacccagggagaggggaaacagaggagcaaaaaggggcggaaaggaacagaggcacaaccgccgcgcgggggggccgacagcagaaaggagagaaaaaagaaagg

SEQ ID NO: 9010 - DNA, 686 bp, Homo sapiens
ctggtttgccgtcagagacgcctaaatggggtactatctggaggaggggtgtgaggtcaggggagggaggagctttgtggaaaataggaaaaataggtacatatttttatgctgatgagaatgagctattagaaggaaagaactgatggtagagaaagcagagctgctcagcaaagtccttcagtaaaggagagaaaatgtgtacccaacacttaagtggatttaggccttggtagggacaggaggtctcaatctgcagtaacagagggcaggtccagggccaggtcgaatgtatagaaacagatgcagtgggttagctatttgatggtggaaagttgaggaaattctcttttgattgattccgttatctcagtgaaataagaagcaggggggccgggcgcagtggctcatgcctgtaatcccagcactttgggaggccgaggcgggcgaattatgaggtcagaagttcgagatcaaccgggccaacatggtgaagacccatctctactaaaaatacaaaaaattagctgggcgtagtggcagacacttgtaatcccagctacttgtgaggctgaggcaggagaatcacttgaactcgggaggcaaagattgcagtgagctgagatggcaccagtgcacttcagcccagggggacagagtgagggtttgtctcaaaaaaaaaaaaa

SEQ ID NO: 9011 - DNA, 1139 bp, Homo sapiens
  misc_feature (1)...(1139): n = A,T,C or G
tacccaagaagtacacgctggtcacgatcatacggcacgacgtacgtaagacggacaatttcatcaacccgtgtcgcctctgctccggcgacctcgagtacagccagtctccggtcgccgagcgtatttgnccgctgtccgcgttctgacctattgggtcggacgacttccgcataacccgggttcgggtgcataggacagcgccgtagaccgagatcataagacgtaccaacgttcgaaccaatgccgcaacgtcacacatgaccagacgacaccgcaccagccacgcactgggagtgaaatactactcgtcgtgtgacgataggggtatggttccgcgatacttcgtaaccggtagtcctcctactccccgccgtttgacaccccatcgtttatcaccacctttgcgcgctcacttcactcttctcgcgctctctcacctatcccatgaagngcgtgaggtgcccgcacctatgcgctttatgctcctcctattcttcagtgctcatctcgcccgattgctcccagatccccacatcgcgcgacggatggtatgcccgccgcaaacgatattgaacgtatgaagactcttcaactagcacgtcgtctttggacatcatttcatgtctcttatattctcaccaatcatccacgcggcgctgtatctcattctgagtgacatgaggctataatacgcaccgctacgtagagcnagtcgttcggggnacacaatgcgtcgggctcccgtagtcacgtacgtgcacgctacaggagattagtactatccgtgtacatggtgtagtcaataantgtacccatactggtaccgtcaccctggtngagttccggctggttgttgccgcatactagtttacgccccaacagtattatcgcacaccactagtattccatcgccgcgcatatctaaggtgtctgatagagacttcgtagtacttcatatgtctcacttgtccgcgctacacctacctttgtatgacccacgttgtctaccgatgacagcaccaccgtattgagcatatacctcatgtattgacctcgacacgacacacacaatgcctagtatgtagccgcacacctccatccatgcgagttatcgtgactacgaatagcacgattat

SEQ ID NO: 9012 - DNA, 1089 bp, Homo sapiens
  misc_feature (1)...(1089): n = A,T,C or G
atcactaagcaacactaataaattattgtcgtgcggttcttttgtggggtgtagattgaggatggaagcgtttcccggggaccgacgaggcgcgcgaggagaaaaatatgtcgtggtcggaaggtttaatcaataacactatctggtttaaggaagtcgcgaccggaatccctccggccggacggcacgcatgtgctagcgaggtacatatgtgtcggttgcacttcgaagcgatgattagctacatattaagtcaaaacacaaaagataacgggagggatgtatgaactttatcatggggtgaagataatgtgcgattcgtgtgtgcgagaaagtgggtagatgggagtgaacaataaaatttagtatacacgcgacaggtgtgtggcggctattgcttatccggcctcctctacgactcccacgattcatccgtggggtgcaggtcaaccgcttgtgccaagttggactacctgtaatcagtgtcactgtaccccgattgctntcatgacatcctccgtgtacacagcgantggtattgccgccgcggacaagtaatacgcatattggaagaggcagcgatagggcgatgaaggcaatcgtgcattatattcagatctaattgatgtccatagtnttctagaccgtagtcagggtgtaaatatacgccatatgtcgccaatcacttcatttagatagtattgcatagtaatggtcgaactctaggcatgatgcgttcataatatagttgcaggatcagtgtagtagtacagacgatgaaatgtgccatacaatcttcaaaccaaagatcatcncccagtttctacagcatagttgtccccccnccgtgtgcctgctcggatgtttgcccatcacagttatgtgtgtcttaatcattccttattattgtagtgccacatgtagttcttcagaatgtctgtgctcgcactgatatcattgtagtcccacagtgcatcacatagtgacgacctgtgttgtatgttagtacgggtgtcgccgcatgagctaatacatatttagtanatggtctacgccatacagtcggttgtgtgacatgcttgggcaagg

SEQ ID NO: 9013 - DNA, 1447 bp, Homo sapiens
  misc_feature (1)...(1447): n = A,T,C or G
tcttctctcttgtgtgtgtgtcgctgcgccgtggtgtgtggtttgggttcttgttgcgttcgtgctcgcgcnttgtctcccgcggtcgctccttctgtctcgttcggtgcggtgcgcctctctgcgtttcggngccgtctcgccttttgttggtgtgcgcctgtctcggtgtctcggcgctcgtggtctgtcgcgngggcgcgcgtgcggcgcgctctttggtgtcgtttgtgttgtctgctcgtgggtcntgcctcgctctgcttgggtcgtgtgtgtcgttcggctgcgtgtcgtgtcttgcgtggtgtgcgctgttgcggctnttcgtggtcgtctgcgcgcccccgncgcgtcgttgcttgctctccgctggtcgtgntcgtgtctngtctcctgccgctgtgggcgctctctctttgttttcttgtgtngtgcccgctgtcttgggcgttcccgcgnggcggtgcgtgcgttgttgtgtggtggcggtgtgtgcggcgccgcgcgcgctgtnccgtctnccgggcgctcgcgncgtgtctctggctggctcctgccggtcttccncgtcgttgtgttgcgttctccggtggctgtgctgttctgccgccgcntctgtgctgctcgtgcgcgtttgcttcccttctcttctccgcgtcggccgctcgcgcgtgtgngttcgtctttcctcgtggtgtctgtcgtccgtctggctgntgctttggttcgcgcgcggtctcttgtgtcttctggctctcgtgtgcgttcgctgtggcccggtgcgtgtgcgtgtgcctctgtctcctgnctctgcttcntcgttgggcgtgncgcgtcgtgcgtgccgccgcgtcgcccgcgtgtctgcgcgcctgggtcttttctgtgtccgctcgcggtgtggcgtctgtcctgtgtcttcgtgggtntgttntcgtcttgcttcgtgcgctcgctctctcgccttgtgggtgtgtccntgtgctctcggccgntttgcgtccgctcgccgcgccctgtctctctnatanagccgacgcccgcgcgagctgtgggcgcgcgtggccgcgtgtccgctctctgcgcgtcttctgcttctgtatgccggctctctcttcgcgcgtgtgcttggtgcggctgcgagagtgtcgcgcgctcnttcttacgcctcttcgctgttgtcggttgctgttctgtgtctattgttctctctncngtcttgtgcgcgtctgttcggtcggtcgttccgctgcctncgccgcgggctcttctgcggtctantgttnctgtcggctgcgcgcgcgatctgcgactcgtaatatgcgcgcatttgtcttctgctgcgtcatataaaannanaataaangagagagatntggctttnctgtntgcgnnnctaagcngcngnngtnggngtgtctcgtgngnttgccnataagcggaa

SEQ ID NO: 9014 - DNA, 900 bp, Homo sapiens
tccttcatagtcactagaggatggggcacacgaaaagaagtagacgtgaaaggccaggagagttagggggagagcaagggccgcaattcttcaaacggacgccgacacccggcggaaaacgcatcagacaagcgcgccaacggacagacacggaagaaaaacgcgtggcggacgcgaagacacgaccgcgggcagatcattgacgcgcatgaataagaaaggcgtgcgcgccacagtgctgctcaacaaacagacatgcggttgtgataataaacttgcaacccaactggtaagtcgcctacaaggtaagaatgacaaagataaatgtgctgcccgccaatggtggcgaaaagagaacaccaggaagtcggtgcccgtccgatcgacatgacggatccaccctgatccacatgtacccttgtccttgccatgcccacatgtcgcagttccccatgacccggcaatgcgaagaccgcctaaagaaatgacatgtagtgcagccgagaggatggcccggccattagcacgtttgtgacacagaatctctgtgccggtacgtggacagcttatgcgtaatttacaactagtgagctcgatccgccgcccaacccagcgcttgggtatcgcagatcaccagatattagcagcttccacggttacaactatccgccaacggtcaaccgatgtcgtcctcttgtgtcaccatcatttccaccacgtctattccaccacgatttgattgcggctgccaggttgtgagttgcacgggatgctacagagctgatgccacaacaaccgttgtacacatgtcacgtttgagcctctttgtagggcacatgatggcagacccccactaatcgtgagaacgactcctacaagctgatgttccattgtgactat

SEQ ID NO: 9015 - DNA, 194 bp, Homo sapiens
  misc_feature (1)...(194): n = A,T,C or G
tgagtgggttttttttttgggngcgccggggcactccagggggagggaaaaggggggggtgggatagagaaaaaaaaaaaagggggggggtgttgggtgggtcttcacgggggggagggtttgtttcgggcacgaatttttttttttgtgtttggtcttnttcggggtggttgtgggaggggagggtagatgta

SEQ ID NO: 9016 - DNA, 845 bp, Homo sapiens
  misc_feature (1)...(845): n = A,T,C or G
cacgacgttctcttctctcttactctttctgaccccgcttctacactcntgcgctatccgcgtctgtgttatctgttacccaccacgtgctgctgccttccgtgccttcctcgggcgcgcactctcctcgtcttaccttgtgctccacgccgcccgtctcgtatcctgcagccgccgccgtgccttggcctgctgggcccatctctacttctttcaaatgttcccgtcggttgtactgctcgttcgctctgttactggtcctcctggggcttcgtctcgtgctaccgagtgctccgtgccttcactatctgtctttctccgatcctcggtattttgcccgtacacttttctctttttatctcctgcctgccgtctcctctcctctctctgctcctgactttctagctgctcggcaatggatcacttgttggcggttgtctgtcgacgtgtcgtctctggtctcctcagttgttgtcgtctcctccccctgctgcttcgttgtgtgtcttcctcttctctttcgtctgctctcctctgtgctctcgcgcgcacgctcccccgtatcccgtcctcctttggtgtagggctgtttcatcttttgcctaggggcctacttatgccccctcgcgtgctagtgcgtcttttcgttctatgtgtttttatgcgggttcggttcttttctccacaaaaattctttctcgtgctcgtctcgttctttcggctgcgttctccggctccactcggacgctgcgttctgttttgaactggatggcatgtcgggcctctgtctacccccgtgtacaatattatgtgtctctattataataagaattgaatgtcaatat

SEQ ID NO: 9017 - DNA, 1720 bp, Homo sapiens
  misc_feature (1)...(1720): n = A,T,C or G
cgcgctagcgcgcagngngtgacncgacgtgtacactngatagctacagagactagtgatccggcatactgtctnatcgacggtcgacactactcctacgtcgcatagtcgtacgaggtacagtgtngaccctcggtcgtagtcncgcgcgcctacagcggtcacagatacgacatcaacncacatctagtcgcgcatanatcgacttctcgatcagctactacgancgtactccaccgtcaatcgcgactcggtcacgcaacgcacggtctnctgcatgagtagatgancgactagcgttgnatgctgcactacgtagcagtatattttgtatgtgtacatgcntcgctatacgtagcatnaacacgtgaggtgagacnagactctgcatacgctgcactcgtgctgctatgcgacgacgtntgatcgcgtcatgtactcgtactttcnaccagatcgnctgtctgatagtctgctatcgacaatgagctatgatactgtctatntatagctcagtcgtgccatcgacgcgctgcgataggacgtgtncacgtaagtccacctcaatgctnagcatatatgcgcagcagaagtcgatnctactctcgccgntncgctctnangtgcactgtcctcactatccttatactcttccatcgacggactgcggtcgcncgtcgcgcacgctgctaacagtatctgtctgtgtagatgcgtatatctctcnctnntatcacgacgactactgctccagtactgatgatcntgactgtcacccagatgacancgctcactcgtgcgagacncgagcgatgcttgtagtgtagtagtatcgangagatagtggacggcaggtagatggcgnacganacgagcagcgtttgacatacatagccgcaccgcgagacgctgactcgaagcacattgggtatcagacgaacgagtgtagatcatcagcgaggtancgtacgttgatgcacacatgagtnctaatgtgaancgtatacgtgcagactcgtcacactcgcatcgaccgatcgacgcctcaagacagtgatatcacatagtncgcatactgcttactctccgatcatgtaactccgcgctcagctcggttcacagtctatagtatagcgnacgtacgagncacctgaccctgatcacagtcgtgcgtctgatcgatgctacactagctatacgctcgacgttatccgtcgcgagagcgcgcactcctactgactagtacgtgccgcgcatgtcttgcgtagcgcgctgactacgcgcgcagtcgntgctgctcacgcacgactcttacatacatcgtacatattcagcgcatatacnatagctntacagcgcacgactaacgtaggcgtcgcatgtggctctcgaccgttgtcatactacgctcgagctgtcgcntgctagtctnctctcatcggcatcacccacgcagtccntcgcgccgcgccgtgtncatgcnactcatcagtcagtcgtcaaggacgtngtactaacgagagtcnattacgaccggacgtacactcttctactagtcttctctatacagacncgcacgcatgacgcgtacgtcgccgcacgcctgcgctagtgagtcgncggcatagagactggtgttagtgcacgatgtgctatagtgcgctgatgagatgangcangagcgggtgtcagtggcacgatcgtnccgtcggtngcgagg

SEQ ID NO: 9018 - DNA, 305 bp, Homo sapiens
  misc_feature (1)...(305): n = A,T,C or G
cgacaacgcgcgagcacgcacccctncgagcacacaagacaaacacagacgaaacacaagcaacacacgccaggaagccctganaagagcgagacaaccagnactnnctactntcncttttnaacncacgncgacaaacgagngatacnacgnctggaggatngcactgtcggctgtgcagcgaataaatntctcgatncggcagagagagaggatagagagcagatcccactctctcaccagcgacgaagccgacgcaggacgacaaacgcgcagaaagaacacgacaccacggcacgggagac

SEQ ID NO: 9019 - DNA, 1666 bp, Homo sapiens
  misc_feature (1)...(1666): n = A,T,C or G
gaggaaagacgtacacagagtctacagcagacgagacgncagcgacactgagtgagtangtagcataggactcggagcnctangactcgtagtcgatacatagtcgcgcagctgcgcgatggtnacnagtccgccacagtcgtataaantacgtaangncatcgatgacgtacatagtgatgagcatagacagagtacagttgtgctgcgcatgtgcgttctcacgcgnatgcgtatctagtacgaccacgctgactcgagtantcaggacagtncatcacagttacttgtgtctacgacacgcacgcagcgcacgtcgatacgtcagtnaggatggtgatggagtcgnnctactgagatctaagggtgcattntcatgacagattgatatctacgttggcacgctgtgccancagtcgacgttcgtactgcatgcagacgtcgagctatcncnatatgcgatgacgcanattcggctcgatcgtacaagacagatagaggcangctgtntantgacaccacgtcaacatgatgacgccgactgacgtcaaagtgagcagagatcaatgtagccgcctttgtgagtacgtgatctcgccnacggtgagagtacagtgcggacagcgatcggnanagatacacgatnactacatgaccatgatgcagcgatacgttatgatcgcgtcgatacagtcgcgctacgcagaagaagagatatagtcacgcgagaagtagtagtgacaacgcangtttgctcgaatagnttagcatctgacgcgtactntntatgtaacgggcacggagctagggctgctgnagacgcgcgacgtaggagagtgagtacgtgcgaatncgctacgcggtagcgcgtcgcatgtgagagcgtgagcgcgagtgncggtanagcgaagagagcatgacgagtaagnaagcgttcacgacacgcacntngaatctaagtgtgtatcgacgacagtggatgacgtcgtgcacgcgctgacgccaggncgtatagaggtgcacacagttagcgcgcatgagntgactgttgcgactatctctcgaagacgcatgcggatgcagtgaagcagcaatcgtatcagatagagtcgagctaagacgcgggcacaggcaccgacacgccgcgcgcgcaccggcagcgagatcgccaagaccgctcacagcacacgagcacatggacgacgcggaacactgctcgcgcgtatccgctgacacgcagcgctcgacgtctacggctctctctctgcgcgcacacagtagctcgttaaccaccgcagtgctacaccgagtctacggggcagcagcagcgtnacacaacatacgnctgtncacgcatacaatctgtagtgataggatgggaatagatttgtctgtgatctatactagcccgcgcacgcgtacgcgtgcgtgactaacgctcgtcacccgagcagacggtactcgtcgntatagagtcgcatatcgtactcgcgatcgcaggtgaaagcngcgctcatacgtgcgacagcagatcgtaacacatcacacgatcacaganaccagagtaccacattcacgatcgactcgcaatagcatcgtactcactcgtatgatcgacgacacatcggtgtctcgtaggagtgtgatagtgtagccggcctnagcc

SEQ ID NO: 9020 - DNA, 101 bp, Homo sapiens
aggctctctgagaagagacagcaaagcttcttagatggatcgaaagaccacgagctgggataccaagttctatgaaaagcctgttacattaggcaacaagc

SEQ ID NO: 9021 - DNA, 1767 bp, Homo sapiens
  misc_feature (1)...(1767): n = A,T,C or G
gtcgacagctggtcgattcangtcggaacgatgagtgaacaggtacgtactgacgactataggcanctgacacacacatgctnttctcgnnaacacacgcctgcgctcnatcgctagacatgacagcgtgactagtacttatgtacgtgcgcatacgaggcggcatacacagctactacgtgctctctctatcttacgcgctatcatctcgagcgatagtatagcaactatatgtctgnatactacgacgtgctggcgacagagggcgtacgtcctcgcgcacgcgttgtgctacgatgacgtcgctantatgtagnagacatcgctcncacagtccactcatgatgcatatctacatacatatcctctcttacatatctcattatatgcatgtaccacatcgccatgcagtaccgacgctactctgtcttacacacgacctaatctgcactgtgtccacttctctctacgtctcacagtacactgagatatcttatacagtgtcttcatcgttaccgtagtatatacatagaggtacattccgtcgcacgatacacgagtgaagagctcgacttatagccgatgatcgcgcagtgtcccccttcgcaggcgacatgttgcgctctcgacagaattccactgccgcgaacggattgtcnacgtagtcgcgttgcgcgacatccgaacgcgtatggaatgcctgtcgcatcaccatctacgacgacacgtcgtcacacatgcactcacagatccatattatatatgataagtgtcgcagaccgcatctgagacgcatcagatctctatgatgtgcactaccgtcgagcataacatgtgagagtgtactagctcgcgtgntgatagtcagcgcgtacgtgtcttcggaggtggataagtgttcgctagatatacgtcgagttgagcgcgtgcaatatatgcaagcgacaacgacgtctacgcgagaatgctacagaccgatcgccgacaggatcaaataatcatagctactacgatcgagtacgggcgtacagagagtgccacagtccgcgtatacagtgaccacttaccgctgtgtgtctctcacgtatccgcgtctccgacgtcgtgtctgaactcatactacatacgcccgcgacgttctcgctagtcgttccgcactatcgatcntgcattcaccattgagtaacggtacaagntgtcacatatcctcatgagnggtagcgtactacgaggtaagacacgcatacgatgcgcagccttaaacgcnatcgtactcgtnctctcatcgcactgntgtctcacgtcgacgtggtcnctcactgtagagacgcacagctaacatctacgntgtctgacatcgcgctatacgacgcgagacgtacatagtgtattagtctgaatcgtcatcttanatatcaggctagagacagcagcagtaggcgacgcacgagtaagaggctgacgtgctacagntactagatgactgtgncantggcgatgctancgaatctatatccgtcgctagtnctaggcatgcgcgacacnttactcgcgacgcagcgatgatcgatcgtgagancgtctatgcntcgcgtatctgctcgatagttcnctgtctctgntagacgagtncgtacgtntctcacgtacgaatactactggtatngtgtancgcgtnctgncgtacgctacatgataggaccgtgtagcgcgtctgtactgactgaaacacgtcgcancactaacntctcacacagtangcngatc

SEQ ID NO: 9022 - DNA, 2071 bp, Homo sapiens
  misc_feature (1)...(2071): n = A,T,C or G
cgtcgagtatgattgtcgatgcgatagcgactagtaattccgcagtcagtcgnttcttctcgcagcatcgtcagggcatgtcacgcgctgcnacaagcgcgatagtactatctgactctgccactccggtccgacgatataccagctgacacgcgacgtatctctctgaganccgtccagagacagcgcagtcacacggacacactcgcggtgctgacgncactgtcaactgtcagactgcatccttagctgcctcgcgtatacgtagttgcgagtccnncancaatagtgcgtgctatgtgtccgtactcatgacagtactatancgccaatgattcatgatgacgtcgtcagtgcgccgatctagntctcgcancatactgatgcgcgcncgcatctgtatatagtnnntctatgcagcaggtacacttggcgacntgagagtganaattaagttcgatancactcacngcgctcgaacgatcgatncgcncnactcantgcgatatacancgactcngctgatcacgcacanacgacgntcgctgaccacatctgctcgtacanatgcagacgatggatgtganggtgtcgnctcacagctnagctagtangncntncagccgcagancactctctgacgacgcatacntatatgtcgtaatgctgactgcttctccaccatgcagcagatgtgatgatgcgcgtgtcatagtaggncntgcgncgcnactcttcgctgcgcagacgacgctcatcanctgttgtcggcagtgatcgctactagactacgacgcgacatcagctagnacagtgagtactgtactncgnagtatcgcacngctactgagaagagagncncntacactagcgtcgacagtantgtatacacatgctatacacgncacagcatagtatcgcgnacgcagcgcgcacacnantgnagacatgacgtagtgntntgntatgatgaaatcagagatcatctgtcgacnatcgtgctgtgatttcgcngcgatnagcgtcgtcgtccnancagtagcgtaacagtcacctcgctcgccagacgtgtnactntgcatgcgntgagacgtcgatctcgntcntcatagtaacgatctagcgctagtcgatctagctctctcgcctantctcacgcgctcttgacggcagtgntcgtgcctcgaactgtctcagatatctatactctgctccgatnattatgagctgtgcgntgccangnanatatctatatgatgtgacgtctgcnagtctcaggctcgcgtgcacaatacagtagacgctagtatnccacactantagtacttcatgcgatatactcactcacgcatgtttntnctcatagactctcgncatngcatcagcgttanacacgctgtagcgaagtatacctacgagcacgatgtctatcacgacgactcacgtctnatctacaantgtctatcatctagagtcgcnatactatncgcnatgtncttcactctcccgctcgcacgtgcgttacgncatctgcttccgtctctctccncagacgccactgagtagnacttgaaanaatacatcgatatgatangncagatcacactgagtacatacataattcatctaccatgctntganactatcacactcctctcactcagcgagcgacacgacacgctactatncgagtcagttatgtncncgacactacactacgatcaagtcgncacatcgcgattntgctgtacgccacttacgacacgctcgtatgtcgttagtgatagatacagatatatangtattactcgtagcgcgcgcacaccgcgtcgactctctctatgtgtgctacagtgtgatctatggagcgctatcaccactgtntgantgattagtagctgtcnactagcaggtcgtcgtatcgatatgcactagtcagcacagtctcgtagacgcagcatgcacgacgtangcacatagctcatcgcacgcancgtgcgattacttgtctnttactgtcactgatacagccatgtagtgtactngtctcnctctcgtcagtagtgactac

SEQ ID NO: 9023 - DNA, 261 bp, Homo sapiens
catgtacaagaggtatagctttctccttgctctctcttctggaccacttgatctgaaggaagccagccactaggtcatgaggacattcgagcagccctgtggaaaggcacatgtggagagcaactgagacttctcacccacagcctgtgagccaccattaagagaagattctccagcccagctaagctactcttaaattctggacccagaggactgtaaaataataaatatttgtgttatttcaaactaaaaaaaaaaaaa

SEQ ID NO: 9024 - DNA, 1492 bp, Homo sapiens
  misc_feature (1)...(1492): n = A,T,C or G
tttagtagtattcatgacagatctatcatgtggagtgagcctcaaaaatttgtcctagactagaattctcttcggtgtatatgctctttagtcgctcctcatccagccgtaaggccatgtatacccacatatcgccactccccatcctcttggatcctttcaacttgtttagatgggtcacaaaggcccgatagacatccgatattaatctagtacattacgtaagttccaagcgtcttcccattgtcntcagatgagtctaaactaaatcatacgagtacgacgcnccaagatttatcaacgtgcagtcacgacgcgcagtttggctatggtgnnnncccgacggtgcacgagtgagatgtgactgtctttattntcactctgtgtattgatagtcacgagtgttaatcagtgcacatgcactaagcacgatacttcagtcantcacacgcttcaactangtctcgcntcncacgctgtgttgacagttgagtgctctgttgtcgtatgcnacgcacgtccccncacgtcgactataatcgctgccacagctgtgcttatattntgtcntatctaagtgcccgcgcacgtccgcagtgctanttcagtgtcgccnccgccgcgcgcacaccgccgtcgccacagtgtgtncagagcataacatcgcttgcacacatagcacactcgcgcncnaccacgctcgctgctntcnncccgtgatgtggcagctccatgtcttatttctacatagtgacgttctctgcntctagtgatgacatgtactgcgatgtcgtctatgcagactgcctcgcgcantcatcgcgtnncacaccatgctgtctagtccagtcttctgtcgcgctactgtncttagtgatgctanattcactaacgcgcttacagcgtcggctgctctncgacgtgacttcacctcatgctccacagtcgctcaccgcgagacncncaccgacgcgcagcatggatcgcgctgcagttctcgtgctancntagttactagttctgtcgtngcnctctcgctactctcaggagtctntnactgatatcattatgtagagcaccgcagntcngcgatgctaggntatatacgtagatcgacgcncttacgagatgcgtcncangatcacctgtcatctccatacatctaacatcgcgttatcagagtgcatcnnntacgtgactctatgcatcttctctatataatcatctcacgctgatcgttntcctacanatatantatagatntntgagtgtcgaggagcgcgcgttgcgtcatgtgtattagttgttntatgcattatactgcttgtctcggctcttctacacagtcttcnccatgtgagctcgcgagtgtccacgcagtccgncnccctcgctcagtctctatnttnacttcgtgctgctgaaccgncgcacanaccgtgtcgactgcgaatcatattctctatnacctgctgcgtgcgctagcgtatag

SEQ ID NO: 9025 - DNA, 813 bp, Homo sapiens
ctagggatcccagaagagcaaacagtcccggactaatagagtagctctacagtgccatcagagctggaggccccttctatttgttcattctgtcatccttaacatgttctttcattgttatggtttcaaatctgttccacttcagtcaccatgccaacaatccagtataaaaataaaggaacggagagaaaaaataaagatgtgcccttttctttttggcacaattatgatcctataatctatattacccttaactggcttttgctgtaataaaaccataacaactgtaatctcaactaatagggagacagaggcaggaggattacttgagctcaggagtttcagcttgggccacaaagcaagacccagtctctgaaaaagaaacaaaacaacaagatacaacaataaaatcataacaacaaaacactaagaaatcatttcaggtcagtacatatttaccacacaaaaactaatgtaatattaatggatgtgtaagttttaaaattttttttcataaatggaagcaatgttacaagggaaacacttgggaatgtcttgcattcttgtgtgagtataacattagataatttttttagaaatataatgtctaggtaaaggcatataatatttaaaatttttgaaatatgttgccaaaatgtcctccaaatgtattggttcataattctaacagcaatgctgagtatatttgttcttttacacacatttcaaaaatatatattttcaaacttgaaaaagaaaaagcagacaatcagctgggttgattcgtgcgctgggatacgggagatggacgtg

SEQ ID NO: 9026 - DNA, 1619 bp, Homo sapiens
  misc_feature (1)...(1619): n = A,T,C or G
ctgcctactatttgtncaatatctcattctcttactctctctttcctggaccgagtacgtnctactcgtaccccactcacattctaatagtcagtgcacctatcaatgctctacttgtgtcccacagctgccactagcaatcgaactccaatcgacctgcaccgcctcactccatctgctcacgctacgcatggagacgaatcgcgcagtcnncagcgtcgagatctctcctctccactnccatgcgtgcttacgagtacnattatgcgtctgtagttctncccatctatatcttctctgacatacgcttacttctaccctctttcctccgttattctcaccacgtgtgatactngaagtatgnaccagatagtaccgactatgtagatgtattagagatcagnnnccgtagtgntcacagccaccactcacacgcagcacagacgcgctacatntcctctattaagtataagatccgagtcatagtgcgcannnntcgctatctgtaccatcgttcagtggcacgaagcgccctacctcgtcacgcacgcgatgtatgtcaaccactgagcgtcatcgctctcattcatgtcgcacatatatagtgactaatccatatgtgttacctgctcccntcactgcactcacctcncgactacgactcgcataatgccccgtctgcgcctacacgctgacctttcgctcctgcacgccgcgacacactgacgctctgtgatcgttgttcttctttgtatcaatctctctcctcgctgtgtgtcacctcattgtcgtgcagntctcagttaccagaccaacgaattaatcgagagcanatacgnnnnagctttcgaattgagagtcgncacatcatcacttcactgaccatgcgnactctacttaccaagacgatgcacatctcaatgacctacagcaatacacacatgtataaccctanatcaacctggatcataccatgatgcgctagtgcatnacggtgncgagcacatcgagtgaanctctatatgcaactgatgtcgacttncgtcacacaacactgcntccgtactcacgcatactgcgtatcnacgtgtcaacaccgcagcacnntccatctcgctcacatacacgtacgcactccgacaacanacncacnctacgagacctatcgtatnctatcctattgagacacgatgtatcgtacacattagcatcgcgatccgcactcctaccacnctcgttccgtagatcgctntatcacagacgcacgtatcttagtcnctcatctattgtagcncncatctactctctcctcgtacctctctcatatactntatcatacactcgtccacgcacgccacgcgactcgtctccaatgacgttcgatatactcgcgcagtactcgcatatatctagcacntgngagcgaaactgtntncnncactacgacgtattgncttctgacgntgtcctatgacgcacncgntntgatgattantgtgccgtaccctacgtcgnacagcgcgctagagcntcgtacaacgtcagcgtctagnaacagcgcaacatatgancagcancntcgatncntnagtncgctcgcaagactgacgatatcntag

SEQ ID NO: 9027 - DNA, 1530 bp, Homo sapiens
  misc_feature (1)...(1530): n = A,T,C or G
gagatgagatagtagtatgaaangtgnganatntgtgttcatcagatgattcagatgtgatagcgtgagatagntacatgtgtaggtgtnaatgatgagagcgataaggctggaggnacgagtgtgatacgtgtgtgtgcgatatgtatacagtaagcgttcttgagtatgcaatacgatatactgccacactacgttacagacgacaagaggcaaacgcaacgagagcaaccgccnnnacaagctctgactctcanaccccacaattgtaaccttaccacagcaatcgagtccagagcatgacgcgcgacggcggcaatcatacatgaggagcgcgctacttccacgcatgacgcgtncgagcgcacaacagcatcggcgctcgcagggcacccgcgaggaggcctctcgagagggctngagagagtggcgcagtgagtagagagatcgnacagagcgcctcgatctatngttactagttcagagtcgaacganaatgatatcaaaaaatatacaagcgcgcaagtatgcgagcgccnatcggtgcggtgagaacacaggctcaggcgccgcaagccgagtaggaaggagactgcngatgggatgatgctcagcgatgaggctgtcgatcagatcttactatagtctcctcgtgtcatggatcacgccgtccccacctgacgagatctgacgaggtaccatatcactcgagagcgactctatgactgaggcacagaacgacctatcgcagcgtgcgtacgcgagcacacatgctncatgcactgtgtgatntcagtagagatcagcactcatcacagaccctacgcgcgcggacacacacgatcgtagcatacgcacgacacagccatnacaatcgctgtgactgccgtcccaacatctgccactgagacactgtctacgtagagcgacgcggancgactacgcgcgctacagcacggcgctctcgcggcgcacacgagagcgagagacacagctagtgtgactacagatgccgtacctacagccgcgcctggagaatggccgtcagccccgacngtacgngcgctgtcgtagcgacacttctgcactcgacgtacgccacactagcatagctccgcgaggcacaatctcacagnttctggcgtaagcacatgcgcgtgcgatacgacagagtgacggcgactgtcgtagactctccaggtgcgtcgccccagagctcccgctgcagcacatcgcatctagtctgccgtacacactctcttacctaactgctacgtaccgacgtctntattcctcgacacacacgcgcgagcgcacaccatgtacagagtacagatctgaccgtacacgcagaccgctcgcaagtgcgagcaggcaccagacgcgcaggagtcagcgaccnccgcgtgaatgcgcactcagacgcgcgcgtgacgctatcacagcgctcagagcgnacacncatcacagcgctcactcacacgatagcgcagcagagtgngttnatcgacagtacaagctgagtgaacc

SEQ ID NO: 9028 - DNA, 1246 bp, Homo sapiens
  misc_feature (1)...(1246): n = A,T,C or G
gccgacagaaagtttaaacggccccccaggccagaaagagaaggccctagtactgagacggatgtgcacactattgcattctgatatccgaagaaataatctccctcctgcccatcttccaactgcaagagtctcctctgaatcaaggaagaagctacgacgttgagctctaatgaaagacaagtcagctcactagagcctcacttaaaatatagctgcaatcgcagaccacgacaagccatagtaatcgcgaatttctcctcgcccctttctaaggtaatacatgtattgtatagagaacacatcttacgcaccgtcgtataataaggcaacaagattcaaagatggagctgagctctcccgtacatacacttacctcgtacgtatcaacctccttaacagattagttgacgcatcgtagtatcccagactctacctcaatccatatcaagctcttagccatcccaacattccactcgcaggagtcgtccttcaaaccaccagatctctcgcattatagcataaaacaatacaaactcaatactacgcgtattgacgacgtcggctagagatcatctacagacgcgaggtaccttactcaatcccgccgaaggcgattttatttatattatagcctgcgagcacgatattaaatatctactctcatccgtgcgttctcgcatccgtaggactagcatatacaggagtcggatgacacactattcgctggacatgctcggcagctggatacagctcgtcacgtcgccaccgccgatngtctcatcgctctgcgaccgctctcgtccgacagccagcataacattcgcgatgtgatcgacagatattatatatcgagacatgtgtagtttttctgtcacttaaccagctcatatctcagaacatatcagcgtatgtgatacacagacgcagtactcggcagcgtgacgtgactnttacacacgccgacttaacgtacatgaaagaagatcggaatgaattaaatcttcgcagtcgcaacgcgctctacgcataccatcgctnctcacatgtcatactgcaatcaattntaatatacagaagcatancacaacgataacccgcgcccgtctcgtatactacttagcagtcaatcagagagactcgatcgcctacacatccatgcaacaccaatatcttacaatctcagcactaccctgcgacgacgatctatgatggtccgggacttcaatatctaatgactaaactt

SEQ ID NO: 9029 - DNA, 1343 bp, Homo sapiens
  misc_feature (1)...(1343): n = A,T,C or G
gcgggggggggaacatttaagaggtgngcgggngtggngtgctngacgtgggcaggatatatacagagaggtaaagaaggaaaaaagaattaacctaagaaaaaagagacaagagggaaaaaaagtttgtggggcgggcgacgaacccaccnacgcagacgcgcgccgcggtcnncgcngatacgggtgtgaaattgncagccctcgggagggtgggcgttttgttttgtgctgttgttttctttggttaagtgatctatcaaataacaatngnaacgtattgtcattagtttggtcgtcatagctatatgtgttatgtaaggtcacatccttgctggttttggtgcgctcttgtcatcttagatttgtgtgtctcaaatactctctcactcgccggtctaccgctcgactttctgctctctactcactttgcttttttgtcaaatatagtcttggtttttctttgttngttttttttttttatttttgttcttttatatcttttttcggggatcagtattttttgtgtactcgcatgtttggattgggatgatgtttggttgcttgtatacgaagagcttggtctggccgtctctttctctcttatctattttctttcctatcctcgctgtcccctgcctctctgcnctcctctcccgtgctttttttcttcgtccggtttttgcgcccgggngcctgggacggtgtcagtgcggagtagataatgctcagtttctttactacttgtgtattccttctcctatttcgcgntcttctcgtagtcatgacctgtcatgcnctgtctatgtganttatcttgacatgcatttcatctgtgtgtattagtctgtgatcgacgatgtggctatattggtgtcgagctatatttattggancgaggtatattgtgtcctattagttatattatgcgtgtgccnttgctctanctgcagcctgcgcctcgcatcttnatattctatcttgtctttatattctattntacgtgtggtgtctggtgcggagtcatctatagacttctctagtacatatatagtgcgagcgtactgatcgcattgactgctctgtctacatagtgtatgacggatttgtatatgatgtcgtcttgttacttgctactatgcagtgcgttagatggcttatgtgcgtattgtgatctatgtcgcatatatgtcgttacttctttattcaggtacgttcgcggcgagttattcgcgncgtcgtgagtgtagtcgtgtctctgcagtagtcatgtagcgcatcnctccacgtatnctctccgattcttcntccgctctatatgtgatatngtatgctctttcgtg

SEQ ID NO: 9030 - DNA, 892 bp, Homo sapiens
ctttctagtcttatgcgtagttcagacgttttgaaggatggtttgcgaccgtcagaatgctcgtccattgtcacaatttctaacatcgctgagcgaaatattaggcgatgtattgatattgggcttcgtctccagtgatgtatgctctctgtgtcagtacactactcggcagaatgtcacagcgatcagtttagtacaaagtgatggtggctagagccactagcgggccatcgcggcgcgcgaccgatgatattttaacaacttcttacatggacttagaagtgcgcgtgagggtgatctacggtgttcgtagtcgagttatgtttttgcgtatggaatcttcgtactggtcttgtgtcgggtgttaatgatataagcgattaagcagttaaaaggaggccgaacatcacgagctgtcgacggcggcatcgcctcgactaagctctcgtaagtcgcgagcaagctcaggtctaagtttcgctttatatgacctcactcgttattcaccattgaattgaattattacgcagaaggtaactgtcatgctaatgtacttcgtattcgacaagtatgtggcctgtgcaccagtgagtttcagtgcatcttagctccactacattctgttttgagttctttgaaactgtggaggaggactagtttgtggtaaggtgttggactagcgtcagccatttaacaaaaactatttctgctcagttacatggcagattagaacaatcttttggtcccataacacaactcgtcagtggagatctctgagtgattctgagaagacattcctatatattgtaccttttatgctcaaaatgatccagtatttctccgtccctcttaaaataaaagcgtaatataatgtcagtaaaaaaaaaaaaaa

SEQ ID NO: 9031 - DNA, 968 bp, Homo sapiens
  misc_feature (1)...(968): n = A,T,C or G
ggtggacgtggggtattgttactgtggatgcgttctatcttgtagagaaggggctgggaaggggggtcggaggtgttataggtggagggtgtacgagggggtaggtgggtcacgaagggggtgggggggagtcgaatgggggtttgaagtaagtgaggtggagagggcctgaggagggtttgtcggtagagcgtccatagtaatgttgtgggatgggtgggtgatccaccaagactctctttcgggcggatggggggctgcgcgtgcgtgttgttgttcatgtgctcactaaacgatttagagtacctacgcaggtcaacagggatgtttgtggtacgggggtgagggtgttgggggcatcagacgcctaattgggtaactcaatatgtccgtggaaaatggggatggtcaacagaggttgtgcggagctggggtgctcaagctgganagaatggtgcaatgaggcctcctggctgggtcggctactttgtctttagatgttggtggagagggatcgttcgtcgtgagacgcagagtcggtgtggcgtagttcgagctacggttggatttcgtgggatggagagggagcgtgcgggggggaggaggggctgagagagtgggatttgtaattcagatggggcgcgagtaggtggtaatgggttcctgcggcctggggagttttggggaggggacatgcagtgtcaatgtgatgggagagtagaacaatggttgggtcccggaactcggctctncattggagaattgtcagtgtattttataagggcatcgcgacatatagtcccttttagatcggtaatgaaccagtgtttgaatgtgattcataaaataaaaactaatatgaggcgaacaaaagcaaagatggctcggtggcaaaagcgggctagttgttccggccgagggtttgtctcgctgtatcagttcttgattcttactttattgtttcttta

SEQ ID NO: 9032 - DNA, 1637 bp, Homo sapiens
  misc_feature (1)...(1637): n = A,T,C or G
tgaggatgatacttgacctcgcacatagcgttccaatanagcatagtccgggagtcgtacacacagctggcacacaccacgcaatatgttctctacacgagtcatacatcaataccgcggcacccgcgtgacgtgccacaccactgtatacagaatgacaccncacacgctggctacgtctaagagcgcgcgctgaggtccctgcnncctggtggcaggaccacgccgccgtgtacgcaccatggtgcgccacttgtgctatgacgatcgtccccagcaagcgcttcgctaagtaccacgcgcacctacctcctcatatcgcagtgtacgcccatagcacacgactgtcgaccaagacagtcatagtagcgagancgagcagatcaagctcacacgagtacgtctgagtgagagagctcgtcccacgactgtatcattacctcctctgctacgcatgcatagtacttacgtatcgtacaccatgtatagagatagactcacatgcatatataacgctcatgactatatagctgctgtagnacatctgtcgatctncgtaggccgggaagctttgacgtgtcgatacgtcattctatcgtaggtcaacgtctgatcatagcgggtgcactaagtgattgctctcggcccgcactgcgcctaacacattactatagtcacgatgggactattagaatcgcatcaggccttcgtcattcacgcgacccagcgaccgcggnggaagtatatagcagctaacagatctgtcggatagacgcttcacccaatacagtacgcatgcgtgtcgacaacctctacacgctctcatgagtgcgatcgctccncntacacagatatacaaataccgctgctatatgcagtagtgcataggctgtgactctcgatggtgaagntcagtacacctcacgcgtntggctctacgctgatgncacactatacagagtggtctntctcatctcgtgtcgacnacttgtcggtgatcgcacgctgcgtaggcntnacgcgatcccgcagatgacagtatcgagcatgcgtcgtgtcactgtaanctagtgcagtcntgancatggatgagctcggtgccgtatgctacgctcgntctgagcatgcgagntcgctcgtgcgtgtctgcgcgacatgcgtctgacgtggaataacgcgtgngncgagacacgcgcagtgtcngnacgaggananacaacntcatgacatactcgactgctgagctgtacgacgcgactcantaggtcgcctgacacgctgtgagacagagtgagcacgcaggagagagagatggcgcctgatcagtatactgtcgtcacgcatgtgagtcttctactcctanattantgctcgcgctacgatcgcgtgncgctctacgcgatacataacatgcgttatgataactcgtgtacatcnctgtgcngattgactcgctcgtcgtcgnctcgtgccntcacgcgcgctancgcatcgatanacgtaagagcttactacttctgtgcgtaagcgagcgagaccatcacganatatgtacgtacgcagcgcgaggatgagactagacagcgagtgctgatctcactcatntgatcgtgacgcgtgctgcaggcgtgtatgcg

SEQ ID NO: 9033 - DNA, 1366 bp, Homo sapiens
  misc_feature (1)...(1366): n = A,T,C or G
actcctcttgcatgctctctcgngaatatctggaagtagctangcaggaactagaatctcactacacgtagatcagctgaactaatgtagtctacgtgttataattgtgngtatgtcatncctcatgatataatgatctacattattctttaagtctctcattagntnagaanatctctgtgncttccgactcgcgctcctntatacgactatatacctcacatcatctcacacgagagaacacgaaggaataganactaatgaactacatgatggaaagcaacatcaaactctctaaagtgngnaaaccgtgatcatctctacacctactaancaacactgtatgtggcgacacnggccagtgcacgtcacgttgagtgggagagaactattccacggctaacctactggctcttgggtagcatgagccatacctcataaagtttatccctgtgaaagtacgatataaaatagggcgacancgcacatactatgaaatactgtatgcgattcaacagtcttggaggggcagacacgagaacattacagagtcgcaactggngacttaataaaaaancctctattacaaatacaacattgaaccaagcgactgtgtgattattaagtaaataagaataagatgactgagcgtatacatatnatagtgtatggtggtcatcggtctataataataattacatgactctatatataaaacaatgtggataataatctgcactacgtangcattaggcactggtactcataactactaacacttttctaaagcaatgacagaagaaatatataaggtctgcgtgctctcagccacaccagaacaaccaaaacacactagaatgatttctactacaactatattcagtncttggtgcgaaatagctcctccacnaatgccacaccnncctatatagtctcgtcactgtctgtgngctgagagcacaccatatagcgctgtgtcgtgatacagatgnagctatactcagcacaacctctctgtcgtgtgagaatagtatctcatgtnttntcttagcagcgtgtcctagaagagatatctagcntagtantnncntgcanaactatatactncatgtgtgtttntttgcgtcncattctcnnanaacaannaatacaatacananaatanacaacataaactaacatatananaaacanactgtgactctcctgttgacgtcacttctanncgnnctaggnagnnctttctntctngnnccctcgannnnnnncnnnnnnnnnnnnnnnnnncactctnnnnnnnnnncctntctcctccttnnnnnnccttnnnnnccctttnnnnnnntnnnnnnnnnnncccctccaa

SEQ ID NO: 9034 - DNA, 2391 bp, Homo sapiens
  misc_feature (1)...(2391): n = A,T,C or G
ctcactagttgatacactcactctactgcgcacnctcatcgtctcacactgcggcnctaggtcanctgagcagctncntctctngcacgtggcgacatgaccagaggacagagagtagctctgtcncncctcntcgtcacatgcgcacatcgagtgcgncagatnacnaacgtaggtattgngcactctgtcgtgtgaccacacctctacgtcaccggcgcgacgcctgatgcatctncacaactccactcgtgatgagagtcgctagctgtgncgatgngccnccacatgtgcgacgcgcgaacagctgnaccaccatntgcaggtctncatagaagataaggtgagatagtcatgatacncagtagtnatgtggctacatagtgtatgtggtgtncgcgacgtccaggtatagncnntcacatacnatgcaccagtcntgtgacgcagcaganagtagcgtgtcnctcnctgtcaacttactggatgtcacatnctgtccgnatctcgcagtgttncnacgctgcgctcgcgtgagccgtctaccagtgctgctgtacgnncgcgangngantgactgacgtagcgtataggcangcgantnctgntnnncnactccgagncgncncgtcagtcgcacactcacncancatgtgcgtcacactagtatcagtctgctantgcgatgnctnnnnnnanntcgcgtgtgcccgagactgatgggatgcntgcagcagngtnagncgctnntnnnntngacgtcgtgcantctgaactcatgctctgnntactgcagcnacatgctcgagtcgtntcaacacgntctcgcacgtcgccgactcgcagccntactntcgactgcgnctggctgacatagcgtctgntaatggtcgtnagngtgcngagtntcatctnatactacgcagagngctgatcgcacntcagagtggtgacncccacgcagcagtcgacgcncagcacggcgctgcgnccgagtatcnacctaggtgncacatcacgacactctagcacgntnnctcgtcatgtacnagcgantncgaagtggaatganacgagacgcnntagactaccaatctactngcctgcatcgtgcgntagtnctcgnangctcngnctnccangcgtncgnnacgangtatcnatgatctgctgacgtntnntantcgctgatcatcgactacgagnantgnnntatcacncantgcgtanntcntngctctgccccgacgtagtncangtagcgncnagtagcgatgagnatgagatagtatagnctcgcanggcagnangnnnngacgcgatgagatagctcangcgcagtgtcgtctncncaggcgcnacngcagcngcgtntanacgtagctatgatcntctcncnctgctgctccagcacgtcgacgcagcgngtncnatcgacgagctgacgcagtgtctgtaacttgactnctacnatctccacncgagctgcttncnnctgtcgtccatcgatacgtgcgcnntnccatgcacnatgcgtctgatgacagtcagatcatcggatgctgcnatncgacctgaccatcgntgntgncantnagcantgcccnnactacgatgcgtacnnctactntcntcnatcgcatgcgnagcgnctgatcgtcgantcgactntacgacgtactctgaacgangacgtagacgtgatacgactgcccgtcagcagantgagctgagnnnnnatccaacntcagtggtcatgcagacgacgatgactnntncngatgtgatgcgcatgacacaccgancatctactagacnggctanacnngtgctgcntgcgcgcgtanctacgactgntgntcgtcgntnctgacgacgatgacggcagcngagatgcgtctcngactctgtacgctactcgacnagtcgtgcanntcaggccgcatcatgcatgacganctcagtcgaacncnatcattcgtatgcgcntctnacgncncagacgcntcgcncgnccagcaacacccagcgtcacgacntatanacgtcagcccctgcantctgcctacacgnctgctctctaccncgcagtcgtcntcntantgtcgtncnactatatcgtcgtntgntcgacgatcctgccacancgncngcactagtctagnagtagcacgagtcagcagataggcatctctagtcancgntantccactacagtgcatgtcgnnnncattcacctgacatcnagcngtctcagacactatgatctntanctcgatcacagctcacacngtcgacactcgacgcncgtncttgcatcantcgtcagnagatcgtccngtgtgcgntnnctncnagctcactgcgagtaggtccagtatcctagctacg

SEQ ID NO: 9035 - DNA, 1367 bp, Homo sapiens
  misc_feature (1)...(1367): n = A,T,C or G
ccggttaatgtcacatcgctacatcactgatctttatacactattctttatgttttctagcgtagtgtttaccacgatctaatcgtttgacttctcgatgctcctcctgatatagatctactactctccacacccctttggttgatgagtgaggtgctncagtaagaatagcgctctgtgtctattgtacaatcgattagatgttctcgtatttccctgcggatccctccacgcctccccccgtctcgctgtctacagtgccctattccatttgctttctggcttggtcccttttcttcgttgtgttgttttctcctggtcgcccagtccgcctagcggagtatttgctcttncgatgtgtttagagtagtaaggaaagtccatagtagctttatgagtatttaatggttactttccgatatcctggttgcttatgtcctcgatttcctactgattgttttcactcccaaggtatctcccccctggttctattcttacttaagcgcagtcccgtaccgctcactcgcccctcgtacaatctcccctgacacccacctgaaacatctaggatttcgtgtgnccaagcgtctgcttcgaatccactgactacctttcctctgctcgtgccacatcacccactgcggtcatacgctaacaactatgtacttttacttagtcatctacatctcattgtacttcatgttcgttcgtacgcngtatacgctacgcagatgactcgatcttatctgtgttttgactagtcaatgctaatactgatcgagatctcgattatgcnatctcttaaagtctacgttcacgtacacatttatcgttatcatcggtatgctgtgattatattgcnagtctggccagatgagtattcgtctagtgatgtcttatnntctgntacagagatcgacatatcatcgtatgtcactgctctccctcatctacggtctcaacggtcacacacacatctancctcacactcagctcgtctactcgcgacgctacacatactcnctgctactctctcaccacagagcggctcgcatacacgctcttctcctctctgtcaatgaggncagcagctgagcatcgtnagatcatgatccntgtacttcntttatatcacagccacgacgcgccacacatgcgtgcttgccttatatcagtgcgcagtcggtgcccgatctggatgacactctctggatcgtttgtcatcgcatgcgcgcgtgtctccgcntacangctggtcnnntcgagcgtaggttagaatntcacttagcgtcagatccagcgtgcgatctgatcatcactagagtaatatgagcctatgtntcacttaatagagtgcacggagtctg

SEQ ID NO: 9036 - DNA, 1294 bp, Homo sapiens
  misc_feature (1)...(1294): n = A,T,C or G
ttgctgtgttttttaaacgggagtagcgtatatagtccgagattgcgcgtgttttcgcggaggtgagtacacacagaaatgatcggacagttttctttattagttgtacgtgtacatgcttagatgatgcttgtttgtaacagatacgcacttcctattagcggcgcagccgagtaaattaacgatgaaatgtgtatacaaggagcgcgcgtctgctcatgtcggtggcgatctctcgtgctcgtggtgttatagtgtgattcttttggtctccgcctattctccgccaaacacatcacttgctgtccgtgataactggtcatgcagccatgcatacttagttataaagatagccgtatgatatgtnatagatggtgtagtgtggtgtggagtgcatcaatttctcgtcgtcgcgtgantattcgtaatatttgctctcttatatcnctctcatgtatttgatagactacgctggtcacgccctcctctgtcgacgtgtgagttgtcctcttccgtgattattcatgcatgtacgaaatagtcgtgagatacgccctagtacgtcgcnttctcctactatcattcgagcaactatcactatcntcttctgcgcgttgcactgggtctttatcttacccttctccagactcttctgtacttcactcaccgacgcggcctctcaccgcgcccgcgccgcggcggtccgcacacctcataactgagtatttacgttttcgtnacgcctctcgcaactacccacccaatttatcaattatatatatagataacggttntcgctgtttctctactctctgcctcgtgtctcgtcgtcttccttttatcacatcttctactcggtctctgcgctacaccctgtggatccgtgccgccctctcgcatcacctgactactttcccacgggtagtgagcagtcttatgtttcttttatcacccgtctcctcgtctgctcattacgggtcagtgtctcttaatgtgacttagtggcgttgaatatgttggtttagtatttgtagacttatgttatattgtatctttacataacccacagcatcaccacgatgtcagccgctcgacgcacccgaacttcgcttccatccaantatctccgctccactcccatcccaagcacaatcccttcgacttatgagacacacaatcgatataaacgctctaaccgaccgcctatcagatccgtcgaccacaccgcgaccgaaagtccccgacggcgccacgcacggtcgtcagagccgcacacccatacccacacatcgcc

SEQ ID NO: 9037 - DNA, 895 bp, Homo sapiens
  misc_feature (1)...(895): n = A,T,C or G
tacgtgaaaacacgttagaggaatatcagtgcgcagaaaattggggagagagacagaccttctccaggagctggaacatttggaattgggtatttaaagattcactggaaagcatgttgatgaacagaaatcagtgacaaccacatttgtttgttaaacccattggtatacacataatattcctgtgcccacacttaatgtcaatgtggtgattttaaccatttatgcaacattctactaagtgtcaatcattcaataatgtctattaaattgatattcatatcttgcctcctatatcatgtgaatatgtgatatacaaacgagatacctcgaaccctccatctaagcttgaccgactgaaacacatccgcgatctttttcttgtccagggtgatatataaccatggatcagaaaatacgagcactctttactcacgaacaccacacacgctcgcgctccacggcctcatcctgagcgacacctctggcccgttacctctgatgagggccactccatcaaactcccctcactcacctctaacccccacccctccaacaccgcagtcacccncattacaccccctccacgcgtagtaccctgtatcactccccgcatcctcgcgtcgcaacaccaattatacactccgccctctctgcaatctcagcgccacgagtttccctctcccgtctctacgctagcgtggttcaccgagcctctacctcgtgcaacgtccacacaaccagccccttgctctgcctcgttcatctcgtctcgcgcgcgtctgcacataccccccctctcacggctcgccacactagaccccgattaatgagcgtccgtcttccgtcagcgatttaatttggccgtcatccaagtctatagttgtaatgcacg

SEQ ID NO: 9038 - DNA, 1966 bp, Homo sapiens
  misc_feature (1)...(1966): n = A,T,C or G
cgctgtctcgctgtcgtgctgtgcntcgcgactgcgacgtgngntcgngtcgttcantngtgacatcatcntcatgaaacgangacnatgtacatnactcgagcatngatgtatgctatcgcgcgaggacgacgaccagatgncgagnctncatcgactatncagactancgactaccagcacatgacntncnacatactatagcnaacangcagtanntantancatctccacnatacatgcacgcgatgacgcgagtgacaacgcgacgtcatgacgcgatcgcatagctcactaacgtatatcgactgtgtgcgagatcganatntgtgtnacgtagtgtntctaatgtgatcacagctaggacgtggtntctcgtagtacgatcagtatgtctcgtcagtgtataancntagacgagtagtgagatgtactatgtntatcatgtgctctgnttgtactgnaggtgcgtctcatccncnactgtcgacagcgncgatcacacgtaggagacgngangcggcagccagcgagcagacgacgagctgtgactcgcacgcgantacatctcaaacatgcgcangtctncacacagtcgtcacatctttatnncgnctgnttctcacctgtgttgngtctccgtatcgcgtgngtccttatcgagtagtagacggactatgangacgctctactacgacggagtngcacgaggtgagctgtananantgacgctatctgtngtacgngatatgtncgtagtctatgtcnggtcctcgacactcgnanantgnaattagcgnntgcgctctgtatngacaccgntcacatctctggtattgctccttctcgctagaatcggtntntgtantancgagcatatcatgtcagcgtacatgtcacacacacgcgacacgacactgtcgtactagcgactatctnggctcgctactactgagtcacgatgantgtgcgtgacagacgtgaggcacacgtcacgcgatgtatgtcacagcatatatagancngcgatcacatctgctatatgtnataccnctgtaagagatcatcgcgctctggactcggtgtagnanganagcggaggagcatgatctatagagacggtgcggacgcaacgttgtagtnatctctgcantaccgctctcatacgtagtctatgtgtngngtgcgtacgtggacacactacatgcgtaccgcacgcacaccagtcgcagctctgacgcgacgtcgcgctctccgtcgtatcnctcacgcgtnggacacccgtcgatggtcactgcgtcgctctactgtagtggcatcgcactgnccgctgtcangcatgtgancgctcggatcgantccaccctgctctatactatntcgtgnngcctcccatgngncgttcagtcctaccgtgaagcgagtcgacngcacgttccagttatncacatagtctctcactctacatatatcgattgactangntctagatgtacgtgttgtgtaccataagnaaggcgcctctcactcgtcgctacgcgcacacctgcgngnacctcagatggacttttattatgttactcnttagcctgactatncgngagccagctgacatcgacgacggtggcgatgacaggtaccatatggcgcgtctgtgtnttangngaccatcacctcctctagtcgatattcctagtgtctctcttcgtttgcgacatctcattgtgacactgtatcctcctcttgtgatctgtccactactatacncgcttgctctngtgccattcgcgtctctcttcctccactcctcctactttatcnttaccgttctctagtcgctcgccgcgcatgtncaactcactctatcgcaccaagctggtgacaactgcgccacactctttctttacatcttcctctgtagtcatatatacaatatacaactaattatcgttgtcacaccactctt

SEQ ID NO: 9039 - DNA, 1480 bp, Homo sapiens
  misc_feature (1)...(1480): n = A,T,C or G
tccgttagcggtcagtcttcggatcaggtgagaaggggtaggacctcgctgggtacgcctggagccggcgcgggcaataatgacactgcaattgcgaccatagacacggctgtacgcactcacaccgtcaaaccatgcaggacactcatgtgctgtgtgcagacgtatttgtgtcgccgtgcgcctaccgtgaccggcgcggatagatccgtccctcgccctgttgatcgcattgggtatatagtgtctgtcgggcggaggtgtgactatcgaatcagcngtcagtaccatttatccagaagcatacacagataccgatcgagtcgccacgcgcacttctagtacgtgagagctatacactggttagagacgagtacgtggtctagatacttgtacgcagagagctggtcacacgtgcactgagggttatatcactatgtcgctctccttacgcctgtacacacttgcccgcattctggcgcgactagaacagtatcggctgttcgaggagcttggcaactcgaccatcgttcgacgtcgccacgcgcgccagccctgttattcgtacgtgacactgccattgcatatgcgctccaagcttacgattctcacntctgcgcgcgctctcgttctcgatcgctgntaacgcagcattcctacgactnttccgcacatatcacagtcactcgcgcgtgcacagcgctgcgctgctctcgcgtcacgcgtgacagacgcgacacgtatataatgataacgatcgtgtnaggactgcacactatgctgtacgaggcntctctcaatgcgcgcgatagctcagctcacacagacgacaacatcgctactctcataggctacgtctcgcacacagtctagcgacatagacgtcacactgcgtagagtctctgactccgacgtcgtcgaagtgtgacgctantgaccgcacctctgtcgtctctgggtcggcgtgtgacggcgtgtaccacatgccagtcctgcgtctgtgaccagtcgtccgcgactccgcggccgctaacagccatgtgatacacacatcccgccgtcancgatgactcgcgctactctacctgatgccgagtatactcagcgtcgagtgtaatatcagctctgcatccatgctcagtagcgcaagtgatcgtgattcgcagatcgtgacaggcgtgagtatgtgtcgcctagacgccgctagctgataatgcgtcgcatatagtgtctgaccatagacattcatagcacatgacaggacctgaacacatggatgtgtgattgcgcgccccgtaaccgctacacctcgtcagcaccctcaagtagagatactccctcttctattcgaatctacttatctatccaatgcgacaaacttagtggatttgtcgttcagccgtcatgaacgctttcagtagtgntatatgtgagcantagcgtggatagatcgcgcattgtctatgccagtacagatatt

SEQ ID NO: 9040 - DNA, 321 bp, Homo sapiens
  misc_feature (1)...(321): n = A,T,C or G
cctgnntctctgatgtagatatcatctcaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaaaaaaaaaaaaa

SEQ ID NO: 9041 - DNA, 1328 bp, Homo sapiens
  misc_feature (1)...(1328): n = A,T,C or G
ggtggtgtattatacntatgttatagatatcagcggacggacttacacgcgagcatacgagcagagccaatcgatacataatgtcttgcagcctcagtcgtaatgtatctttgacctctgctctcgatctgtacttgctgtcgtgagcgttggtcgtaatgcgcgcgacagtgacacagtatccctaggagaacggccgtggacagccgcctctagtgtgtctgtcgcaccatcattatcgtgcgcactagcgttctatcagtgactactagttgctttcacgcacgaccgatgtagacgcgtcagaatattaccacgtatgcatataaagtccctccgcgctgccctagccacgtcgcgtgtgccgagtgatagtacntcattcgtgggcggcgtagcggtgtgatgctcgcgtatgctacacgaaggctgcacactctcggccgccacggcgtgcgtgcttcatttatccagcatcatctgaccgtcccgcgtgcgatgtccgatgcgtacctccacccgcctcaccaatatatatcagaatagttataatgattacggcggcagcgcgtctctctgcatcatgtacatctttcgcgcaccgcagacacgcacgcccgatgtgcgacccctatccatcagccgcatatctcatatgatacctaagatataatcagtaaagcctcattacacagatgatgatctgagaatacgatattagaantcgcgatattctgtacactatgatatcgtctaccagntgacgactggaccgtacgcgctctngctctagcaattcacgttgacgcacatctcaggtccacttcgcatagcgctggtagacggcgcacgtggcgaggacacgtctcgccgcgcacgccttcgtcacgtccgcgatacaaccactccacacggctctancgcaacatgctgacaaagcgtaggagaactangcagatgagtcagtgagtcggtagcgcgcggacgaggtcgagactcaggacgtaatacaacgtatatctgtttgatgagcgattactgagttgtgtcctctgtttgcctcccactcntgtctatccgttgcctctgtgattaagtactgtacgtctgcaggtcactatgtgagtgatatatacgcgacgcgcccggcnatgtatcatcagcttgatacgacaatacanagatcgcacgcaacactctacctcactaccgcaacgtggcgcggcctcacgaaggtgacgagtagcaatantntaatacgcgacnggtataccggcatacgcaaactgccgccagagtagagtnttgcgactcaggacgaccatgag

SEQ ID NO: 9042 - DNA, 984 bp, Homo sapiens
ataagtccagtggaacgccccgtggtagcctaacggagcattgatgggggaagaccccactttgttttttttttttatgaacgttctccttttttctgtagcagagcacagagcgtgagaggtacacctgtaaaaatagctttcttgttcgataagtgtggagatgtgtgggcgaggcggtcgaacgagccccgtatgggattcgtcgcaagtacagacgcatgtgctaagactaataacgggaatactacacctcttttgagtttcataaggttgtattcacgcgtcccatgttttcgccccaatcttatatgcgcatcaactaactaccacaatcaagtgagaccggcactccctcccatattatctcggaggataaataacacgcaataccgacagactgaactagattcccagctcactcctgtggtaccggtaacacggtgaaccacctatgtgctgtgtttccattcgacatgtactcgaaccagcgacgaaggtaaggtaactataggagatgatataacatgatccaatccaatcatcatgcatagctagttcaataacaaagaaggttgtgcagagcagcactgtggtgaacagatagtcattgatgcgtatcctgatcgcagcattacgcgcattcgcattcccgcacagcataatattcctcctgtataaatcgcactatgatccagcggaaataggaagattatgaaacagatatgaatctgcaatccgcgttgcatgcggccgctatggacgcatacgacgtgtagcaaacgttgcgtacaattacgtgagattaagttatagtaagtaaccataagacaatacgacagcatcgcgttagcggtgacagactagcacaaacaggtcgccgcatgtaagttacctaactgcgagagaataatacgataatgtcatagatatatataataaaacatagaccaagcgcgcacctccatcctctctctgtctctg

SEQ ID NO: 9043 - DNA, 1219 bp, Homo sapiens
  misc_feature (1)...(1219): n = A,T,C or G
ctctgcgcggcgcgcgtncgtcattcacctgctcgtcgtccgtggcgntgtgtgactccctgctctcggtggcccgctcgcagtcgcgctcctcgccgcctcttcgttggcttctcggccctcgcgcgttggcgtccgtttcttctgctcgctcgccgcggtgcgctgctccgtgcgtctttcgcgtcgtgcctggcgcggctgtggccgtctgttctcctctctctgcgcgcttcgctctcatccgttccgcgtcgcgctccngcttccgtgcgtcttcgtgtgtgtgtccggcgtctggtcctctgctgctgtcgtcccgctcgtcgtttcttgtttcggctctccgcgccgtgcgttcggggcggcgtcgttggcctcctctgtgtctttctctttggccctgtcgctgctcctgtgctgcgtcgcctccctctccggtgctctcctgtgcgtgccgcgcgcggtcatgttcgtggttccgctcggccgctcgctcgcggtgcgccctgtcttgcttgtgtacctcgcctcgtggcgtcgttcgtctggcttgtttgctctcgcctactgccttcgcgtccccgtcgcttgtccgcgtttttctctgcgcgcgtgcggggggtgtttgtggtggtgcgcgtggttgtccgcctcgcgtcgctcccggggttcgctcttgcggtgcggccgccgctttccctgcgctgggttcgcttctggctcgccgtcgtgcggtttggctcttccctgcttttggtcctcgcgtgctcccgcgcgttttttcctcgcctcccgtcgccgtgcgcccgcgtcctgctgggttcgcttggccctccctcccgttcgtaggaatggcgcgctctgtcctgtgcggccgcgttcttgtttcttgtggttcctgttcttcctgctcgcgcgtctgcgtggctgtgctcggctgcgtctttgttcgggcgttctgctccgttccgccttcccgcctgccgcctcgcgggtccggccccgccctcgttgcgccggtcctcgcgctggcgcgctcgctcttcgtgtgggctttgggctccggcttcccctacgtctctcctgtcttcccttcgctttccgtcgttgtgttcgtggtctctccccctggcccaacngtcggtggttgggttctgcgcccccaancctcttctctctgggtgtggccccgcccgctttcgcgcgggccgtgtcg

SEQ ID NO: 9044 - DNA, 1231 bp, Homo sapiens
  misc_feature (1)...(1231): n = A,T,C or G
agacgcgnagaggggtgacagagggatggtgtagntgagtcaagattctgcattgtgtagcggtgcacacacggcgagagctctgcngggctattgatgcttcgtgcgtctctcgcgggaggcgtagagtgtcatanacaagcacatactagaacgtgtataacgaggcggtgcgtctaaacagtggtgacctacgaggtgtatatatcatatgagacaggcgagcacgccgactgccgtgaattatgccgacggcgactggagataagaaaatacatggtgttgcggggaaatcacggcgtcgtaagttcatgttgtcatatgatgataatagatcggcgagagtggtaatagtggggggggagtactttgagcaagggacaatcatgctccaatcctgtgcatctcgagcgtgtcagtagtgaatgagagtactacgaactgtcattcttcagcgaggaggtaatttggttggtccaaggatgcgcagacacgctgctatcttgctgtaccattcggcacgttcttgatcgaggcagcgttcatcacgtgtatacctaaattccatagagagatatatggcttgattgtgttttcacaacggtgatggacggtatacaatcaggtggaaatggtgactcatattcgtggggccgtgtatgcgtcactcacttacttggttggatgtatggccggtgtcgtgtacgactatgtagtgctatttatctatcgtgcgcgcttcactatgccgtagcattcgtattggggatggcgaatagtgtccggtttgcggagagcttcctattcgaccgtggatactgttcgttatttgctatcggggtgtttcgatcacgttacgaggacggacgtgtctaagtcatgcactcaattgattattagagttggaacaagtgctcgactccgctctcgtgccgtgtgtgtagtgtttctgtagatatgatgattgattgtatcgttgaggtgatatacgatgatgatcggtatagtgatgtgcactatactagcgacccgacttctttttgatttaagtgaacttgtagtcgtagctgagatatcgctagtgcatgacatggtcgatagtagtgcgtcatactcttagttcacaacaccttactgtgagctggtttcccgttccttagnctgctgcgtcgacatcttgtcgcgtaatagaatgccgtacaaatcgtattggtncgagccattcatcgat

SEQ ID NO: 9045 - DNA, 1500 bp, Homo sapiens
  misc_feature (1)...(1500): n = A,T,C or G
tgtagtggagcggactgggagatgatngtangcgatgtgacgttcgtgtgtgcgncatcgnctgatagttctcgcgatacgatntcatatctagcgtgactacactctgtctgtcgacgtatgattcgcagatgcgtgcgtcgttcgtactagtctagcactngcaatctatctacgatcacgcacacacgtaggcgcccgatcgcgnagcggctcgagaccgttgtatattactgctcccgtaggacgcaacttcggaccgtcagccgcactcaatgctaccgcatgtgcgcagtgctgcggtgtcgctttctcgtgtcatgacgtcgtgtcctccgcngtcgcgtcagtgcgtcgctagtgatgtttctgtcgcgatgcntcgaatctgacacncgataagantcagaagatcgcgctctatacgtacgcgcgccgcacttgttgtgagcgtctccgtcgttcacggcattgtcggtgagatcacaggcggtgtcattacgacngccgcggtgcngcgcatgtcgtggtcgatcggtgagcatgcacactccgatcctacatagaatcgtgttactgcgagtgcgcgcagatggtagtgcgcgcgaacgactgtcgcatactcgcgtcgtcgctactgcgtcttcgcgtgcggtccgtcgctgccgctgcgatcctcatgcacctgccgagcccgtctgtcagtgctgantactccaagcgtgtgtnatcttatcgtagccctcgatgccgcttcgatgcgcagtgtgtctgtgtgatcggagtaatgcacacacacagctcgtgatatagatcgcgatgcgcgtgattcgtcgctcgcgcgcggtgtctgtatgttgcnntgcagcncntactggnatctgcgtattctgggtcgacgagcttcgattcgtccgtcttaccttgttcctaatgggactggtccgatgtgcgatggcgctccccgtcgctgnctatatgctctnacgcatactctacgttgagattgatgtcggtgtggcgcaatatngtcgtacaatgacgagtgtcgcnacgcatatgttcgcgactgcgccggtggacacgtcgatcgcagnttactcatacgcgcacgtcacgctgctgaagtgctagctggcgcacactactcgctcgctgctgtgcgtgtcgtagagcgcccgatgtgcncctgtgcgtctccattctttcctctccactaggtgttgactgcactngantaagaagatctgcgattgatgtgcgtgtcgcgatctgtaccacttctcacgcggggtgactgaaggcaggtagttgtgtttgttatgtcctagtgaatacgtcgacgagttactcgtgagcgccgagtccacgacaatcacaagaatgatggtcctctgttggcataacagcgcgtggtagtgtttagccggcctaacctctctacgctcttcggggcggcacgccctcgggcgttctaactatgtcgcggctcggtcgacg

SEQ ID NO: 9046 - DNA, 1497 bp, Homo sapiens
  misc_feature (1)...(1497): n = A,T,C or G
ccgccccgccccccccccacttcacgctttcggtagccgtggaggntttagtgagagggagagaaggaggcaagaaattttatggncnntggcncacacaatcagcataacacccatttctgccccaacaacacgggtnaataanacctgttacctcgagtaattggtgagtcggttacgcggtcggtgcgtgaaagaacagctgtggtccgccgatctacgctgtcggggcagacacttaagcctcatcaaggcgatgggatgattgatggggtgtatttttacgattatatgcccgttctatttttcatctcttgctttctatcttttttctaatctaaatttatatgaagatgataaatagagtagagattttaagtggttgttttgtataattagcgctgagagtgttggatgtgggaggttatatttgacgcctcgatctgggttcccgtcgatagataaacacaaaataaccaaactatctcttgtactatcccaccgaagctgtttcgccctccgcgcctcgcttcttatatgttgattgtgtgtgcgtcacttattatttattccattactacttctacacacccgccctactatggccgataggagggaaagagtgaggttgtttcggccccagcgagcaggacggagtccgtgctattatgtacttattcaaattattatgatatcttcgtgtacgtccggtgtctcggttataaccataattattgcttcttgttcgacgtgcgtgcagcggtctagagaataacgggtgtttgaggaggggtgtagcctgtgagcgtaaattgtagtattatgttaaattgtatagaatctcgtattctcgctgtctgaatatttctggcattcagtacgctcaagagcgatcatcgtgcataagctactactctcccgcgctactctcatacctagtaaactctaagtcacggtcgctcgctgcggcattctggttctcattccgttgtctgatcatgccacattntatttttatacttgtctcattatttacattcacgtaggtagctgaagcagtggaggacgagatgattcggctacatgcaacatacgcacattgtgaggataatgtatttacatgttgtcgtgtgacgnctgtgtcttgctggttatgtcgcttgttcgcatgtgacgacgtgcgcgcgatatttgaagtagttggtgttngtattcattatcttattctcattcttttagtatctatttcacccgacgctgtgtcgttcgagtggtgttattacgtgtcaatgtatgagttgtggttacgcggatgtgtgaatataagagcacccgacgtagagtcatcttgacacgaataggatattttgaatatatatatcatttcttgtaattagttttcgtgtaggtgtgtacctaggccgtacactcagtcggtctgcctcatanantatgaccgaactcccgcgtacggtgcgctaacgacgcccggctcag

SEQ ID NO: 9047 - DNA, 1477 bp, Homo sapiens
  misc_feature (1)...(1477): n = A,T,C or G
gaggtagtgttcagagcnnngtgaagaaatatagtaatgcgcatggttttttaacaaaaaaaaaaacaacgaaacatattttttttgttcttctcattaataggggataacggacaattataaattcccctcctctgttcttgtggcgacgcgggactatgagaggatcggttattgtttcgcgacactcatcggattgattaggagtacataccacacccattgcgtgagactccagtacgtcctcgctttacgaagagtgagtatgtacgtgtgaacgatcacggacgagacgtcgtccttcgagcgtcatcatctcctctctacatttctatatcgcaacctcgtcagcaagcgaagcaactaagagacgagtaataggtaaattaatatctttgtagctttatgcaagttttttatttcatatgaatttggtgtgttgataagaagaggaggataaagagggntataaagagaggcggtgttgagttcgattggacaggacgtaacacagcggcacgccgacgcgcggcgcgatcgatgtggtctgcgtgactctcgcgacgccccgcgtactgcttatgagtaaanaccgcgtcaaacgcgcgcgaagcgccgcgaaaaatctgagccacgacgagagagcgtagagactagaacagtcgccagcgtcgcatcgaacgacaaacacgagaaaacatataataaactagcgtcacaggacgtacaaagcgacaagtgacaggacaagaacagcatgttatataacaccaattcatctgtgtgaagagctgcatcacacggacgccaacagaccgacatctacatcagaactcttaaatgacatgaggtatcaccactgccatcatgttggaacacgtaattcgtaaagccggatacgataatcctatgaccgcgcaattaaaaaaggttaattcaaaaaggcgatacctataattcattccatcgcaaataaaacccagataagtacgacaccgagtaagtgctaatatgtacttagtatacaccagcaaatttcatacactgttataggataaaaacggcgcgacattcgcaacggtagcgacgcctatatgatatgactcgcgtcggtaatagtcggacctcattatagcatgcgctttcgacaatattcgacgtaagaccgaaatgaatatagatacccagatataataaacaacaaatgatgatttcaagctacgcgcagcgaacggatatagccacacaagctgtcataggtatatttttacgacattctcacagatcacgtggtgcatagcattaaaaattctcgcactcctagatgattcaagtagatcaacgcagtcttcactgtaaataatgaacatgagaatgcgagtgtatagagagctngcagctcactccatccttctaacgttcatatcgattattatcttttgttgtcgtgctccaaagatctcaaccaatgaaacga

SEQ ID NO: 9048 - DNA, 1776 bp, Homo sapiens
  misc_feature (1)...(1776): n = A,T,C or G
cgcagtcgagtgacattagttaagtgatatgtagaagaggtggcaagaggtgattttttagctcacnggccggcaggaccacacaaccgcgcgcgattctttcgtctgtacacgagacattgtgggtatggtgtatattatnaatacgntctttatctantcgttcgtggtgggatccgcgtacgacgacgtggtcattatcgaactttgatcacacgagaacctatattcagataatgaggtaggagagtttgtcgtagatgtgtggcggggatcgtggtgcattggagatagtcatagcgtgatgcgtaacgtctcgcgtatgtcttaggagtgttaagtcgtcagatcctatcttctctccgatgcatcctcnttacctntacatctccttcctgttatcgttagtgcggctcgactcgacctcatagtgcatcacattgtatatatatccattctgttaggtgttgattagacgggagatatagatgtgagagaggtgccattctttgttgtgagattttgtattgtttctgttgatcacgaacgctctacagactcggcgccgtgcgtcgccgacggtcgcgccccctgtccggacgcaggggtctgcggactatgacagtagtcnccgagcgccggccgggcgcgtctatgcatatatatgttatgttggcgcatcggcgggctgcgccgcgantatcgagacggtggtgcggctctacatacggcactatatgcagccgctcgacagtccgagtgcgcgagagcgagtattggtatcctcgtcntatgcgacacgagcacgtagctgatcgctncgtgttcgacactctgtcatcaccgtcatgttacgtncgagcattcgtcgttatattatacatcatccttactgccgcgcacgcgccgtctagtgctattacaattacactgcgatatccacatcacctgtagagcagcatcgacgcagctaccgagacacagccactcgcgcgacacgagactcgancatgtcgtacgtgcgtctcantccacgtagtcaccctagtctcgcagcctcagcttcgtctcgtagatggccgagagcatgtcgccacgatcgcggctaatggtcgagagcgcatatctgatcagtcctgcctgctatctagtctgcgtagtgttatcgaagtgacgcagcggcggttcgcgcgattacgtcatctaatgatgtcgagtaagctgccagcgccatatcatcgttcgtcagagtggtattgtgantgagcagactgcnctgctccgagtcgacgacgtacggcgcggcgcggctagtatggatgggcgccggtacgggacatgtgtctatcacgcagccagataagcgtcttgggccgtctaggacgccagnggtgcggcgcgctatcgtgcagcagtcttactagttacgtcgtcatcatgtatattgtgaatnaagtgatcatgttacgttgttcgtgtcgtgactgtgtggnacgtggngcgnaccgcngtgcgatgagcgagtcgtcataatgtattgtatcggacgatcgagcaggttcgtggtgtggtcgggcaggcgagtgatctaagtgtccgtacgcgtggtatagagcacgctcgatggatangnantntntaggatggctatacgacggggngtcgatttgtgagagtgtatatggtntccgccgccccgcgcactcacgccgtgactctngtgtgtcnttgaatatgcatcgtccgcccgcgtcaggcggcgcgcgtcgatcgtcg

SEQ ID NO: 9049 - DNA, 1336 bp, Homo sapiens
  misc_feature (1)...(1336): n = A,T,C or G
tgactccacctacccacctaccgatcacttacactccccccctcacaccatctgtcacatacttcttctacctctcgtcctccacttctgtcctacctcacttacaactcctccaacactctattttcactaagcacgtcacgcgtacttactcacacaatttcccagatcttatccccacccatttggggcgcctgggggcgncccacaaaatatatgtcttctctgcttactccctcttatcacactccacaccgcatcccaaatactctcatcacacacttctatatatttatttactctacttctatttatctatcatccatcaccgactcctttctctctaccccgtactgctccctactcttcaggtgattacanacacttttactcctctcacctcctcatactattccacnnctaaacccttatatcgtcgtgggggtacattcgtcatctcatacacatcatctcacctcgtctctacatcacagatactacttcattactctctaccactctccactcactcaccactatcacactcactcgtcgtgntcntacctctctacaatccccgctctctctgaccccagacatacctcccacactacttcctccccccgccaccnnttctccccctcacccttcccacctcatcttcgtattaccatcatctccatcaatcattccccccatagtcacgatactcgcacctcacatctgcactcatcatctaacatctctgtctcatcttagtagtacctcactctacatttttcatataactctctcacccattacgtcccattccctcctttcttctaataaccccacaccccccttatnatattcataatcccccacccacatcctgacanatacactcccacactccttcgctctgtaacgtcctactacttctctatatattttctatctcgctctcaactttcttcacatttcccacaatactctacttcctcacctccttttatgtccacatcttttctcttatctttctatactccataccacactaatttcagtactcatacctctctctacttttctcctcctccacccctccctgcctacatctaattatcatacattctcctcccgatactnaccctccacaccccactccacacatattcattccatccncacatacactcaaaccaacacatcatatcaatcctcactaatcatcgcctgtaatatccctatcatccaactatccaacanttaccaccctccgactcccagcatatcaccatagcaagaggagacgaacggtccactggaatccaaccatctatgctctcgcata

SEQ ID NO: 9050 - DNA, 1572 bp, Homo sapiens
  misc_feature (1)...(1572): n = A,T,C or G
gttgctcagtctcgtcgagtctcgtgctgtatctagccgctcggtagtgttgtacaggctgagtggccgtcggtgtgttcaggcggtcgtagagtacagagaatagtatatagtgcatacgaggtggctgctagtcgtcatgcctcgcggagacgcgcgtggctacgtgcgttcgctccctttctcatgtctcacgtgagacgccagtaggttatgcggccccgcgcnnacgctcggtggccgagcatgtccagcgcataagtcaagaagcgcctccgncnnanaggagcgtgcgtcagatgcgcagtccactgccggacgcgagtgcgtatttgattatcgcgttatcgctacatgttatccagaagcgggctagcagcgcccactcacgccgacgatacagggtctttcggtggttaggnactcagctagcacactacgctcgtttnctttaggcgctagtagtcatcacgactgcacagtatcgtgatttatgcgctagatacaatacaacgatattcgcagatagtctcgcgattagctacagttggttcgtatctgctcaggcagagacacgcgagagatcggtgtccacgataactctgaacgctgcgngcctcctgcgtgttccctattcgacggtacattagacgttactcgtcgatcngcacgcgacgcgagccaccgtccgcgcgtgctactacngncggagatcgtctctctgacatgtctgtcatcagtcatatactcatcgatagctgtcgtctcgatgcatactctcgcgaatgagtctatatgataattctnatcatcgtcctctnctatggtactcgcgcagtccgactcacgtgagagcgtncgttggcgatgctgtggtgcagagacgatcgaccgtggtacgtcgctgtcgtaggcgacgaacatgacacagcgcactaatagcaagcncacggcacaccactactgtgacacagcatcgcagctctgcantctgcntcatcagcgntacctatagtacgcatgccaaagctgttgctacattccgtatgtcacagcgaggtgcgctgnatgacgtgacctattacagtgtcgcatcgagcgtcttcactggagacacacacctgcgctgctgcacgcgtcgtntcatcatncgacgcacgacagccgngtccagagaagagcttnatctacatcgcgcgtagacagtgcgcagtcgtggtntgttacgagagtcagtgaacgtgtggtcaaggatacgtcatatgcgtagtgtcgcgaaccagcgcactgccgacgcgcactcggtcgtgataccgataactcatgntcgcacctactacgctcatacgcgcactgtagctcaatgatgattatacagangcctacatagtgtcacacgaccgcagcatatggtgcncgacactacagagtgtttctgttnttnccatggtggagcgtatgcacagccatacgacgaccatcagcgcgcacgcgctcgatgcgtcgnacgatgcgatgctcgcgagngagctatccgtcgtgtcatcacctctgtatcagctgtcacactta

SEQ ID NO: 9051 - DNA, 341 bp, Homo sapiens
ataccctgacttataaggaggcccaaacctattttacctgaaagcttagtggaattacaaggcattggacttgtaggagcatggcacaagataacctaatgcagcaaacacactctgaagatggcttcaccaagggaccaaagccaactgaccttactgccttcaaccagctccaggagggatgcccttgccaatgggtccagaatcctccaagttggctggcaatgcccctttctcctggacagagtctgggtggatattgccaaaaattgcctccaagattctcctttcactttgctttcatgaacagattaaaattcctttgaccaaaaaaaaaaaaa

SEQ ID NO: 9052 - DNA, 436 bp, Homo sapiens
acttactgctacgaggttgatttactctcaggacaaaacgtaagaatttgtgacaggtttcatcctcttacttgaagtcatatattcgagaaggaggagtcctgttgagaatctctaccctaacacactttgggaaaagcagaattctccgtggcactgcagggaaatcatgagaaatttacagccctggagaaaaaaatgcttaaccgggatctattttccatagtgtggtacttacaaaagtcgagaagtagaatggcaaaggaactccctctggatcacagtaatgttcatccttaatctcttggagaaacagtatgcctggattggtaaaacaatttgtagaaagtagaagaaaaagaacttagatctgtatgggctggttttatttcagaagtctgagaataaatattgatccagcagaaaaaaaaaaaaa

SEQ ID NO: 9053 - DNA, 2318 bp, Homo sapiens
  misc_feature (1)...(2318): n = A,T,C or G
gactcacaactctcacganccgactgtctgcgcgtncggtcactctgcgcgatagtcttcccagcactgatctcacattctgntgttacgccgcaacgtcgcgctcaaccttgcgtctcttcacattactctcgacccatgacgtgctcgcagtcagccatctcatgcgagcncctcacatcatcgctatcgccatctcatactncatacgcgcacatgttngcacagtncgtattatcntagnccagnctcagtngaatatgacagcgtctgctcgncgcncnctccgacgagtgtactatatggtgatacgacgtacttgtgtcatctctcgcngcactcttgatcgcgctgcgctctacgtccacgactgacagagcactgctgacgtgtacatctacgcgtantaggtagtatgccgcagtaatttaaggaatctctgtntactgtncgactcatatgatacatagttatgcgatgcagtgaccgtgtcnacatatctcgatcagattncangtatctatcagtcgttcngccgcanacctcagctcttcactgtacgttaccgacaccatcgatgcnactcgaatgattcgcacncncaganccacgcctacgctganangcagcncgtgctcatgcagctgtctggcgcgtactcgtcgctacatgnaanccatacgctcgcagcacgtaccatcgcgcgtcgtgtatgatgcgtcctctctagcaccgcntctagtcacgactactntactcctactcaccgtcaatctatactcgatgcatgcgtctcgctcacgccnnctntctcgnatcagtntctcgagagactgacgantgtgacncagacgcagcgtgacgcgcantcacacgccagcgatcgctagatgtcgtncncatcatatacgtanntcatcncntcnnntctattcgtctgacantntgatcattcgacacagtacgtgtaacagcttatctactcntntaatgacatcactatcacntgatgatacactcatgactagtctagactacgntcatctgcatgcantntctctgcgacgtcacgtcgagctagcatgcgnctgattactntcgcnantacngccactagctancantgctgttcgctcatgctgtaccnatacgatatctggcgatntcacttacgagctagcgcagcgtgcgcgtacgagcgcgcaagcatgactgtgagctgctacgtccagtcntgacagctgtctngtcngtctgcgacgtggcgncntgaccagccacngcagtcgtgcactcaccgtactcggcgctactancaacgtcgacatctgggtgccngtannactgcngacgaagacgctagcncatcntntcgtgcnntnncactgactganctgnagcgtcgtacganagagtcgtacgnctgctcgtagcatgacntgncagcgcagtcgtgactgatgtacgcngctaatcgtgacgcacggcgaacntncgntcgtagntggctgnagtnctntacatcagcgtagcagctaacgtggagtcatctgncntantctactntcagccgcgcgacgtcntcctgcagtcgacgtcatcatagctctacgatcgttcgacgtcgtcgncngctnanacganntgctgacgantagtgatatcctacanganacgacgatcganaagccacagtactagcngacagtacgtcgtcgtcnctantgagctactactatgatgatacgactatcgngtngctattcnactatcgtcaancggacgctcancgatcntcgnatccacgatcgctaagctnctgtcgtcantgcagtcgatgcgntacggcgtcaagntgnatnctnatgagatgacatggnacgcatnatcgcgccgctnganntatatnnnantantggtaggaccngacgncntcgtacctcgncgacccatagtagatnnacntgtcatcgccgnacnatnacngcngcgatcgnacgccgatcganncgacatncntactgcaancgctagacngatcnactgcngantncgtcgtcatnatctaccggcagngtctcgacgctnngttntcgnnagaatattactactgangcagcgttacnacgtacgagtngtcgacgtntcgactgcgacnagtccacgacgacgatgacatcagaccagctgactacagagctctncagcgtacgtcgtnactnaagcntacgctactatcnnacgaanatacntagccnacctgcacntcntcgatgncatcatcgnacnacancgtcatgcaacgtctcngangantc

SEQ ID NO: 9054 - DNA, 460 bp, Homo sapiens
cataattgtggcggaagttcatctgatctgattaaaatttgcagtgacccctctgagatgaaactcctcaacttgggtcagataattaggataactacataatttatcatatatactagaatatatttgtaaatgaaatgaagtattaaatttacaatttttgaaaaattgttttatcaaaaattcattttgctctattggtaggcttataatatagctctgttcagaaataattttcaaaataagtttctaaaattaaaatagcatgtatccatgtacactgcatgcagcatttttttatagtttaatgttcctaagtgaatctgattcagtatattgctgaagaattgcagaattgtttttctaatagttttatttttgtcataaaaatgccttcaaaattcttcgaagtggtacattatggccaataaatttaaaatcagtaacaaaaaaaaaaaaa

SEQ ID NO: 9055 - DNA, 1493 bp, Homo sapiens
  misc_feature (1)...(1493): n = A,T,C or G
cggcccttcgcacatcttttccccgttcaccactaatatcagtaccgaacgttcactcatgcttactctacttcaccctctttcacgacctcctgtctataatatgactgtatcgctattaccttgcgtgttatactagctcaactctccacttgttgattagttcatcgctccccactatttacaattagaccattccatgttgctcatcgctaacacggctacgcatcccgttctagcagaggnttatcgattgtagaagtatgttaaagttcgtgattaatgtgtatacatcgtcattctaccatattctctctccataacgatgagcgatagtgtgntaaccatctaccagatttcggttgacttgcgccatactcctattccatcacgtacatgtcttcatgagtgtataatagatagtntaatacagattctgtcaatgtgatacttctatttgtatataccgntatgcgctctgccggcgaacacgcacacaagcccgactcgtaccattccaactcgagcgcccgtcagacganancagtaggttganacacatgtgagtattattatataaagatttgtctantncacggagtggtctgtagcttccatgttatcaaacgcactacgttacagcgtcgatccagcagcgtgcaacccnctatctcagacggagacactggcgttatctgatgagcgacgactacaccgtgcaccttacatctcgatcaacgtagtactcagatgcgcacgcatcacgacgacacgctncttcgctagcacatgtcactctactagctgtcgccacagggtctacacactgactcnttccaccgcgctacatgatcagtttactcggacntcgcgttctgtctacttcgtgactgcatctccgncgtatgagtctcttctgtgtcgtatctcgctatctatactgagtctaactgcgtatgtattttaatgtgtgtgattatctcgtgcctccactcgccgtatagtgatgtgatctcgctactttcgtctcgagtactcgtcacacacacgcgcaccgacangcgatcgacagacgncaacgccgcgacgcgnatatctgcagataacgtatcgcatcacgagatatactacggtagtatgactgcgagtgngatgtatantntgtgcgcgctntatcatacgtatgctatactgtactcntntgcagcaccgcatgtcacgtngactcgcctcgtcgatcgcgccagcacgagactacatnatacttatactagtatacgcgagaacgatcgagngangcgcacatgagcagagagagcagctgtgtntcatacttacnagtgagtttagtacggtgtngntacactcatgatagncgnatgcacacgacctaccatcaatcagtgagagagangtgagagcacgcgtctgacgccgcgcatcagtcgctcgacgcttgcaatgcgtgagtagcgcgaagctccagtccgagg

SEQ ID NO: 9056 - DNA, 1271 bp, Homo sapiens
  misc_feature (1)...(1271): n = A,T,C or G
gggtggtgttggtgaacaatataaatgatcgtggcaccattaaaattgaataagagggcaagaaagcagctaaaaaaaaagcccaaaaggggagggggtggggcggggggggagcccgaccacaaggagaacaaccaaaaccaggcggacgagagaacgtgggaacaagtagagcgagaagaacagctgaagaggtgcggttgtaacnaacgagagaggcacgtggccaaccacaacgaccccgacatcgaagtgcaagagcacacgcacgctccggcaggagaggaccgagcggagattagagcagatgcgtgagccgagtggcagcagggaggaaatcatagcaggtatagagacgcggccatgccggccgaggggtgccgccggcacgccaccacgcaactgccatcgatggggcgaggcggtgacagcagtgtgtctgancgctagaaatggttgtaatggatgctggtgtgggggcgagcagagacaagaaagggacacaaaaataagagagagagtagcactccacacgccgccccaggcggcaacgcgactacgccgaatagaccgcggccggacactcggcagatacagagaccacacggaccgcacaacagcaggcagaactagagtagatccgggacgcgccgcaaagcattcaccaatctatacagacagatagcgtaatgagagcgaggacaatgggccgcgctaggtggagatagatgacacaacaaggacactccgtacacaacggacgacagacagtacgctacgagatgcaggcatacgcgaggccggccacgctgcggtaggcgcatctggcactgttaatccgcggcgacacacagagaatgcagcaccgtatagaagtagatgaggtgtagagtaggatgcaacgacagatatacaaaagtaagggtgntgaagaatgtgccgtaatacgcctccgttcagcacgtgagactgtaccgagatccgtcatccggctgcccgggtgtgtcagggaacgncagaggagatgcttggaggatgagaagggttatgacgcgccgggcgtgcgtggtatagtggtcggaggtgtgagtgagcacacgacgagggggagacgttatgtacagaattgcaaagatagaaagtgatgcgcgtctataagactaggagggagagagaggtagtcgacagcctcagctgaacgaccgacagacgtactggtgacgaactccagcatatgtaaagtagaggaagaggaagagcagaagaacaaa

SEQ ID NO: 9057 - DNA, 859 bp, Homo sapiens
cacacactcaacactatcaccctattaggatatcattatctcccacgtacaccataatgccaacgtcgtcgataaaacgcgtgcttcaccatacccactcccatcgttcctcgctcaaccctccctctacctacgctctccccgtctacacaggtctccctacttcgccgctttccctccgcatcttttccctcgccgcacctacccaatgatgtctgttacgttgtctcagtttgttaaaaattaacattccgatccaatactcaaatctacctcgtcagtcttaacattaactctccctcccctaccaacctcatattctccataaaattgggaacggtttggtctttctacatttcatatccatcaagaacaacatggaatacacttctttaagaggcccaccactaaagttcatcgtatggcccttcggtgggtagatgttaacaaacccgcctaacaaagagttctttgaaattatcaaggcaatttcccatattctcgaatattatcgcataacacagcattatttatttcattcgatgtgccatgccatagtgttatgttaccccaagaaggcctgctagagcaccatatttaaatatttactcatgaaatagcctgtgcctggattcactttaaaatatataagcccaaacatttaattggaaaataaatgaactaaaaagatactgatacattgctgaaactgggtgatgggtatatggaagtttattacttaattttggttttgtggctacttgaaaatttctgtataaaaataaagttgaataagcaactaacaaataataataaacatttcattaaaaataatcaccagaaaaaaaaaaaaaaaaaa

SEQ ID NO: 9058 - DNA, 1384 bp, Homo sapiens
  misc_feature (1)...(1384): n = A,T,C or G
gctgccatgtgaccggccgccgagttctgatcgttgcaccgngtagtagctgggagataacgtatgatntaactagtgccaagcgtgataggtgntcagtgagatacaaaggagagcantaagacgacatattgtntnagaggatggcnnatgcgagtanacgtgnntcgtgtggttacagcggntctgtgacatcatgatgatggatatgtgcgttgcaggcncnnctnctgacantcacgatagggcgccatcttcactatgcgcccacagagctnggcagcgnncncctcgtgccagacagtacatgcgaagaggntcnacagcagatgtagaagagatgtatactangancactnatgacgtatatagaagaggagtgccnncncgccgacgcatgcnaccagcacacgtcggcccccgctccacctgcacagatcacgcgcacgacaccgccgcncacagcgccccaccnccccatcgcgcccgctcgcccctcacgcgacagagcagcaccgcccctcctacgcctagacgagtacggccccacgctccgccccccgccgataccggtcacgagctagagcggtcccgccggccgcgtcggtcctatgatgacccccgccaccgcgcgatgcgccgctcgagcacaccancacgcatcatgcgaggcaccgacccaccgcccagccgcgcgccgcaacacccgcgctccccacacccgagtcacaccgtccncacacgtccccccactctaccctcgcnctgcgcgcccatcctccctacagtcgcgcccgtggtgtgtccatgcctgcgtgtccctccaggcgnncgatcgagacaagcgatcactcctcctatatctgcaggtcctcgcgtggccgctcncccctggcgtctgccaccacaccccgacaggcccactcgccgtcacatctgcattctgagacgattttcaacgtgctcgatctcgagcgttcccacactcacactcttccntaccacacacatatcagatcgtctgcgtctaatgccaccatccgacccatcgctctaccgcgaccccgcacaccgatacacacccgcctgcgcctcntccacgccacgtcctatcacctcagcagactcagtcaatganaactcatgtggactccgccatgccacatccctcgccgcgacacgtgtgcactttgacagagtactcgtacntccgntccnccgacctgctctgcgactngatctgaacgcagagtgcgcgncncttngcgcccagctccntcatctcagntctnttcactaggtatctatgcatgatgatgctctgttnnnttatgtgtgatngtacacagtgtgttgcgttgcggtatnatgtagagagcgtnng

SEQ ID NO: 9059 - DNA, 469 bp, Homo sapiens
atgtgatcgagcaatgggatggatatatctgtggagttccagtcatcttagaaagtttttgctgctttccctgaatgaagtgctgcagagcggacacagctaattgctcgctagctggatgagtctgccaaagagtgatgagaggactgaaaccggtgtaagtcatcgatgttgataaattggctcccaactcaccctagagtgcctgcgggaactcataagggccatggtctgtcacaaatgcagactccttagataagaagcctgctatactcaggggaagtaaatgtcaaaacctgagccgttgactgcaaactttatattgttgctcttaattttcagatgacaccactgatgctgattgtgctatgtatatgtaggtagggtggaagctcagatatagaacttcaagttcaatccatactgtgcactcaataaagattacctttcagcttgaaaaaaaaaaaaa

SEQ ID NO: 9060 - DNA, 1411 bp, Homo sapiens
  misc_feature (1)...(1411): n = A,T,C or G
ttatagtctatantctatctgaatcattatgatacatctaagagcgtcgacgacgccgaactgcacgtactcgtacacacgcagcgctgacagtcatcatgcgctgtcgcaaactcccgcgcgcgcgctcacataagacatctactactaaggtacggtatccactatatacttccgctactaagttcctacatacgccacacagccagtttagcgttccccgctccccgcgtcgtatatcatatcactacatccctacctgtcgctcattacacagaggacctatagtcacacattagcgaccttaatcgctcgactatctacgtttgtcttttatctgtgcggtactgtgatactgaatgaacatataatgtacaatacactatagtgcacgacagatgtgatcaatgtagagctctgaagctgctatactctctctatgtatgttcctttatcacactcaataccttcacccttacacgttgccttatactacttgtgtcttctgtgtttgcgaaaccttgtaagagcctacgactgcaacaacgaccccgccgccgcgccgcagcaccgtacacgcgcgtccttcatatagtgctcacgattatgacgcggatatagcacaacatccgtatatccacctaaccactcgtccacgaatatttnatacagtgcgtcatgcgcgagatgaatgaatcgagagtgccgcatatagacaccacgtacggtgcacgccatgcactgtaggagatcgtaatcagagttaaccgcgtgtcggtccagcatagagttaagagacgcgccgcgcactagtcgtatctntgctacattcgcttctgctcattgtataccacttttatctttgttgcacgactatgacattacaattgcacatattaacctcgcgcgccctagatttaactatatatgtcatctgagttggctacgacgcaacgacactctccttgacacaagcgcgtacacatcaagcacacagtctccaggtaatatattgatacgcgtaagtactactttgcgttatgttctcttccgtcgatcacccttcactctgctctcgacgtgtcacaatgtgagccgcgacttgcacatcacccaatccatcactcgcttcctacttcctctacttcctctcgccatcacctctctcactcgtggcgcattcttgntgtgcgcgtgcagacacatganctcaataagtgctcactgagatgtgatgtgcgcttactcgtaacactcatctacatagtggtctccgttctcaccantgtcctactctcactagcggtcagctatgtattgttgctgcgcataggaccaataaggccgcgatgtaagtacagctgctatgatagcgtatagtcacggcagatacaagaaagaacatangatt

SEQ ID NO: 9061 - DNA, 392 bp, Homo sapiens
atgctggagtctgcacttggaaatgtgtgaggaatccaggaccttattcatacccatgatatcatgatggctaatacattaaatgtgtacataacatattcttatggactctgagatggagcaagaagcaggttcatccagtggactcaatggagagcaatgacaaagccatgaacatgaaaagactgtggcctttctagagattcactgaccaaggactggacaaacaagtgacatcaatggaacctccacacttctgaatgtgtgtgtgtgtgtgtgtgtgtgtgtgtgttttgtgtgtgtgtgtgtttgcttgtctgtcacagagaatgattgaaagagatggttaatgtgactaaatgcatatagtcttaaaatgaaaaaaaaaaaaa

SEQ ID NO: 9062 - DNA, 1118 bp, Homo sapiens
ctgtaccccaccgaggcccgccgtcgcgaccgcagcagagggaggggaggcttcaggggggggaacagggaggaggggggatctcagacgggggagagcaccagcgaggcgacaacacacggggaggaacacgcgagagaacagctttagcaacgggagcgacccgcgccacgggcgacctcggcgactgagacagacggggggaggggggacagaccagaaacacaatatcacgcggaggcgagaaaacagcacagacaacggtggcgcggcgcagaagggcggaacgaaacacgggcgcgaactgacaagggaggaggggacgcggcgaaccaaatcaacggagggcaccgggacctctctctgaagcgacacgggacacacacccgggcgcaaacaacagcagagtccttggcaaacggggggagaaccgaacaaaacccaaccagacacggaacccggggcagaggagaccagaacgcacaaacggcggcgacggagacacgcagacaccgcacacaacgatggggacagtggacacaccgcccacgccgcgggaaaacctgcgcaagcgaccgacactaggcgggggatagggcacacacagcaaacaaacggggcgacgcgcgcgacagggcgagcaacacgcacaccgggcgagaggcggggggacccaaaagggacacgacgaccagcaagacctacaggattcgagagccccaagacggtgcgaccaagccgcacagtacagaccggggtctacacacccgggacacgggtgggcgcacaacacaagggggcagagaggtgttggaggcacacgggggagacaaggcgggacgcacagctggacggggggcatcggaggcaccccaccggcggggcgccgggcccaaggccgccagggggccgggccaaaacgaagaaaagagacgtggggggacaaggcgcgcaccacgcaccacacaacccaacagaggagtggcaacacaacaatgaggcacccagacgggcgaggcgcagggcagaccggagggggagactgcgggggaagagggacatagagtgggcggaaggtgcaccacgggcaggaggcgcaggagacagagaccgagggg

SEQ ID NO: 9063 - DNA, 346 bp, Homo sapiens
atgacactggctataagggatttcaatgtgcacagagcaactgcctcctcacctccccacggactccactacaaccatctaggaggaccacagcagcttcgtctagccttccccttcccccaggaccctgggctggggtggaggaggaggcgccactgcagatccagtatggtgagaggaatctcatggcttccaccagaatcctcaaaaccacagcacatcagtttgctagcttgcacaaaagccttcaccggatgctgagcaggtgctgggcctgtgcccttggacttcccaccctccagaccataagtcaaataaattcctttcctttataaaaaaaaaaaaa

SEQ ID NO: 9064 - DNA, 220 bp, Homo sapiens
cattctgttatctggggtttatttgccaaaagactgcttcttgcttaaagcacaatctattcaccttcattaactactggattgctcagagttctattttctgctaatattggacatttagcaaatcttcctcctctgtatttgcttgtatcacatctcaccatttgacaaagccattaaagttttcttgtattgattccttgccataaaaaaaaaaaaa

SEQ ID NO: 9065 - DNA, 1984 bp, Homo sapiens
  misc_feature (1)...(1984): n = A,T,C or G
tatacgtcgtagatgtntcattaatagttcgctgatagtactacttccacatctatcagcacaacatcttatgcacgcgacgccactctttggagtgaaggcgagagtcattctctntttgatatgtgtgaatcatctctctagacaggagagcgctacacanaaggccgtctnctcgcgtccaggcgtacgcgctccagnacgtatnctctcagatagacatgtatgngcgtcgcgaacgtacaagtgtacatctcgacngtgcgtacctttatctnnacnatctgtatttacacactgtcgcgcgcnaccgcactcacttgacgatatgnatacttatcacatatcacgtatcgtgtatacgtgtctatctcncgtgcgtgactccgtatctagagctgtactcgacnagtatctgagttacactcatcgatgagatngtgcaagcagtatacatgcgacgcacgntgacagcacatagatgctacgatantgttgagagtgtagtgatgtatcgacgtccgtcgtccagagctcacacgcgcatgttactctanactagcaacatgaacgcatcgcactgcatantcatagataagtgcgcgngcagtgagacgtgactacttntgcggngactcgacntgagtgtgtctgctgcgccgagtgatagtagttttagcacgatagtacncgacatanatctgcgcacacgtatggtgagagtcttcggacagngacgcacgtcttagcgtcactgatctacgctcgctgcgacgcatacagtgatagtgaacatataagcgtcaacgtgtgtagatcacatgtgataataagtctgagagcacatantacgatactgtgacgatcnatctgtcgtagngcantctcgatagatagtgcgtatgagactgagacgagtatgnagagcggatncaactgcngtctcntctcgtaagngcttcaggcgtagacgcagagcagcatgtcagctgtcgacatacgtctccanactagatctcagtcnatcgactagtaccttcgctgagntctcaagagtggtgncatcgcacaggactcacactagtnttgcgatgaagcgtgntgatgtatgtcgatcatatacaagtgtggcacagtatgncncgtcgactcgcgagaggatagtcgagcgnagntagancagtcgctnagtggctcactngcgctgtcgtgatgtcgtatgcatatcttangcagttagtctacgcagtggacngattgtgantgntgatgtcgttgacgcaggtagcgaaccgagttnagangatgtgatangtctgtatcgcgtagtgcgctagcctggtatatntatgtgaactactgagtgtacgactagtagctacgattgctgttagatatgtagtagtagatactatgntccaacactagtataggtcgtgaaagagatgctgtgcgncgngcattacagtagatnagtatttggcgctgagngtagatatcancgagacgatatactatcanacgttncgcnctcgatttctcgntgatataagcagcagacntccgtcggtgcgacgcgattangaatgttgctgcantagtctactntcggagagagtancatcgcgtagatacgctatgtggagcatgtaatatcatcgatcaattgatgagtcgatacatgagcatgtgctntatcgacgnaganatgagatcatacccacgctacggcggngcagcatactcgtcgatggcatccgtctatatgnctcgtcngccgtntgcatcgatcngtatntaacnctntncngnantngnacgctgcactcacattcttctgtgagtatgactagcgtcagtagctccagtgatgtgtgctctactgatgtgtgagtacacatgatgcgtatatatgtgtgagangnagacgcgaacgnacgacgcatatgatatatgtgataagantacacactatactatgatg

SEQ ID NO: 9066 - DNA, 203 bp, Homo sapiens
cattgactataagacgtgtgatggcccaagaccgaatcaagaagcagatgcaagaatctagctgactttcaggaaattagaccttaaagcgacttgcaaaaatgaaaaacgaagcctcttccaaattttttgttttggaaaataagttatttttcataaaaaacttacattaaagtatttatgtcaaggtaaaaaaaaaaaaa

SEQ ID NO: 9067 - DNA, 230 bp, Homo sapiens
ataaatagaagcggaaaataacaagaaaacagtattattttttggaaacaaacttttattgggggggggatctgtatggcaatacaagataatgtaaacagttttgttttagcaagaacaattgtcaaaagtctagcaactttgaacattcataaatcattgcagttccctgaggcttttataagtacttgatagagcaaagataagaaagatctggctcagctctagag

SEQ ID NO: 9068 - DNA, 1099 bp, Homo sapiens
  misc_feature (1)...(1099): n = A,T,C or G
ccttgaaggaaactgatagaagaccgtggccatgatttactgcctgaaagcaaagtactgtcagccaaggatcatgctgtttggggtatcagagaggaattgaggagagagctacaatnatttgtgtaaaatatgagcgatatgggcttacatagataacatgaccaatgagtggagagagctatgatggggggaaaagaaatgtaggagtattaaagaatgaaggatagagattatatgtaggcgaaaaatatattaagaaggagaaggagaaggtggtaggagaataaagagagaagaattaatattaaagaggagggtccaagttcataggagacagacaatttgtaagggtgacaaaggagatgtaacggggtagatgcgtgtattgttgatagagcgggtgtgttaagctggacagtcatagagggtgggttatagtggagttatgatagaagagtggtggggggattaatgggtgggatatgagattttatgtataatatggagtttgaagagcggggtgtttgggttagcggaggggatgggtgtgagtggaagattaaggaagaggggtgtggagtatgtaacggcgagtgggtatggtgtggggcgaggaggcgggagtgtagaatatgttgggtggtgtgagtatggggggatattggtgcgactgatttgagtgcagtggacgtgggtatgagcgacgctggtaaggtcggagttgagtgggtatattagtctgggagtagtaaagatgtgggagagttcggtgtgggtgatagagtacgcgggcgtgtataagagatggtagttacgctggtcgtagaatgagatgtgatggcgatggtacgtatgatagcgtgctgggtggtgttggaggatggtgatggtatangcgcagggaagatatacgtacgtagtgatttgtgaaaggngaatatgcgtgattacatatagacgactgattgtgtatgttaagtttcggataatacgagaggtgagtaagtgtcggtggtgtggtccgagnacgtcgcgttgataatgtgtgtgtatgtgctgatgtgaggctagtagcggagcgtagtgagtgagagtg

SEQ ID NO: 9069 - DNA, 1927 bp, Homo sapiens
  misc_feature (1)...(1927): n = A,T,C or G
ttgctggttgtgtgtatngtgggngcacaganagagnnnnnaagtnatanattncntattgatatnatactataacagattntatggagacacttagttacgaaagaagagagaagaaagagacgccttaaaanaganagagaggaccaagagnagaagaaggagggttgttaggaggaccacgagacgagaaagcacatcnncagcacgcaccacaagccacccggcncggtccacncacgatagagtacgtgngtccncgatgtgcgngcgttcgcgtctgtgctatcgcgctgatcgcgtgagcagtacagtgatntgcgtcntcagcgctnnccncncagtttacgcgcaagcgncgctctggctcccagatttctncttcntcaanatcgccatcaaagancggacgcgctactcacaaaccatgcgcgacgtcnttgcgcaatagantgcgcgatcagtcccgctgctcgcagactcgactcgtctgttttcatctctctgctgatatgccgcgtgatcactcacacgtcagtctgacgcgtcgcncagcaacacacataacatcacaatcacgcatcnagtgctcacatcctactncacatnatgcggcgcacgtgtgtgcgttgcgctcggcgcgtgcgtcgccaccgcagttggtgaggcagaggagtgggcgtacgtgggaggtgtggttgatgcgtgaggtagtatcntgagtacgatttcgcagagtatatgttgttatttgttttatantccgtatgtgatatgtatagtactaatacgnatggtcggtgatccgttgtcgacgtcnttacgcgtcttcnatcggtgtgctcggtcgtcgctntctagtgcatacgcgtctctgtgtcantcttagttatacgatgctgtgaatcttatcgcttcgcttctccgccacgcgcgtcgcagtgcccgcgtcttgctcggcgagtgtgcgcgtcgcatgtgtngtgatgtcgtgccgcgcatcgaggacgaggngncgtgncgactcgacgcgagngcgcgcgtgntntcgttttagacntgtgctntgtgtgatgtcggatgcgngngtctagagatagagtgcgcttngcgcgcgctaccgncacgcgacactcgacntgccgtcagtcagcgatcgtacactgctgtagtgcgtgaggtgtantagngtngtgtgatatantcagtacnctgncgtgatcgctgtgtactaccgagctgatgcgacttgctgcgtcgatagagtattactntntnatngcatntacgatgtgtctgtactgtctcgtcntgctgtagcgtacgncgacncntangctatgcagacgtaggtnagtcgccgnggncagctaacgatgcatagtaggaatagtctatgcgtgtagtgtagctgttcngctgtgcngtngtntcantcgtgtcgcgtancngcagtgtgacgtcagtgncgtcggagacgtgncagtgtgtgcacgcgcgcaangtcgagctagcgcagcgagtgctggtcgctgccagctctactatgacgcnatcacgccatgacgacgtcgcggntaacgagtcatagtagcacacgctgcacgatatngatgaagntcgcgactcagatcagcgacggacgtgttgagtctgntgncgacgaagttntcagctatatgtagttttcactatcgtgagtncngtcggactcggcgtcgcgcgcgtcntctgtgaatnanctgctntatancnacgcgttgtatagtcagtgcangctacgatgacgnccgctgcagcgacagcgtcgctcagtagctncgtcgcttgancgatgcctgcgacgacncatcgctcatcgtgatattgnatatgtagtgtgntcgtctcagtatgtgatgagcttacacacagtantagcgactac

SEQ ID NO: 9070 - DNA, 1003 bp, Homo sapiens
  misc_feature (1)...(1003): n = A,T,C or G
caggagcgtnanggatgagaggtagagtgcgcgtcatgacgacaggcgngtgagggtatcgcgtatagtgtgtatatattgtgagttggagggtgttgtgtatgatcgagagtgctatgtcggacgtggaaggtgtctagtggtctgggagcagagatgatggcggatgatagcgattaagaatagcagtgtgcgaatcgtgtgcggtgagttgggtgtggcgagagtagatggacagcaatatcatgtgtgtgtgagtgagggttatggtaccgtgggtagtgtaccggtatgtgagtataacatagtagaaggtgctcagtgtcaatatcggactggacgttgtggttttagtgtgaacaattgacagaggtggaaacagggtggagggtaggatgaagaagagaaggaatgtctttgtcacacgaaagtagttgctagagggagaggcgcggaggtgggagagtatgaagaaagacgagagcagaaggtcgtgttgagaagaaagagcaaggaaaaatatgtgtggtgggtttgaaaattttttaaaagaaggggtgaaaagcctggcaagaagtttgagtttgtaagaggagaggaaaaaataaaaagggtgggcgaagaatgaaaataaaataggttttttaagggggaaagttgaaatatattttttttgggaagagggaggattaaaattagtaagaccgttgggaaaaaaaaggaacgaggtggaaaaaagggaataaaaaaattttttttttatagagaaaaaatggttttaaaatttcacccaccaacagaagaaaaatgtatgtttttttaaaaataaaaaaggtttatttttgaaaaaggtatttattaattttgtggcctgaagaaaagtagttaaacttttttggtcgttttggtttttccaccttnaaaaagggggaggataattaaggtgtattttcagaatcacgaaaataaatttatgtagagggtgtaaaaaaaaaaaaaaaaa

SEQ ID NO: 9071 - DNA, 188 bp, Homo sapiens
tattctatcccgattcccctcttcccggaacctctcagcgttgtgtccacccccgttatacccgacttttcccctctgattgtacacaccgataacagagatatctgtacgaaggttgtagtgggaggctcagattctttgaaaggggggcccgctactgctacccctgagtatctctatttgttctt

SEQ ID NO: 9072 - DNA, 616 bp, Homo sapiens
ccgggggggctggtccccgcgccgcagtttgccggaccgggccgcgataaagtcggcctatgatttttctctccgcgtcgcctttattccgcctcgtccatgctctcgtcctccctcgcgtcggtcagcccgtgtcctcctcgcgttccacgcgcctcactctatccacgctacgcgttgccgctctcgctctcgcactgcgccatcgcggtctcccgttgcctgtgcgctcctctgtgaggcgcttggttttttccctctcccccccgccgcgtttttccctcgtgtgccgaggcccgtgtgtgttttttcttactgaagatgggtcagtgctcgtcggctctccgtctgagcttcgctacggtgccgtcttctctttcagctcggttctggtgtaatatgtctgttttcgttctcgcggtgttcacttcgttagtctttctttggagcggcctgctctgtttttatatgtcttcgagggtggtgtcgcacctccggcccgttgctcgcggctcgcccgtggcttttcctgtgtctttccctctgggccggttgtcctttttgcctgcagcgtgtgtggggtcgcctgcttcttctcttttcgtttcttgtctct

SEQ ID NO: 9073 - DNA, 619 bp, Homo sapiens
  misc_feature (1)...(619): n = A,T,C or G
gtgtcagttgatgtatctgactcattattgtctgctgtgtgctcatgtgatggtctgtgcggtgatagtctggtacgctgctgtagttgtcgagagtcgccgaatcgattactgcatcacaaccacacaccgcgatctgctagtaaatattcaagcgcaccgcgacgaggtcctgaacttatgattgtgacgcctctactctaagcaaatacgtgcggtgatcgtggtggtggacagccgaggagacgaccgatgcacacagaagcagatactttagctccagagacggtatgttgagtctccttgtaaatattatgcgctgcctacacggtgtgcactctcgaacaggtacgccatcgcatcgcctgtggatctctgctgttgagcgacgtctttgcataccgtcatgantgaaatactcctgctatgtacgctactatcgtacnatatcttactgatatatagttggtcncttagtggataattataatccaatgttcacgcactctcactactataatataggtgatcatgtgagcgcgagaaagtatanaatactcactagatgtacggtgtacattgaatgcngtaatatataatgatgctgtatatggttctg

SEQ ID NO: 9074 - DNA, 166 bp, Homo sapiens
atgaggtagtaattaagagtgtgaccttagacaagttgtaagaacttggacaagtttctgaatctctatttgtctacatttctggactgggaatagtaaacatagaaatgaagataatgcatggcaagatctccaaataacccaggaagcatcaaaaaaaaaaaaa

SEQ ID NO: 9075 - DNA, 406 bp, Homo sapiens
atgatggagtctctccctgtcgcccaggctggagtacagtggtgtgatctcggctcactgcaacctccacctcctgggttcaggcgacgctctccctcagcctcccaagtagctggaattacaggcgcctaccaccacgcctggctaatttttgtattgttagtagagacggggtttcatcatgctggccaagctggtcttgaactcctgacctcatgatccacctgtcttggcctcccaaaggggtgggattacaggcgtgagccagcgtgcctggcctctcagatttcttaaactctgccccaccagcaaagattttgttaagctttatatcccatagtttgtattaggaaaacaatagctgtgttaaaaaattaaattgttataatattgaaaaaaaaaaaaa

SEQ ID NO: 9076 - DNA, 1834 bp, Homo sapiens
  misc_feature (1)...(1834): n = A,T,C or G
tgcgccgctcggctgtcagncngtagttctcatacatcctgctctgtctgtcaaatctctactatagctctatacatcacgcccctcattcgataatcgtggtcgtcagcgccagacgtctcatcacagtcatccagcacacgccctctccctactcnactcagcgctcagcatgtcactgcgcttacgcagcgcntgcatacacgagatgntacntcatcgagacactattgtcacgtcgcgacagcaccgatactatcgcgtctcgctcgcaccgagtntcacacatgatacgagctacttcgtacagcgcgacgtggacagtcatcgaccgagcggcgtgagatcgcgcctcatcgccgtagtgctcacgcacacgatcgaatacgctcgctgatactgaacgactgacgtctntatgtccatagagatcaactatctctagcagtaacacacactacacatgtacaaatggtctagantgatacgcacgtattgcgttgctcgttgtcgtctntctgctacgtgatcgatgaatacctagttctgcgcgcactactantgagtgcactattcatactcaatccatccanctgangtggcgatctagacgtagtctaccaggttcgaccatttggtatngtagtgttgtcaccgtagcgagctctaganaatatagacttactagtgccagnactcgantcacatcgactggacaatgacgaagtagagacatctaatcctcagtatagaactagttcgccatantantgctccgcgtacgtataaatgtgagncagtatcgttgtaagtagcacagatatacnagtcgaatgatgcatanagatacagtcatcntgacttactacanctaccgagtcgcaaagttactatcatntcctactctatctcgagtgtatctcactcatacatgtatgcacgctgcgactccactctatatataacaaagacgtatatacgcgacgctgacgcgctatagatgacgtctgctgntgcaagactgacactgagctntatactgcttaactattactgntccgcacccgtctcacgttccccagcgcatggcgcacgngcactggatgatggtctcacgtntcggtgtgtgcgcatgtgcgcgagacgnagacgaacacgatactagacacncatatcatactgnatctgtcgcngngtcgncaatgcgtcacttcgactganaccatactatgcgagtgcgcntgtgcgtgcgangctgtatcacagnanacgactantgtntgancgttgctgatacgatatatactnactcgacgtcatactaggttatgtgatatcttactcagncagtcancatgtacaatcatnctatnagtcgtgatactgcgtctctcgnagcgatatcgtgattacgtacggtgctcactacgacaccacagatgcgcgacgtatagaagtctacagatgcacgagtccttactgcgtatgatcacgtctatatcgtcgcagcactctctgcgaacgactctctccagatacntntctaatcatcntacgatgcgcatcatcatatcattcgcgattctagtatgtgcgctagatgaccgatgtncaagtcatagtgtgctggtcacgtagctctgcgtgactngcgtctagacgaggcgcntcactatcacacattantgnacacaatctctgacactaacagatcagcatgacagtcgcgtgaattgtatcgaatatggtagtcggtcgcacggagactactncacacntncngtcatgtcgtgtgtagacatcgagcgctacacggatactntgcantntactg

SEQ ID NO: 9077 - DNA, 2271 bp, Homo sapiens
  misc_feature (1)...(2271): n = A,T,C or G
gcgacgacgtgacngngactgcgatcgacatgacgncntgntatnncgtgcgcgtacncggtatgaagaatcgactgtagtngcaacaagtncatgactatacngtaatagntatngttgctcngtcacacnacnatttattatactctacagtacncggangcagctnacatgcgcacgatactgctntcaagctatatataantctntcagaatnagagatcgtcngcncncaggtcacgactcgactacgagtgtacantcgcagagatagtngtcggtatacatatattctngtnagtagatgcangttcgatactgctcatngatcgaatgatnctanagnctngagacgacgatacnnangacagtngcgattgngacgacgtacnagtngcngacgtanaggcagcgcagcncgtctcntagctagaattantanntatacnntgtncgatgnacacagcngtctatctgatgatcgcgctgcctcgtagtgactgcgagatcantcacatcttagtcgtcnganagacnttgacacngtcngcagatctgcgcggttnagctnnganttgagtnagcagtcgaatatngagtagncgtaggtgcngcgcgatgatcacnactgtatatagtatatagcactacgtgtantatagtagnctgtgcagtantangtgtaanattgatgatgtangagtgtanagcaggtcgcagatngcgcagctgccgnacngngatcgtgatcgaangtcagagangtcnagtatcgcgtgcnatcangcagcgatcantccagtcatgctagtagtantgcnaggtatactntnaagnctggatcgtgctcnctactcagtagcacancnactcngncgagcagcngangcanatnacatcgtgangacgacactacangttactagttgatagtgcntcacgatatncntagantcntaatcgntcgtcacatngtcagctacaggcacgacgtacgacnngtacgcgtgagngcacatcacagcagaatctgagtcgcagtacatgaacgacaggcagtcgagtactatagccgcacgctatgtgtantgacnngtatggacgatatgatgcanncagatacngcgctggangtagtcggtagangcaggagtccantnancgntantatgcntatcntcatnatatatcaanntacagtggaanataatgagacgatactatagtanntatgagatctgtgtgcatacgcagtanatgatgctggtngtatctactatncggatagtcntcgtctagcaggatgcgtgagtgatntgcgaccgacgacgatacatgactgcacagcgcgntctacggaagnacgtgtgangtgttatatatgcgntcgcgcgcantgaggcacgtcgcgtngagtatnccgatcgatcaaatgtgatagtcgtattantcgtatcaggatgtgtacgcgcgccctgatnantgatgagagagnagtgcggagtgcgcgagcgacgaagatgatcatagtacacgtgagataaatatcgcgcagatcgagtatgccgcatcgngtagtatagcgcgccaatatgataccgcgcgcggcgccgcagtgtcatcgtcagatngtatatacgccgtctcacgtcantgntcattatggcgtatcgcacgcgatgtttagatatcgtatgtgccgagtgcgtacataatcacgcatgctcgagntattagcatatgcgctcacagntgatccacggatgacacggntctgaattatctgcgcgcagngntgnactcnantgcatagcatgcatgcgancatcgcgcgctaagacactcatgccgtgaggtattgtatcacctactntnaccataattttctcgactagctgatcgtctcgcagagtacctgnttgacagactagacgagcatacgaagattagcgagtcatacttgaatcngcgacgatactagtaggatggngnagtagatatatgcgcnatanantatgagtgtacgagtatcacgagcancgaacagtatacngcgcgtgaagtagtatatatagatcgtgagagtagaccgagacttgatatagcgacgcagcgtgaagtgagagcagagcacgatantcagcgagcactgagagtgacatatgagatagttcatcaacttntgctaggactgactcgcgcgcatcgcatctctagttgcagatcgtagcgcattattctctccgtatgataatcatgacatcatcgtag

SEQ ID NO: 9078 - DNA, 238 bp, Homo sapiens
catggttataccatatcaggaccctgtagatgtcatctgatccagctacctttacaattaggatacacttcttgaagtgggatgggtgcatcaaagaagatgtgcatttttattttgatgactactactacactacccacctcatagatatgccaatttatactgtgctcattccccatgcccttgacaataataaaagctttcaatctttttaatttttgctagaaaaaaaaaaaaa

SEQ ID NO: 9079 - DNA, 1079 bp, Homo sapiens
  misc_feature (1)...(1079): n = A,T,C or G
ttacacgtactcaccacgcatcgagctcaccttcgacagggacagcccgacacattcctaaagatagaggggactctgcgcctcgaacgcttatcgacttcctaatgctgtacagagtgcacttcacctagaggccataagatagcctctagatcgtctgggtcttcctacttgcgagtacgattcgcgaaaatatacacatgaagcatattagattatagatagcgctcgcacaatggacgcgtctcgtgtagtcacttgctccacgcacgtagacatcatagaaatccacgtcggtatgtttgggcaatgagacctcccatggctcgcaatagatccaatatcatgttcgtgataatcgccacaatatcggagtgatgatagacgctgagtgtttttacaaaccgtacagaccgcatcacatctctcatagcgagaaagacatattcattaatcatgacccaaccctgtcagtgcgagaacgtgtcatcacatgttggacgcgttatccccttccccaacgcgccctgacgcatagcatcatcataacacgacgcgacagcataatgacgctcgcgccagtctacgcaccccatgttgcaacacaagtgtcgacaattgagaaaaaagaagattaatagtaaatcaatctgtcgggtgaaaaacacgcaaaaaggaaaaatctagctatgggttcactccccgaagttatcgtgaatatcgttatatatatataagtgagtatcaataatgaacgatcctcattaacaataccgagtggatagaatagcgctcataattcagcaatggaccttcagcatcaccttgtactatatcgatataccggcgaatcgaaggtatagggctagattgatantccacaagttatgcctctactcagatataaccacgcaagaccatcattgagggtcgaaactgaacgttgtcttatgcgtatgacagtaaaagggtatctgacgactcacatcagacattactttaacaccacactgcaacacacacaccatcacgaaataagcagtcacccgatatcgttcaagtgcaccacataacagcca

SEQ ID NO: 9080 - DNA, 759 bp, Homo sapiens
  misc_feature (1)...(759): n = A,T,C or G
ggtcaggatcagcagacgaagccaggacggactgaatcagaaggaagatgcgcttctccaccctgggtgggcacagcttgggctgtggggggtaagatggagtctggctctttcgcccagggtggaatgcaatggcgcgatctccggtgactggaggctccacctggcgggggtcacaccagttgcgtgcgtcaagctccggagtagtgtggactactgggggggattgtcattgacgggctaaagcttagatttggggagggtagatgggaccgaagtgtgccgtgatgtgtgatacgcgcttgaacttaggcgttttgcaactctggcggaaaaagagagccggaatgcgagccgttgccgtttagggggggaggagtcttagatgcctgagtgcgttaagatcttcgtgggcgagggtgttgtgtttttgccaaatggtacccggcgcagatggaaaggggggaaccgatggttccgagagatcgagtggcagatgccgcagtggaggcgcgcagcagcggggaccgggtagggtgtgtgcgtgtggagggactgatggtatgggcttggtcaagacacccgggtgggggcgaatggggtgggaaggtgaagggcatagtgtgttgggggaggacggagggggaggagtgagatgaaggaagagagtggggcagagaaaacattgtagtctagttagcctggatgntaccaccagatacggataggttgataacgacgcaggagttcaaatgagaa

SEQ ID NO: 9081 - DNA, 841 bp, Homo sapiens
  misc_feature (1)...(841): n = A,T,C or G
ctgctaacacaatgcttccacaccagacgtgtgcgagttgttttcccgccaccaaggaactctccagcagacaccagctgcctgtctgtcctcgctttgaattcaattctgacactatccccctggagacagcttctagtcccacaggctaagggctcagtcccacaacactgccccctgcttcagaggccaatcgtgcaagcctgcattgtggctttcgcttctgattgactggctgtgggggatgggttcctgtgaccccctctgcaggttccattaatttgctagagcagctcaaaggactcagaaacactttacttacatttacccattaattatattttacttttattttatttttattttttagacacaaggtctcactctgtcgcccaggctaaagtgcagtggagtgatcatagctcactacagcctcaaactcctgggctcaagtgatcatcctgcctcagcctcccaagcagctgggactataggcacatgctaccacagctggctaattttgtttattttagtagagatggggtcttgctatgttgcccaggctggtgtcaaactcctagcttcaagcattcttcccacctcagcctcccaaagtactggggttacaggtgtgagccacagtgcctgacctacccattgattataaaggatgttacagaggagtccaatgaacagtcggagttgaaaagatgcctanggcgaggcatggggaaggggcattggagcttcatgcctagtccgggggcattccttccagcacctccacgtgggtagcaattccggaagttccccaaacctagtcctttgggggtttaatgga

SEQ ID NO: 9082 - DNA, 862 bp, Homo sapiens
  misc_feature (1)...(862): n = A,T,C or G
caaccaagaataaggcaaccaaaacagcaaacacatcaaaggacagtagcaccacatattgatcacnagcatacatgaactaatcaaccaaccatccccaaccgacagatccacagtgaggacacacacacacaacggaacacaacgtcagagagacatgtcaccgtgctccacatccgtggcgatgacgctctaaagacaacagaaccaaaacagcgcgcggagagcggacgcatgcggcactccatggcgcggggtcgaagcgagaagacgcgacagaaaacgataaaagaaaacaccggaaaagaacctgaacacagaatggcatagcccgaggcgaagtgcgctgcgacggaaacaggacgagaaagaagaggaggatcataacgaagcccactcaataacgaaccgacacaaaaaaccacaccagtagagaaggatagagactagacgcgggaccgacaaagacaaggcccgccgcgacaccacggctcacgggcgcagtggcacgcactcacagaaaacgatacacaacacccccgcagtcaagaagaggggaacaatactggaggcgcctagacaagaaactaaaacacagtgaggtagacaatacgagagaaggagcggagatttttttatttttttttttgaaagaacacacacaagagtggggcccccccccccccgcagcggaaagaaggggggagaatggaggcgtgaaccaagagagcagatgagagagggagccgggcaaaaaaaaaaatattcgccccttttcggtccaacccccttcgcttctttggggccgcggggggggggtcggtgggtggggggggggtttttgtggcaccccccggaccac

SEQ ID NO: 9083 - DNA, 1847 bp, Homo sapiens
  misc_feature (1)...(1847): n = A,T,C or G
cctaagttngcntgagacacganatcancgtgctctagtcgatcagtctgangtgnnagtcgcgtcgcggtagcagtctgtgctcacatgcgcgacgctagtcgtangtgcgcatcagtacatcgctacgcatgntagacgtgcatgagactgcatcatgtagtcgctcgacgngtgcgtgagtgacgagacgctngcgatgtgtngtgcgctcgaaatcgtctgtcgtgancgcgacgcactcaggtcagcgtgagccgaaccgtactctgtcgctcggctagantgntaatagtagtacgagactgcncgagacancagcgcgngacggacggacgcgcagcgcgtgtncgtgacggaggtggagctgtgtntnataatacntgctaacgtccgagtanggaggtcngcgctatcaacacatctcactctacactaggcgctcatatctntatgtatgatacggtgacgtcgtantgcngacacacctcgtanantcagtgtgntngacgtcgntgagtcgangagcgactgtgcctagatgtgtcgctcgtgagcgtgtaatcgngtgcgtgtacgatgatctcaccangcnggtgaggatgctcgtggggtagtgctcntacaggagcgtgntacgnggcgcgtcgactacgtcgacgtcggtgtgcgcgcgctcacgcatnctcgcgttcgcgcacgtgnggcgtggtanatgcgagcgctctgtgtgagtgnagtagctcgccggcatatgtnantacganctctctgctctcactgtcgngcgtcagannnagngtacanacntcagcgtgcgggatgagcgtacatctgtctgacgnctcaccgntctctctacctgtgcgtgtntacntgctcatagcngtcgcgcgctgctgtgcttgacgtngnagcgcttangcgcgtagngttgcgcagctgctccggtagngtggtgagnagatacatctgnacactcctagcgatacactggcttatgtgtcgttnanggcgtcatcgcactatgtgntntctnttgtgtngtaccaccgtactgcgtntccgaaaatgtggngagtatggngattgngtcttatcttgtgcgcgtatanangcatgtgtgggccactgcggtgggacgctacgcgccgtcgaacgagcgcagngaccagtactctactcgcgtatagtacgtgctcgctggtancacgcttgtgactctacatgtgtccatgatcgatcttcaacgatatgtgtgcctacggtgttcgtatgtgtgctctntgtctgacatatactgcgctgatgaggcctcgctacgtcctctgcantgggcgacgagagnacggcgtgactggcgtggcgtgctggagcgctgtgtggtggtggtgcgtgnagctcgtctgtgctacacggatctgtgcagcgcgtgngctcgggtgtgtcttcgtgtgcgatgtggangcgcgttgcgttatgntttagtggggtgatcgagtgattcacgngatcatcgcncactcgcgtactctagaggnanaacgctacatggtaaggatgcatatatnagattcgataanagacaagggacagcanacaagatacagaagagatgtcnagactaacatcaaccctaactagaataatgaatcaacacgcgaaataccaaganaataacaacaganaacagataacagatgtgtctctgcngtctgtgtcgatacgaggtcggcgtgcgtatgttcggttgagctgcagcgctaagcgtgtngcatcctttctactgtgattnatcttacccgccacgctatatattaccttaactctatcttctacctattgat

SEQ ID NO: 9084 - DNA, 126 bp, Homo sapiens
  misc_feature (1)...(126): n = A,T,C or G
tatgaagcagcatgggtgaagcagnatcaatgtcctctagacanaatatcattaccattcggaattaaaaatgtattcttaattttgctgtgttgataaatggctttatggttaaaaaaaaaaaaa

SEQ ID NO: 9085 - DNA, 261 bp, Homo sapiens
cctgattattaaacacctttagcttgctgaggatgatatggctgaggttagctggaagtttagaatcccctgaaaaacttaccgcaaagaatagattctggactacagagtcaggctgcagattacgcctgggttttcttaggcatggttttcttccatggaaaactttcctgaaccaaccaccttgacacagtgggtttgccacaaaaagaaaataaataagtaagctgtgtgagcaaaagggggggaaaaaaaaaaaaa

SEQ ID NO: 9086 - DNA, 395 bp, Homo sapiens
ccttgtctgaagcattcagccgtacgttggatcctgcagggacagcctgccctaaaagccaagaagagaaaaggctcatgaggtacagggtctttggaaggctgtcgggatggccagcaagccaacaggacttactagttcatgaagacacgactcagctgtgttcagttacctcctcaatccacccatccctctcccttgaacacacacaccactcgcataaactcactttgctaatctataagggggggtgtaagggaatgacgtaagatgggcaagaggattcacacttgaatctagagaccaatgtcccccagttagaacctgcatatttaagctcttctatgtcttcttgagctaataaaagctttgtgttacgtgcaaaaaaaaaaaaa

SEQ ID NO: 9087 - DNA, 194 bp, Homo sapiens
ctggttatacacatatcaggacccttaagagtcatctgatccagctacctttacaattaggaaagtattgtctatagtctgaggatatgcaacattactttacattcaattcatcacacgtttaatgatcatttactgtgtattagaaaggtgtcattaaatcaccgagtcttagagctttaaaaaaaaaaaaa

SEQ ID NO: 9088 - DNA, 330 bp, Homo sapiens
  misc_feature (1)...(330): n = A,T,C or G
ctggagtgccaccgaaacatcctatagtttctagaagtgtgtgattctctcccacaaaactatgagctatttgggaaaaagggggctgggtgggtgctcttttttttcccctanaaatgagaagtgggtcacgcaaggggctgcataacagtttgacgaatgcttgagattgggcagcaatgcaagcctcagcaccagagtgtggaatcntagaatgggagaactggaaaggatttcaggggggggggggactnctctgtgcaatatnttaacccataactacatgtggctatttaagaagaaatcaaaattaactgaaaaaaaaaaaaa

SEQ ID NO: 9089 - DNA, 1385 bp, Homo sapiens; identical to SEQ ID NO: 6882
  misc_feature (1)...(1385): n = A,T,C or G

SEQ ID NO: 9090 - DNA, 367 bp, Homo sapiens
  misc_feature (1)...(367): n = A,T,C or G
tgaattctttcacatctgtgtactgatgaaactgctgactcagctgggctgaaggaccccactngcgctnncttntctggggnggcgtggtgatcacaacttncctnaangaccctactgacatcagctggtgtgcaaaggacgccacaagaaactgactcaccaaaaaatgcatcctgatgatttcatcccccttaacccaaccaatcaacaaccccaaatctacacagccccttggggggggggattcctacaaaactccagcccaaaactcctcagggagatggatttaaaggggtcctcccttctacttgcttgatgccctattattattaaactctttgctacaaacccaaaaaaaaaaaaa

SEQ ID NO: 9091 - DNA, 1189 bp, Homo sapiens
  misc_feature (1)...(1189): n = A,T,C or G
ggaatatgttataagaggagatgttatgtgaataaccagaggagagagcaggaaaggtgtgggggaaggtagaggcgttagaggggaacgcgcggggcaggcgtctaacagaccgccaccccncacctgatcaccacccgcaacctagaggatgagttctgataaacacaacgaacaaacgaatgaagtagggtggagctctctcccatctgatctatattttgagcctngctactttcgatctggggccaccacctcccacactagccttagccccacctcgtaacatgctggttnctggtggcagcatgggactgggccataacatatcggtgatcggtggcacacaaaacacaaaaaaccaaccaaataaggcgctataactccctcgtcagcatcatacagcaacggagtcattcatattactaaaagttccctctattatataacaataataaatgatagtaataacacagagttaatataataagatgaggtaccaccgtcgcntcaagtcaatttgaggcgcgctgcgggctgaccgctgtcgtatgccgtagctatcttctttgctgaacgatagtagtaacagtcaaccnagaatcagcgatacacccggactacctgcatagctcaagaagatccaagagaaaggtatcgacgcgaggtggatggtgtaatgtttagtaaagaggtcatgtgacgtgcatgagagacacttcactaactccgtcgtgtccagatagcggatctgtttaaaagtaaatcgatacgagagaactgatagataaatgagagtataatgtnagaagtgagcgagattagagtaatagatgagtgatgtattatatccatggtctacctttatttcacgagacgaacatgcggaccacatgcggatacacacatagccgaactatcggtagttcatctgattaacgatgatggagacggaattcatacgacatatatnttaagtatagtgttcacaacgacacgacaaacgacacaaggtagcacgcgcgtcgagaaggatgaacgtgacgaggcgtcgccgggctggatgtgctcagtatgcagattactatatgtgagcgagacgtctaaacgagagtacaacacaccgctcatggacgtggnagagagccagtatacgcgaagaagatgagtctagtggtagataagagct

SEQ ID NO: 9092 - DNA, 713 bp, Homo sapiens
  misc_feature (1)...(713): n = A,T,C or G
cttaaatacccaatcatcttactaaacgcccggaccctaaccaacctctacccatctccatgttatacatcaagcccccctctaaaaaattaacctcaacccctctatcccaattagcaagaaccgttaaaccttcatcgccaacttcccaccacactgaagttgtcccttnaaaggggggattaacaaacaaaactacttaattttctatcctaactaaaattcctaaccctagcttgggaaggtaacccaccccactttaaaatttaggcctttacttaacttacatctaacccatcaattaaaaaaaaaagctcactaacctaccattagactaaaaccagaacctaaaaaaatttctttatttttcacccttatcacacgagatggaaccttattggtatataacccacttattttaaaagcattcgcatcccctttggcccccctccatttaataggaacgctttttcaatttaattaaaccttccgcctcgatacaataaaaaaaagaacgaatactcacccaaaaaaaactgaaaaggatcatgcttccttacccacacgacgacccttttacccagaaccttggaccgatgtatcattataccgtcaccaaacatactttatagtctgttaaaatcatgacaatccgttcatactctctcttccacttaactaaacccataattcatccgaatgcgtgttaatag

SEQ ID NO: 9093 - DNA, 1289 bp, Homo sapiens
  misc_feature (1)...(1289): n = A,T,C or G
gtgtagatggggtagggtgggggggtgttggggagtgtgctgtgagttgaggcggacgatagtgtgggtatagtgaggtcggtttatcaggtgtaatatttttatagagaaaaaccaaagagcgaggagagtttgtcgtggggtggagcagccctagaatcacaaacacacatttaatattgacgtagcagttaatacacgtccatctcgtacgccgataatccggtgaaaattnacnctacaattcctccatcgcaagcgacaacgcgatcacgcctagatatagcaccccagacgtccatccatcaaatcataatcattgactcttcactaaacaaaagatacaatcagaaacaaaataactacaaactaaataaccaagtaacaaaatatgccgaacaagtgggcaccatcgcagaaaatgataacacgtcgctccggagcgttcctttacattatcacagtacgttaggtatagtacgaatttagagagatgataccggcattagaagaagacgtaattatattgttagtaacacaccctaccgcattagaagccatacacaccatacaaaccaccgacgttagtctctctcaacattcattaacgatatactccgataaaacattatactggtggcgccgaaaccacatggaggtacgcgagagggagngcgangagtagctggcgtcgcgagtatgtacctgcatgctaatttncatgatacaaaantagaagtcattctaactgtaatgcaggctgagagggaggtagagagttcgccctatgccgctcttagtgctgatccgtgttggtgagaatatatgcgaaataggctggagacagatactaaacttgtagttgtagtatattatagaggagggagatgaagcggaatgcgaggtattaggatcagatataaaataagtaaaatatnatatcgctgacaatcggagcgtaacttaatagcttatgtgttatctcgcgccttgcaaggctggagatgaatttgccgccgcgcctgaccaatcgcggcataagttttggtacatgcacacgtctatcatacgaacagactaacaatatacacacgagaacctatgctgtaattatacanccgacgccgtgggtntcctatcttgttcgtagtcacgcgtncgctntaatacgaatatagggtaaagaccgangtgaacatcncaatcgtatatcgcggagtgtgtgtaatcggagtggcagngccattgtaatagagtagcggaccactgtatcgacatatgtcaaatct

SEQ ID NO: 9094 - DNA, 129 bp, Homo sapiens
  misc_feature (1)...(129): n = A,T,C or G
gtcagtgaggacgtgagactgcaagtgattgaagagtttacatcgatcctgactgcttctggtgaaatggaaaacannatttaggaaggggtgtcatgatcactattatgaggttgaaaaaaaaaaaaa

SEQ ID NO: 9095 - DNA, 1487 bp, Homo sapiens
  misc_feature (1)...(1487): n = A,T,C or G
tagaattattttaattctgaattaagaatanaattattgtatgagtagtgttatagttattattacactaaaataggattaatcattatgtaatatttttcgttgngtaggtgaccctgtttagtagggagaggtctaaaagcagaacgccgcaccccgccncaacggnttatctttatgagtgcttcgacttgctgttctatattgtcaatggncaantatagagtagtaagatttgtgacagatacggaaantaaanaaagagccatagtaagagtccttgtgcaangcaccgaaggcctgcacactcggcgctgtctcgttacatctcccgcgctctatcgcacatgcacctcgcgcacacccccgggttaccacgcttatctaccccactcaggtgcacatatacgagantncgtgaggacganggtcgcagccntctagtcgcgtancgcgcgtgtgcagtcgatcacgcgtttccttactgtctcgtaantgtcanctgantgcgctcgtgcacncgncacgcacgcgagncgcagcaggcagagaggaggaagagagacaggaacgagaacagcgcgacactcgacgtacgttcccgttcgacggtgatttattagaatatgttcgtacgctgatcgggtctcgcgcgacgcatctacgttcttcactgagcgtcctacgcgacgtgcagtcgcaggacgaagcaggtgactgcagacacgtactacctgttcctctccgcttgcccttacgatatcccaatgtcgacaggcactaaggcggagcagtccgacgggcgcgccgcggacgagctcggacgcgctgagcgtgcggctactacaagatatgtattacatgtgatatctgagttgcaccactataaccactctgtgtgaagattcgatcttggatgtgcacccaggacgcagaccgtccggctcgcggctagatcgtgtgttggtatggntcggtagatggggaccgtactacgtagaggaagctacagatggatagtagctgaaaatatacgtcaggagtctgtgcgtgctgatcgtagattgtcgtgaatggaacgaaggagagtgcgtgcctggatacagcncacgatacgtctgcgacagaaangcgagactggacaaggcctaccattactctaacgcacctgaaccacgcaccttcaccgagtagcgactagagtccactgtctcttatgaacggctgactcgtacaatgagacagacttacctcatcgacagacncgtacgatacctccanctgtcacgatcncagcactaagacgacatgtctgcgagcgtcgggcntctcgcgcaagacgtcacatacatgtagatgtgacaacagccgcgagagagctccgcggccgtacaacgtagtcgtccgtggcacgtatcgcaccagagatgtcacgaggtacagcacagcgtaacggcgagtagcagcgggtagcgaacgatacngcg

SEQ ID NO: 9096 - DNA, 864 bp, Homo sapiens
  misc_feature (1)...(864): n = A,T,C or G
taaatttaagggngnggtggnnnnnggnnccctattttcttctaactggtcttaacagcctctactgaatgtatccgtgctggccactatgcagcaagcatcataattagacnggctggctaaacctatcctnagaagccaaacttccactgattgaaaagctgaaacacaaccccaagatgcagacactgccctaattgcttcctgagattcccatattaataaagaaaaaaattatctcccattttttcctactataataatgggtgagtcttaatttaaagggtacaantgtaaaaaaaatcctttaaaaatctttattatctaaacaatctaaaaaatgatgtttatttccataatttaatactcccacttaaatcccaattaaacaaaaatttaccatttccttttataaaaaatctctactaaataatccactacaacataaaacatactaaaaattatataaatttaaacatacattaacattcgtctctctctttgccaaaagaaatacaatcttccacctgttataaatgatcttcttgctttataccattatcaaaagcttgcatcacatcatcaataactaatatatatattacactcatatctaatatatattaatacatataataatgacatataattaattacaaaactatttctaataaatacatataaataatatacaaatgaatacaattaaaccaatattaacacactaacatataataataactaattattctttatctctaaatacgtacaaaacaatataaaatataatgtccagcactacaaaatttaacaactatttaataattttacatatcatcataataatttattatataattttta

SEQ ID NO: 9097 - DNA, 939 bp, Homo sapiens
  misc_feature (1)...(939): n = A,T,C or G
atattatatcagttgagtgtcgttgatttaaatgtggggttatgtgattattttgtgagagtttggtatctgacaatctatagtagttgttctaatgtcttatgatagtattaatgttgcgggtgtggtgtgaatattgttgttggtagtataatgatatctgtactgtgagcggactatatgatctgcgtgctgggatggtatgatgtctgtgtatactgagtatagtgtggatgttgtgtggctatggtaagtcggnacgatctatgtgatagtagtggtggttgggacggaggttgatagtgtgatgtgtgtgnttattagcgcgagcgcggtatctagagtggagtgcatgtactgatgcatgatcatcgggctgtgtgtgtgagtgtgtgagggtgggtgtgtggacgtggagtggatgtgggtaaggtgctgatgtggtgagtgttgtgggtcgtgtaagtgggtatgtcatggggtgtgggacgcggggatttgtggtgggcgacgcgtgttgcgatgtgaagttgctggaatgcgagtgatagatgggagcgatagagtgtggagagtgtggtgtgggttgcatgggagtcgggaggtgtgtggttgctgtgtgatggataagtgtagtgtgagggagagagggctgagtcgtcgtgcatgtggcttgtctagtgatagatgtgtactttgattgagtaagagagagctaggaggcgggttgtgtgttttgttttgtttggaggggggcgctggttttttgttaccccccctccagagaaagaagagtggtggggaggagtggtgggtgtgtattgaattgggtgggaaaaaagattttttttttggtggtggtttgggcagtggtacagtggggtggtctgggagaagtagtgtttttgtgtaaaagaaaaaaattttttttgaaaaccc

SEQ ID NO: 9098 - DNA, 782 bp, Homo sapiens
ccggtcttcactatcctgtctctctaggtactctggttattcgtgactttgttatcgtttggtgcgccttgcttcgctcttttattgtggtcgagtggccgggtgggggtgcttaacggcggggcggggctcttcgttctgtgtggtttgtgctgcgctttgcttggtgggctcagtggggctcgtcctgcggcgcccgtcctctatgggcgtagagtgggtttgggccccctcttctctatgctgctcccggtgtttgtctctcgttgcgtctgctctcgtttcttgtgatggtgtgtggcgcgggtgacggagaggtggttggtagtagtcgctgttgtgttgtggggcggcggtctgtgtccgccgtggggggtatgtcgttggagtaggttgcgggtggggtcccttgtcttgctcctggtgtggctgcgcgccccactgtgcctaggttgcggtgtggtgcttgtgcttttggatcgccggccttgtggggtttgtgtgatccgcttgcttgccctaccccggtggctgcgtccgaggttgctcgcccggtgtttctgcggcctccgtgcttggtctctggctgcgctggtggggccgcggtgtcgcgtgggcagtggggcgggcttgctttgtcggggtttaacaggaagtgttttgtttccctctttttctttttttgtgctgtctcgggtttggcctgttgttttgccctttgtgtggggctcgtccgggcgcgattatcattaaagtagagaatgaattatgaaggaaattac

SEQ ID NO: 9099 - DNA, 1732 bp, Homo sapiens
  misc_feature (1)...(1732): n = A,T,C or G
cagccgtgtggaagtggtgctagtcggactctaggnctatcgattgacactaattaggtgttatgatgtgcgagtgtacgaggcgctgtacgcggagctatgtggtctgaacggtatatgagcacactcgattannatcacaggagcgtctctgtaggagagaatatatgatgtattgaggtgttggngcctatgtcgagcgctgtattcgcgtggcacaattttccttcgtgacacgcggactagtgctnnanacgtactcatagtgtgtntcagttcgaagctgtgtctagactgcgtngttcgtgattattangatataacgtcaggtgaacttcgagatagaggcatggagtgttggtggagcgtatgtgagcagcgcggcggatatgngtgattacgcacagtagtggagaacacacangnntacacgcgatcttatagcttgtngagtgtgttngactgctgagcggcgtcgacgtaagattctggatgactgtaggcgatcgggttggtcgtgacaacttcggnatgctgtagatctaaatacntgcgagaaatcgtaaagaatggtgagctcgatatcagtaggatganggacgctcgagacatgcgtgacgttgngcacctcgtctgtcgtngtgatgactataatanaatgtcactgtgactgttatgngtanctctcgatcctactgttgcatnggnnnntgcatcgtagtcgctatacnacgccgtcgtngtngntactctcactttngngatatcgantngtnnnngnnntntncgtgtgtcgtgtgtatagatgtctgtctgattgtcgtggngnggcgtgngnttgtngnacgtgatgtaacgctanngaaggngatgacatacagcgtcgngncgcctagtntcgcgcntgtcgctatgcgtacagctgcactatatggtgaccgtgtagctatcgctgtatgtntgttgactgnttgnngttangngtgtcgtgcatcttattntgactntctgntgcatgctcgncgtgnnngcgaccgatcgctgctctcactcttctggnccaccgattatatntatnnnnnccgttatcaccatcccactccactcgtctcactctcctcatntctgcatcatcttnatactctactacgtcgntntccccntgacgctncaccatntcnngnnnactnnggacgtctgantcgnancagactactgcntatcntttgttncannnanntccctactatctgtctttcngatcgtangatcgannnggccaagagatagacaccaatatgacacanacagcaacaatcgcagagcatatatacctgacatataacaattntatcntacacatnnnancacctctncacacctnnnnnccatcctcactnntcntnncnctctctcncactctcttcnnnnctcttatccatactacctnnnnnnancactctcttttctccatctnctnnnncnnnnnnccctctntnnnnnnctcctaatcatactacctcntnannnnnncnctccatacatcttnnnnnntnncccccttcncncctnnnnnnncctnnnnnnnnnnnnnannncnnnnnnccnnnnnnncatnnncncttnnnnnccctctcnnnnnnnnnnnncnncctnnnnccctctnnnnnncacacactccnnnnnnnnnnnnnnnnnnnnnnnccnccccnnccccnnnnnnnnnnaaaac

SEQ ID NO: 9100 - DNA, 918 bp, Homo sapiens
  misc_feature (1)...(918): n = A,T,C or G
ctgggcccgatgacccctggtgttacttcaacagcaggcgactcatacagccggggtgcactttgttcttctatangggcgggggggggggtgagatataacagcttcttccctgacccaagattatgaggggatgtctcctggggtctcttctaaaaattttacatttaggtgcataatccattttgggctaattcttttaaatagggcaaagtatggatggaggttctttttttgggggggggggggcaaatacatattttattttttccaacaaccattgggtggaagaggactgtgggctggcgctaagtaccctttgcgttgggggggcaagatattttcacaccttggccacgttgcactggtgtgattgggctctttggggaagatgctcctgtgtgcggtgatgtgtgttggggggggggggggtggagggttgttttaagaaaggagggggaggggatttgagctgtcttttgggagtgaaagagggggggggggatgtggagaggttgggggggtcgcatgtaaagtggagggtgggggggggggacttgagttaagggtgttcggacgggggaggtgtgggagagggttaggccgtggaaagagggggtggcgtgagggaggcagatgggacattatggaatgatgcggaggttgtgaccggaggagaacggggaaagtgggttcgtaggaggaggaatgtgagtggcggggatatggggcagcgagggttggcgagtgtgcggtgagggcgaggtatgtagacgtggagttgggatttggtgtagggtgcgaaggagtagtcgggtgttgtgatgggcgtggggcgaagcgttgggaggtagattgtggtgagtggcgcgaggagcgtggtgtgtgcggagctgcgtgtctgggagacggcgggtg

SEQ ID NO: 9101 - DNA, 1481 bp, Homo sapiens
  misc_feature (1)...(1481): n = A,T,C or G
cttctgcagcgtcttttcgtcttgtgtgtatattnngngcgtgtttgtacgatctgctggagattcagttgcgtctctgccgttcggcggcgtgttcgtcagtgtgcttatctcttgcgtgcgccgcgtgtcaggagtggcggctccggaggcgaactctgcgccgcatagcgcgtgtaggaggcctgtgggggtagtgtatattggcgctgtacgatttgctanactgntngtggactgcttgtgtgatgngagtgagtgcggggaggtactgggtatgcttcgtctgatgagtgctattgaataggtgatggcggtgtttgcgatagcgatattgctgattggcgtgttgtgtgtgtaacttgtgcatcgcgttctgtgacgcttcgatggatcgacctcgccgcgtgcggtgngtggtgagtcgcgtcagatagaggtgagcggtggccgataagccaaggctgcgccgagtgggantgantggcgngtggtagatgggcgtagcgctctgtctaggtggtgcgactcagctcacgtaggatgtatgaatgtggtccgggttgagcgcgattagtgagtatccgtgacgtggcgnggcggccggacggtcgtgtgatgatgtcgngngcggtcggcgatgcgcgtgtcgcttgcgcggaggagacgtgttgtccttcgctattgctgatcgtgttcggcntntgcgcatgtgatgtcgtgatgtccgtcttgtgagcttgttctggctgcatgnngctncctctcgatgtctgatagtctttgagtgatcggttggcgagagcgggtgatgatgtgngngacgtggagngagagtgtggatgctgctgtgatcgtgagagatgtagtgtngctgtgcgcgtgtgggaccgtcgccatacaatggtgttggtgcggcttgtatccgatatatgagtcgtaggaggtctatgttggtcagtgcgcgttcgtagtgagttctgtgtctgtgcttggtgcgtaggtcgtctgtccgctccgatgcgggtgcangaggtgtgttctnatctcatctctgatctgngcgcctgaccgattacttagttnaagnttctactgcaatgatcacataggcaaagtatgacacattatagtanctgagtgcggacagagcgtgtcatctgtgcggcatctcgagnanaatatgtnacgctatatgcatgtgcatanaancgctatananacagcgatacacagagtatgagacatatatagcgagatagagatacagacgcagacggatagacgtaagatacatgnagataggnggacagtgtgtcctctcctgctgtggtgncncaaacnacgncggngtggtgtcacgncttgtctcgtctcgctgcacttgaacgctgcagttcttcgtctactctctctcgtgtgttatatgtcgttgtcacatantntctgtacaataatatcatatatatgtatctattgct

SEQ ID NO: 9102 - DNA, 862 bp, Homo sapiens
  misc_feature (1)...(862): n = A,T,C or G
catggctggagtgaagtggtgcaatcgtggctcactgcagcctcaacctcccagactcaagtgatcctcccacctctgcctctcaagtagctgggactgcaggcatgcacaaccatacctggcttttttgtatttttgttagagataggattttgccatgttgtttaggctggtctccaactcttgggcccaagcaatccacctgcctcccaaagtgctgggattagaggtgtgagtcaccccgcctggcttaaaattatgtttacttcactttctaacttagcaaaagctgactggtatatttttaaaacataaaatattcctacaagacttcaattatatacttttgagaaagggaatttttgtgtattttcatgcttaaatgttgactgtgaacttcataaagtcattcattctttaaaaatacatcctaaaatgttaggactggttaaaagaaagttgtttgagaatgagccacctgngatattatgatgagaatgaatgggacaaccaaatgtgtggaggaagctcaaccgtgagaagagaactcacactaccttgtaccttctcctttcaaatttctctcaaaggacaaatgaagtgaataaagatggacaaatgtcatctaagatcacatactttaggttatgttctgaagaaatagtaaaaagcaggaggcaccttctcccaaactggataacacttttccaaactatgactcantctgagaagggctcctatgaagatactcagtttgtgtcgagtcgtatgtctgaaagatcccatgcaagcgaaagaagaggtgactgctgaataccattgactgggaaatgtggaaagtttaataagtgttattactana

SEQ ID NO: 9103 - DNA, 1678 bp, Homo sapiens
  misc_feature (1)...(1678): n = A,T,C or G
ctactacctttatatcatcagntacatagatcttcatttgtgtgacatgcaggcgcagctatgttttttgcgtagagactcgccgcgtcactctatatctgtgtatagancatcgcgctacataatcagagcgtngctaccttagtgcgcatcngtgttctctatacanagcgtctnctnatagtgctgtcacagcgtgcggtcacatcaccagctctcacgcacttcgcgtacgccggctctcnttctacagcaganataaggctatatagcttgctgattacatcgacgacgtactcgctacctcatagtgngaagctcancgagcgcagcgacgtgtgcgcacgagccagataagatacgacgtacgtactagctcgnatcatatatatatatatggtcatcatancgctgctgactattaggcgtctgaaatcttaaagacgttggcgctacggtctngggtaagcgacgtgtatgtcgcgtggacgtgtncacatacacgtagtatcgactnanganatgtactgctgacgtctcagacgtcagcgagctactcctatgtcgcgagtatacaggtcgcactgcgtccgactcgtatanatgctgttcacgtanccatagatcgctgagtcgnatatcatacctntcacgttgacgctatgacttcatctgtactgtntcgtcgngacacgcgacactagtncgctgnccactctcttcgagtgatgtatgcgtgacngatgctagagttcggactgcgctacatntcactgagaggcgacagctcagtntactgcatatcgtgntagctctgttcatgcacggtatcagtagcgactcgctgatgtcgtcgtgtaggtgggtgtgtanggactctcggngtgatntactgcgcatncgcaccgtgctacntnaatctggactatgacgcattcatgtagcgcgncgatacgagtgatatgccntgcgctgcgatatatctgtcgtacactgtatactcgcgtagatangtgcnggatcgncgcaggcatgcgnanctcgcgcaaccactcggtgcgtactcgatgntcgagtgactgcgatgcgctctagacttcgtttgggcatgagtcacatncgctcagtaatataangtacncagncacgcgcacgagcancatcnactgctagacgcaccangcaccactagtcatgnctcagcntctacatagcgcagctgccgaatcgattagcncgttacactcgcagcgtctctcgtcgcactngcagncncgtggcantncgctcgctgtcacgcgccgannanacgatctgatctcgtctgctcagcnntcgatccgaanctagtcgtctnatctnctntctcttgtgtactcgtcctgtcacgcgctnatgnctagcgcacacatctgcgtcggtacagatgctagtnntctgtatagnatcgctagactgtatctagcgancacgattatcaaactagtgatagtgattaatagcgtgnatgcgagtacgttanctggtgtagacgaagtatagnagcatcgtcgtacaggatangtatctactcactctgtncaacaaggtccgtatnacatgacgcatacagcncgtgctcgtcacagcgcatagtacaaattcatctatcataactacacaacagtctcgacctgcg

SEQ ID NO: 9104 - DNA, 1463 bp, Homo sapiens
  misc_feature (1)...(1463): n = A,T,C or G
atgcgacgacatcggcgactgcagtccctgtggaggtggcgtgtttcctctcctacatggagagcgacgctgacgcttgtgccatgtcacttccccaccggttagagatgccggctcgtgtcgtacttcagggccgccacactataggtctgcatcggcggtttgttgtgcgtggttagtgccgtctcttgcgcatggcgtgtaaggaggtggttcagcgcgtgcggtgtgcatgcgggacgttgccgctccccgcggagggcggcgagcgtatgactcaatccagacggacggctntctgctccctctcacgctggcgattgagtattcttctctctggcgaggactctggcgctcggcgtcgcggcgcgttgtgcagtagggccctaccacgtcctcgcggcacctcggtgaggcgacggcgcggggggcgtggcgtgcgatcacgtctatacgctccacctgcggggggtgcacatatctctcttctcgtatggacagcgtgtcttcgatgcacccactgcggtcatgtctgtgacgcttgacctgcgcngcctgcgggcggcgcattcgtgacgaganagcgttggctgttgctccgtctccttcgtgatgacacgtgcggttgcggtcgtgccgctatccgtgctcgcgctgtcangactgatgtaggcgtgcgtgatgtgctagagcgtgtcttgattgtgtccaccgnagcgacaactctgtgcgggtgttntcgtgtcacctctgtgtgtgtactgaacaagattggagtgatantacgtgtggnctcacgggtgtcgcgttgtgtggtgcgcgcacgcgcgtgtgagcgcgtctagagagatatntattctcnttctggtcgtgacagtgctgcgacgagagagtctntcatgtgttgtctctagatatctctttgctgcgacgtagactgagcggtagcttgtcggcacgcagcgcgtgagaggagtggcgcgcgggccggcggaattgttacgacgtcgcgggtcgttgcgtatcttctgtcttgctagacatgcncgccgtgacgagggagaggagagagganaaattgctgtgcgtcttgtctctcgtcttctgagtggagtcacataagagagtnaactganaagagagaagcgtattgacagatgaganaacataagacacaatgtagataagagacagaacatagaganaatatagagcaacagaganataatacactacatacacaagagacaggacagagagacaatatacatagataaacataganagacanatgggtgtctctcncggtntggngnccctnaccangtcggcgtggcgtanggnctagnctngcntngtcgctcgggaagcgagtcttctgcttcgtctctctctngcttgtcccgcggcacgcgtgtgcgtntgcctnncacactttactcatttcatttatactcctcgtc

SEQ ID NO: 9105 - DNA, 299 bp, Homo sapiens
atattctaaagacaattacagaagttatttcctgatgtgacttatggctctgctattcagagtgtgacacgaggaccagaactagcatcgcctgggagagtgttggaactactgaagctcacatcccaccccagacctactgaatcttaatctgcatttttaaaagattcaatgttaaagtttgggaactgctttatagcccttacatcagacatttaaatttgtaacagtttattaacaacaactgcacattaggaatcaataaagagaaatacctcatttgattaaaaaaaaaaaaa

SEQ ID NO: 9106 - DNA, 165 bp, Homo sapiens
atggtataagaagcttacagcattctgtggtatactgctgaagagtggtggtggttggaggaagcagatggcatgaaccctgccttcctctaagagggtgtgaaatgtgatgattcaggcttttaaattaaatgcataaagattcaaaccccaaaaaaaaaaaaa

SEQ ID NO: 9107 - DNA, 839 bp, Homo sapiens
  misc_feature (1)...(839): n = A,T,C or G
caggacattactttgcattattcataaaagtcaactcaaaatgaatgaaagacttaaattggagatctggaactacaaaacttctagaggaaaacacagaggaaatcttcttgacttgttcttcacagtaataattgcgtatgacaccaaaagcacaggcaactaaaaataaataaataaacaaggagaagtacatcaaactaaacagcttttatatagtgaaggtgatttggtttggctatgtgcccaccaaaatctcttcttgaattatagttcccataatccccacgtgtcatgggagggacccaatgggaagtaaattaatcatgggggctgttaccctcgtgctggtcttgtaatagtgagttctctggagatttgatggttttataaggggctttcccccttttgctttgcacttctccttgatgccaccacgtgaagaaagatatgcttgttcccccttctgccataattgtaagtttcctgaggccccaccagccaggtggaactgtgagtctattaaacctctttcctttataaattacccagtctcatgcatgtctttattagcagcatgagaatgaactaatacagtaaattggtactgcaaagagtggggtgctgctataaaaatacccaaaagtgtggaagcaactttggaactgggtaacaggcggaggctggaacagtttggagggctcagaagaagatagggaaatgtgcaaaagtttggaatttnctaaacagttagagggctcagaagacaggaagatggagaaagactggaacttcctagagattttgtgagtggctttgaccaaaatgctgatagtgat

SEQ ID NO: 9108 - DNA, 766 bp, Homo sapiens
  misc_feature (1)...(766): n = A,T,C or G
acggttgcccgtgactcctctcagaaagggttcatttgtgggccgttgcggtaatgtgggtggtgagaaaaggcgctccatcttttcgagatgccccagagagggggagtttctttgtggggcggtcgccctgggttctcgaagacttcaataacgctcgggggcagcgctttgttctccattgggggtgggagggcgttgggccaagttggggccccccggttgggttttaagggaagaactagtgtggttttggttcgaagggtttataggcagaaggggggttgaatggtttgagaggaaaactgtgcctggggcttttggggtaagtcgtggaataagttgagatttggggccactttgggaaagggaagattttttttgcacgatagggcctagggtttgccaggggtaaggggggaaaatatgttggggtgggtcccctccgaaatttatttttgaaatgtaggtgccataatccccacaagtcatggtagagactgggtgggaggtaaggtaatcaggggagtgtttttcttnnagggtgntntnatgatagccccccccttttcaggggatttaattgttttataaggggtttttaccccttttagttggcagttctccttgttgtgcccatgtaaagaaggatgtggttgcttccccttcctcccaggattgtaagttttntgagggttttntagtttatggagacccccgagctaattaaannttttttctttgtaaatcaaaaaaaaaaaaaaaa

SEQ ID NO: 9109 - DNA, 1093 bp, Homo sapiens
  misc_feature (1)...(1093): n = A,T,C or G
ctatcttctccccctcattcacactactcaaacaaagagaacctacggaataacatngaaggagtactttaggccatgaagtccactgcctgaagcaaagtactgccagccaaggatcatgctgtttggactatcagacaggaattgaggacagaactacaatcattcgtggaaaatattcccgatagtcgcttacactgatacatcgaccaaataataaattaacgctaaattctcatacacaaaaaacgatgtcccttcgttcggctctcatgcggctggagtctccatgcggcccgtatttctattttagtgcgagggtacaatctcactgaccccttcgctccacttgacatctcttcgccgctctggccacgtcctcgcctgcccgtttagtcagttttcacttatgccctcctctgtgccgggttattatccgttttatctaacagaaatacagtggggattactctctcatccaaaccaaccattcgttaactctacaaggcgccatttcaccactgctcttcgaaactcgactacatcaggctcgaccgtagattgctctaatttattccataatgtcttccgatctccctctttgtcgacgtcatcacccagaaactcatctcccctagcccgatccaatgccgcgccatactcttcttcctgaccttttatagacacctctcttttttcccactccgcacgcttctcatgtttcgctcttgtttctttcccaaccccgttctctccactactagatcccttctctctctctcccacccataagcaacgccccatgtccctctctccccaccctcttcttgatctacntctcttctttctatctgacgcttccctcaccctcctgatatatatctgattttgactcccactcatcctattaagtcatcactcctctcacctcctcacttctctactcacccatttgacctctatcacatctcttcatcacatcatccttcataccctactcactcctctcaacaccacactccgactatgccctcgcaccactacttcttcctccctacaacttccttctccatttaaacatattctataatcg

SEQ ID NO: 9110 - DNA, 815 bp, Homo sapiens
cccgcctctatcctatctccatagtcgatttgtctatctcacatcgtcttttccaataactatccttatctctattctaaaaaaaccccgtccgtttttctctccttcaatcgatctcatcctagcccgtcttcctacgagtaaaaatatcactcccctactttgtttaattctgttcctgtccgtatacatatatcgctggttgtccaaccctcagtttagtttacatgagtgctcagaatttaaacacaccaagtatagatggcgccagttgcttataataatcttaaatatttgcccaatttagcgaggttataacacttctgtcacagctttctcacaggtatgcaagtcagaagttttctgacagtcattttttataatatagtttctctacataaatgctttgtaataacctacactttatttatatcaataaagctcctaacttttattttcaagtattttcaagattacaagattcgttatcgattgttttacttataacaatattcctagggtgtctacatttaataattctaagtttttaaagcaattttgaactatttcatttaacagacaatacaagctaactaagataaatttagaaatataaatatccctcacctgtgtttttaaaattagagacaacttttgtatcattccgagatataatttatacctatataaatgtgtttattttaaatgtgccatttaaaagaactggtttatgctttgaaatggctgcataatattctactctacctagataccattaaatattgaatcagctctctaaaaaaaaaaaaaaaaaa

SEQ ID NO: 9111 - DNA, 215 bp, Homo sapiens
catggtatacttataaaagcatataatagttccaggaagcaacactccaaacagctaacagtggatgtactgggaggtggctgaatgaaataatcactttctactctgtatgtctgaattttttcttttttacaatgtgcccttattggctttgtaattagtgtaatctttaaataaataaaatcacatgtgtgtagcactgaaaaaaaaaaaaa

SEQ ID NO: 9112 - DNA, 1232 bp, Homo sapiens
  misc_feature (1)...(1232): n = A,T,C or G
agaagcaataatgcgacataagaacaaaaaacaagtacccaggatatgagaacaganagcggcatttgtgaaagatacacccaccgccccgccatgttttctaggtcgcnccatccccctccgctcatctcccagaatacgagactcgtctttaatcgagccagagggatcgacagacgtgatgggggtgagtagttatcataatacactagcctccgcagtcaataacagggtaaggaacgaacacggagagtatcgtaactcgatcgtagattacatacaacgcacgccgccaggcgagcaaccgagcgataggctgcgtccactgcgtctcccttgtacgcctctacggcccgtccccgtgtctctcgaggtacgngattcgtattatgatgacgtctctatgctcactcacactggagaccacacgcgcacgtgtccctactctcgccaagtatgaggcgcgtncagattttcatcacctcctctagtggctggtgccatcgcctatgcgtcgccatatactgaggtatccgtaccgccatagatacaataacccatattatacccttcacgtcacaccgctgccgagcccatcgagatttgaccactccgtccgcaaccatcgttccttcctctttcatctaagatttcncgctctgtaagctgntggagtgtcgtgatgacaaactccggagattcctccatgatggcagactcttatatttaatcgcacgtctgcagtcacctccatgcgacgcttttgtctgtctcacgctcacataagtccgcaacattgctatagaccnttacttcttctcgactccgatagcatatatcttatcacatattatcttttactccgcgaaatagattgtatattaacatgtatggccacatagtgctagctgcgcatccnttatangtagtggaagattggaagatagattgtctaacaccagctccgacgccggcgcttatactgtgtcgttattcgcagtggctcgcgtcgtcntctctctctctcncgtccactttctccctccattgtcgaccgccacctccttgcaggaatgatataccgagctaataatatatatatatggccgacggcatgatncaaccgcgcatatatcagtctatagtatcccgtcgtatatatactgcacaaggcgacagcctcgcccgctcatcnttgactcatacctctccataacagatatatgagtaat

SEQ ID NO: 9113 - DNA, 182 bp, Homo sapiens
atcagtcattcctttgactctggagccgatgttgcatactgtctgcccgcgaacctttacattcttacagcggatcactcgtacataaagacagactgtagtgattctaatgcttctgtaaaatatctacttattggcactgtcatcagaataaatctaactttattttaaaaaaaaaaaaa

SEQ ID NO: 9114 - DNA, 339 bp, Homo sapiens
ctttgatgaacaaaggacacactgtttaaaataaacatagagtaaattgcatggatgtgatcaaaatgaagaccggctgccatcaccatagatctatgtcctcactcataactattagggaagaggatcttctaactgccactgagggctgctgcaagagaaagcatgactaagatggtctactgttcacaaaccataaaaaaccttaatatattacattacctatattcatacgcaaaaagaaacaggtacatcgtttgctacttgttgaagttaggataattgcatgggtaaggaatgatagacaaataaacattgtacatatgtatggtgaaaaaa

SEQ ID NO: 9115 - DNA, 1193 bp, Homo sapiens
  misc_feature (1)...(1193): n = A,T,C or G
atgctccggggcttggaaggagagcgcaggaagcgacgcgcgcgcgcgtgggncgggtcaataggtcgagtcagcacgagctcgacgcaaccgtgtgtttcaacattactctgactcagggaactgtgcatctactctcggccactcgaggtgcgctctgccaagagggaccgtgcagagccgccatggagggactatatacaatatgacacgccacgggggctcgtcgcatacacgcagaatctagtcctagtgatctggacgagtcgaagggggtagagatcgagagtctgggccggacctgcacacgacgtcgnacgcatctgcagcatgtcaacattacttattacacaggggtgtgctagggggcttcagcgacacctactgaggcatatgtgactacattcgcggaattacgcttgggtccaccgccaagtcgctggacaatggangtcgcagtgtaacatcagggnaccatcaagatgtggtcaagagaatgggtcggcagacaacgtacgactggtcgctgaagaagaaaggaacggcaacccgacaaccgagaatcaaacacgaggnnacacatttggacgatacaggatgaagctcggtactcacggatacactccattattatctgataagganaaatctaccatcatccgtgnatcatactccataatcctaaatctctgnccctcttgatgtcaccgtctcactagntgtgtccgtgcactaccttgctttgntactaaccanntcactcctctatctttnncgttttcatgnntttcttttctnatttacattttnattgaccattttttgttttctcnttatctatttgcatagagattcctcactacctnttacattcctcctctcactattcctttctttcaaacctatccacatccagttatcacacgacaatnaaagaatacactcctatacacactacaataacgtttatatcaccttaactatannnactatattctctnncccattattactatctccgcgttcatttcaattnctatcatcttactattcntnatntcnaacattactnntccaatagtactaaaaatnnctcacaaacaaaattgtctcacctcccttatatttntttncccaaaaaactcntntcttccactntattcttnnnnnnnnntnnncctcanccccccccc

SEQ ID NO: 9116 - DNA, 1048 bp, Homo sapiens
  misc_feature (1)...(1048): n = A,T,C or G
aagggggagngggggaggnaggaggnaggaggaagaggaggaggnnaggaagagggntgataagnnaaggnngtaagagatttagctgtaaggtnagtatgttacctggtttttgagnaatggcaaaagtacctgttaacctttaggtctaggtagactggctagcttgtatattctattcacctccgtgctctgttttttttggtaggagtgagcggcgagtcacctctcccacgtgtgagaaagtnngtgtcgcgtgagttatgatccgttctaactagtaaccacccgaggaacgttggggtcagtttatatcgacaaacgcgacacactccggccgtcttagtcgacgcgaatcccgtgaaccggccgtccgcgccgacgcatagcccatagatnncacgattactcgctatcatcactcacttcatgtgnacctcacttgcgacgaggnccctacacgcccgccgggcccccacccgccactgcaagtgtccgtaccccccgcgcggggaccncagcggagncatgttggacactatgtccaggtataggctatctggggcacccgtgttcattagagnatagcgtgancgacgtgagttagtgtgtggatgtcagcttcatagggnaccaccgcggcacggggtactgatgatcgaacaatcaacggtnccatttcggcgttatggtcccaccgggcttccagcgtcatgcagcgcgaataaccgcgttgtgtncagtggcttttttcagttgccaaagtctacggtccctgganatccaggttggcccgatgctgtgttttctcttcccantctgtccctcccagtcaacgtctccctgagaggctcaagctcggtcncctggacgacgccacgtcggtctctactcatttctatcacccataccagctgtgtgatggtntcctcggacagtaaacggtcaccataacggctattcctaacgaacgttcaaccacccccggccgctcgagtctgagttccagtgttgctaccaggtgatattctatgtcatccctcgagtg

SEQ ID NO: 9117 - DNA, 811 bp, Homo sapiens
cctccccctcctcaatctctctcgctatcggatcaccgtccagcatccccactctgctattcactgccgcgataatgttctcctccgaacctatccgacgcctaagatctcgtctggggagctccagacacgcgacagtagatgaggcccaacctactccaactctccacgcaccctacaggcccctttcgtctacgccgttcaatcgttactaatgctcatgcccaattatctgtctcaatgatcaatatactctccgttataagtataccccctactcagctttcccccccacgtgctctgaggaggagggattatcttctcagtggaaaaaggtctttagctagctgtcctcctcgccaaccaaacctcccacattccaactcttggtcgtagtgatactaattgccatccataatgagcttattattgtacgacgttttgtaatcattcgatctcggcccgacttacgtacccgaagtgctcacacccaactacgtaccactccttagtctgaactttttccctctcatcacccctgaaaagtaggcggcatgctcccagtacacagatgaggcacgtgaagctcacataagtgtatccccccccctggatgtgacacccaattctgtttgaattctaagccaaagttccttcaacttttctgttcctactctttgcattttatttatcaatgtgttaaaattttagccaaaatggagaatccgctgtttaaaaatgtgtttgcttaatacacggccccgccacgtcaattgtaaatatttatataacctaaaaaaaaaaaaaaaaa

SEQ ID NO: 9118 - DNA, 1386 bp, Homo sapiens
  misc_feature (1)...(1386): n = A,T,C or G
ctcttgctgatcgtagcatactcgatagtcacttacctttatcgtgcggcgactccgtctcttcatcgagcacgtactgtggcctatnccgatgaatctgtaatcatcgtcacgcgcatacgtatacactaacaggcttctcctcgtcatgtcacgatatcgcggacgtgtaccgcgagaacagtccgggtccggtcgtccggcaccatacgtactccgtctcctctggtggtagggtcagattgtatgctgcactccctatctatgctagctctatggtgacaccgtgtcgtgtgcgtccattatgggaggcagcgccggctacatncgcngcctagttgtgctgccgcggcgnctcgtggtcgttcacgagtcgngtgtcgcgtctacgacgcgttccgctcactcattatccctctccgtgctcgatcgcgctttcgtgatgctatgtctatgtcagaccgagtcatttatatgtanataacaccgtgcctgccgtcatgtatcacagtctattctattgtgcgtctncactgttcctctggcagcactcctcggccatcactctctcgcctcgcgttgaactcgtcgcgtgctctttgcgacgctcgttatgtcctcgtcttatcgggcagtggtgtacgtcgtgcgttgtattcggtgcgcgcagctggctgcgatgtcgctacaccacgacctactgcggggcgccgagagcgtgtatgatatgttctgattgtcctctctcctcacctcgtctcatcaataccaacgtctcgccctctctccgcaatacctgccttctccggcgctgccaccgtcgtattttaccgattagttcgcgtctagctgtctattctctcgacctatgatggcggtacatacatgaatgtgaggacagctatattcactcctcccgtcgacactgacccgtgctatccatcacactcggccgatacgcgacctgctcgagccggctgtgcgttgtgctctttgatttatatcctcgctctcggccgtttcgaaaaaaacaccttggcccgcatatttagtatgcggtgctcgtgtctactatttatgactcgtgcgcgctcctccgctttatactatactaagcgaagngttggtgagagtcgcacttcattagcaagtgcgttgcgagagctcgtttatatgatagcgattcttccacccctgttgcctatcgcctaatcttcggacgacctttcccgcacttacccacagcccgcgtttatatcttcttgggatatctgtcacactactttgaacttgncatggggtttcttcccccttccaggcgtgcgggaggttnggtctgcccagacaatcttttttttgcttttctcccccttccgtaatcccgct

SEQ ID NO: 9119 - DNA, 895 bp, Homo sapiens
cttttttttttgttgttccttcgtgtggggtggtcgctcgcgttcgcgacgtgtgggcgcgcctcttgctgtgctggtcttttgctgccgttgctgtaggcgccggtctcgtgggtggccggccgcgggcgcggtgcgggtggttgttttgttgtgttctccgcctcccctccctcgcggtcgtggtggttgtgttctttcctgcctcgtggctccggtcggtcggttgtgtcgtttgttcgctctctgtgtctccctcttctcctcccgcggcgtgtgttttctttttggggttggtggtgctgtcccctctctggctccctggtcggggcgcggcttctgcggttcggggtgggcggtgtctcttttcacccggcccgctcgtttgcctcccttcctttctcctcgggctttcttctttctttttcctcttcgcccgcttcttgctcgccgctcggtttcgtcggtgtttctcgtctggcgggtggtgttttcgcggcggtgtgttttcctcttttttcgttttggtggggcgaggtccgccgcggcgcttttgttccggcctttcctttttttcgtgttcccgcgtggggtttttttctcttcttttctcgggggttcggtcctttgttttttttttggtcgggggctggagtctttcttcgtgccctcgtcgtccttttttttttttggggggttctgtcaccccggccggtgggtgggcgctcctccttgggggttttttctcctccctttcccttgggggggtgggcctcgcttttttctgtggggaaaggtgttctgttaggagcttcttctgtgcaatcaggccttgctgattttaagataaggaccaacggtaatttacttggaatctctaaaaaaaaaaaaaaaa

SEQ ID NO: 9120 - DNA, 1531 bp, Homo sapiens
  misc_feature (1)...(1531): n = A,T,C or G
tctcgactcacactcnccgccgtcatgcgccacttgtagtattcgtcgaggtagatctactgtacgtgacgctctgtgtctcgttgcatctcgagtgtcatctattgcatcatctgtgttcgatgtctaagcgtgtgtgcgtgtcgctacgactatatgtgtcgtgccgcgtcgctgcacgctcncctccatcttcgtcgggctcgtctctnttctctagacactctaatcagcagatgcgtgagatgttatacactagctatgcactcgattancgagctncttatatgtcacataagcnagatgcctattctatcggagtgacacatctggccgtggtctacctggtacgacaataactctcccgtctctcttgtcttganacggcaacgtgccatcaattagatcgctgcggagagtcatcgtctcaagttgtgtcgaatatgccgctgacgggtcgttgtagttagacagatgctatgtcggcctgcggctctgtgattgtcttcgtcgtcatgcggcttgatcancaccgcttcgcgtgtctctacctatgtgtactacgtctggatacagcttcgagtgtatgtcgccagcgagcgtttcgagtgnacaacgcgtgtgtggtgtcagaatcgtcgtcaagagatgtatagtgttgagtgcgctangcgtcgactgtctacgacgagcgatagactcgcgcgtcgtatgtctacgtgctgtagactgttcctnatggttattgcgagcgcgcgacttcgatagcaacaggacagtcatctgtttcctacagcgcaatcgggacgactatattgtgcgaggcgtcgacagaagcctcgtacggcgtgacagtgtagccagttaatggtatctctgngtcgcgtgcgcgngctatacagagtgccgacatcacttaggtaccgctatcagcacaccgtcatccgctttaatcgtgtgagcgctttctcgcttgtgacggttagctcagttacgtctcttccgctcatgactaccgcttcggaggttacgtcgcatgagagaaagttcgccgctatccgataacgangactacatactaccctggtatcctacagttatatctaccaggcggccgggcaatcacatttcattcatactctttctgttctctcccaagtggtactcagttatcacgtacgtttgttcggatgtgttcgttactatgctgggcggccgcgctcgttagcgaccacttgctgctacaccacgacgatctcacatcgccgcgtgcgatactcgcgtttagtactttgcgtggtatgtgtacgctctaaataacgctcgtgcgnaggctcgcgacatctcatctctcgtctcacttgctgaccagactatcgntgctatggtagcgtgatgtgatggctttatagattctnttcgtcacaacgtgtcgctacgatctntgtaatgttttgctcatatagtacgccagtcagcgtctctagtaattgcggctgtagtcttctcacagtgacttgtaatagtctga

SEQ ID NO: 9121 - DNA, 1338 bp, Homo sapiens
  misc_feature (1)...(1338): n = A,T,C or G
cgtgnggctgtgtgttgtcttcgttcctctcctgcgggncgtntcntctgtgcgcttgtcgcgtctgcgtcgtttgtggtgctgcgcggaggtncgcggtcactcctggtcctcgctcgtgttctcccctctccggtctcgttgtctgtgttgtgtgcctcggcggccgcgcgcttctcgcnttgctggtgcgcgtgcgtctcgtgtgtcgcgtgttcgttcttgctcgttcgtgcgctgtgcgtgggctgccgcggtctccgtgctgcctcttcggtgggtgtgtttgggcgtgggggtcgtcgttgtgctggggcgtgggtggcggggcgagctctggcgcgtcgccggttttgtttgtcgcgggttgtcgtctgtgcgacgctcgtctccgtgtcgctggtggtgcgcgggtgttgtgtggctggcgcgcctgttgctgcgtgtgtgcgtcccagcctttcgccgcttgcctgcctcgctcgtagtctgtcctccgccctctctcgttcttgtccgttgctctgctcgttgctctcgctctctcgtgctctcgtacctcgtgctgtgctctcgtcgctgcgtcgtgcgttccgttctctcccgcacccctcccttcctcgtcgtctgctctcgcttggtgcgtcttctcctgctgctggctccgcgcggcgcgtgctgtgtgtcgtcttccgcgcccgtgcctgggccgcgcgtgccgtcttctgggtgtgcttatctgctgggtcgtcgctcgcgtgcgcggcatcgggggtggtggttccggtctttctcgttcttcgtgcttctgttgctcgctgtgtctgttgtcgtcnttgtgctgtgtgctctgtgcgttctctgccgcgtccgcctcacgctctgcttgtgtcgtgctctggtggtctgtggtctcttggaaaaacgggcgtcgtgctcttctccgtcgcgtggtgtgtgctcgtgggcgcgcttctctcctcgcgctgctntcntcctccttgcggttgttggtgggcgcggtgnctcgtcgcgtgggtgcgcgtggcggtgttgggcgctcttggctggcgccgttgtgtgtctgtggtggtctttgctgtngtntctggcggctgcgggccgctgggcgtgtggcgctctgtccgctgttgggcgcgtnggcgtgttctctcgttgnttgactctcttggtgtggtctctcctctcttccctctgccctgtttttgtggtcttccgccgtgcgcaccgtcgtgtggtngntgttngtcgcctaaggnctttttgctcttttgtgtgtttgcctgtccttgtacttccctttcctgtcttcttgtt

SEQ ID NO: 9122 - DNA, 948 bp, Homo sapiens
  misc_feature (1)...(948): n = A,T,C or G
aagaggggagtggttatagtataggagtagagggggggttggnaaggggaagaggtgagtgcgggtcggagcgtggggggaaaggtggtaggagagggaggaagaaggtggcggaggcgggggggagaggggagatgtgngggggtggggagggatgggagaggtagcggggggggaggagtggggggggggggtgggggagagagatgggggaggggatggatgngggagaggggacgaggtgggttggggtggagcattgaggtgatgtgaaagcggggagaagnaagtaaaggtgagcggtgtggatnnggagggagatgatggggngcggagggaggtagtgagatcgaataagtagtggaacgtggggtcgtgggtagggggggtggggggggaggaggaagaggtgggggagggggggggggggggggggggggggggggagagagggggggtgtgggggagatggggggggggtggtggtggaggcggagggtggangggttgggggagggggggaggcggggggggggaggggggggggtgaggggnaggaggggggggagaggaagcataagagggagggtatgtgggtatggggtgtaggggggggttgagtagtgttttctggttgaggggtgaagcccattgttgctctttctttactattttggttatttttttatttcttttgttgtttgggtaatgattttttatgtcttttnacgatcttttttgtttttatttnaaattanattcaaacaaataaaaaaatattactttactccctttttccttctttttactccttatncttatctttatacttctcctttncttatcattattnctctataannncttttttnnnctnctncaaaccccnacttttcncctcnnnnctctcctttncccttccnnnnnnnncnnccccccccnnccccc

SEQ ID NO: 9123 - DNA, 236 bp, Homo sapiens
gcttttgtggggaacctaatccaatctgtcattatgagaagaggaaatttggacacaaaaagagaaccaggggcgtatgtacacagagaaaagatcacgtgaggacacagagaggtctgcaaaccaagaagagaagcctcagaagaaacaaaaccagccaaccccttgatcttggacttgtagcttccagaattgtgaggaaataaatttctgttttaaagccaaaaaaaaaaaaa

SEQ ID NO: 9124 - DNA, 2082 bp, Homo sapiens
  misc_feature (1)...(2082): n = A,T,C or G
acgacgctagacnganacgacgtgaagcggnagatgatganangtggtntacgntaatagtaacntntgntacanagnatgatngagtantctgntangtagancagtntcgtncgtgactagtcangtnatgacgtcganganagatgacgagtagatnagcnactanatantacagcantntcgcgacactnacgtgctnactgtactnacgatanncatangtantancgntgcgncgtagaatcgatgcatcatagtatctgncgtangancgatcgcagcaagtagcgatcgacagcgacgtcgtcgtctgcancatcngcgcagccgagtcatcatcgtcgcagctgtgacaccttngatcagaatatgcgantactgcgatgcacttctagtcganccgctaccactacgactantantcagcancgtcgcatnctctgctgntaccatcatcgctntactagtcatcgctngacgatanctacgcgtacgtcgtcgantcgacantcgcgcagagncgggncatcacatagcacatcgaatgcncagcgctgcancngtacagccgntcctagctangatcactcagtcagctgacataagctcatgatacatctacnctagcantgcactgtnacgacacgngctgcacacactacngaggtcancntagagctgangngatgtactgagtactcagagancagcngacgtagtctntcactgtgcncatnagatctnatgtacgctgnctatacacgctatcacatactatatctagctcacacagancactcngtantagcnatantagtgctcgtcaccgnttagtgaagagatcatcagtgactaggctgcacgtgcagtctangncgcgctgaccacgcatcagactatagcagagctcacgncgcagtganacatgctcagtcgacgancagtngtgacgcagacgtgcatcngaccaggcgtacntctgcgatacatgcancataactactcactcgtagtantgacgagtgctatgtagangagtcgtcancactcacgatcagcattaccgtgcagctngactancctgtgtatacgccactacntcatacagtcgctcacgnctagatgacntcaanacgacatatnangtntactcatcgatagacgctaacgtgactgcagcatgnccatatctataccgcagatgtcatctctnactatggtgtctacgctagcgatagacacgacactagtacgtacgcagcngacngcngcggagcgccgacagcgcncgtgcggtcatgtcagtaccactcgtacagagtaagactncactacgtcaactgcgacgtatttctctntgcgcgagnagacgctngattgggcgattcgcacactcgcgctctaagtacgcgtctngctaactncgtgcgcgctcctgcgatagntagctagatgcactgacatgtgcctgacgcagancattggctncngcgcatatctctgtgctagacgtgtgccgcgatggatatagtaatncaacactgtggnggcacgcatgcctcgcatgagcgcttantncatcgatgtcgtatgctnactancatacatagattcgtcgcgacgctgctcgagatagatggcgatcactcggactgtcgttatctgtagtacgtgcttctcgtcagatgagtgtagtacgtatgagnggacacattcgtgcggtatngaatgtgtgtatgttgcanatgtgtatatgcactcgtactgcactatctaccataatatctacagctgccgccgttgcgtcgtctcagagagtaccacgcagatctattagtgtactatactgacnaacaacttnctatcgctcttatgtatcnagacgacgagattgatacagtctaggcagacactggcaagtgctgtnacgcgtgtcgcattcggttctgctatgcngtgcgcacaacaccacgcgagccgctgnatctagtgttctgctactgacgtcgacgcgatagtttttgttntctcattgtggtgtatattccagatagtcatcgccgcaagccactgcgcgag

SEQ ID NO: 9125 - DNA, 973 bp, Homo sapiens
agaggatcgctcgtgccgattgatgcatgataccatcatgtcatgtctagctctcctctgtgtcgcgtggagagttaattacaaatatatatggtttagttggccggtctattgttataggtgtaaacagaggagctctacgtttcgatccttcgtatatataaagaggaaagcaatcggacaaatgtactgacgacagaataacataaacgtaaggtagtgagtagtgtgtacataattcaacaatttcaagtattaaatagtgatgagagcaaccaattcctcattgtgcgtagatggttaatatgtacatgcgtattgtgtgtccttaactaaaactgtaaagttgtacgatggaactgcgcataatttaatatagtatgtttgtgtgtatattgaatgtgtggtaatgtatcagtctgtgcgatgctgtcgagagtctatatcttattatttaggatatagaggcggagttggggtactattttgacatcgttcctaggtataaacagggtttatatatgtattaaataagtattttgtttaaaaatagcgctcgagtgcttgtatggatctggtattgtaaaaccaaatataccatatatttctctgtagggacaggttaacaatttattcgcataaggttacatatatagactaaaaggctcaaaattgtcaataaacatttcttcaagccatatgtgtatagtatgtatttagaggaatgtgtaacatgggaatcctatgcaacctgagttgccactaaggccaagataaaaaagcctcaaccaggccccccaggattgaagtttgtaaggagtgggatccttaacaagagtggtggagttttggaaaaatctctgtctaccacaattgaaatggtggttagagacaaacagttcaatctttgggcattcttatataacaaaatgtcagacaataaaatagatgtaagcaaaaaaaaaaaaaaaaa

SEQ ID NO: 9126 - DNA, 1226 bp, Homo sapiens
  misc_feature (1)...(1226): n = A,T,C or G
gggcgtctggagtgcgctattctcgtggtggctcgccctccgccctcgcgggaggcttaattggctttgtccggtctcgcgctctncggtttcggcgcgggccttcgcgtccttgtcctcggggctgtggctgcgtgtgcgctgtcttcgtcgcgaggtgaggtgatgaggggggctctgtgttggcgctgcgccgtggcgcgctctaatctccgtggagggtggcgcgcgggtgcggcgcgtgttgcgggcttcgggtcggccgccgcgtagtcgacgtcgagagtgtgcggcgtgcggcgaggcgtggggcgcccgtgcgcgccggccggcctggtggcggncctcgcgtcgtgcgcacgcggcgtcgcgtgcgtgggcggcggaccccgtccctccgtcctgtgngcgcctcgagtcgcttgccctggcgggcctggcgtgtgngcgctctggcgcgcgcctcgagatcgcacggcccgtcgcgcgcaccgccctggggcgtcggcgcgggncgagcttcgcggtgctggcgtcggcggcgccggggggggtcgggcgcgtggcgaggtgggcgtctcctcgcggcttcgcacctctcgtgtggtgtgcgcgtgggggcgctggcgggggcgggcgtcgttgggtggcgggccggggctgtgctctgcgttccggtggtgnggccgctcgctgcctcctcggggccgcccgctcttggcctcctggctgctgtgcctcctcgcgtcggctgtgcctgtgctggggcgtggcgtggggctgggtgctgcggtgggtgcgcgtctgtggcgctcccgcgtccgttctggcgtgccggatataaaaaatattgtgttctcgcctgtcgtcgttcancacgtccgctttgtctgtctctgttgtgtggcgtngagcggccggngcgcntcggcgcgctggcctctgcgcctgcgctgggntcgccctccctccgcgcctcgcctgcgtccggcnccctgtgttgccttcggtctcgtctcgtcnggtccngnccgnncctccctccttnccttctntctcctctttccttcttccctnaacctnnnntctcttcctcccctcncttccttctnccctcttcggtttctccccctccaaanctctttttttttgtttccctntaaacttctttttttttctttttttnttcttcctccnctccttataantnnntanttttttatttt

SEQ ID NO: 9127 - DNA, 305 bp, Homo sapiens
  misc_feature (1)...(305): n = A,T,C or G
ctgtgagtacagagactacctgaccttgactatgtggacttcagaagttaatctctgctggcatcttttccaaaaaaaaaggggccccgtcggttccaatgtgatatatatttgtataaagaagatagttccaactgcgaggaggaacaccaaaacactgagtatggagaagagtgggagaatcattgtcccctgttcagagcatgaaagactgcccacggtctgacaggagaccgtggtntgcntgaacntaattaaagattctttgaatatgttttctcctgctcaagtgaaaaaaaaaaaaa

SEQ ID NO: 9128 - DNA, 1048 bp, Homo sapiens
  misc_feature (1)...(1048): n = A,T,C or G
acaatataataaataaagtgtatacaaaaaaaaacagggctctcaaattgcacccatgtaatacatttagaagaccccatgccctcccaaaattatgtcctcacttataactatnnancgaacaggagctcgaggcgtgttctataaaactcctccactgaanaccaaaaacaaaatggccttnactttttaaataattggngaacccaaatttattacattagcaaaaccatccacaaataaataatgtcacaatactacaattagagtctttgtccaaacatttcttggagggggggcaaaaataatatttggaaacttcaaataaaaacatagtatataatatccatgattttttcttctcaatttttccaattattcctacttcacccaatttaatatttttttaacacacacttttcttctttatcctttctccacaaaaagtgaaaaaatttttaaatacccaaaaaacttaggaacagtctccaaatctccaaacactaaaaattaaagtcccctaaaacattcccctttttttttttttataccgatatttccaaataatcaaatattcccttcaataaatatctaccctccatcattaaccctaaatttatatccttaaatatcccaacttattattcgtttccaccctataaaggtagaaaacttccaaacaaattaacccatctagataatgtggtttttccacttttttcataaaaacaatcgtctccaccaacacaaccccattaaaacaccgaattaaaactaaaaacattcggcaccctcaataaaaatatttcccaccccaccgctatttaccctaaacaaatctacttaacactttcacaatcatacactgctatgatatcacctcttattaactaccctatatttttataagataattcgttgcgacaaaatacacctgcttactcattctttatactctcatagtctaaaaataaatacaccatcctgctctctccttgacacccactgaacaactattcacgcgtgctctcctttttcatcacacacg

SEQ ID NO: 9129 - DNA, 1428 bp, Homo sapiens
  misc_feature (1)...(1428): n = A,T,C or G
tctgcgagttggagacggagtntgatcgtatgtgcgtgtgtanngcgacatcaacgtactcatctctcctgtgcgtgtcactgatatgtatgccgtacgtactctgcgcctcgttcatgntcnccctctcgatgtgangagngtgcacctanacgtngnctgtcgcgatcgctatnnnccgcttttcgtactgtccgaagcgcgagtatagagtgcgagtgcgnganagacgtgtgtagtggnngngtctacgcgttgnggngctcagtgcgtgtcgncgacgtctctnanacctaagtcgcgngcgctcatgcagtctgctgcgctaacacacatctcgtatgtgtgagngactntgcgcngtgnagtctatanggcgatgagngtggatgatanaggcatagaacgcaagtatagtcgatngaatgatgtgacagtcgntcttatgattatgtagcgatcgcgatgtctgcgtagcgtgactggatcttccctatctcggtgngcggtggcgtggnntacgtgttgcgtgcgtgcgctngctnngcactcgcctaggngcgtcttctgtcgtgagcggggattggacttgtgggcgctatgcgtgcgcgactgagcgtactgtggcgtcgtgcggcctctgacgagcgtacacctagtgggcgcgtctcgatcttctatggatagtcggtattggtctctgntggttggtctgcgtgcgggangtcgcgtgcggtgggagcgcgcgncganagagcgatggagaagggtagagcgagcgtgcgtgtggnaangcctgtgtggggatgaacggcggagatactctttgaacgctatgggcgagggtcgcgagcggtatacgcaatgggnaaaatcaacnttgcatttttataactatcacttgngaccatgatgcgcttagtgggtctactcgtggtcacnctttgggtcttgtgcggggtgtggangttggctgtctcatcnntacttccttagacaatctcagttatgtcagggctttcgtctctggnnnctatactattntaaattatacttaggncatcttcgctttcatatctatcttantgcgtgcgtgcatatggtnttgtgttactactatgatcctttttcttctctcgtcgnctcctagctcaaacaacttacatattgttattatgaactcactnctcttctcttcgcttctcttgtcgttttactctagaaatcttactctanaccatatcgttattattactctcttnccataaattgtttnaatatgtatattctcaataatnccttggnnatcgccccaacgagtttntcattaattatattacatctttattctaattnntaaactnttctnattctctnacatannnnnncctnnctattnccatatttnnnnnnnnnnnnnnnnnaaaa

SEQ ID NO: 9130 - DNA, 1778 bp, Homo sapiens
  misc_feature (1)...(1778): n = A,T,C or G
agccgcgacgagcgcgatctatctatagtcgcgctctctnancgcggtattcgtagctgctntccttgctgtgtgtagccatgtgtgtagtcgtcatcgttgcggatgatatacatctcaacacgcgacactcagacgttgtcacagagctctaatcagcactcggtgcatgcacaatacgtatacgtcgacgcgtacggcagcntagcatcatactcgcctnagactagtgtgtcgccgactgctctcgcacgtcactgacgacgtcgctagtgcagagtcgctctgngcatatcgtggagatagagcgaagcagccgtcgacnagatcagcgcctcacacacatgtgangtgccatctcatacggatctcgtcacactgcccactagtcagtgcatgcgcctatgacgcacagatctattcttcgcatnctggttatcagcacatcatcgngggaacgcactncagacatctgcttcccgtcgcttcagtgtcatctcgtacgcatccgcgctcacactacctgcttactacactctgcctcgtctcctctgcgcgtgtccngtgcgcngcacncgtcaccatcatcttcatttcatgtactacagcgcgcagctcataatctcaacgttcgcgaaatatagatatatgtgcagacagcacagtcgcgcccgacgctgtaaccgcggcatctctagtgcgcgtgcgccgcgttatggcgcgttccgctgcactcgtcaccacagaatcanaccggtcacagtactgtagcatagtgtagtccgtcgctctgtggacctgtatagtagcgcccgcgtcggcgcacacgagcaacgcgtcgtcggacagtctagtatgtactattcactcgaactgctgcgtcagcacgtgacgtatgctatctcgctcgtcgactatctcacttctctcatgtagccacgcatctcctgtcactgncgcgatcctcncgcgcttagtcgggaganatagactgcantttaactgttacgcctcatctagctactacacncacgatctgatgcgtttgatgcaccggatatccatagtgtcgactganttcgcaccatactgtacttctgcgctntgctacntacaatgtcagctattagcnacgtcagctccgagccacgccgcgcgtcccctcctaccacagaagacgcagcgccacgctactcgttgctatctgcctgtgcacgacactgtcattgntatagtctttcatctctgtgcgcgcctcgcgnccacacggagacgtgtcangaagccgctgtctgtgaagantgctatgatcatgatcctcgcgtcnacggatgtggagcctgangaccgtngccagcactcgtcagtncttcatttacagtagtgtccatccatcatntacttactacttatcgcagnctgctcacatgatctgncgcggtatatgtntggacagtcgggctcgnggctgcgccgtctgccatcctatatctnactctatgccatcgtgtctactacacatgatattatagtcgtacatattgagcngagctcgtgttcanctgctatactcctctactggtncacagtatatgagagttgngtgtcgtctgntngcntccgcngctcatcatncaccncgcctggccgtggcgctacgtgctgcatcgtttttctgtctctacnatgcgcacgggncgttcctgtatctnntttctntttcctctactctcnacactnagtcatatacgatcagcgtcgcgcgcccgacaatgcgc

SEQ ID NO: 9131 - DNA, 241 bp, Homo sapiens
atatatatttagggtttcataatagggttccattcaccaattacgttaaaattcctctaaattattctattttatgaccctatgggtaattctatcgattgaaaatcaccatattattttgtgcaaaaatgacctatcccagtcactttgtaattgcaaccagttaatttgtcactgttgtcataacactatttaattgttagcagcttcatgctttaggttccggttacaaactaaagta

SEQ ID NO: 9132 - DNA, 719 bp, Homo sapiens
aaataagcagatgtctagaaatgtgaatacagataatatgggaaaagaagcttgattggacaattgttaaaagttggggctttgcaccaatcccatcacagggtatatgcccaaaggaaataagattataccaaaaagacacataccctcatatgttcatcaccaagctgcccatcaatgttggattggataaagaaaatgtaatacatcggcactgtggaatactacatagccctaaaaaaaacaatgaaatcatgtccttcacagcaacatgaatggagctggaggccataattttaagcaaatcaatgcaggaacagaaaaccaaatacctcctgttctcatttataagtaggagctaaacactgaacacatgtggatataaacatgggaacaacagacactgcagactaccagaagtgggaaggagcaggagacacagcttgaaagactacctattgggtactgtcctccttacctggatgcgatatacctatgcaacaaacctgcacatgtacatcctgtatctaaaatgaaagttgaattaaacaaaacaagtacacatccatgtgctgggaggctgacacaccccagctccatggggacagaagttcctgtctccagacacttccagacctcactctatgtacctcttcatctggctgttcatctgtattcattctcataaaccagtaaacactaaaaaaaaaaaaaaaaaa

SEQ ID NO: 9133 - DNA, 392 bp, Homo sapiens
catatgaggaatgaggctagcaatagtaccttgtccaaagtcagaatctgcccaagttctaggagacaaagtccagcaatctgactctggagccagtgttcctacccattatgcttgtctctctcctcctcacgagcatactgaggaaaagccaacagctgcttactgtggctcaacccgactgctacacacaaggaatttgctcctgagggtggaaagaagttcatctgcctcaaagaacacacccacacggcagggctgggatgccaccatcagccttccttttgacttaaagcttgtccacgttgtcatcaagtgacacaccaaaccacatcagtcatttcttcagcatgaaagaataaattcgatattttcctggaaaaaaaaaaaaa

SEQ ID NO: 9134 - DNA, 184 bp, Homo sapiens
ctgattcagcgtgtatgaaggcaatgcctctgtcagcatggttccctgaacaactatgaagatcaaagtgcaccctcctcctcatatctatatgttacatgcttaaattccgagaaataaggggaaaaaacggaaatgttgcatggatgagcaataacattttatttaattaaaaaaaaaaaaa

SEQ ID NO: 9135 - DNA, 262 bp, Homo sapiens
gcctatggagtactccagacgctttctgacgtgtgatatcgcaacagactgaatgcaaaacagatatgagaattcagctgtttccattaagccagacagaagacatttgcaaatgtgcaaaacaatgccattcttctcatgcattttttttgtttggtatagtaacttttatttttaaaaatatgttatttcagttgacattattactgctattggaaatgaattataaataaatatttcacaactcagaaaaaaaaaaaaa

SEQ ID NO: 9136 - DNA, 186 bp, Homo sapiens
ggtgaaaggaaacttctagccaaagatacagaagagaacgctgttgaggctgaggaagatattgaggtaacgcatctacaaacctcggacatccaagcaaagagaaaagtctgggacagattctccctcaaagcctgcaataaataaataaataaataaataaataaataaataaaaaaaaaaaaa

SEQ ID NO: 9137 - DNA, 358 bp, Homo sapiens
cataagtctcgctctcttgcctacctcggatgcagcagcgtgatttgtctcagctcactgtaacctcaaccttccaggctcaggtgatccttctacttcagcttcttgagtacctgggacttacagcaagttataatttccaaactggacatggtgatggacacttgtggtcccagctactcaggaggctgagacaggaagatggcttgagcccaggagttccagcctactgtgagctatgactgctacactgcattccagcatgggtgacagagctagaccccatcttttaaaaaaagagttataattttcaaataaatctacctttatgatttcacttaccccaaaaaaaaaaaaa

SEQ ID NO: 9138 - DNA, 1235 bp, Homo sapiens
  misc_feature (1)...(1235): n = A,T,C or G
actcccacgccaccacacagacccgaagccagagaggggaaaaggggcttgtgtgaacgactgcctcagcacttcctaaacgaggatgataccgnctcancactgaaagcatacctactcgatgagagctctatttgtcatgctaggatgtcaaccgcgatgaaagcactaatgtcgtatcacctagctgcgaattagtctaccagcgacaccacaagcaacgaggcgtcggtatgaagagaacgatacgactagaaagtatctcgacaactcgattgccttattagcatgtgaaagaaactacgcgaaacaaaccgcccttccgccctcgcacgaacaagaagaacaaatatttttttttaccgaagaaattcaagaaacngaacaagcagcaagaaacaagaacaacacaacataaaaaagagcgcgcgaaacagagcgaatgccgacagcgaggcaccggggcaccggcaccatcgcacaccatacatcacccctcgtcgccacaaatctcacaccgcatcgtaagcgagctccgcgtcacaccctccgacacgatcacagcgccgctccacaccacgatcacaccaacccaaaccaccacacccaaccgaaccaaacacacagcaacaaaacacccaagctccaacctacaaccactccagaccacacagncaccccatacgaccaccccactctggaagatagattccagacacctcacccaacactctctcatatctcatatgccacacagtcagcgaaacacgcaggagccatcccgatcaggaccgcgcgagcgtagtacatgacacacagcctatccacgaacacncactacccgctgngaggactcagcntcgcacagagcacgccccagctcacaccgtggcgnccggcggcacccccacctcactcacgatcacctaagcggctcaagatgcgacgttatcagaacaaggatgggcgccaccggtgtagcaacagagccaatacccgcaccaccacgcctcgcagtaacatcgtcaccccncccacccaaccacccatcaccaacgcgtacctcctcgcgcgacncactctcaacgccctatacatcgcaccgactgacacgccnacactccgtagccgcctcccaccgcacgcncacgcgacacatccaccacctgcccacgctccntcacgttgctactgcgaatgaggactatgcatacactagagggtcaccactcagg

SEQ ID NO: 9139 - DNA, 936 bp, Homo sapiens
  misc_feature (1)...(936): n = A,T,C or G
acgtcaaccaataatctattttacaccgcccggagaaaaccttctattgagcaccattcacagtcagttactgtcacggaccgtcatgatgtcattatttcctggcccctagagatggatctgtgctaattaaacacatttaatgggaaaaagttctgttcaccttaagctattatttctttacttactagtgtttgttacaatttacaaacaagaattatacatcccagtaaattgaaccttctttcttctctgctccctttcccccacactcaatttaccaggtactaaagttgcataaagtttataaaccagttggatggcttcttgggaataaagttttcattgaacagttaaaaaaaaacaacaaaatcaaacccttaactataatacaacaatttcgttttattctacatcatatttattgtagccccttttgtcgtcggctatccatgtgctctctgctgtctctatataatagttcgcgggcctactccacagactcttactatacaacttggcgcccaatgcacgcccctaaggagctcattgtgatcatatctgcatgaccgagttgcctatgaacttctccatatgtttgtcatatcgtaacatgtagttcaccgtgcatctaaccaatcaaattaccaaatacctcattaaccgcatcagtacggatcccatagcacaaggaagatctgacaacctgcaatcccttctctatcttagtcctggtntatactgaacactactcctacaccttgttactttaaaagtccctacgtatactcatcctatacacagatccttcatacctcccaacaatctcttctgatcccagccctactcggtccctcccccactcatcaacatacttttatgcgcacacatgttccccattctacctctcaccccacatccacaatctccctacgt

SEQ ID NO: 9140 - DNA, 224 bp, Homo sapiens
ccttagagtaaccccttgctacagctaaattggtttgacagccctccccagagccaagatccaccagagaaccccgatctgatgactgccggcgggtctgtgcagtgccttcctctcgatttgaagagcagctaatttaatttgttctcttatttgagagtgaaccagatcatttgcattgtaaataaaaccatttcttgtatttaaaaagaaaaaaaaaaaaa

SEQ ID NO: 9141 - DNA, 635 bp, Homo sapiens
aagtaaatgtgttcaagttatcttgctatattttatattccaaaacataatgactaaaaacagcaacagcatttctttccttacaactatgccatttgttcagggctcatcagaaacgactctgctctacttagagtcatttcaggtggctaaaatgttggggaccgaaatcatcatgtatctctggtgattggctggtataagccaagcatttgagagctggaatagctgtggctccttgggcaattttttctttaatatggtttttacacgtgttctctccaacatgtctgtttcagaatagccagacttctcacattgctgactcagggattcctgcataggtaccatttaccaaagagatagagccaatcagaagctgtgtcaccttttatgaccccaactaaaattaacatggtctcattctgccctataaaatcctttagaatcaagtcactaagtccagcccattattcaagaggaagcgcattaaactttaatttggagtggatgggatgaaatggaagtgtcaaatattttatgaaatggttctactcatccactagatggtttttcattggcttcctacaggttttattattgactaagatggatccatttaatgatgtttcttg

SEQ ID NO: 9142 - DNA, 832 bp, Homo sapiens
catactcttaacctctatctaggattaaagaaaaccttccagaaagagctctctctatgtcagacatgccaacataccgaaccgattccaggactactagaagcagaaacttgcaggggagctcgcgattaaacccaagtaatcctgaagagtgggatttatactctagagaaatcttcattgaaaatccttacagtagtcattgtctactagtaaaatatttctgagttcgcaatcttcgcgaagtttgcgtactatccctaacatgtgacactgtctattaattgttccatatatgcgacgccgattcctctagaatcaatccgaaagcatctaatcataccaccgcgcgcttttatgacagcctagcacagggctgcgccaaactgcgtcaaaccacgctgtcctcgactcctcttcattgcgaagacgaaacaataacggaacctgcattacttttctctctgcacactatctgctcctttagggcatcacttgacttccacgttttcagcttcacctcaccttccctctcactcaacaggctttgggactttcctctccctacaccactcgcaccattacacccgatcatataacatctccctactgtccaccctatcgtcggtcctctcctatctcctcccttcaaactcggttttctcatgatcacctcctccctccctctctttcctcctcgcatctatctgactacactatttctctctccatgagtatctacccgcgtatccctattcgcggcgtcctttattctgttttttccttacctcaatctaacgaagcactctaatcggcatgcacgtgccctctt

SEQ ID NO: 9143 - DNA, 922 bp, Homo sapiens
gggtgttgctcatcgtggagataaaaagcaacaactggtgtccactgggaggaggtttatgccgagcagccccaaaccgctgtcgtccgaagctaagcctgcctctggcctacccctgcgcctaaatgcagaaccagtagtgggagcactgtgtttatagctaagagtgaacactgtttgattatacttggaatttcctctgatatatagcttttcctaatgctatttttcatacaactacaacaatatttcatgattgtcagttttgttgtatacaagtttggtgattattgcattttaagaaattattcctggtacatatacttattgcaatattgtgtagtgatgatagatctgatatatagagatgtgagatatagtggttttctgtcttaatattgatttattaaaaatggcgtcacctgggctgtcttatttagtgttgttttgcatcttttatgttgttatgtaagttttaaattgtgtacgttttatgaatattatagaaattcatattaatactaaatcttatattttttgatatgtgttatgataatatcagtggttagtagttagttgtacattgttagtggatatcctctatgtttttatatgggatgtaaatggtcatgaatatggtgaacgaaattagaggggaagacgactatgtggtactctggttgatgattgttaacgatagttttatatgttatactttattacgttttattctcggtgcatacgctgctactcactttatgttcataaatgaaaatttataaattatacattattctagtgttgtaatgttcattaatgggatacgataataattactaatgacgccattatgttattcgccatgttagtttttacaatcttataagtgtatttgttacgagtatatttattttgtgtgtgg

SEQ ID NO: 9144 - DNA, 151 bp, Homo sapiens
cttggaagctctgaggaaatgagccttcactgcttgtcatgaactatcaattaatttctcagcaattgtgttgtcaacaaattttcaagacaaatgtttcaataaataagtacccatcaattttcagttctccaaattaaaaaaaaaaaaa

SEQ ID NO: 9145 - DNA, 579 bp, Homo sapiens
cttgtggcagactagtaagatttaatgatactgtctgactggagctggaaagcagtgagtatggctgctatcggagaggagagagaaaatcaatctctgtgggctgctattatccagaagaaatggagagctcccaatgaccaggcattccaccgagcaacagggcttacttgcctctgctctcattgaaaaccacacagagcatgtaacactttgctcactccaaaactttatgactttcttcaatttcaagcaatgttgaatgctgactcaataagatacaaccaaaacaacttgttgatgagacaaagctgagtttattttttaccatggtaaaagtgaacgctacctcagcagaggggcaagaaatatattttttgagattttgaagtctggtgcaagtttttcaatgtggaacttggttaagatggggctagcgtcataatgtagttgcttagaattgtgaacgcagggaggagagaattttgagaaaagtaattcaaagggtcttgacatataccattcagtaagttgctggaatgaaaaataaagtcatttgcaattgtaaaaaaaaaaaaa

SEQ ID NO: 9146 - DNA, 910 bp, Homo sapiens
  misc_feature (1)...(910): n = A,T,C or G
cctcgtgggggcggcagtggncgcgaaaaagcacaacacttcgatgctgacatagtcaccttcttttcaactgcctaaaacctgtagagaagaaattctgcaacaacagaggaaaagtgtgatgggaatgcaagcaattttatttgtttaaatcttcagccccttttccatattcatggtaggctcatattgaattcccagaagtcttatttttcaggcctgagaaagcaatattggccactgtagtgggttgaattatgttccccccaaagatacatctngntcctagcccctggtacttgtgaacgagaccttatttagagacagaatctttgcaggtttaatttagttaaggatcttggcagattagcctggatttaggggtcgccccttgatacaatcactggtatccttgcaagagaaaggcnacacacattttagacacttaggggaaagcgcatgtgaannnaaaagccgagtttgaagtgatgactctacacaccatggaacccacaggatttctagtctgctaccagaaacttaggagagggggagncaaccagattccttccctagaggcctccgcaataaccaaacacccttaattttcttcactttcttattttttgcctcccgaactggtgacagaatataattgctgctggttgttcgctatattgaactaaaaatggctccccgtggcacctacggaaggatttttgcgggcgttatccttttaggaggatgaaatttactggcacccccgttattgactcttttgggctaggnctgtgctggtcaggctaggggcatcgtatgnttcgaaggtgggattactggtttctccgtttctcgtgttcacgcggtcattaacgtggtctccnncatcagacaaagccgtgaccaccat

SEQ ID NO: 9147 - DNA, 1739 bp, Homo sapiens
  misc_feature (1)...(1739): n = A,T,C or G
gtcgncggcgacgctcgtccgtagtagtggtgtcgcgccatctgcgtcgacggctagntcgtnatgtgtgcactctnctncncgctctcgctttatctgntgctcgtggcntntgtcgtgttgngttgtgttctgtgctgtcgtcgtgctgttgnntgcgcgacactgtcggtnctgnctctgcgctgtgccggtgttgggcgttgcgtcgcgcgctnncgncgtccggtgcgtcgtcatngctgtgtgtcgtcgntggctcgtcgtgcgtcgcgtcgcgcgtgcgcgcgctcgcgttcactctccccactcgtcgtgccgcgacgcgcgcgctgctccgctgctatatntgtctctgatngcncgtgtgctcgtgtcgtctgtctccacgcgcgctgtcctgtcgctcgcgctcgcgtctcangagagccgtggtcggtgtggtcgtggcgagtcgtgcctctccgcttgtctgttatgctttctcggcgcctgcgctctctctcgtgtgatgtcgcgtgttgtcgctcgcctgcctgctcgtctgtgcgtggtgtggctcggngggcttctttgccgtgtcgctctggtcgcgcttctccttcgtccctctgcttgtgtcgcgtntgtatcgcgcggcctcgtccgtgctgcgcgtgcgctccttcgttctagtgcgcctgcgcggcgcgtgcctatcgtgtcgtgcgcgacccgtcgcatgatctgcggcgtccgttcgttttctcgtcgctcggtgttgcgngnggtggccgcgcgcgctgcttgccgatccgtgcttgtagtcagcgtcgacactgtcgcgcattgtacgtcgcgcgtacgtgttcgtatctcgtgtgtgagtgcgtcgtctgacgngcgcggcgttctgntgtgtccctgctatgtctgctcatggcttcgtcgccgtgctgtcgtcgcgtgcgtcncgttctccgtgtgcgcctccgctntcgtctctcgcccgcttgctggcgtgtcctgccgtcgtcatcgcgtgtctgttcgtgcgnttggctcgcgttgtcgttgtcgtgctcgctcttcgttcagtgtgtttctgccgcttctgatactcgtgtatctgctgtatatgccgcgtcgcgcgccgtgtcgtgtgatgctgcttgtcgtgttgtctntaccctgcgtctctgtcngtcgtctntatcatgtcgtctgcgagagagacgagtngctcgtcgctgcgttcgctcgtcgtcgcgcgctgngnngcggngtgtgtctgtgctgtggtgtcgcgttgtctcgtgtntgctcttgcgtntctgtgtcggtgtctggcgctgtcgcccgtcgtgcgcgcgtgcgccgccgggttgggcggggcggtccttggcgcgtcggtccctctgccgttccggtggcggtttcctgcgctgtntgcctctctctgtgtgcgtttcttctcctgcctgcgcttgntntgcggtctgcgcggtgcggttgncgcgcgcgcttgctgtggttcgcgtcgctgtgcgccgcttttcgtcnctggttggtncgtcgtcttcctccttcctgtgtcctgcncgntgntngcgcgttttctcccntctccctctctcaacgnnnctgtggnggcgtttgnnggttcntgccctttgnggcagggccggtttgtcctcctgctgcttgtgctctttgtctcgtgtgggtctcccctgctcgcggcgctgctgtgcccgcgc

SEQ ID NO: 9148 - DNA, 828 bp, Homo sapiens
ccttggttggaacgtaagcataattacttaggaaatgacaagtcaactatgaagaagcaggtgaatctgcatttgaacaactcttctattagaagttgcatgtacagtatataaaagaaggctggatttaactctgggttaccggcctcttgaacactgcagtaaaagagtgaactagaacattcaaggaagatgcattttctctgtaaaaattagcatcttaactaaaattttcagtgcactgtgccacacgaggacagcttgatggagcaacgaatgctgctctccgtatgtcagcagaagcagtgttttgacagttcatggcatatttttgcaggtctactgagacctccgggactgtactaaaggaaggatttagtcttgtttctatggaaaccataactactctgtaagcctgttaaacaagacagtttgcaatatggtatcttattcaagatgaatagtctttgtaatatatcattgataaatttttctgtctagatttcaacatctgcctgagaaaattctaaatctttgatgactccacaagaaaaacatcagccagccacagtgcaaacaagctctattgcaatctggttcatgtgctgggaaataaaaatggtgtctaccttaacgaaaaaaagaaagggaattcagcctataacacaggattaccggaatgacatcttcactttgacaactgacgagaagctagcattaccttaactagcttttatttgcattttttaaatattaacttttttcacgacaaaaaattggcggttctaaaattaattggtttagggttaaaaaacaaaaaaaaaaaaa

SEQ ID NO: 9149 - DNA, 1354 bp, Homo sapiens
  misc_feature (1)...(1354): n = A,T,C or G
cgaccaaccacgcagcgccacgcagcgaccgagcgggcgngacagagaacaagcaagagcagaaagagagaagttttcgttnatcgggtnnntaccnagnacagcaagagaggcccctggaaggnggggnaggagtaatccaagagngacnagngcgacgaagaggcgagacgaacgcnaacagggacacagggagtcttagcgcagaggacggagacaacagcacgagagcaccagccgcgcacaccgcaagacgaccgcgcaagacaagcaggacgcgccgcagcgacgcgcgcaggcgccgaccacgacagcgcacagcggcgagcggaccgaccgcncgaccagggccgcacacgagcaacgacgaggancacacgcagcaacagacagacagagggccacagacgagacgnacacagccgagcgacgccacggangcgcgagcagagcgaagcggaggcgcgagcagaggcattctctctctgtagagcaaacgcgacgagcggccacgaccgccgcaggcacagcgacgcaccacacagaacagcncacacgaggcgganacagacganagagaaccgcggccgcgaaaagacggacnaacgcaagcaaaagagccggaacaaagcaaagaacacagnagcaagaaagcaccaagcaggaccagacaccagagcgaacaaggcaggggagcgcacaggaagcgaaccagggaagccgagaaagaagacgacacagaccagaacagggagcacagagcaagaggagagggggaggggcgaaaaagacgaaagggacgaacacacgcgagaacaacaggagagaaggacgcagagggcgagagacaacgcaaacgagcaggcnaccagagcaaacgaagagcgagcagggagacaacaaccggacgagcagagcacaagacagagaggaggcgcacgcgagacccggaagccacagagacgcagcgcacagcacacacagcccagggccgagacacaccagcagcaggagagggcgcgagagcgggaacgcgcgccaagaagaagcaaggaggcgagcaggagnacggggaaccaagnagcacgcaccgacaacaggaggcgagaagaagcgacaaagacnagagcacgcgagagggaganagaggggagggaganggaggaaagacgcgcgagaacagaggcagagnagcgcgcgagacacaagcacgacgcgagcagcgacagagctaacacaacacgacacgccagacaccgaccacganctcgcacacgcgcgatgagacggaacacgaagatggcgcgagaggcacnagaagcaagaccgcgagggcgacacaccgccgcaccaa

SEQ ID NO: 9150 - DNA, 594 bp, Homo sapiens
  misc_feature (1)...(594): n = A,T,C or G
ctgatgaatgaataaataaactgtgggtctgcataaatgtcgaaatactgttcagccttaaaaaagaagaaaattctacagggggagggggggtggataaacctnnannaaattaaatgaggtcgctcccaagggtgaacactctggagagaaagatttgctctcagtgctgatttatgaactgcggcgccagaaaccagcattaatttggagttaatttttccccaaagcttttcgggggggggcantcatctcttatccctgaaaaaacaaaacacntatattattgggctttatactttcctaaagaagaaaaaaattctaagaaaattatatttagtaacttattggcttaagaaaataactgcaaaatatctggctagggtgataaattatacgtgtaagtttattttttttcagaagcagagaacatcatttctctagtaagttcacaaagataattaggatacccagatgaaattctacagatggctttaaaagttgatggggaactgaatgtttagtattaatgtgtcataattgaaataaaataaagataataggagattaaaataatggcctcgttgggcctaa

SEQ ID NO: 9151 - DNA, 1674 bp, Homo sapiens
  misc_feature (1)...(1674): n = A,T,C or G
aggatgagtatgatgtagtgtangagagaggtgaganagaaggaagngannagaaggtgtgtanagatgtanagatggnnnnnnnnnanaannaggnaangaggnaagatgnggatnanaagntaanagtngaagannnnnnnnnanagnnanagaanagnnnnnnataagttttggtatgtnnnanaataaaagaggtgaganagtagannnnagagnagagtagagagnnaagtgaaggagagnnngaaggtaggatgatgngnnnagaagtggagagatgaagagatgagatagagagtggaagagaganaaaagggtgnngaantgagatganaaaagatagtgagtctatattaaggccgatatggtgtgnantcacgtgtactagtggtctctctgtgtgttatatctattaaatgtaacagtcattcatatatcatggtgnnnttaattgtagtgatgtgaaagatataatagactatgagnttctgttatatngtagtgttcattcngattgattgtatcttctttgtcattatagtgtgtattctgatgaatctagtattgntctnntcttntttattttntttagtagtatatgagcctagtcgcgcatcacgctaggtaagtcccaatgccatatactcaccncnccttatgtgtcttatagtctatggntttgtgactatttcttggtggtggtgttcatatatgtggncaattgatgtgtcttctaacagttcatgtttatgctttatatgtacaaggtctcctctcctctccatctttgtcatcactgctcacgccctcgcgctatactgcaacgagacgcacactaagacaccgccactagctacagttatagantcctcncagcagcgtaaaactatacgtcncggatgttgtgctacgcacgtatatctcgttatatntttcgcggtctgccatcatctgtgatgttgtagtcctctatctcctctctatccatncgtattagagaacttagtgtgcgtacgtgttagtgatagtnntagtatgtcgacatntctagctagagatgtgcnacactcgtagannaatatatagagtgcgatatcacttgatgtagagtacgtaatatgatgtgttagtggtnnnnctgagtagtgatcnacgntatctgtgattctaacgcgctactcacntngancgctagttatgnagcactctagtgtcctcgacgatgagctgtcaatgtcgangagcgagngtgagtactgngcgcacgtacaccgatctntcactgtctaccacacctcactcactntagtctccgctggtcgcgctctcncagcacgagtcgctgatcacgctcgtgtgagnatactagtcgtgcagacgtctacacgacactatgttgtagatactgtctnagcgcgcggagtgatagtccntcgctctctgatagtctatctataggatggagtntancctctgctacacacatcgctagtatactgcatacgatgatatanacacataatatgtttatanctancggtcgtgagacacgtagatgtatgtntnnnnncactagcnttacnatgatngtccttttnacgttcagacttnctcattagntnncncnaccactacatacagatcttncagatcatacgcgacatgangcag

SEQ ID NO: 9152 - DNA, 120 bp, Homo sapiens
cattatttagcaccattcacagtcaatgactgtcacggaccgtcatgacggtcattatttcctggcccctagagaaggatctgtgctaatgaaacacatttaatgggaaaaaaaaaaaaa

SEQ ID NO: 9153 - DNA, 544 bp, Homo sapiens
  misc_feature (1)...(544): n = A,T,C or G
atgtctaaacttcatgaggtgaaggaacttatggaaaatctggtatccttcttcatggagccaaacacacacatggtccagaagttggaaaagctaaagaagagccagtgggagttaaaggaactgcaggcccagctgttgtccccatgccctgtgcacaagatgagcccatcattaatgagggacagtgtgtgtgtgagctataacagcccctggtatctctgcacttactttccaaacttaaaatttcaactttactttttaccttccaaataacaaaatgttgtattgagctcatgctatttcagaattatgaagggaagggaaaatctggaaaatatagtttagtgtagctatactgaatcaatacaaatctactacattaccatcggggtgtgtgtgtgtgtgtgtgtgtgtgtgtgtatgcgtgtgtgtataaataattttatatgtttaaatacatataaaatagatgaagaagaaatatatcanatacattatattaaaaactaataaataccctaccgcganaaaaaaaaaaaaa

SEQ ID NO: 9154 - DNA, 467 bp, Homo sapiens
  misc_feature (1)...(467): n = A,T,C or G
cgagaggacggaatctcgccgaataataggtagcggaaggaacggggagctangacggctgacttccccaacnagaattatgcacaatgagaagtgcaaattgccaacagaccacattttctctgctctctcctaggcatctgaaagaggatgcgcgatacagtaatgtgagcgctgtaattaatcgcggctctgcataatataaaacgtgcttttatctacagaaacactgctgcactaattcccaacatgaagtgcatcgctcccgttaaagctctttctacatgaagaattcacctcttctaccctttacatatctacagacaaatttgaatatgattgatatgggaaactgaatatgggtaaacatacgatgatattagtactctatagggctaaatctataagccttaaagattaatattagtgcttggataactgctgaataaatctacatagacaatttt

SEQ ID NO: 9155 - DNA, 1045 bp, Homo sapiens
  misc_feature (1)...(1045): n = A,T,C or G
catgtttggcgtccgtcgcccctcgcggncctcccgtcgcttctcgttggtatactttccctcgtcgcttggggtcccgggcgcggggcgggtctccggggagcggtgcggtgggctcggctcggttcctgtgtctgagtgcttgatgttcttcttcggcnncctgctcgtagggtccagcgcgtngctcacatccgttgctgccgtcgccgacgggtctcgccctggtgaggcgcgttgcgcgttccgtgtcccgtttcgtgtgaccnttgggtcgccccctcccgcgcccgtccgcccgcggggttcgggcgggcgccctgctgngcacgcgcccggggggggtgtngggtcgtcggcctccgtagccctactcgctctgcgtgtggggtggttgccgggtcngctggtggcgccctctctccgtgggccctttcacgtccggcgcggcgctgtccgtgtgcttctcttgttgcttgccgcttcgcgctcgcgtgctgccctataggtgtgtctgctctctcctttgttttctttgcctcctgtgggccgggagaggtgttggtgtcggcgtcggccggtgtccgcttctccccgcggcttccccgtctctggtgcggccgcccccgctccggagactcgctctgcctcccgcgtgcgcggcgcccctcgggccggctcttgtctcgttccggcgccgtctcctgcctcgcgnctccctcggggggttgcctcggtgggtggtctctgtgttgtgctcctctcttcctcccgccgtcgcgccctccgtttccccctttccatggccggcggtcgaccgccggtggtcgtggctggccccgttgcggcgtcctcgcgggaccgcgcgtccgcgcggcgcgccgccgtgtgcccccccccgctctcgcccctgcggtcgagctgtgctccncccctcgctttcctcctctcctcngccatatcttgncccccgtcttgttctctttttcgtcgttggcttgtttcccgcnnnttaaaattggtgtgcgtttggtttccctttaag

SEQ ID NO: 9156 - DNA, 260 bp, Homo sapiens
cgagggagttgagggccattaaaggattgggagggaagaggaactagatggaactgaaatgccctgttaggccagggaaccagaaccactgtatgactgaggaaggcttgaagaaagatgcatcctgaaactagaccttcaagatggaatacagtttttcagaaataacacttacactgaattgctttaattatataagaggacccatactaacattttgaaaaagtgtatataataatagtgatgaacagattcaaaaa

SEQ ID NO: 9157 - DNA, 823 bp, Homo sapiens
  misc_feature (1)...(823): n = A,T,C or G
ttatatgtattattctatttggacttctttattacttgaagttttctgttttttatttaagaacatgagtgaacttagcattgaatagacaaagaatgaaagtggataggaactataaagngttatgtgattaatgtggaataattggaagaatattgangattacttagatattagaaactaacagagaataaaatagataggaattttcgtaacaaatgttaaacacatatactatactgtatatatctgatttagaaatatattatattanataaaaaagtccaaataatacgaatgattcgtatggaatgattggtagttttattatagaaataatagtataaatgcaagaatgtatctgtgatgctataatatgaaggttatgcattgtatgtattttcacctttcccaaataataccatattgttttccacagtgattgtacgaatattcatcgttaccactattgcataaacgttccagctggttccatcttcattaatgcttaatgttataatattttaagtaaaacacatttccttttaagatattgagtcagttctgagaaattaaaaaacaaattaaaatatcagctttttactcctagaaaggtagtaaaaagccaattaacagaaaaattgctatattcctaggtattttattctctttgtagcaattgtgaatgggagtttattcatgatttggctctctgcttgtctgttgttggtttataggaatgcttgcgataattacacgttgatgtgttnccagagtgtcgcaggtgtttcaaaaacaanaataaaaaataannnaaaaaaaa

SEQ ID NO: 9158 - DNA, 1278 bp, Homo sapiens
  misc_feature (1)...(1278): n = A,T,C or G
ctagagtatgagtaataatgtacaaaggggactgagcagtcgntatagcatatgtcatctaggtgggaaataagtgacgagtagttaatcgtacgacgggcaggatacatatatctgagcgtagcgtacgcatacgtacagaccgagataatacncacacacctaaactcaaaacatcacatatatgtctctcgacgttagagtgcgtatgatctgcagcaaactctgaccagagtactcggactctcatagatgacatcggtacacgaaacgcacactaagtctagaacagagcttcttgcacgacacgagacatcgagacanacagacccagcacggcgacagggagagtatgcggggagacgaaagatctgtgatatagtcaagctctgtcaatcacagctcgatgtccactcacgcatatctgtganaagcagcaggccgaggagtgacaacagnacaaacataacatcgcacacaaagaatatattctatctcaaacatacacgacaatagngagcatttacatncagatgcgcttatgatgagaggcggcgtaacgatacancaatcgacaggatgcactcgtcgcgcacgactagatgcgggaatgtgtagttgcagctggctaggatcggggtcctgcgtagcgccatgtcgttcggatgggctggggcggaatgtgactgggtggcgcacctcttttcggtggggtcggagcaatgcgatggtgtggtggtagtgagcttgatagatgggcgtgtgtttatgttttgtcatggtgtggatctgcagtgaacggaactagtattatatatgttttcccgtcggacatatatatatatatctcttatcaccaaaccgacggtnactacaactacttaatcaatacttataactgtgttgatgtttgaataattttatagtgtaatttgaggttgtngttatggggtgtttgggacgtttctcgctgtctatatctcttggattactatgtnctcatctatcagaccggtgtggcgcggcggcgcgtctcggtggttgtgggaattggcctatgcgcccgggctgcgcgtcttnngncggcggccctcgcggtccttgtgcgtctatgtaggatctctccccggtctttatntccgccggccccggtntgggnggggagggggcttaaaccgctcttttttttcttttttattttaaatttgtttggtnttttttgttttgttgntntntggtagttgatgttnnttnnnttgaaatataattataattgag

SEQ ID NO: 9159 - DNA, 674 bp, Homo sapiens
  misc_feature (1)...(674): n = A,T,C or G
cttgtgagtactcgtcatctgtgatatgtttttcttgttatgattccttagatagatttcctctattattttttaactataaggatgaaaaaattttaaatattttttaaaacccaaacagatagatttaatttaaattacttgtattgcaggtgatgagctgtgcaaactgtgagaaggaagtaccaaaggagcctttgttcaaggctgaaaacaacttagagagtgattaagggcacttgcttcatataatttcctctttgtgtctcaattcttcaaggaaagaaaggctattggtctgctggctcagtgtcctttatatccataaaataagaaacatttctttttagccatatttatttgacaactacactcaagtggtgttgcttaattgtcattggcaatgataaatgaatgaatcctgccttagaccatttgtcacaatctctatatgtatatgttgcatctctctaaattgactttcaaagatagaagctacattttagcataatgttctccagaaattgtagtatatgaggtggtgggtatgttaattagcttgatttaatcgtttcacattgtaagcattgtcataacatcatattgtactccatanatatatgcaattaatatttgttaattacaataaagttttaaaaataaaaaaaaaaaaa

SEQ ID NO: 9160 - DNA, 837 bp, Homo sapiens
cttggcaggagcaggaggaagagagtaggagggagatgacacatactttgaaaccagatctcctgaggaccatcacgagagcagggcaagagacggagacccatcctcatgatagaatcacccttcaccagaccccagccccaaccctgggaattacaatttgacatgaaatttgaatgggggcactagtacaaaccatatcggctgcgttttattttcgctattgcctggttgccctgactaggaggttcagtgctatgttcaataggagtggtgagagggcatccttgtcttgttccaattctcatggggtttgagcttttgctcactcagtataatgttgactgtgggttggtcatagatggctcttattattttgaggtatgttttttgatgcctagtttgctgagggtttttattatgagtgagtgttggagcatatcaaaagctttctcagcatctattgagataacatatggtttttgcttttattctgcttacacaatgaatcacagttattgatttgtggatgttgaatgaactttgcatcccaggggaaagcccacttgatcatgatgtgttacattttaaagtgcttcttgattctatttcgtaatattttggtggaaacttttagggcttatgtcattacgaatattcatctaatattttttttttaataatgcctcttctggttttggatgccagaaaacacagtgaaaaagacagctcctcaataacgaagataactggacttcatatccgaagaattaagttgaccttttgtgaccccttgtacaaaatcaactaaaagtgagccaacctgaaccacaactg

SEQ ID NO: 9161 - DNA, 347 bp, Homo sapiens
cttatctagaaccaataaaatgggcttaaggaacacggaataaagggagcaaccctgtgaagaccacaaaggcagaacagtgacagcagctcagcagcaagactgctgggcaccgggcctggctctcccaccacctgactgggtaacttttcaaacaccttcatttcccaagaagtaggaatgttgggaagactaaataaacatatgtcaagtacttaattacctgcccacatagtaaagtgctaagtaaatgttggacattgcttttgcaatttcatttatattctacccattaagcaatgtttaaaatctggaataaaatagattattaaagaaaaaaaaaaaaa

SEQ ID NO: 9162 - DNA, 1329 bp, Homo sapiens
  misc_feature (1)...(1329): n = A,T,C or G
aaggaannaannnnnannnggggnnnnnnnannnnnnagnnnannaagnnnnnnnnnnannnnnnnnnnannnnnnnnnnnnattttttnnannnnnnnncnannaannnncnaactttttgatcnncngnacgcccacnannnaanactataagaacaangcaancncaaagcaaagagcaaagaacgagtcgggacaaaggacgtaccnaaanggacaacaacacacaaagaaccacccagcaaggtggtcccacgaatagcagtgacacatctccntctanattttccattctgctccctcgccccataaccacatggcaggcgtcaactgatatccccacacagtcgggcgcagccaggcggcgctcgcggatcgccgcgtggtagcgcagaggcagcgcggtacacaaaggacgacgcaagccttataataagcggcaacttgtaagcactaaatattttagagcgtgatagganncngagatagtgtcgagaggacggtagttagatcagatcggtgaaggaagaggagagcgaagggtgaggnaagtggtgtgtatggatagggcgcgccacgacccgcgtcagacctgcggtagacgaacaaggaagcatgagagacgtgacagatacgccgtggagtaataggcgcccgagggcgcctcgcacttgtgcccgcgcgcgcccctcctcctccgctgtcgcgtgttctctctgcttctcgttgtcggcaccacatatcgaagatttgtagatatgataagcggtagcaacggtgtccataatagattatttccatatactctcagcgaatcggtcggctatgatgctacacttagacgcgatgatctgatagagcncatgtgataatgattcactcgatctctctatcactaattaaagttctcaatacgaggccagaactacatatatgtattgatgagtcttttcatgatgtatatgtggtcttgctatatgcgtatacacacacgcgtcgagtatcacactagcgagtaggnatgcgtgacgcccggtagtgaggtcgataacatggcgacgcggcgcgctggagtagcagcgctcaatttgcnctcaacacggccatcgctgcgtcgaatgacngtangacaggctagatacacgttctcatgactatactgtgatggagcagcgtagatatcagtgaatagtgctgcgcgagagcgatctgcactgtatctacatatatttgataatctactaagcgaccttgacatctcgaggttaattgtcagatcgttgtgtatagtcttggaggacttgtgctaaagatagtggcgactgcnt

SEQ ID NO: 9163 - DNA, 1184 bp, Homo sapiens
  misc_feature (1)...(1184): n = A,T,C or G
tgtgagaagagtgcgccgggccgagaaaagagaagaaggggggctttgtaggaaaccgtctagaaaagctttatgaaggaaagctcattgtcagtagacctgaatgggaaccgaccagtgctgagaaatcacaccaggggagttgtgcgtttccatgcatatctgtatacctagggcagaaggagttgcctagatcataagatctgacnagaaaccttagagattagctttatacacctgacctgggcaaaacgtaggatgacctggactagactaaaagtgaggcgctgagtcagtaatgcacattggccatacgcgactagagacacacataaagaaggactacagatgtggagtgcgctaacaatgtagctttgatacgcacactatgagtattgtatatgaaggacacgggcgataatggaatatcgttgaaataggcgagaagagggagtgaacaagtaggagtaaagcaagacccgaactagagtgtagataagatactgtacaaaaaatataccatcgagcccagtcattgaggaagaatggggaggggcagatatgtgcggcaaggctgtctctatttgacgagagggggtcagtattagtggaacacgtaaacaacaacgagacaaaaccgtgagttgtataactggatacgagaatgagaggntgaaggcggcggataaagacatacagtgcagctggtgagcgcatagagtatgagtgaggaataataaatgagaagggagatgtagcgcaatgatttgagagaatatggcgacggaaacgacgggtcagcaaaagtgagtgtagaatgagaccgagagaagtatcgtggggaagttcagtaagaatatcatgtaaaagaatgtataacattgcactcgcgtggagcaaagatagtagattaagttatggcgggtgaggacgtaggcagtgtgaagcgctgcgcgagtgtctgggtggtcgagacgagagagaaggataagcgtgctcccatgcatgctaggaatactgatcggatgagttagaattctcgaagtataagagagcattaacaggaatagtagagattagtcttacatcactactctccatagcactcgcgtcgcacaatcgtgtggaactcgccgattgagaaagtgtgcgacgatgcaccaggcatataacataccacctcg

SEQ ID NO: 9164 - DNA, 899 bp, Homo sapiens
gtagcttatgctcgcttggccgaggagaccgtctaaaagacagtcgtttcatgcctttaagatgtggacagatggctcagtgacatggtatgggtattgatacgttcaagactgcctctcattacacctctaactagaagatctgttatggaaacattcgaaaccaaccatggctaatcacatgcgtgagacagtgattagtttttttttgtgaactagaggcgagggcatgtagatacatttggagatattttatgatgggtgtattaaagattatggaagataatgttgtgatacccccctaggtggaaccttacagagtataattgcaccttattcttgatgagattacaggctaataggatctaagggagcactcaccctaattatggctgtattggaccggcttagtcaccaactttttcgggtctaactcctagttcagagatgacagttgaaaaatcataatgtacactggtgatttatctttgtgagtgagggggaataattgtaagtgagtatgagcattgacttgttgacctttgtgagaactgctttcaccaaagcgttctttgtttagaaggggaatatgggaattttctatactagaaaagctaggtatggtgcagttgtatcaattgcgacgctctcttattggcggttaaaaattggggcagcggagacattgtgggattattgtatatgggtcactggttaaaatagttttgtgacctcaaggatttttagtagaagctgttcaatgtttacctttaaaaactatttttcttccgtgattcgatcggatctggaccgtttagttttgtaagatggcgtcgtaattaatttggactcgaatatacggtattagacggtgaggcctcctctattttggtactctg

SEQ ID NO: 9165 - DNA, 303 bp, Homo sapiens
atggtgctgctgagctgcagtgaatacagtcctgatgaggcaatagcaatggcacattacatgaactcagctgcacacactgtttctgtttacagacaaggtttcgccatgttacccaggttggtcttgaactcctgagctcaagcaaaacacctgcctcggcctcccgaagtgcggattagaggcgtgagacaccgcacccagccaaatacatttttaaaaccctctttctctcccctaaatgctactctgcttacttctcccaaactaataaataattcgttaatatgaaaaaaaaaaaaa

SEQ ID NO: 9166 - DNA, 829 bp, Homo sapiens
  misc_feature (1)...(829): n = A,T,C or G
catcgtcgaagacacattacaaaaaattgagagagaaagttggcagctctgttctgacaggcctctgctactgaacagtgggattcttcttgacatcaaatccacaggcgcagaagacttgcgtatcctgtggtaccaaatcttcagaatcttgacttaagaaagtcacaattggtaacagagcagctacgattggtaatgangagctgttgcatattctgaaacaaattcttatttgttctacaggagcggatctgtatattaatgaagcttggttagttggattatgctggcttgtatacactcatgggcatagttctataggtttgttgatctagactcatgactatgtaaatgatgatggatgtggttttctgaatgtgttctgatgttttttagggtataagttatgttttattcttggttttatttaattggctctagtactgaatgtattataatctcatttttaatgtgcataaacttgtggtttctatataaatggagtggtgtgaagtgtacgatctttttgtgtaaggttattcggaacttatagacccaccttttatttatatcttctcgtacgtggacttttgaggcaattactgttatgttgtttattctgatatcttacttttattttactcatctttttttgtaagtataatagaggagaactacgtatgacaatatggatatagaggtgattgtacgaaggagttagctcgcatagaacgtttatatgatttcttgttagagggtatatttgaataggagcgggatgtgtgtagacatagagtgttggtgtatgttgctaaagtaagactat

SEQ ID NO: 9167 - DNA, 360 bp, Homo sapiens
  misc_feature (1)...(360): n = A,T,C or G
cctggcngtgcactcatcggataatatacgaccgcattggctgcagtggagattgttacctcttgtgatgctggtgttacacagctaaattgtgttgcactccctgttgccggagttacagtgctccagacttcaacggcgacagcacttgctttatctgcggctgaggaaccatctgcaaaccccgcaccgtcattagcagttccctcgcatgtggctcgcttggttaattttatttgcgcttttttattggggatacccgcacagtctttgaatttgagtttgaatgtttttactttggtcttggcattgatttcagaaatatatacatcaccaaaatcaacaacaaaaaaaaaaaaa

SEQ ID NO: 9168 - DNA, 852 bp, Homo sapiens
attttttataagtttttatattttaataaattttttttaaattaggcggcattttttcagttcacactttagcatttagggatcttcagagaacactttttcctgtgctttgggaaggaggattgagagacaggagggcaaaggaaggccagagagagctcgagagctttctttttcagttcagcatgtcaaagtgccatattctagggtattggtttctgagccccaacagaataaaaagaagactgtaagtgttgagtatgctgccaagaccagctgcagtgtggcaggtgctctagttcttcccactaaccttccatttttgaagcattctatttcacacaattaccatcataaaagaaaaaataacctacggtccatttggaattgtttatgttgtattgtgaaatatatccctgataggacaaactttgggttctgcctaaatgtggataaaaatctgaaactttgccttaatatttaactggtctgatgattgcgaaaaatttttgacaaacccacctccctggcttcatacatttgtaaccttgttatatacctgcactcctctacttactatctggtgtccaacggaccaccaataacatcattcacctggtattcgagtcacttgaccctttattgtttgtaattcttatttcccagtatctgggttgagttacacatacaaaaatttttagtatttctttgaatctatttccttaatttgtggtgattatcccaataccctgtttctacactgatatggtttgcaaaacacccacattctattatattagaccccacacatattttcgcctttccgtttctttttgtctatcttaggccgtg

SEQ ID NO: 9169 - DNA, 1100 bp, Homo sapiens
  misc_feature (1)...(1100): n = A,T,C or G
ctgtgcgcgccgggcttttggggtcgggtcttttgttcccgttggcggcgcttggtgggcggcaggccgtggtgctctctgtccggtggcgctggtggtattcgctgcgcgtgtcgcactggtgtgcgccttgctcggcgccgtgtttgcgcttgtcgtgcgtccctccctctgtccctgaggccggcgtcctgtcctgcccgctcctccggcgtgctccgcggtcgcgtggtcctcccgggcttgtcggtccgtgtgtgctgggcctggcccctgcgcctcggttcctcctgggtgtcgccccgccccgctgtctctggttttcccctggttttggttctcgtgctgctcgcctcgcttgtgctgtttccgttctggttggcgccgcgccgcggcgcgcgtcgctgcgattccgtctgcgttcgattcgtgcattgctgctgtggcgggctctgctcccgctctgtccccgtgcgcgtctttgttgtgttgtgtggtgtctgtggtggcttgcgcgccgtggttctttcctggggcgcgccgtatcctcttgtggtgtctcctttcgcgctgtcttcggtgtttgtgggggtcttgtggctgtcccggtgtcgcggtggggttttccccggcgcgtgtggtcttgttgcccctcttctcttttttgccccctgttgggtgtttggtcctgcgcctgttcttgtccccccggtgggggtttggcctgccgcgcgtgctttgttttgggtcttttcccttggcagaggggtgccgcctgcgctttcttttttggcccccccctctttggtctgtgtgttttcttccgcctgtgggctctttgtgtggggcgccgccttcgtcgcggggtgctctcctccttctcttgtcgttgttgtgtgtccttcgcctggctgtcgttccgtggcgctgcttcggtgctttctctcgggcgggaaacctctcccgctgccttcgtggctcctttgggttntttggtcctcgttggctaacagcggtggcgctttctccgcgccaaccctcttcttctcttgcttctctccgttccgtctgctgtcgctcctttgtcgtcgcgtggtctg

SEQ ID NO: 9170 - DNA, 635 bp, Homo sapiens
acggagtctcgttctgtcgcccaggatggagtgcagtggcgcgatctcggttcactgccagctccgcctcctgggttcacgccattctcctgcctcagcctcccgagtagctgggactacaggtgcccaccaccacgcctggctaatttttttgtatttttagtagagacagggtttcaccatgttagccaagatggtctcgatctcctgacttcgtgatccgcccgcctcgtgctcccgaagtgctgggattacaggcgtgagccaccgtgcctggcaaaaacagcctcatgttttaaaaaattatctggtctttatcatatgtcattccttcagaccctccattatgatgtcagtgaaggttatgggcatcacagcattagtagctgaagttattaattaggttcacaaaacttcaagtcaatagtttttatatcacatgtagaatgtacatgatatattagtattggtatcttttaatgaaggtgtatgttctacagtatacaaatacattacagttatattttatattatttattatattgctccatattatataccatattgggtatgtaaatatgaatgctttatacagtgataaataaacaaatggcaatgcaaaaaaaaaaaaaaaa

SEQ ID NO: 9171 - DNA, 1008 bp, Homo sapiens
  misc_feature (1)...(1008): n = A,T,C or G
cggaagcagagggcgtgagatagcggcggcccgggngtgtgnacggcctcatgtttgtacatcagtacacaggaagagacgggtgtggaagacaccaagagagcaacgcttttcatagttggatatatttttgggggaggggggtctaattataacttcttttataatacaatttnntcctctttttataatagtgtgggatttttcactgacatgtgagtaaaataaatgtgtacaatgtggggatttaaattgggaaatgggtctttcacttgggaaggttcaatccatttctcttggggggggggtgtcaatnntacaggaatccctaaaataatttaaaaaaacgaccaacttttaccctcttccctaccaaaatttattttaactttaaactttcaagaaggggggcactttcatttgagactgggctttttcttatccaggctaaaaggatnccctattttgtttatatagtggggctgggacataataattaaagaccttgttgggaggaagacaaaaaagaaaaaaaggtgggcttcgtttggccctcaacgggggagagcctttggggggccgtttcccttttaaggaggggggaaattcagtgagcctgcgcgtcactgaactcggcttgcggctgccgcacagttcgcggtgggggcgaggtgtgtgtcattcgtctcctagaggcgggggggtacgggcgcgccccccgcgagtccgggcggctaccccccgcgagaaaaccctgggcgcgcagaagcgcccgcagagggcggggacccgcggctggcgccgcgcggcgatggggtgtgtgcctagctcgccccgcccggtgtcagacaancacagaagagtggcgcgtcggggcgaggctgcgcgcggcgcgcgcgggcctgtgaactcggcgcggggcgtgcggccgtgcgacggccatcgcgcgcgccgcctccctgagcgagccccgcacccgtaacgtgacgcgacagccgcgcctgcgcc

SEQ ID NO: 9172 - DNA, 1063 bp, Homo sapiens
  misc_feature (1)...(1063): n = A,T,C or G
atgtctgttgggtgttcgtgcgcggttgngctcgctcctcctgcggcctggcgaccccctgctctggcgctgtggctgcgtgcctgcttccgggctcgtttgtttggcgccgcgtgctccgggggcttacccccgtggtcgtatcgctgcgtgtcggggagctcgcggcggtgttggcgcnctctttcccgtgtccgggcgcgctcggcggcgctgcccggctgcgctgccccgctctccgtccctctctgggctcgtctcgctttcgtgtgtgtgcgctctctgtcggccccggcggtcgctcgttgttcacctccgcgtggggtcttaggcgcgttcggccggtgggccctgtggctgcccccgcgtgcgcggtggctgcgcgcggcgctgtggcggccgcggccgtgcgcgctccgtgctggccgcgttggtgggggcttgcgcgggggggggtgtaggtcgagggtagggccggcggggtgtggcgggtaggggcgcgcgggcgggctcgcccgcgcgcgccgtgcgccctcgtgctgcgcggccgcgggcgccgtgcgcgcgtgtggggtgtntncggtctgcctccggtctggtcgggcgccgcccgccgctcttgttgcgccctgcgctcgcgccctcctctcgcctcgctctctcctctcggccgcggttcgcgttcggggtggcgtctgcgcttcctctcctctccccttcctttggtccttgttcttttgttttgtacatttgangttctctttgctttctttttcttttcgctgttcttttgtgtgttgcggttctcccccggcgcccctctgtcctcccctccggtngtctttctttccttcttttctnctcctgctcctgctcgccgtcccgcctctccgtttctcccctcgtgttctttttttttnttttttctctttctctccttccctcctccctttnctccctctcctcctccctccctccccnctttcttgttttctctcttctntaaanttctttcttttttgttttccctttaaaattatnnntcttcttnnncttnnnnnca

SEQ ID NO: 9173 - DNA, 1334 bp, Homo sapiens
  misc_feature (1)...(1334): n = A,T,C or G
gcgacgcggagtggggacagtttgtgagagagaccgagagaagaaatcgttttgatnnctnnaaaaaaaggnnncttnngnngngnaaacnngngnnngggggnggnngcggcggggggggggcggcgttcttcggggggggcggggccggcgcgggcgcgccgccggcgcggggggcgcggcgccgggggggcggcggcggcccgcgccgcgcgngcgcccgcgccccgcgcgcccgccgccgcggggcgggcggcggccgcggggccggcgccggggggcgcgcggcngcgcccggcgcgcggcccccgcgccggcggccggccgcgcgggaattcttctttcttggcgggcggcggcggcgccggcggcgggcgcgcgcnccgccgggcggcgccccgcgcccggcgccccnccgccccgcgcgccgcggcgcggcgcccccggcgcgcgccgggcggcgggggcgcggncgcccgagcgggccgcnncgggggcgagacgccgcggccgcgccgcggggccgcggcgccggngcgcgcagaggaggacgagcaccccgcgcgccgcgcggcgcggcgcgaggcccgggccgcagcgggcgcggccgcgcgcgcgcgacgacccacgangcggcaccgcgcgcgagcgccaggcaccgcgccgcgcacgcggagccgcgcccgacggcacgacgccagcgcggcgacgccgagacggacgcgcagagaacanccacaccgcacgagccaggccagacgcgnagcagcgacagcgcggaccgggcgcacnacgcgcgcacgagcgcggnggcggncngcgcgcggncgccgtcgncggcgacgacaccgncgagcgaggngacggcgcggcgcgagcgcacacncgacagcacgcgcacgncgcgccgcacgcgcagccgacgnccgcncacgacgccgcacagcgcagcagcggcagagagggaggcgagaggagcgagaggcgcagcgtcgcagnagtggggagagacacgggcggccncacnactgcgagcggcgcgcggcccgagagcgcgagccgcgcgggcggngacagagtgcgcgctcagcgngcgagtggcgctcggacggcatangcgtgctgcgcgctgcactcgncggctgcgtctagcccgaccccagctctgcgcgacgacgagacgtggcggcgcgncgcagacacacgcgcacgcgctctcgcaacgcggcacgcgctgcgcgacgcacgcgctctcgctcgctangcgcangcgtgacgatacatctctcacaaccgtgacacagccgctcgagcgagcgcgcagagcggaggcg

SEQ ID NO: 9174 - DNA, 2265 bp, Homo sapiens
  misc_feature (1)...(2265): n = A,T,C or G
gcaggacggcacacgacgaggagacgcaaagcccactggacgagcccgagcgccagacgcgaggcgcaaaagcgngagcnnccttttcttcaagggnnnnaactnanacncgnacgagagaggannccngctggnnanngagggaganananntaacaanannnggaggngnananaagagaagagagagagaanaggaaganaggcagggaaacacaagaagagaangtttttagaagngaagcggagagagagggnagagaagagnacacgacgagagagcagcgcagcagagagacgcagccgcggnancacgcgcgcaccacngacgcacgcgcacgncannggngngagagagcnancacacaggcacgcacacngagcagcgagcagacagagagacagcgaccagcgaagaggaacgagacagaccgacgcagacacgancgcngaggncagcagaagagagcgacgagagccagcggcacangaggcacacacananangaagcacacagaangnaacgacgacagcacagncagacgcgcacggacgaacacgnagacacagacagcgangacggnancncagcacagnnagnagacananagangaacgagagacgacgcgagncgtctttctgtctctgtatttacacgagacagnacagacgaccgaagggnanagacgaccggcaggacgacgcgcagagacgagcgacgcangacggnnacgncgngcgcagcacaagagacagncgagacacacngcacgcaccangcgacgacganagcaaacangacgcancngctacncgnagacgcancacgagcncgacgaagantacancgacctaccagagcaggcngcacggatagaacgactatgagcgnacancgacagatgacacagcgctgtcgcacgcgccagcaggagacgcagcagcgngangnagacgtacgtacagcaggagcacgtatagacaggacggtcgancgtaccgcgacgcacgcgnacgcagcagagcgacgcgaccgaggacgtgacgcgcggccgacggncgcaacgagcacgacgcgcngcgacggaagtcgtagagagagncgacatcnancgacgagcgacgtagatacacacgcagagcgcgngacacgagcgcagcacacctgaacgcacaccagnacgacnacgcgcacagtacgaggcntgagcgagcgacgagcgacgatacagaacgcacatcgatacgtcgaactcgacagctacgatagctatcgcagcgactanacgagacgagacgntgcgagacgcgtnacgacgcaggcgacggnnacgtacgacatacgaaagagaagtcgccggacgagtgctgatgaatangatgangcgagcgacgcagacgcgcangacggcacgcggaanacactngagncangagnagcctacgcacgtangacagagcancagcaacggcgntacgacgattgagacgcagcaganagagcgacganacgcaggacgacganacagagaactagcagagtctagtcacgaggcacaaagcatgacanacnacnacagtacnncacgcgnancaatcaccgagacacgtacgancgatgttcaacgatgnangcgtgactcangagcgtcgacagaatgagacgacgacgcgcangcagcagcgactgaacntagcgnactacgntnnagcgaaacgcgctacaggaggcagcncanacgaccatgcgcgacgnacatgtctacganactgacgatgacgacatanaggcgtcgcagcgcaccgctgagcgtcgaatgcgcatacgcacagangatgggcgagagacacgtncnggtagacgcagcacgcgtgaagagcgcgaagtaggacgnagagtgcgtcgagcacacgtgatggcagaagacagnngacgacgcacgagcgtagcgacgccgtagatagnagacgagacgacgagcgggaaagaccaccagcgagacgcanatnacgacgaagtcagacatgnagtacagntaagcagtgtncnacgcaancgtacagacgaataccagcancagancaacgacaagnacaatganaagntangatagtagcagatcancnanactganggacggangcgacgncgagcagacgacgacgtacganganagcgacggntcancgacgacgtagcgtcgacgcnggntacgcnataagcagacgaagcacgaacgtagtgactgctacgacgacngcg

SEQ ID NO: 9175 - DNA, 1642 bp, Homo sapiens
  misc_feature (1)...(1642): n = A,T,C or G
acagacaccagcaggacgagaacaacacaaaggaaggccagccacgaaagaaccccttttncgggagaaccnaggggggaggggccttgngcggggggggaaaccaccgggagaggaaagaagcggagcgagcacgagcaggagcaaccgaaccacgcgcccgaaccgcgcgccacacagcgaaaccgaagcagcccgaagacgcgcaagcggcaacacacgagagagagaagcacaacgcacgacgaccccgacgaccgcacaccagacgggcggacgggaggcgnacgcaccgcgccgcggcgcgacacggcgagaagaggaaggacgagcggcnggagaacagcggcgaaggacgccgacgcgacgaacagaaccaggagcgaggcagcccgaccgagcggagagccgtctttcccggcacgcagacacgcgcacgggacgcgaagacggaacaccgcgacggagccgcganagaagacagagcacganacgacngacaccgacagacncagacgacngcgacgcagaaccggagcaacgacgaaaggacgacgcacgagcaggcagacgacacangcaagaacgacngaaagcacgnanacaacgaacagcgaccgacgaagccncacgcaaancnacgcgcagcgcagccgaagcagncgacgacgcgagcaccggcgcgcgacgagcgncacgacagcaggaagcgagnagagacgacggcagcgacancggagncgaagancgcagcgagccaggnggnnagcagcgacgacagacgagacgagncnacacagcngngagcnagaggacagcacgaacagaaggacagaaganagcaagccgncgacgagacgagcgagcgagcngnagacggagcacnggagcngncgcgncggacgacagcagagcgcnaggagcgcgccgccgacacacncggcgcagccacgaagcnagacgagcgcaagccacganacacagcgcacangaagacagaacagaccacacaccancgacaacgagaacacgagcaccacagacagagcacggnacacgcagacgacagacgacaggangacaagcaggagagacagagacacacaggcaagcagcgcgcgcacgagcgcgcacnagagcgagccacacgcgacccgnaacgcagcacgaccacacgcacgaggaccaccaccacacgcgacgagaggcgacgcggagacacacgagcaaagacgcgcgnaanagcgacagaacaccacanagcaacgcacgcacacccgcgcgacgaagcacgacagnccggcacncnacgcgacgacgcaccgcgcgcgcacgcgcgccgcgcgccgcgcacacagnacggcgagcgacngcngcgcgacgagcggccnagncncggcgcacagagnacggagagagcgacgacgngagcaagcgacgaacacccgcagcagacgcgcagcgcgcagcngcagacgcgagagcgancgacaggagaagcgaggacaccacanagaaccgagcgagcgggaacaganaacgncacnancccgagngcacgcagagacaccgacgacagaaccgcgcgcgagcgcagnaacagaacgccaacgagcagaagagagcaaacgcgcgcgccgaa

SEQ ID NO: 9176 - DNA, 1845 bp, Homo sapiens
  misc_feature (1)...(1845): n = A,T,C or G
gaggaagcagagataanatgacgtgaagnacagaccagnagatgancagagcgagccggagcgnagnagggagnanagagagnnnnccttttaatcntggnntnaaactnnnnnnacaagcncnnannnnnnnnncctcnnnnnnnnnngcnncncngantaancnnnnnncgncgcngcnacngnnnnncgnnnnngnnnactgcggnncgngnacgaacgcggncgccagacgtttttggagcgagaagcaaagannaccacgcacngngcgnacacgncagcagacgancacngcgcaccagccgcngcgcacgccgacaccncngcagcgcggcanccgacacagancgcgacaagcgngcacagagcgancggaagagngacacgacgcgcgcgncggcaccgcggcgngaagngcagagngacgaacacgaagaccngacagcnaggcgaagcagcagacgacgacaaccacgccngccgacgcgncgcancagacgagcgacgcgacgngagagcgcngagacacaccgcgacgcccanccancncgcncgcgcgcagagcagngcgaancangaaacacaatttctcnncttacttatatctacgcgcancagcacgacggagcgccacacagcganaagagcagcgacgacggcagcagaccgaacnacgcgngccagcgggnacnacanacgccacacgggcanggcacccaagcncgcaacacgcgcgctcgccancgcgaagcgaacagcagcgaacacnagcgaacgcgngacgcagacaacgcgancagacgcagcgcggcgacgacgcgcaagagncggcgccacacgacacgagacagcgcaaggcacagacggaagcccggngcacggagncagcggcagcncngnancggacggcgccgcagcncacacgagcgagcggcacgagagagcacgcacgaccgcacgcncgcaccgccgcgaccacgncagcgaggcagcgancgacgacgacacgcgacgcacacngcaagcgcaagaacnacgtaccgacgcgcagccgacgcgaccaccccgnacacgcggcagcgctgcgcacgcggnacgagagcacaaagcagcgagcgccacgacagagcaatgcgtacgntcacgacgagtatgcagtagcactcacggcaagacacagagagnagacactcgacagaggacanacagacacgatagacgcggcgcgagcgtgcgcgcggcacgtacgcantgccgcganactctgagagcgagcatcgcgtagcgctngntctagantacgcacatgcgcactcagtcggaccagaacgacgccgacgtcgtgantntcgacacaccggcagcacgtgcgtactgcgtcgaggtgcggcacgtgccgcagcgcagtcagactatgcgaaccgtcagcgcgtcaatnagcggcgcggacatgcatggcacacgagagtcatgcangaangagtactgatcntgcgtcagtacgcgagcacgantccngacanancgacgtcgcgcaggatacanagactcncgtgaacgaactagtntcgcacgaatgacgtcncgcacgngacgcgangcgcagcgangacccgcacgacgcggcncgcgtcgcgagcagccgacgcatcgacgtgtcgcggcatagcatcaacgactcacgancgtgcgacgaacgcgacagcagcggcagcgcggtcacgcgtgcagagtcgcngcggagggaacgangcgtctagcgtagacgcctgcacagtcgagcgaccgcagcgcgtncgactgtcactatacgacncngaagcgacnctgcgcagcgcatcg

SEQ ID NO: 9177 - DNA, 1272 bp, Homo sapiens
  misc_feature (1)...(1272): n = A,T,C or G
ataagtacatgatactcactctcataagatacatcctactagcncactacttcacgaacacatacactagtgagtgagagtagaacgacgcnatanagtgagtacngaatnacatnagcatatatcaagcgttatagataggacacacatctactatgtagtgnanagcgatatgtactaaaaatacgtatgnctgtcgagataactatattagcacgagaatataccactgaatgcatagntgtaccgacttctagcngtgagtcactacgcggtacagacacaaatcactatgcatgtgggacgaagtcgacatttngcacctacagtataacagattcgactatatatatatacacaagactatagataattaaacananttatagaaagatggaaataagttgttatatgtattangctgagattgaaaaagcacatggcagacgctcagtatggtaagagaaatgactgtggttagatacgttnaaaatcgataacatctaaacagngcaaccaaaaaacgattatgatatagcgagaatcacattaggaatacacagctaaatacatgcaagttattagtgaatattatgaagaaacgacacggtacgattaacatagagaggaagtaatattgtgaaaagtaagaaaatactatgaatgcaacaaacaaagaatatcaagaaagaaacgataagcggcaacagcaacatccactttgacacatgagagacgtagaaagaacgacacacgccatcatcaagtagaaaacatgatagaaacacgaagatcggggaactatcgatcgttactcttcatacgctaaattagagaatcngatcaattgaacattaatgcaatgacttgacaatggtgggcgaaaatactatttcatgtgaaatcacttacggcacacataaatggtcgaaaaaaaaaagagaaagaacaataaataaggataatgaaaaataaaaattaaaagaaaaaatgataggtaagtgaattctacatacaatagaatgtattaaaatatttgntttcttgttgtctttctttgcgtgttggcctgggtcctctagtcgcttcgggggcgccggcctggtgtgcgtgcgcggggcccaccctccgtntcttcctctctnngcccgcttctttctnccccacccctctcnnnccacccctctctcccttncccnnccccntccncnnnnntggttatctcccctttcacaaanttnccttctttnttngttttcccccnnncaggna

SEQ ID NO: 9178 - DNA, 1324 bp, Homo sapiens
  misc_feature (1)...(1324): n = A,T,C or G
agaagggaggggaaggggaaggcgagggggaaaaaaagaactaataagagacnaaaaaaaggggcctccggngncgnaaacnngggggggggcggcgcggcgcggcncggcggccggcgctcccggcccnacgcgaacggcagcaaacaccccccaacacgagaacggagaaccgaaccaggagagagccgcagacacaagcgcaagagagaggcgacagggaacagcacccgccagcgagaggcggaaagagacagaggcagagaaaggaacgaacgaaaacacaacagcaaggaagagaggaagatttttaaacgcggagcgcgggccagcgagggaccaaagcccacaaagaagagccccgcggacaggaacctggacgaaccaagcgaaggacggtgaaaagaaagagaacagaaaccgcagaacaaacagggacacaaaacaaagaacacaagaatgagaagagagaagacgagtagagagaagcgacggagnggtcgagagaggagaaaangaggccgaccaccggccaaccacaaagccgtgcgcggcacaagcagaaaagaaagaggatggccagnagaagacgcgacggagtacgacgacaggtcctcagaagaacgacgaagccgcagagaggaccanacagagacgcacngcacatcgacgcgagcacaccacgcgtcgaaaggaagagaagagagacgagagagaatgcacgaggagacaggtgacagctncnaacgtaggcagcagtatanatcaagtcgcgtcgacgcagtacacgaatacgttcgcgcagcgacgaaggatgtaatgaattcncacgagcgagaactgtgagcaagacggcacgagcgagcgcagacacccgtacccgagcganagtgacgcgagcatacntgtngcgagtaagatacaacgcgcgagcacaggtacangatgaacgatagacacagtactatagacagcaagagcatatcaccgannacacgcgagtagacgacatanacgcgagacngcgacgcagacgngacgtcnctcacgacncnctgatgagtacgangcncgacgcggagaacagcgtgcgatgcagagcacacgcgcngacatgagcagcgaggagtgatcgatagagantatacgacgagcacagatcncgacagtacgtcagtatcaaatactgcaggaanacgctcgcncantatatgagcgcgctaanatgagagaggatgacgcacatcacgaacaggtgatgcacgcagagacatgtagcggacnatgatgcaaatgtagatgancgccngagcgcgtacgtgag

SEQ ID NO: 9179 - DNA, 1811 bp, Homo sapiens
  misc_feature (1)...(1811): n = A,T,C or G
ggagagaagggaagggaagggaagcagctacaacgacgcaacgagaaagaaaaaagcccccgggtacaggtgaaccnnnagnccaananncncgtcnnnanggggnnantatcnagannannaganaaggannaagaggagacgcgaagacgacgcagacgcttacgaaagaacaacacgaaacagacacaaccgcgcacgaacgccgagaacccgcgaagagaagagaagagagagagagaaggagaagcacgaccggcccgcccgcgagcaacagaagagccgcgaggcaaaacagcaggggacggcggcgacagaaggcgcacaagcgaggagagaggaggcggcgacgagccgcggcacgccgangaagaagagcgcgacacaggagacgcgacacgaggcacggacgacggcacgaaaagtactttttcttnatggaagcgggcggcncagcgcgcagagnagcagagccgcgaggagacgcanacgaccacaagacaggcgcaacangacagaacgaggcgcngccacacgcagacgacaagagacgagaccgcagagcnacgggancaangaggnccgacaagaagcagacgacgcgcgcgagagcacanacacgagagcgacagacacgaagaagagcgagagcgcgagcacggacacgagnaggagncngacggagacacgggcacaacacncacagagcaaanagcaacancccacaggagngacacgagcagcacaccagagacagacgagagagagaacancaacaccacatagacaacgcgagagagcacgaaacgagagacgcacagcaaganaggagcacagagacagacaagacaaggacgagagnaganangaggagacgagacacagcngcgcancacggcgcaagcgngcgancgcaacacaggagacagagcgtancgtacgcacgcacacgagngagcgactagaccncgagacacagcgagcnagcgatagcgatgcacgatgacagancntgntgagcgaagactacgtaaagaggangacgagagaccaacgagcacgtcgcgcaccgacgcaaacagcacgacgcatgcagagnagagcgacgaagacgtcaggagagacacacgacggagcngcnaagcgacagcntcggcgcagcaggcnacgnagacacaacacgacgaacgacaggtagacgcacnacgacacacgacacgaaacgcaatacgcagcgcacgacgcagagcacgcagcgaaacgagcacgacgcatcgaggcacgagagagacncgncgcgcacgngcgagacgcatgcgagancgcacancgtgcgagcgagngacgtcgcagctgcagcangcgacgaccagacaannaacacacacgtcatgtatcgagagngcacagagcagagatagagagactcngcgctgactacacgactgacgaaaacgnanacgacgacgcgacaacgangacacagcacgagacancgtagcacacagacaccagcaggagagaacgtacgagagagcagtancgnacgcngnacncaggcgcatgacgangancggcagagcgacgagcgcaacgcagacgacagcgncaaangaagggnnncacacagagagagcagangtgcagagagcatnagncgnacgacgaaacgtacgaccagcacagancagaacgagngcngatcgaggngaaaggaggagcaggagcagcattacgngcagntagaacgatgctangnagtcgcagcgagcagacgacgangacgcgntagnagcagacgagcgtactga

SEQ ID NO: 9180 - DNA, 985 bp, Homo sapiens
  misc_feature (1)...(985): n = A,T,C or G
gaattttgagtatattcaatcatcttatttaaagtaaaacagaagaacctttgaaaggnaacaaaggcggcaccttcaggaaaagaaacaacaagggaaaacgatgagaggagccccagagagaagacggccaccgagagcgaaagggaagcaccctcaagccaagaaaacacagcaagagccaacacacacacaaaagcacgcaggcaggacaaggagaggaccagacgacctcgcgaccgaccatacagacacagcagagacgcagaaagacacacacaggagcacaggactttttattacatgtacaggatgcaatggcaactaatatttctagtttgctcttgaccgtggttattaacttagtaatttatgtcacgacatacctgttataaaaacatttatatgattttattctctatattaagatactataatgtaattaataacctttacacttctcaatagtagtagattccccttaccggtatatctccgtacacattcctgaatcgtattactctttcctctctctctcgatgtacactatgtattgtccattagcagtaagttagcatctcgtacccatatctagagacatctagctttattacttttttcttatatataaatacatttttagtttaataatattatatttgcgttcattattataaaatcactagttatcaattataaataatttaatatcattcatttttttttctccctcccactatattactcgtgttctactagtagtttaaaatagatgatcattctacttctcggtgatctctatactttaatatacttttttattttataggattccactctcaattatttatttttcttactatcacataggtattgttccctgcatcatatatattattttatatttagacatgcatagtaatatctaagtaatttatattctttattccttcgctacgtatactatctgttttactacttaatg

SEQ ID NO: 9181 - DNA, 1534 bp, Homo sapiens
  misc_feature (1)...(1534): n = A,T,C or G
ccggagccgcgtgtgcggcgttgtcgagtgtgtacgcaacacgaggaggananagaaaagaagttcgtttntntgttaaaactnnngnncaaaangngngcnnccttgnccnnnngnnnngnncatcnnngnngnggngnggngnnnggcgnnggcgngcgngcgggaggcggagcgggagcgnctttttgcngngcagcggaggggcgcgcgcnagccgcgagaggcncggcgcgcgcgcacgcgaccgcccagccagaggcacaccgaagcgagcagcnacgacacncgacggaagacgcgagcngccagaacgcgccgcgacgccggcggcgcgcgcaccggccagcacgagccgccgccagcgcgacgccacngcggcggcacgcacgcgcgcgcnacgagcacacaccagcaggagcgcacaggacgancaccgcancgcgcggacgacggacgngttttcttttttttagaaaaggccgcgcgaccgccggcgacccaggaggcgaccaggacgcnccgcggacgagcgaacgacggcggggagagacacggacgccgancgcgcgagacgaggcacgcggagcacgcgccgccagcagaccacgacaacgagcacggaggagcagccgggagaagcgcaggcgcgagcgcgggcggacacgacgcccgccgacgagcncgagcgcgcagnacacgncgacagcgggcgnagacgccacgacgcccgagagacaggcgacgcgcgctacgggcggcgcgcagcggnagccgcgcagaagcggcgagagacgcgcgcaacgacagcgcgagccgcgnccgngcgcgcgnacgacgccggagccgccagcacgaccgccggcgnagcgagagcagagagtgcgccacagcgngagaagacgccgcccagcgcgacgccccacacgccaagcgacgagngncgccacgcgcgcgcacgcgaggcgcgcgcgcgcggaggcngcgagagcgcagagcgcgccagcnccngcgcgacagccgaccgngcgaacaggcgcgcgcgacagcncgaaccagacgcgcnacacgaacgacancgagagncacanacgcacgcggcgagcgctggacncatacggagctgcgacgngagacgggcagaggtgggtcgtcgtagctctacnggagtctgtccgcactctctggnagtgttgcgacgtggtctggcttcgtatcgtttgcatgtctccgtcgttatgcgcgcggtgtctcggtctncgccntgcttcgactctgtntggtgtcgcaagngtgttctgtcggttcctatagtcctgtatctactgtctcttagagtcatttcgctgtgtgcatcgtcgtctatcggtgaatcagagtagagcgacgtgnttgtgaggtggtttgcaggtgcgctcgcgttggtgagtgtgcacgtcgcagaatgcgctgctgccgcgcggtcgttcgcgncatgacgagtcggtgtgtagcgtgacatcggcgcgcgaatgtganacgccggacgagagta

SEQ ID NO: 9182 - DNA, 1390 bp, Homo sapiens
  misc_feature (1)...(1390): n = A,T,C or G
agccgagaagtacacgataataaaggaggaaagcacggggacctaagggggaacaaggggaagagcttacggagagaaaatccgaactcagaccgccgccgagaaagaaaaggaaggtcccacaacaagaagtcacgagccaggcgacgaacaagagtgcgtacagagaggccaccggcggggccgacggagagcgaggccgcgcgcggccgccccgccgaccacacgtcacggagtggtgtaaggaacgcaccagaaggcgcggcgtgagcgccgcgcgtagagcggcgcgcgtcagatggtagatcgaagacgacacacagcgcacgagagagcagcgaaacgcacgagtatttatcgcacatgacaaanagaagacagcatagagagctgcatcgcatgagatgatagacgacggatcagcgtgacgacgagagaatcgtagttgatcgttgcgagcgagtgactcgacgacgacgtcgatcgcggacgaggagccagnacacacgaaccaagccgacacgcagcacggcgtcgctcgacctgcagaacgcgcagacagagtcggtagagcactctcgcgtgcgcgntcgcagccgcgacgacaatcacgcgacacgagaagcggcgccccgtcaccagtctcaaagccgaaccacacacgcacgcagacacgacaagtcgatcgtcctagtgcanagaacagctacgtgaccataggcgcgcgacgagccgcagcggactgcacagagcacgnggcggacgagactgatagngactgccncacggcgcagcgacctacgcgagncaacagtacgtatcgccggcagtgcttatcgacatagtgatacacgcgcgagatgcgccgagtcgcagccgtctccgcgactcctcgcatcagatatgacatanatgagacgtggaatagagatgacgacagtgcaacgacatgcgcatgagagtacgcacggagcagccgagatagataaagcgagactcgtccnacacacacacgtatagtactgntgcgcgcgtataggtcgacagcgcgcgcaccaccagactcggcgttgcgcgccacggacgcngagcgcngcgagatagaagcgaatgtatgagttgatagccgcgccatcgcgcacccgagacacagacgaccgaaagaagatgcaaagacaatctggcacggcgccgaacacagcaacgaacacgaatgtagtcgtccgacgcgcgctgacatacaccgcaccgcgcgngccgcgactccgcgcggaagcgcctangacaccacgcccgtgacataganactgaatatataatagaccgcaacccggacaacgagcagaaccacgacgagccagagttagaagaacacagcacggcgagcccg

SEQ ID NO: 9183 - DNA, 1616 bp, Homo sapiens
  misc_feature (1)...(1616): n = A,T,C or G
agcttgcagaagatcgccaacgcactgccatgatttccatccgtgacggtcatgtatggactttcgatggatgcacacgcatgggagcgctttttggtgagaccgaggtgtagtctcgcgagtagcatttctatctagttcgtgcatctcactgcaggccaggatgagatcancgcggtctccgtcgtcagtattatcatagctcacagtagatgtatggtagggcagtacntggaggcccgtcatggaagaagaccgctctcgccgggtatattccgtatgcagtcactcgaacgccggttgtacaggccatggtatatatgcaagtatcgtacgcggcgcatagtagctgtgctggcgggcgctggtcgtggatgccacttagtgcgcgcnctatgctgtgagatagtaggttgtganagtatgatagtcgagcgctatgcgcatatctccaagttacttcacctaagtcaggcgcgcggcggcggccacgcncgcgttgctcgangataggttcgctctgaagagataggcgatagtctcccacgtcacgacatagtcgtgaccgctgcggctgcgcgcattcgtcagtcanatcgcgacangtancatccgaatagctntacgcgcanctacgcgacgtcggagacaatgctctcgcgtagtgacttcacggcgacgtgcagctgtagatgtgtctgtcgcgcgttccttaataccggatgcaacgcgtctagtncagcagtgtatatgacgcaatgagtcaatgtgtctacgagtaatagagtcagnacgcgatcgtgtcgatagagtacatgagtcatcatagntcgaccacgcgagacaatacgatggattatgtatatagatatatatagtatatcgatagtacgagctcgataagatcgagcgcgcagcgagcgtctatatctaatcgatcgcgcgtatgagatgcagtgagtgagcgtcgctgcatattgagagacgtacgatnggctgaatgcgcggatcgagtgagtcgagcgtagacgctagcngtcgtataatgctagtgtgtgcgcgatcgaccgaacacgagtccgtaatgatatgagtagtgactctatgagtgcagagtcgcgctcgcccacaagactangtcagcggacgtgcgtatgatgaggcgctgcacgtggaacaacgctgcggctagacgtggagnccgaccgttagtcgttaatcgcangtgagaagtgtcgcgatgctccagtggatatggtnagagatgggctagtctcaagcgctctggctntgagattggtgatgcgccgtgatagagtatttgctcgactgtcgagcgactcatatatctcgancagcgtngcagtgtgcgaatgcagctgaccagcgatgcgttgtgatcgtctagcgcgacgtgagctcgntatnatgatataatcgagagagnangagacgagcnagtgccagtcgaatcgacggcntctctcatcactcatctgtcgacgatcgcngtacgtgntgtacggcgcgtactaagtntgagtacantcagatgaggatcgcgcntgcgtatagtgtgcatcgagcactgcacgctgtgtgcggtgtctacacca

SEQ ID NO: 9184 - DNA, 1005 bp, Homo sapiens
  misc_feature (1)...(1005): n = A,T,C or G
gaataagcaccgcgcaaccgaagaggaggagagggggggggggtcttgtagtngaaggggggggggcttgnggagcggaaacancagcgagagagacggcccaagaagaggaaagggttacggaggcagacaagaaaccgcggcaccncagaacggagcaagaaagaacaacgaccgcgggaaaacgaaaagcgcagaggcagggacgccgcgaggcggcgaacaacagaaaacgggacccggaagccggcaccccgaggacaaaaggagccaacaacgcagagaagagggcggagcagtttttttcgcggcggggggcggaggcgaacaccacacagcacaaggcgagagaacggagaccgagcggcgccccccaggacgcaaagggcgaggccgccaccgagcgccggcggggggcagaaaggaccacgccgggagacgggccaggcacccccccggcgccggcgcaggcacgcccacgcgcgcgcggacgagccacgaccccgcgccggccagcgcacggacaaaccgccgacgccggcgcagcacagaaagcccgcggagggcggcggccaaaacgcgcgccagcacacgacggagagagaagccagcacccgagcgccggcgggcgtgaagggcggacgggagcggcagaacnggaccgcgacacggcgacgagagcccaccaaggacgacggccggccggcggacccacgacaggtggaggggtgcgcgcgcgacgcggagcccagagccagaggagcgtacgccgngaaagcaggaggaggagacgcgcaggcccgcccgcgcgccgcgcaggcctgaatgagggacgcgacgancgcgggagcacgcacagcaacgcaagcgcgaggcgaggaggcgccggacacacgcacgcagctggacaccgccagaacgcgccgcacgcagacgcagagaaacaccgcgaggccagcgaaccgccgcgcaccgcgaaggaagagccgacgcaacccgccgccc

SEQ ID NO: 9185 - DNA, 547 bp, Homo sapiens
  misc_feature (1)...(547): n = A,T,C or G
tggctcgtttagtgggcgaccgtggggggggggggggggggggttcaggcttcccttcaaatttaatggacattttgaggcttgtcaacgtctacaaaagtgtactggaattttnattggggggatgggggatcactggatcaatttttggagaactgacaactcgacaatattgagtgtgtaggtttatatatgtgatatagctctccatgtatttagatttttagtttccctccacaatcttttatagttttaattaaacaaattgcacacatagggggggggaatgtatccctaggtattttatttttaatgctattgtaaatgctattgggctttttaaaaaatcgtttcaatttttctgttgtttttgttaaatataaaaatgcaaataattcgggttcatagaccttatatctggaaacgttgctaaatgtatttttttattccattagctcttttgcttattccttactattttgtttgggggcaggcttgcatttacaaataaacagttttactccttttgaccctaaaaaaaaaaaaa

SEQ ID NO: 9186 - DNA, 1341 bp, Homo sapiens
  misc_feature (1)...(1341): n = A,T,C or G
gcgtcgtgacggagggcaggccccgcgtttatgagcgcgcagccggagcaggagctcgtaatgatntactaaaagcgcgagccctgngggggggngaatcnggggggcgcgcgcggnggcgcgcngaacggcgcacggccagctttcaggcccacgccgcgcgggacgccgggcccccggccngcagccggcgcgccggggcgggaatcgacgcgccgcgccggcgcggagagacgcggcgacagcccaccncaccggcgcgtcgcgcggcgaagcaaccgacgcgcacgcgagagctacagaggaacacgcgggacacgcgaagacgccgcgccgccacccgccgcccgcccgcacgcgcgccgagcgcgcgaggcgatttttgtttagtctcggacgatggcggcgccggaggcggangacgcgacgacgcacaggcggcgcgaccgcgaacgaacacccgggggccgaagcacatggtagcaccctgctcttttccggttgtctgcgtgttgcgtgtgcgcgctcgcgcgagatcgtggctcgtcctgcgtcgcgcctacgtcgccgcagacgcgggctgcgcgcgtgtctcgctgtgctggtctcaccctagtgttctcgcctctctcctcccgccgcgcgtcctcttagccgcttctcgcgtcgtctctctctcctgccacttgtgcactcgcagtctgcggcagtcagtgtgatgtcatatatcggntgacgctagtcgncgtgtctcgtgttgtgatctttcgctgtacngagtgtttgttgcgtctgtcgccacttcacagcccgtacgtgncgtacctgacgtatcgtgctcntctgcgacgtcacactgctcagcgtgcgcgcacgagaccgtaggtgtcgntccaccgtagctcgtcgtctatcagtagcatccgtggnctgtcgcgtacgcgcccgcgctgccgttcaccttgctccgctctcgctcgcgctctcgcgcgccgcgncccttgctaggcgggtagagtctatgcgtctatggctgtgcaggcgtatgtgcgncgcgctgttgagtgctgctgctgatcgctgtcgcgtagggcgctgtgttgagagtgtgcgaggctgtgggtgtgtctcagtactcgtcttcgtgatgtttcatcgtgtgatttagactggtggctcgcgcgtgcgatgcttagtgactgacgatagtcngtctgctctgcnagacacttcgctgctgcnacggcgtgcgtatgtcgctgttcgtgcgctcacggtcctctggtcttctcgtgactatcactcgtgacttcgccattcacatctcctctcctactgcta

SEQ ID NO: 9187 - DNA, 1377 bp, Homo sapiens
  misc_feature (1)...(1377): n = A,T,C or G
aggagaaaagacacgaacgagggaggcgaaacccaacacacaaaggaggggaggggaaaggagaaaaaanaangccctggnntnntggggnngacctnncccccnccnngnnggcctgnggnngnggnggananaacccncangngcgngnggagnnnggaggggnggagaagaggngngngnggagaggtctttannaaaaagaggggggggggaaaggccccnagaaaganaaaaaaagaaaggaagagaaagaaaggggagaagagagagagaagaaggagagaggaggaggagcgggagagcgcgacaagcaccacgacagaaagcacacggacaccggaggcgcaggccggcagggaccagcagacgagcgggcagcgcgagcgcgcagagggcggaacgcgacgcgacgacggaagacgagaggagagagcgggcgagagacgaaaagcagagggagctttgtttcttgtgagagagggggaggggaggagcagagaccaacgagggaccgncgacgcgggaagaaggagagggacagggnagaacaaccgaaaacaggaggagcgaaggaccgaggacagcgcagggaggagagccgccgaccggcatcacncgagcgagacgagcgcacgaacagcgcaggagaggcgggctcaaaggcgaagagcacgagacacgcaggacccacaaggagaggcagacgaggagaagaacgggggagaacaagaccgaaggagagccagaggagacgagcagaaggacagacggagaggacgcgcacgacggagcggggggacgtgaccaggaaggagagcaacagaacgagtctcgcgcacgcacagaggcgcgcagacgggaggaggagaggaggagcagggcgacggcgaagaagaaagagacaccacgaacccgacgagcgcgcgcacgcgcccaaggccaacagcaacaacgacaggccggagaggacgcagagaagagcagaggcagaaggggcgcgagggaaagggaagaggggcgagcggagaggcagaagcacgcaggccaggaacagagcagcgcagcagggatcgagacgcagcgcgagggagaacgggaggcggggggaaagagacggaaagagaaacgcgacggggcaggaggacagagcggcatgagaggaacgcgacgagcgaggtagggagggcggagacgaagagcgccgcgggganagaagaacaagagaagaagagacgacaaggagagaagaangaaggcaaagagacggcagggaagagaggcggcgggaggaggacgcaggagacaaagacacgaagagaccccaaggagaatgaggagaatgacacagcgagaaccagaaagagcagaaggaag

SEQ ID NO: 9188 - DNA, 1533 bp, Homo sapiens
  misc_feature (1)...(1533): n = A,T,C or G
gacgtagataaatgttagtgagagcagacgactataatatcacacagcgagcgaaacagaaaaaaaaacgncctttagtaaagatgnaacntnagaaagcccganacnnngctggnngngngnggacgaaatcnnnangnggcgnaaacaggagacggacaggcgaagacgagagcacagccaacacaattttcaacaagacacagaaacaacacaggaagaccacgacagacagcgcacaaagaacacgcgaaagccgcgacgcacgaagagcgcaagacgcgaggaagacaggagagggacangacacgcaagggacgcagacgacgagcaacgcgcgacgagcacagcgcacagcacacagcagcgaggcgncgcngacgagcacanagncgcgcaggcgcgcgcgcacgcaccacgcgcncgccgcacgccaccgcgcacacgtcaacaccagcgcacnccagcgccagcacactattttttttataacagcgacacacggatcgacgaagcaagcagcaggcagacgngcacaagcgtacgcacgcctgatgactgatgagagagnaaagagaagatgaagagatgagcacaancgtcagatagataacgcacgagtactacatagtcgacgcagactacactacgatcaacatatcgcactcgcacacaccgacacatctcagacactagcgaactaacnaaccacgcgagacaggagtacgcagcgcatacagtanggcgcagatgggagagagcgagtgataggtagacgagcaacgcaagcgcgatacgacgcgctcagatatatcgcgtgacggcgcattacgcgacantagcgctcagtaaacagcgcgaacatacgtcgacacacactcgacagtcacacaagttcgacctcgcagcactgagacgcatacagcgacaggattcacagaacacacagtcacagcgtctgcagctaacgatgctctacgcgacgtatataaacatgacgacatatccaagcgtccctntacacgcatcgagagagagaagatcttcgacagaaaangantgaaaggataaagacatatgcgctgccagcgtatacgacgagacgcgcgtgatcaacacgcccgttcagtcgcacactcacacccatcatnagatccgagagagagcacatcatatctaggcgaatgagatggctgacgaccaccaccgaagccggcntgaacagaacgtcaaccatacaacagcagcacatacgattacatgtctagtcggattcgaggacgcatgntcactcccgctctcgaccgtctctctcacagttagcacgcacacaacgtngaatagtcattcgaaatagtcgangagacagagtacgatcagtgacgcatgagtagangacgctagtacacgagagaatagactncagcacgtcgtgactgtatacttcgcacgtncgagcgcagatgagataatcaacatagtagactnagcattggctnatagacagactgcacgagcggacanacgtggtca

SEQ ID NO: 9189 - DNA, 1395 bp, Homo sapiens
  misc_feature (1)...(1395): n = A,T,C or G
gtggacaaggatagtggtgatggcaagcagtacctaactcacacaaacgaagangctccgtgcatgtgggagaacncaacaggcaggggacgggtgcgccgggggcagcgacccactgcccaaaagtgactccccacatctctcgctatatccgcgaaactctttttcacagaaacacaggggcacagtcaccaaaatttccagcgctcacgcgcagtggttctcggatctgtcnctggaagaggcgaacttcacacactcatccgctattaataaccacctcagttctccatctatcagcgatacctcccagctactgatcgtgctacgacctacgcgnccacgacgagcatacacacgagctgtcgtactgacgtcacgcgagcgcatcgtaaggtatattncttttattttgactcaagtcgcgcacatctaacgtgagccaagtaccgaggcactccgaagtcagtgtnctctcaatgtcaactggaacatagtnncactcaacatactctcatagagtcagtgaccgcaagtcccactctatacgctaagtgcgcgagcagcgcgcaagtaacaccatcgaggtaatagatcgcgatacactctaatgctaataatatctagtccactgacaccgagttgacactaccaggatcgttcgccgtccgtactatggcgatcantcacagacttntcccgtgagtnagtcttgcttccgcctcataggcaggtanttccgtctcgcgnnccctgcatcgccnaccgctcgctctctcacgagtctcgtgcgatgacgtgtacgaggatctggtttatcgtgagtggtcttctagtgagccggacggtgaccgagcccacgaggtgtgacgnacggtgtctagatccagtaccaacgaaccagcgtgcaganagcgcggcctcacggncacgcgtatgcncctcagtcgtaggactcgcaggggtncagagagggcgcgccagcgacagtccacacgtcaccaccgcatctacgatagcacacatcgatcatgccgagactccgctacatgtgacgcnnaccagtagaccacgcacngcgatgtatcagatcccaagctatattagattcgctgtgcacatcataactnttntntgnggatgtgagatagtactcactagtatcacgatatgagatatggctcnnacgaacgtatgagtagcgacacatgagaggnnatgagtggagcaattagtntgagagaacataattatagagatatnntatagcatntngttagcagtatatataatgagtntntatatgtgtcgagtgtgtaaatgactctatcatacgcaagataaggtannnctcagagacttctcacagagagagaccgcancgtgacactacgt

SEQ ID NO: 9190 - DNA, 277 bp, Homo sapiens
cctagaacgcgacagtggaatattagtttcctcattaaaatctctcctcagtaccattgggaacaacgatcatcccacattggtacgtgcattgtttcctatcaaacggatgtgtacaaattatgtgtgcaaatacttcttactgtccagtggttctctctcactggattttgatatactgaagaggtgcaatctatgatggagagttgtatgctaattgttactagtaattaaatacaggagggttcctctgccttgtcatttaaaaaaaaaaaaa

SEQ ID NO: 9191 - DNA, 1567 bp, Homo sapiens
  misc_feature (1)...(1567): n = A,T,C or G
ttttaaataagtatagttagtaaatatgttnnctatatacagcgaagaaaggcgcggtaaaacggagagacncanaaagaaaagacggctttccangagtgaaaacagaagaggataacgtatcaccgagacgcccgtatcaagtggcactatttccgttctcgatctttcacatgatatatgattccacagtgcnaactgcacgtctccgtgtctactttccgactaagtatgaagtgtccatgtgggacatgatgtaccagctgatgctctgtgtctcctcattacgttatatgtgatgcagtcatcgagagtgagagtaggttgtgggaatgaatcgcgacctgaacgacgcacgttttctggtatctcatagcgtaggtcgagatcgtcgcgatgtatcttattgattactccaccttcactcactcacaccgctctgcgtcggatctcgtactgtnnnctctaatcgattcggcgccgctgagatcctgtgtctcatgtctgncntcntatcagtgtctcgctatagctgtnagtgttcagtcatgttctcattctcgtctactctctcntcattgatctcagctgcaagaacatcntaccagcgccacgtattacatctagtctgaactaccgtgtgacatagtgaactcgtanatctgtgagtatcttcattacgctcgctactctgttcacatatatcgtacgngtatcgtgccgatacgcacgcgctntcacagtaatagtgtcgatgtgctcgtactgtgntatagcgtctactgantagatgtagttggtgaactctgtatgacttntgctattgtgtattacttctacgtcgtgtctatctctacgtatcgtgtntatagttgtnatgtgtgcgctgtgtgctctcncactatagtcgtcgttactgtgtagagttatagcgcatcgtgcgatcagttnatgacttctgacanacgcnctatataatatacatacacgtnctcatacatatcattattatanactcacatagtagaacatatnatganagaagatgagccncagatagcgagtagatactgcgagtgcanncganagtgaggaatgatagtcacagcatgtcgctcttgtacgcncgccgacgtgtgatgtgtcgcnacctagtatcttgtatgatagcgcatcgactctcagcataatnctgctctcgattgtgtataggtctcttcgttcactaattanacgctaatatatggatgctctatcacgagctgctgacgtacgcgtctagtctattcacagtgctcganatcgatncgggtgtagtgtgatagtgcacacgctcnncgagtgcttgactgatgtcgatacatatagtgcntacactagagctgtatacggtnctattcatgagagtgaattcgatgtgcnacatattaagctctnatgatagcatcttgagcttctcnctgcatatactgacatgtacatcagcgctncancgtaagtantagtacactgtctcacttcgtatgatctgctatacgcgtatatgtatctcagtctacgaggagtg

SEQ ID NO: 9192 - DNA, 370 bp, Homo sapiens
cctagggaataccttggcaagcagttccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaaaaaaaaaaaa

SEQ ID NO: 9193 - DNA, 1746 bp, Homo sapiens
  misc_feature (1)...(1746): n = A,T,C or G
cgacagcacaggcaggatatgagacgagacagacacacacacagacatagacagagatgacagcgaaagacgaggagagngaaaggacaacccnnccttttngnncnaggnntngnnaactnnnnangcngcnccncnnangggcncncgctgnnnnnnnngnnggnngnagagantaaccannnagngnnggcganagcagngagnngggnggcangnngggagngnngggggacgcgcagcgggggcagcgcgccggcttctnacgagcgcagcgagcacgagcgacacgcagagaagagnccgagagcgcgngcaggnangccgacacangcaccgagagcagcagccacngacaancacacagcacgagggcgncagcgacgaggcaagcgacggggagngcagagcagcnangcggcgagcggacggcgcgcacgccgcaagcagccgcaccgacagacagccacggagaaacgnccgncgcgagcacgcccgccagagcnacacaacgaagcgcagagccangaccgcgaagacgaacagacggcacggaggagcgacgacggacgacagacacngcacacgcacacgagcngaccgcggcacnnancaagcagaatctcttttcttctttacgagcgcgacgcacagcccgacgcggcgaggaggcaagcggcacgcagaggcgacagcagcacacagcggagaggcacacagggcgaggcggcaacaagaaggaccgcgcaggccaagaccggcgccgaagacacaggagccgacgccccggcgggggcagagcggcgacggaggacaagcacccgccagagacccacacggcacagcagagacggncgcgcacagaggcanaggcacaaagagcagcangcccgagcgaacacaaccgcaagacangncggngcgaagaccacagagcagagcagagcgcggccaagacggaggncacgcgcccgaggacacacgaacagagaggcgncagcagagcagagncgagcnagaccacgacaggaagacgcgagngcagcgcgagcgtaggcgcgagaganagcggcgcggcgacagcggagcagccgagcanacacacaggacaaggagacgcgcaaggagcaggaggcagagcgacggacgagcgaacagacgcccngnancgaagacgcngcgagacgcacgagacgacggcgcagcgacccgaacgcgcgacgnagcagcgacgaagatacacagcaggagcgatacgcacggacgctcgngagcgcgcagatgcgcgagagtccagagnggcgcgcgacgcacgcgctggcacgacgcagcgagcactacgcgcacacgcgcggcaacangagagcgtggagaagagagaaacgtatgacgacggaggagagcgagtgagcagagcggcngagcagggcaggacggagcgagaggccggcgcgacgaggcagtaacagcgagacgaagagtgagagacacacgggagacatgatccgaggccgcgcgcagacagcaggagcgacgacagcgcgcgcgcgagcgagagcgaagcgagacgagcgccgagnagcagagaggacggcgcacagagccaagagcaagacggccagcgcgctgtgacaggcgcncggacgagacagatgtgnagtgaagatcgaaggaggagcacgcgcgcagaacgacgagcgagtagaacatgacgcacgcgccaagagcgacagcacacacgacaga

SEQ ID NO: 9194 - DNA, 1500 bp, Homo sapiens
  misc_feature (1)...(1500): n = A,T,C or G
gcacacaaagaaaggagggagaccaggtacgtgacacgaacgacggagcgaagaagcaggnnccgttcgntatgtntnaactnnnnnacgccaacggnnnccctcnncgnangnngggattancnnnccggnggcnccaggccagccggccaggaccgacggagagcgaagcgaggacgtttagcagacgagagagagcacgcacgcaccaagcaacacggcgcgacgggacgccgcggcgggangcacacgccgacgacgacacgccggagacgacancacaaccaacccancaacacgaagcacacgcacaagcacggccacaccaccgaccgcgagccgcgaacaaagcggacgacgnagcgacgaaaagacgaggacagagaagcggaaacgcgaccagcagcgaccagcgcagacagncaggcaccaccgcacaacaacgcgaacacacgacaattcttttttttttatagcgcgcggcgcnccgcggcacacgcgcagccgccgcagcgcgaagagnaccgccacaagaacagagggccaaagacagacanagagagagacagacgganaagagcgaggacccgcaagganacgcgacggcacgacgacccgcngaccacgcaccagaccgcgcacncgcgcgacccacacccacccagacgagaccagaacgccaggangacaggacggcggaccggcggccgcgcacgaccgccacgccagagagcgacgcgcgccgcacgagaagcgaagggcggaggacagcgagcgcaaggcaccaggacacacggcgcacaacgacgcaacacgccgggcacacgcgcgcagagagncgcacacaagacgcgcgagcggcagncgagcacacccagcagacgcggcccgccgaggaccgcagacgacgcgcgaccgccacgcggcnacgacagcaacgggcgcaaacaacgggcgcgagcacngaggcgacgacgccgacgcgagccngncgacggggcgcggcgagcagcagcaccgcacgcaaagccnacagancgcaaaaagcagncaacacgcanacgacgcgcgccgcaaagccacaccagcacgcacagacgcacgccnacaaagaagnagagcagaacggaagcgagaagagagctancgaacagcaggcgcacgacaaaggcaccacgncacacagccncacacagcagagcaagagacatgcacacatntgaggatcgaagctaatacagcacacgaacgaggcacaacgcgcgctatgtcgncgacgacagcgagcaacaagacaacagacgccagagagagacgagacagaccggaggacagagaagagggagcaggagngctaggcgagagagacccggccagacaggacacgacacccaacanaccaaacagcggcacacgaccgcaagagngacaccgggaacaggcacgccagcacgcacagcggcgaggcggggacggccgagcgacagcagcagcgcgcag

SEQ ID NO: 9195 - DNA, 1267 bp, Homo sapiens
  misc_feature (1)...(1267): n = A,T,C or G
ccgcggacgtaagaggatctctgttgtagagtcgtcatgaanactcatagggtgtgggatgtgcgcaaacttaccatgaagcgagctaacgctacagtgggtaatgttgcgacaacgaggggcaagtggcgaacagctcgttggctaaacaacgcgagagtccgggtactctgtgagcgctcttatccatccgtgtcaaccacgtacgggtgacttgcatcacactgaatcaacggggtggatatgctcgcgcggcaagtgacgtccactcgcccagccactgagaggcgcgcgggtcaccattgttcctgggacagtaacccgcacgttatgttgtcacatgcggccacggggatcgcgcatctcgttgacgccgatcaaagtagacagagccacaccattacaggtggtttgtcatgtgcgcgataaaagactacaccatgtgtgcacgtcacgggcacgttctcgtcaaggcttgctacgtacttgcatcttagtaaacacatctattattaacatgggcgcgcggtataccagtttgataaccgtgtttgtgcattcggcaatggtcgtacagatgttcgagtaagacggtgatcacatatgttcggtgtgtatataacgatagtgtgatcgtgtgatatcgtgtgcagtcacattgtgtttgtcatgtacctgttcctaatctccagtgtcttaacggcacaacccggggcctgcgtgtgttgaccgatgggggatcgccgacaggggacgggcttggcagatatgcgacttcagatttcgtgtgagtccgtacatgtacggtcatagaattgcgggtaacagaggaccgtgagagaagccgcgggacggcctctctccgcacattccgctcgattcgcgaactctgccatagtctctgggtgtatttgtgtcaggtgtaaactccagagagttgatagaacgagacaccacgtatattagtggttgagcgaacgagactacgaccgcgaacactggttggaatagtcgattcacagagtctgtaaaatacaactatagcgatcagagactcgcgcgagcaggaataacaatggtagtagcgcagatggtgacgcgagtccgtgttctctttgctgtcgatcattgcccgtgtcacagaagaggtgtgggtagtggcgcagcgatctggacggcccacgagaaatagagtctgttgcgcgacgcgattaggtggccttgctgggcggagtcgggatggaagcatacgtatgagcctattccg

SEQ ID NO: 9196 - DNA, 1286 bp, Homo sapiens
  misc_feature (1)...(1286): n = A,T,C or G
acaaagacaagaggggcgacggcaagagggagggagaacagaacagcaagagcccctttgcaggaagaatnaggaggcggaggggccgtgnngagggggagaaaaccagagagagagggggaccgaggacgggacgaggcggaggggaggcgttacgcgggggcccgccacgcgcagagggcagaagacaagggagagcggcagcagacacgcaacacccgaaagcaagcaagcagcagcacgagagcaacgccaggagcaccaaaacaaacagccaagcgcaganacacaaaccgccggaaaccaagacagcagaagaagagagcgagcagacaggcaccgaagcaagcacaacacacgagagcaggcgaggcagcngagcaggtttttcttaagacaccgccgaggcgacagacgaggggacaagaagggcgcaccgacggcgagcacgccggagcaagagaagacacacggaaacaacaggcgcaaccgcagcccgaacgccgacacacaatcggcagcgaagagcaagagcgggcggaccacgggaagcaagcaccgcaggccagggagcacacaccgagagcgagccgacgcgccccacacgccaagcacggaccgagaagagcccgagaagccgcgaccggcagacggggtagagaggtgaggacaccgaagtgcgagcaaggaaccaccagcgcagacggcaaggaaggaaccgagaacaggagaaagaagcgacaagaaagaaggaagaggaagcggaagcggacccagggcgcgcagaggacgcgcggcggcgccgaagacacgagcaggaacagaagggcgagcaaaacacccgacgagagaacagggacggacagaaaaagagaagaaaagcagaccacggacaacgagctacagacgagagcaaggaagacggagaccgccggagcacgaggaggagcgcagacacgagagaagcgacatcccacgcaagacagagggcagcgcagagacctacacagagaagagcacgcaaacagagaacacacacagcagacggaagggaccgacagaccgagaacgacgacacgagcanccnagcagatgaggccagtatcagcgaggagggtgcagaggcgcgcgagccaagagaaggcgcncggcaacagacgaggaangcgagaaggacagaatgcaagagagcgagaagggcngccgggagacacgcggaacagaggagaagacacgaaacacgacgcacgcgagggcagccactcgcagaacgccgaacacacgcc

SEQ ID NO: 9197 - DNA, 251 bp, Homo sapiens
cagaccctgcactcagatcagctagtgtcacccagatcaataaactggctcatctggtcttgtggcccccacacaggaactgacttagtgcaagaggcttcaactccctatgatttcatctccaaccggaccagtcaacactccccacttcccaaccccctacccaccatgttatccttaaaaaccccagtctctcagttttcagaaagactaatttgagtaacaataaaactctggcctcgttggcctca

SEQ ID NO: 9198 - DNA, 1317 bp, Homo sapiens
  misc_feature (1)...(1317): n = A,T,C or G
gaagagagaggaaaggcaggacagaagaagagggacaagcacgagagagaagcagccctgcagcgggacgaatnaaaacagaggaagggccctgacgcgggggaggaaacacggangagggggagacggaggagcacagccgggaaacgacgacggcccccggaaggacgccgggaagcggaccgacgccggcaccagaacagccgggacgacaccgaggacggacgagcggagaggagcacacaccaacaccacaagacacgaagcaggacacaccacacgcacgggcccacgacacgaaccgcgagcgacagagaggaangaagcaacagcagagaagcacgagagccagagcgaanaaaccaaccagccacgcaaccacacggacacgcagagcggcgaccgctcggcgagaggagccgagggcgagcgcagacacggcaagaacggagaggaggagacagaggaggacccagaggcacgaaagcggaaagcacgnagagcgagagacgaacgangagaccgaagcacagagagagggagcgaacgcgcnagacacgagagcacagccgaagacagacgacaaacggagagagagacaaaaacccaaacgaagcacgaaacagaccgccgagacacagcgacaaccacaggaggcggcaacaaggcgcggccaagagggagccgccaggccggcgccgaccgcccgcggcagagcacgccagacgagagacncgccagagagaaaagcgaganagacgaaacagcacgagcagagagagggagaaaagacgaccgacaaccacaacaagacaaacgacacacanagcaganaagacggagacgcacggcgaccgagcccgagagaacgncacgaacaacaacaaaaganaacacgaaacagagacaaacagacgcaaaacagacccagaagagccacgggcgggacagaagaggagagagcgcaaagaagaggagacgancgacggcacgcacgagcgcacggcaggcggaggacggngaaagagacgacnacacggcaagagagaaagacgacagagaagacgaagagagacggacgcacaacacgacacgcagaaaagcacgaacaaganagcaagcaagagagcagacacagaacacccaagaagggacaacacggaggacacaaccgacggcgcacacgcagaacagacgacaacgcannaggcagcgcgcgacgcccgcacaacggcagcngagagcaccgacgcgaggaacagagagcaacgagagcagcacaggagaacacacacaacaacancgcccggaccaacc

SEQ ID NO: 9199 - DNA, 280 bp, Homo sapiens
ctagaaataccttcaggaaaggcagttgaactaaattttcatctttattttgctgaggcaatctattcctgccttgctgtagagctaaggaaagactctctggatgtattaaaatattttcagaaatgtatttttacaattgaaacaaaacaactttctcttaaaaaaagaaatgcttgcttatatttacttgtgagaaagctgtgaagaagttgatcaatgtatagttaaaatattaggggacatgaataaaatttgagcaaatttaaaaaaaaaaaaa

SEQ ID NO: 9200 - DNA, 923 bp, Homo sapiens
  misc_feature (1)...(923): n = A,T,C or G
aaggaagagaagtcatttagaccccagaagaaaactgatgtgataaaaaaagnncttnngggcaaaacnngggcggcgggggcgcgcgggcagagaacttttaggcaaaaggaggagcagaggcgggggagaacgaacacagcgacaccgagcaccgcgacagcgacacgagaaccaggccccgccgggcgcccgcgacggaggaagggcagcagggccgagaaggcgcaagacgagacgcccgcgcacacaaccgggggcccagtttttttaaaagacggacgcaaccaggaaatagcagaaggtggacataacggtgcaggacaagccggacgcgaaaggccaggcgaatcgagcgcacggcgtcaggggagcagccgtggactgggagtcctttggcataacgcgagtgacgctccctgactggcccgcgaggcgcgcgctggccgtcgaataggcgagccgccggggctgggtgggcacggtagacgtggcggtgataacagtacggttggaggaggatccgccgttacaagagcgccacgcgacagacaccaaggcggcgtgacagcacgatctgcacatccgcgataacagtagagggagaaaaacagcaagtatcaagggaaacaagtgacgaggcgcctcgcagctcgacctacttccgggcctgactcgctatctcgctgcgagcggcacgcggtctcgcggtgaggatactccgtcgcgggtcccggagggtgtcgcacgcgcgcccggcgccacgggagaccgccctcacgcgtgtcgacccacagcgcgtagctagatacaccctgatacgtcggcgggcgtgggtggntactcgcgctcgacgccacgagaccacctcgacaacacctcacaccacgaccgggacgggccgccagcgggcccaccgccgc

SEQ ID NO: 9201 - DNA, 152 bp, Homo sapiens
  misc_feature (1)...(152): n = A,T,C or G
cagcatgccacctgaccctccagtggctcccttgtcagtggaaaaaatagtgccaatgaaatcgccattgtaaacctgtngcttaaccaataaatacaaaagtcaccatagtattgtcactaaatctcttaatggatataaaaaaaaaaaaa

SEQ ID NO: 9202 - DNA, 1285 bp, Homo sapiens
  misc_feature (1)...(1285): n = A,T,C or G
cggcgacgaagagagacgacaggagagacagacagagaggagcgaaaggagangaaagaagggggcctggnnacagananaaccnangncnncganganccnctggcnnnggggnggannnancacagaggaacagagacagaagaagaggagacgggagcgaaacagcaccaacgctctaaggagaggagacaaangcgaccaagcagaaggcgcgcaanaacaagacacacgcagaggaacgaacaagacgccgacgcgaccaacaacacgacgncggcgaagagagcagagcaacaacggagaancacaaacgccaggnacacagggacggagaacgacgacaggacggacaggacgcgacaggacgagaaggcaacggccggaggaacgggcgcagccgacgcagacggcgaagacggaggagaagaaaatattttctttccaagcccgaacangccagaggcacgacgcgggagaaacgcgcacaggcgcaacagacgcaaacagaaacggagagagggaagaacggagaagcgcgagagaagaaggacgcgccgcccgaccgcgngacagagaacagaacaagcagacacgaccaaggagagacgcaacagacgagaacagcgagacgagcacgcgagcgagcacggccggcgcagagagaaaacgcncggcaagagaccgcacccacgccgcacggacaaccgcacagcaaccaaccgaacgcacccggcacgcgggagcagaccaccaccgagcaacgacaacggcaggaagacgccgagacacaggacagaacgcagcacgccacacaacaccgacaagagagaggagagagaagcgcgggagcgcacagggacacgagcggacaaggacgagacaacggaacagaagaggcagagaaaggagagccagagacgaagagggaggaagacgagaaacggagacggagcacggaacagcggcagacggcggccgagcagcaccagacagcaaacaccaaccagacacggcacggcgagagaaggaaagagagagaggagagagacacagggaccgacaagagagaagcgagaagcgaagagaccaacacgacacagggaagcgaagggcagcccagcacaacgacaccccgcanacgagcccaacagagacgcgacgcacgaccgcgacgcacgaccacgcgcgaagaaccagaccagccaggggcaagcggcggaaagccgcacggagacgaagaggggcgagggagaagagcgaagaaagcgagcgacagaaagag

SEQ ID NO: 9203 - DNA, 1302 bp, Homo sapiens
  misc_feature (1)...(1302): n = A,T,C or G
gaagaaagaagagagaaaagcagcataagaagaccaaacngaaagannnaannccttttgtatgttttactnnncccnccccnncnncctgnnagagntnnntaacncnnanccccnccnnngnnnnnnnannnnnnngnacccccgcacaactcctttacacgagacggagggcaaaccttacgaggcggaacacaacagagaggaccgcctactgcagacgagacacgaggggcagagcncgacaagcgggaagacgangcgcagccagtacagcagcccgcaaagcgcgcacgacaaaacacgccgtacacaaaggaacgagccaaacgacccaacagcccaacaggaccacgcgcacagcgagccgagacaacgaccgagaaattccccttccncctcgcgacaaggcgcgcgacaagacaccgcnacgcgaggccgccncaggccacgcagccaacagagaacaaccgcgagacacagaacgacaacaggcacgcncagacacacagcagcacaagncaaccacgggccgacaagcgccgcagacacaagccgcgcccacgccgcgcggaggcaaacgcgacgcgcagagacgagaaagccgaccagggaggagggagagcgagacgcggaggagcggcccgcgaacggccagaggcaaggagaccacgggaagagcggacgaagacggcgccgngngacgacggaccggcgcacccgcggaacacgacacaggaccgcggcggaggagcagggcgacgacgcgagccgacagcgacagagcaagacagagccgcagcgaccacgacaacaaaganaaccgaggagccacgccgaggcagcgacgacggggagcaccggcccgcggcgcgccggacacgacccccacanaccacgcgaccgagcgacgcgcgcgacacngcgcggacccgtcgcgtcgaccccncacgcacacgcagcacaccggagctaaaaacgagcggccagcccgcggaagcaactaacggaacacaagacagcacccaacgcaccaggccncgacaaccgccgccacccaccgacagacacccaaccacccgagagccgaacacccacncagcgacgaaagaagacgtccacactcaacagagcacaccaactgcggtgcacagcgacaaacgcagagtgtacacgagtgcatacgaccggagcgacaaggagggcgcacaaagcaacctcacggaggtcggagggagatgaacgaggagagaaagacacacgaaacggcgacgccgccgaacgcacgaggagaagcacgga

SEQ ID NO: 9204 - DNA, 128 bp, Homo sapiens
taaaactgtcacgaatccaactctatttaaacagagattttgttatccatagattgatatatcaggatggtatgtatttttaaaactacaaatgtattaaatttataatcttggcaaaaaaaaaaaaa

SEQ ID NO: 9205 - DNA, 1204 bp, Homo sapiens
  misc_feature (1)...(1204): n = A,T,C or G
cgcgaccgaggcagcacgcaatagaggagaagaagaagcggggggaggtcctgatagtangactgggggggggggggcctcaggggggggagaaaccagacgccccgaagcggagaagcccacccagagaggagacgttcaagcgaccgaccggacacaaaccgggacgcaggcggagagaaccgagcgcaggcagcgagccacgcccccacgcganggcgagagagacacaaacccccgccgcgcgcgccacaggccccgcgagggcgcgaacacgacgggacgagcgacacagcgccggcgcgccagcacagacaaccgcacaagagagcgggagcacgggttttttcttagaaagaccgagagcaaaagagacaaaaaagcgaacccagcgagaccagcgcagacgcgccgcagcgcgcgcgaaagaaagagcagcaagcgagcgaagccaccgagagcggacgggggggaagcgagccgaggccgcgagacgggcgcaacaaacaacacggcggcgaggagacgaaaccggcgcgcgcaagcgacaccaagcacgacgctgccgcgcgcgaacaaaccgccccccccgtacacgagacggcgcacaaacaccaagcagacgggtaagaggggcagcgcgagcgagcggccgggggagtggcgcgcgcgcgcgacagagggcaggaggagacgcgcccaatgcaggaggagcagacaagggcgcggaccgcagcccgacgccacagagccgaagcagatgaaggagataggaaaggacacacgggacaggcacaatcggtaggggagagcaaagaagagacacaccgcccagacacggcaccggccggccgacagcaggccgccccgccgcccaacgccaggggccgggtaagaccacacgcagacgaagggtagatatggcataggaccccgagacgcgcacgccagagagaagacgaacaatcgacaaccagacagcccgccgccgcgccgcacacgaggagcatgaataaagnacgcccacgcacggtctatagcgggcggccggatcacagcgccnggcgaggcgaggcgcggaggcacgagcgcaccaggaagaggatggagcgcggagagacccncgagtagaccacagagcgggctgaanacgnacgccacgcgacagcacgacattacataacgccacactaccgccacgcac

SEQ ID NO: 9206 - DNA, 289 bp, Homo sapiens
  misc_feature (1)...(289): n = A,T,C or G
gcgacggaagaacggaagcgcgccgctagaaaaaaaagaaagggggggggcttatgagagaacgacagcgagaccttccngaggcagaacaccccacccaaacgcatgacaaaaggacaagaccactcacccacaaacgactgttgtnggaaaacacactagaaaggaaaaaacggcgaagctgaaaccaagacacagaaaatgatgcgctctcaggccctggagggggagctcggcacacacttacctaaagtgaggggaaattcatgaaccaaactcactttttctt

SEQ ID NO: 9207 - DNA, 312 bp, Homo sapiens
ctagtctctattacagaagctctttttggtctgggatgctgacatttgcctcccctgcaccctctgggaaggccatggttaaaaggaccccagagatgcaagaatgacatgaatgcagccagatgagagcaagtgaggtggccagtacaggtcaagaatcagagctctagcagttgccatgaacggttgtttatttccctctgcccaatccacttcgatacactttgctgcaagtccttttcctgttagtaaaacaaggtagactccaatttccacataaaaaaaaataaacgactggcctcgttggcctca

SEQ ID NO: 9208 - DNA, 1447 bp, Homo sapiens
  misc_feature (1)...(1447): n = A,T,C or G
cgagagcgagacacggacaagaacacagacaaggagcaggcgcgcggaaggagccgagggaccccttggttaagganggaccnggnngggggggaggagcctccagccggagggnggcgaacacagcgagaggcgccgagcaccgcgagcgcgcgagaaacaagcacaagcacaatttgcacagacgacacgccacggaacgaccncaccgcagccagcacgcggacccagccaagcagcacacaacgagagaacgacacacgacgacgaagcagcagcgaacggacgcaaagcacgcagacgcgccgaaacgcaccggagcgcgaggcgagcgagcggaagcacgaagccacgagagaggacggcgcaggaaacccgagagcgcggagcagcaaaagaacacaaggccacagacagagacgacacagagcagcagcgccgcattttatttcttgcccgaccaaggaccgcgcgncagcgaacacggcacaccacgagcacaaacggccaccgcagaacgcacagacaaacccacgacgccacggaggcggaccgacacgcacggaacagacgggcgacgcgccgaccaggggacgcgccacccaccccgccacagcgcagaccacgcagcaagacgcaagagcagangacgggcaacggagaggcgcgacaaccggacgcggcgacgacaacggacgaagaagagcgcggcgcagcaacgacggagcacgagggaagggaggcaccgggagcggganaaacgcggacgagagccagagagaacaacgcagcgcagacaagcgaaatacaccggcggcgacgcagcgacgaaagaggcagacgaggagacacaccagagaacaagatcgcaagagaggcgcacgcacgccaccngaccgcgagaacagagcgcagagacagacgagcgcacgagacagcngccagcacgcacngcgcgcgcgagagccagaccgcaggcggcacaaagaagagcgcgcgcacgaccagagcaacagagagaccaacagcgcagccgagccnacgacggcgccacgcgcaccgataacacgagaggcgcctcncagcagcagcacgcgcgtcnaacgcagagcaggagcgaggcgcattgatcacggcgccacagcncacacgcagcacacgaganacgcaaagcacagcacgcacgcgtgaagacgagcgagcgcccgaatccagcggccccaggagcaacgcaagagagagccgcgagacgacagtcgccagcagaccacgcagcntcagaccgagacacgcgccgaagaagctacagacgagagcggcgcagcgngacacaaccganagacgacaaatgaatgacgagcacgagagagacagcgaagnaagagactgagagtcgnacacgacagccgcgagacaagcacgaacgcagagacgagacgccgcgcna

SEQ ID NO: 9209 - DNA, 790 bp, Homo sapiens
gcctgtggatacatgagctacagattcctattgcaatccctcaggcctaccagtattgcattcgccctccagtggacagacaaagaaagaagctcactcaaatcatggaagcagaaccccagccatctggtcgactaactgtgggctcctgattacctggaatataatctagaagggggatacaggttccagctgaacttgtccccacaactccaccaacttctcattttttggtgataaactcagctgaaagagggatcaagcaaggccctctaaagcatgaggccctaggcaaaaaccctcttgcccagatctggaggtagtacccttgtgatgctagccagtatgaactggttttttttttagacggctttgatgaacatctgtcttttcaattaaattatggagtaaaaatcacagattcaatcaatgctgccatctaaacagcagataaattataaaataatctctatgataaaaagtgtcccagggtggacgcgataatcccagcactttgggaggccaaggtgggctgatcacctgaggacaggagttcgagaccagtctgaccaacatggagaaaccccgtctctactaaaaatacaaaattagctgggcaatcccagctacttgggaggctgaggtagaggaatcgcttgaacccgggaggtggaaggtgccgtaagccaagatggtgccgttgcactccagcctgggcaacaagagcaaaatttcattttagaaaaaaaaggataataaacaaacgattggccttgttggcctcagcggg

SEQ ID NO: 9210 - DNA, 383 bp, Homo sapiens
cctactcatcacaggtgctgttggtttgatgaaaccactgaaagcgcagttaaactcagccttcctatgggacaagaagccctcataaccctaaaagatggacaacaatttgtgattcagatatcagatgtaccccaaagctctgaagatatttatttcagagaaagcaatgctaatgtgtgagattatttatttgaatagagaataagaaaactgatagacttgcattcttaaaaatattaaatactaaagtttttctattgacgaaagatgatgttatgtatataatagatgtagcattgtctattttatgtttatatgtatttcaaggaggtggtttcgataaaatatgtaaactgatttggagaataaaaaaaaaaaaa

SEQ ID NO: 9211 - DNA, 1109 bp, Homo sapiens
  misc_feature (1)...(1109): n = A,T,C or G
cggacaacgacgaccggaagatacaggagtagaaagacacgcagcagcgacgacgaggcttctttgtatgttngaccngggggaggggngcccttangnggggngcagatccacgcgaaangagngggcgcgaacngagagaaggggaagagggagtttagagccagaaagagcgggcccggcaacgcagagcgaagagaaggagacggacagacgacggcgacgggggacgaggccgggagcgcacgcgcgcgcgagcggcgacacccggcggcgacacagcagcgacgacgaacgcagagcacgacccaaggacgcgggcggcgagcgccaccgcaggacacagcagagccgcaggcgggcaggttttttttggcgcacggaggcgggaggcaagagaaacacggcagaagacaggcaggaagagagaaacgcaaggacagacacaggcgaacgaacccggcgggaggcgcggcgcgcgagggaaaacaggaggagacggccggacaagacaggagaaagaaagagcggaagaagagacgcaccgcgaagcaacgcaagcccacgacgaaacgacagcggagcagagagcgagcaaggcacgaccgggagcgcggaggaaaggagcagaagggcaggggcaggcgaggcacaagagggagcagacgggagccgcgaacgaaggaagacgacancagagcagaggaggagcgggagcacggggaccgacggcagacaagagagaagaggagagaaaaagaggacaaacgcgacgtacggaggacaggcgagaaggagcagagggcgcgagcgaaagagaacaacgaacaccggagggacacgaaagcgagagcaagggaggaacggaagccgacggagaagaagtagaggcgagcgatgacaggaaggggcgggagggagagtggagcgacgncggcggcgcgccacggcagaaggaagaaacggggcagaggagcgagcacgaccgcacgacaggcacgaaggagcacacacggactcgcacgacgacggnaacacaaaggagagagaagacagcaacgacagcgagcgacggcggagaagaaacacgaagcanagagcacagcgag

SEQ ID NO: 9212 - DNA, 769 bp, Homo sapiens
ctcatcccacccccactcttgggaatggactctgacaaactcaccatcaggaaagttgatgtttcccatctaggatggaagaatgggattctgaactttgtcactgtttctgaaacgtcatcagctcctgtaattgcatggatgggacagatctatctaaattgctctgaagttttcccaggaaattcccactaaattgtgcaacccaaggaattgaggaggaaaaaatggcactggcctcacattggcatcctcaccacaaccttgtaaaggaggcaggtagccactcatattaatgatttaaaaaacgaggcaccaacacccacaaggggaacagtactaggtagcacggactataattaatatcaccgacacacccctgaacatgttcacaaccaatccgcaatcatcataagcatacaaaaccccccaatagaacaaagaaactcacgagaccaagaccagttaccacataaaaacaacattaatgagacacaaacgacacccacccataccaccccaccccactaactataccaacgcaccccacgcgaaacacaagtcttattcttgtacgaccaaatagtaacacacccccacataaaccacctgactcctaaaaaaacactacacacccaaacctcaaacacatacacataaaaaaacacgatacttgccagcacccccccaccacaccatacaaagaatacaccaaataccaacataatcaagttgatacccgcacacagaccacacatgaagagactca

SEQ ID NO: 9213 - DNA, 217 bp, Homo sapiens
gctaggacaaccatcatgcctctaatcattcaggatgcatctttttaaaaaatctcagtaagcaacgctaaagaagagagaccacaagcactagacgttttcctgtataattaagaagaatctgttcaacgaacccccatgacataagcttatctatataacaaacctgcacatgtgcccctgaacctaaaataaaagcttggcctcgttggcctca

SEQ ID NO: 9214 - DNA, 1663 bp, Homo sapiens
  misc_feature (1)...(1663): n = A,T,C or G
cgagcagagctcgcagacagctatccgcggacgngacgagtgtgtgaatcagtagtacgangatgcggcgagtatacgncggnagcagcgccttttcnagntcttgtatcngaaccntcgagagngagacgagnaaggnnncctttagagnggngngngngaagannatacccgatgtgacgcgcgggtcatgnagagtagcngaccggatccacaacgtatagtagatgataagatgctgcgcgttcttagagaacagagacagcgagntnacgaacaccgcagcgcacgacacacgcgagcagctcatatcagtgtagctgngcgcatcagtcgtagcngtgcagaagatcgcacgacgaatangtcatgattatctagcagatctcgtcacgcccgtgactatagctcgagcacactncggcacgcacatgatgcagcgcgcatctgtgcgatgtgtatcacacgagcggtntgaatcattgcagcatcgcgctcgagcggactcgagcggacgacagagagtcgagangtcaccgagtcacntacgagtcacactgtagtacgatagatatagtacgtgatcgactggcagctgcgtcatggtgttcttatctcggagncacgatgnacgantgctctgctctgattgctcagtccgaagctgtnctngtgcacatacatcgatcgagncgacagactcgcgacgagcagacgatctcgacagtntgngtcgatcanagcgtcatacgaacgtctgctgtgcacgcaggaggtangtgcatgacctgatggcatcagcgagtagganatgtgtatgctgcgcgcgnggcgcgcccgtacgcgcgccnacgatgtaggagcacaggactgtgagagaagcagtgacactcgtgagcgagccacnncagatgctagcgatagcatcacgagtggacgcgcgcacgtaatnatcggtgncgcgagnacagactcacnctcgcacgccatccacattacatctagtatcgcctgtgcgccggccnggacaacgcgangatgaccgatgataggcgcgcacgatgcacacggtacgagcgcagtctctcgagtacgcgccgcatcgccgccgagcncgcgaaagagagcagcactaccgaagcggcggattcagcggccgttcgacagcncacgcatcgctgtgctccagccacgcacgtctctgatgatcggttgtcgatacagatgcgatgatagacacgtccacagtctcgcacgtaatatgcgcacatgatgtacatacgcgactagttgtagaaacgtagagtctacacgtcnatgtgcacgtgacgcggacggcgagtagcagagaccgcgagtgggatgcagcacgcggcttgagacgatatagtgcgatagatgagcgcgctatatcacagatgangtngatatagagatgggaggtgagcgaagaccacgaccaccccgccttcctgcacgcaatgtgatgatatgtcgccagcagcgcacgtctgaagaggaggctgcgtctgactatcatgatgcatgatatccgtccgtcgcggccatgcgcgntagacagtcgcatgaagacgcacacggcctacgtgcctgagtgtcagtcactcgagagtatgaataccgtaaatagagaagctcacgg

SEQ ID NO: 9215 - DNA, 822 bp, Homo sapiens
taccactaactatagggcgatagatcgccccaactgggtgtgaggagctcactcatctgctcgggatattttaggatcgcgcgcgaacatccctaacgcatacccaactggagactgcattcaggcctaccttttttgtaaacccaccctacaccactatccacggctgaaccactatgaatcaaacaattattcctcactgctcctcccgccaccttactcaccgcaatatatcaagtcccccgcagtactacccatacctatacacccagctcccatatacgttaacccacttcccttcaccactctcctcctactccccgcccccacccccaccactgtcacccgacaactcctaataacaaatgacacacatcacacaaacaaaaataaacgccctccccccacacccaattaccacctacaatcaccaacatccccactctctcgcacactactacacccatgcagccacttttacacaccaatcttatccccgccgtctcctctctaaccgtatataaactcccgcacaccacacgtagccacaccattattctaaccgccctatatacacccccacaaattccccccacctactactctacttctcaacacccatacccacccccagacccttatattgcattcaatgcaaccccacaacaccaatacattacttttttctctcccctcccctctacccacccctatccctctcccttcactcctctcctatcccacccacacaacactccaagatagtctacacaaaatctccgatctaccttacccgccatctactcacactaccccgcccac

SEQ ID NO: 9216 - DNA, 336 bp, Homo sapiens
cattgaacaggcatttgggccacgctgcaatggtgtcaaatttccccaaaagcaagatgaactagatccagtccctgagcctaagaagtctaaaatctcttctggatgccagagcaacctgggagcctgagctgaagatggaagagcctgtctgcgtgtctccccagtgactagtgaggcggcttttcctcccgaagctggaccttacatcagtgagaaataaacttccattgtgctaagccaccaaagtctgaaatgttacagcagctagcagtaccttaacccgttgagtacaaagataaataaagctcagtcaccatctgaaaaaaaaaaaaa

SEQ ID NO: 9217 - DNA, 821 bp, Homo sapiens
ttctcttgaacaaaggtgactggtctcatgagccctgaagaatgaactcagaggaggttgtttacatgaggttctcccactgcgccagctgttgagagtctgcgattatgaagagcaggatctttattactgtgtgaaagcatggtacaagttgcttaaaccaccagcagtcaaggtgatttggtactgagctgatgtttaataaacggatataaagctgggctggttatatttatttaaagagggggtggcatatatacaatggtctttctgtatctaacaaatatattcttttgcggtgggtttcattttagtgacgtttagaattcattcacccttcaatcgatggtattatgtaccgattgctagggtcactatatttaccgtgctatttattagtgttattgttgatggtgtgtagttcttacaattcaataagtagttagttgtatatcttttataactcacgaattatgagtaatacgtcattctttcagttagttgatttgtgttgtatggctttaattatgtatattttcaaatgtttccctatctaagtttcttatattatctaactttttttttttatttacatgtcgtttttttagtatagaaatcgatgggaagttgtattaattggagaagaaatgagtgtagttttttattttatagggactacttatggagtgatatatggatgaaatattatccacgcgtacaaattgtttattttatgtggatgtgccctcgttttatattttttttagcggttaattgaatctgtcaaggttttctacaaattctgattatcgtgaatcact

SEQ ID NO: 9218 - DNA, 1478 bp, Homo sapiens
  misc_feature (1)...(1478): n = A,T,C or G
cgcgatacaaccgggaccacacaaagatcaggggggagcgagagagcggggaggggtcctgtgaggtaggactggggaggaggagagcccttagcngggggggaaaaccagaacagaaagcaaacgcgcacgcagcaatgaagaccaacacagatttttccacgcaaggggagatgcgcgcgccacgtgcagagagagcgaacacgcgacggccgcggtacgcaaccggcacgggcacccgagccaagagagacaccacccgcagcgcggcaccgatcaatgacagactagcgcaccacactcacgcacgcgacgcacgcgaagcaacagaaccgtagcgagtgtaccacacaggagacgacgncgtgaggccggcgcggccacgcattctttatcgcacgcacgcacaagaaccacagtgagagcgcgccactcagacgcagacagcagcgcagagtaatgcaacgacgacatcgagcacacacgaacgatgagggcagtagangtcgacaaagacacaacacgactccacaagcagcgcgaatcgagctgagcacacgacacagccgcgcagaccacgccggacgcacgacatcaagaccgancacagcagtgaagacagaggagcagcgaatacaggcgaggatcgcactgaatcgacgtacagtatgtacagcgaagctgggagaggcgacagcagagaacgcgaaggcaggcggacagcgagaggcggcgtgcacgctatacgcagcgacgcncacagcacgaacacgacgtcccagcgcgagatcatgtaggaccagagcggcgcngccgcaccgatagagctgaataagcggcttcgcacgagcggcggagatgatcgaggacngcgcacacaacgcacgagacgctcacanccacacgagaatgatcaatacgacaacgaagcgaggcatacaaacacagaacagaatacgacacagaccatcgagaaacgagctcacagatagcgccagagcacgcgccccgctccgcgctcaaagtcgatcgctgcgatcaagctggnacgtcatntctactgcggcgagaanatatagcatctgccgcgaatgngcgagagcgcgcgcgtcgagagacgaagatatgacgataagtatagacgcgccagacgcangtctgctctgctnagactacgcgaccgatgcaagcgngagaggcaatccgcgcgccgagcacgcacagcgcgcgcggcacacagcgaacgcacacacaaatacgcgcgcantgagtacagagcacacgcgagcgacctacacacacatagagacgcagcatacgatggagacacacgagagtacccgncacgacagcgtaatgcagactctcaagagatacagtacgacgcncagacgcaacagacgactcgtacgcagacaggacgacagtcgaggaaagacatgaagnagacagcgagagatcgcagaacgcatactcng

SEQ ID NO: 9219 - DNA, 254 bp, Homo sapiens
  misc_feature (1)...(254): n = A,T,C or G
gctaggcgataacggaagcaataaattactctgagcaagagaatgatgtatataggccattagtttaggaagattcatcacaaattcatgtgcaagtagataggaggaaggaagtatcaacagaaagaaaggccaattatgagaccattagcaatactatattggtacacatgtnagcatatagttctaatatatatagtataacatatatcacacaccttcaaaaagtcagtatatcgttaaaaaaaaaaaaa

SEQ ID NO: 9220 - DNA, 1585 bp, Homo sapiens
  misc_feature (1)...(1585): n = A,T,C or G
agcggagagtgtagctgatgtcgtatatcngtataagttatgttgagcatgatacacgctgatggacggcgtcttttatcgtggcgtgaccacgcacgagcgatggcgacgagtgtcatatactagtagacgtcgacgctagcatgatanagctcacacagttagtaccnctacgtcctcggcaccagnangttagtatatcgctggagagtagtgagnatacacgcgaccggtcagatagtaagtaccgcacacgaagctcagatatgtaagtgactacacgtatgacatcatcgtcaacttgctctactatcgcgcctcgtcacgtcnacatgttacttngcgatactaggaccgagcgagncagttcctatcncngttcntcctaatcgcaagactatgattgtggcgcgtatcagccattgcagagcgcgatagcggagctcgatgtacaacggcgacgatcatgtatgactattctgacattaacggatactctgcgctccgccggctcaactgtagtaatgtgccggcctctatgtctgcggttattacgggtcagctcgacacctccacgtcatactgtaattctcgtgctcgtgagtcggcatgacactccacctcgcattgtgttgantcggaggtatggatgcgcgacaccgatcgtgcgccgcgtgcgataatgactgtggggtctcgcgctcatgtacgccggatggtggcatgggagcgtagtaagactctcgcgatacgacgancgatgacgagctgtgtccgtgcgcgctatgcantacgcacncnantgagtacccgccgcngctcttgaccatgatgtcttgtcggtcgcgtcaggtccgcacagtgagaagtgtcagcagncgcgatgagatactcgtgcnagatatattggtgagtaatatccatgagtagtctgcggtgaatgcgtatctatgtatatgaaatagtatatcgcgacgagctacagcgaagcgcantggttaagcgaggccacgatgatgtgctagaggagcagatgcgcgtatgtgagantgcgccgtcacgcgagcgagcacggggctctgtagacgcgtagtgcgtagtattcagaacatcacgttcatcttctccgtgcgccgattggtacacgcnctcacatagttnattgctgtatactgtacgcgctcctgacgacacgtatcgtcgggtaccgaacgtgtcgccagccagcgatgtaagaggagactgcantnagatgtacggcctcgcatgagagagtgatatagatgtgtcgactgtgcgtcggtgtacgcgcgacgaacgatctcctntatcgattctgatcgtagtagatcacgcacgccgacactaggctaggattgatgttcgtgttgtatagcggcatgctcgtaacgtaattctatctacgtcatgtctngcacatcacgctagtctctgcntacacgcgctgggcgctcacgctgagcactgattttgtgttactgtacgctctacgctctctccttattcgcctgagcgacagagtaagcgttcntaggngagtgatctcgtctgcgccgctgcgccg

SEQ ID NO: 9221 - DNA, 230 bp, Homo sapiens
cctagctgaagaaaaggtgactggtttcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcaaaaaaaaaaaaa

SEQ ID NO: 9222 - DNA, 158 bp, Homo sapiens
ctggctttcagacagctgccatgaagagactacattattggatgcatcccagtctctgggacacatcaatttccaaacgttactgccaaggccatgtagaagagtcaaaacaataaaaaaaatcctgaaaaggagcagttgttctaaaaaaaaaaaaa

SEQ ID NO: 9223 - DNA, 1359 bp, Homo sapiens
  misc_feature (1)...(1359): n = A,T,C or G
gaggccgcacagacaacggaagcaggacacaggaaaggaaagagaggggaggaggggttcctcgttagttngatngggggggggggggcctccagcagggggggctaccananaggcccggagcgccgcggacccgcgcgcaggcaagaggacgtttttgaagcaggaacacacgaagaacagcagcgcacgcgccgcaccacggacggacagccgagccaacaaccgccacgcgcggggacaacgagaccgacagagagaaccgccggagcgccaccgacccggcgagaagcggagagcagagcacgcccgggaagggagggccggccacagcaacggcaaacgacgacaacaacgacaacaggcgcaggaaggttctttttttgtgaggcccagccggccccgcgaggcggcgaagcgcgcacgaacatgagccgacccacaagacaaagcgcaacatacgagaccgcgtgagccccgagacctcagcagaggacgcaccgccgcgagcncaccaacgcaacgcccagcgacgcgtgtgaagaggcgaagacgncacgcacgagacgccgcgcggccaggaccagcgcagcngacgagtgncgcgcgcacggcgcgcacgaagcaaccggctcacacgccgctgcgcgcagcgaccaccaaccacgcaacgcagcgcgacgagcagacaagccacgccagaccggacggacacgcaggcccgagacccacaaccacgccggtcgcgcaagacacaagccgccagatacgagagcgaggcggcgcggcgcggcggccgaccatcagcagatacacgcgccgccgcgcgcagccgccacgagaggagacgcaccggcggagccgatagacggagcacgacagaaacacggccggcacgcgagcagcgcgatagacgggacagagggtgatgtcaacagagagcgagagagaagaccgcagcgccgcgggcaggagtcagatgaaacgaagagcacaggcggcaacgagcgnctcgacgtgccagccgccagagggaggccaggcgacggccganagcagcagcgcgccatagacaanccgccacccacgaagagagaacgaagacgcgcgccgaccgcacaccagcggcgatggagcaatcaaaggaggagggaggacaccacacgccgcgtcccgncgcgacgcacacacgggagaggcgccgacccgcncacaaagaaccgagacgcgaagagctggcgagaggagcggcgaacgcgcgcgccgcgcacgaacagcacaaagaacgagcggcaaacggcgacatgcacgcagagcgcgcncacgcgcaatgagcggatgagcgacgagcgccgaaca

SEQ ID NO: 9224 - DNA, 1104 bp, Homo sapiens
  misc_feature (1)...(1104): n = A,T,C or G
gctcttcacttatatagtcccacttctgcnaccaacaaccatccgccnatcccccgcctcacccacgaccactttctgaggcgagactccactgtacatcatcgctgaatttataatcaatagaacataccctactcacaggcgctcattaatctcataactgttcagacagtatactcactattagcaccctatcgggacgttgtatcgtgtcaatagtatgaccttgaccgtcgtatagacaaggcagaaccccttttaatgacccctctgctcatatccgcttacccatcactcaccaggtatcatgcaaaattttccataacgcactctttcctcatcgtaaacgcaccctcctctatctttctcaggggggcgcctgcccccccctattttttacacatcttttcacctcctgttataagatcgcaaccgatgaccataatcgaataatactctacccaagcatatacccatatcctaccaaaccaccttgattcattcatctacactatcctatattgcacccttaatcatatccctgctcatctcccacccattactattgcattatatcgactcatctccgctaacgtaaatcatagctgggaattatcacggcatcatactcccctctctacgaatattactccacgtaatgttcgccctcaaaatctacactcttctctctccctaccattctaatcactcactcatctccgccccatcctcacccttactactttccgccacatataacactacactctacattaaatagccgtttacgccgaatctacgttatccttcatattagaccactccctagtctgatccaacgcgtggtctcttcgtgtctgattacgatacattgccactcgagaattcaactaacgtcttctcgcagccgcacattaactcctcctctactccacaaatccatgtgtcgacatcccccatccaaagagaaacaaagtccacccaattgatacatcttggccgcccctcactccactcataattacctcctacacctcccgcaacctgcagtttggtatctctctacacccgtgcacccggcgcatataattatatattcgttct

SEQ ID NO: 9225 - DNA, 837 bp, Homo sapiens
tttgtagtttttctgttatgaatttggagtgtggggggggggctttggggctagacccaactgcgtgttggacgcggtaactgccatgatggagagggtcgcctgcctatcctggagaaggagccgtctgccattcactaaaaccgcttctggacgctaactgagcaagtgacgctttagcaaatcacatcatgtgactctccaggaacctcactgaacgggtctgactcatcgtctgggaattttaaatagaccttcatagaataccacaacgacgtttttctatttgaaaactacgaaatgttcttccattgttaaaagaattaatttggaaaactttaagctagaattaaaagtcttttacttaattggccccaaaaaaaaaaacacgacccgttacattatgttcatattagcgcctgtgcggttctgttattcgtaggggaaatgtcttcttccactatattttagactctgtacttgctgcccacgtagagggctctatgcagacgataacgatttgggcgggttaattttagacactgtctgtctgcctctctggattctctttattctctgccggtattttctattttcctgtatggtcgtctatttttggttggttgtcggagttggggtaaaacgacaggaattcaatttttatttatagcccaggtcgagcccagatctacaaatatgctctcgcgcactgggtggtgtatgggagttgtctcttcctttggatagatcctgttccattacggagccacgttgttaatctctcaccaagcaattccaaccgccttctatccctctgactgccatctgcaccacacg

SEQ ID NO: 9226 - DNA, 1206 bp, Homo sapiens
  misc_feature (1)...(1206): n = A,T,C or G
acggcgacacacgccgcgcgcacgaacaagcggcgagagaccgggcgacggggcctccggagctcgactggcggaagcagagcctttcacaggggggcgaaacagggagaggganagagagcgcggcgcggacgaaaaacgggcgcaagaaacgcagccacaccgagaagaacggcgcaagcggaccgaggancagaaanaacactcaccacgcgacagcacgacacacgcgcagaagcgaacgagagcagccgaaggcgcagaggcggcgcggtgagcggagctacacagaagagagtgagcgggtcccgcgagaacgagacggaccgcagcgcaagccagaaggagagaataggcggcgnggaagcagcaaggagagcgaacgccgcgatgttttttgtccgcgacgcggcgaccgcggagagaggcggcgaacgagcacggcagagcgcgggggtagagcgcgcgccaccgggacgacgtcccgtcgcacgcagcagagccatcctcgagcacagacggagcgccacccgcaaccgctgcgcggagcaaaagcgcgagaggcgaagggagcgcacgagcggcagaacccagccaccgcgccgcaagcgcgacgaaccatgaagtctcgagcgacgaacgaggtgcccggagcagagacgagcgcgggcgacgccggaagaggtcacgagacccacccacgcacaccacatcagcaatgaagaaacgccccgacccgcgcgaggcgcgaatgcagggcaccgagacagcatagagagcgcggatgagaggcggggcgcgacgcgcagagcgacganacagcgaatgagcgagcacccagactccacgcagaacgcgaggaccagcggagcagagcacgacaccggaacccagcagagcgatcagagggaccggagcgagacggacgcgcagacccgaagaggagccggccaaagggcanaagagaagagaaggccaggactcccgcgcacgcaagtgacactggatatagagcagtgggtgcagcgacgggcggacagcgcgaggacacagaaggaacgacgccagagtacgtacggcgcagcgagatcgacgcgcgacaacgcacgaggaagcgcgccgcccaacgcgcgcgagagcgcgctcagagccgcccgcggccgacaacgcgccatcgcgaagagacgaaacacgacacgccacggt

SEQ ID NO: 9227 - DNA, 845 bp, Homo sapiens
catggattggacgttgcccatccccgtggggagggaaaactgttctactccgtctgctgattcaaattttgggctgatgtacaaacacttcaaagatactcccagaataatgtttaaccaaatatctgggtccaccatgacctagtcaagttgatacatgaattaaccatcacaggacaattttctgcctccaaatcattctgaagtttggaacgtttttcacagaggtggtttgttctcttttttgagttctctgttcaaatgtcaacacctcagactgacctttccaaactgcactgactcagaaggcctcccccagagttaccacattctctcatatcttactgagtttcgtttataacacttatcccaatatgtaattatcttatttacatcttacttgtttttaatgtctctctctcctattagaacatattagggtggaaaacgtgtatgccttgtactttaatataatccaccaaaaatatacttggcggtaaataaaaaaaaataaaaaaatggcgctctttggcctcgagcggtggagtctttgcggccggttgccctttgatagagggggtaatgtcgatgatccttcgcttcacttgacctcgcttgcaccttcggatctgttctgcgcttgcgggcaagccgtttatcatccttcacttgaaagggggggtgaattcccggctaatgccacaaggatatccatggtgataacccgctaaggaaagaacacatgtcgagtcataagtgctccgatcgatatgggccactaatatctaggtaaaatagggctctcgtgctggtggggcgtctattagcaatagaggctcgcctcc

SEQ ID NO: 9228 - DNA, 122 bp, Homo sapiens
gctggccgtcctattccttcagactcaatattgaaatcaggccaattaataatgctatcatggcttctaagtgtttaagtgaaataaaaagttatatgtttctcactttaaaaaaaaaaaaa

SEQ ID NO: 9229 - DNA, 1592 bp, Homo sapiens
  misc_feature (1)...(1592): n = A,T,C or G
ccgagactcgatgacacagtcacaacatatagaatcttagcaactgtgtgatccatatacgagactaattcnacaagagtagagagccacgagcgcgnggagaagtctttgatgatcgcgcgtcgactcgatgagtaggatgtagagatgtatgtcgatcgcacgtgtaatntataagtatgtcgcgcattcaattcaacagcttcaaaagtgcacgccggccgatctgcttcntgtcgatgatatgcgacgtcatgacgcgagcagatccgacgacgaccggagacgctctaatgttgttacctgtagncgtgactccacactcagcaatgcgcagcgacgcgactatgactacagttatccatactatgacgagcgcgcgacttagcacagcgggcaagatagatgctntcgtgtatgtagaatgatttcgacgatcgtcacatcaggtgactcgaccgacgcggtcgtctcatcnatatgctgcggctccnagtacacgtgtgtgatgtagtgtgaactagcgtatatactagagtctgcgttcagttctctgctcacgtacactccgtgcttntagtagctagcgcgttctcagcacagactcggtngacgtacatatgangtggcgctgacgttaaatcgtcagcgctgctnctctatgccgaganattgatagcaatgataatcgagagacacgcgtaatctnacggcacctgatgccgtgcgatagagcgataccgtacacatatcaccatgcgagatcgccgctgcagtctcatcagatagtatcncgctcgtgcacgctgcgcgcagcgtantgtatctacatcgccgactcagatgatagcactgtatgagtagtgcgagattatacgcactacgtgtggtgtcgagtccgcgcgcccantcgtatgtagtgaacaccgccactcgtccgcggacgngtcataaganatatacgccgcatatcacgtatgcgtgaatatgcgcagcgagatacgtcgtactcgatntgttagtcacacgtatgcagacgatngattgtctatcgcagcattcaacgtaacgtcgaagcgtgaagtgtagctgagcatcaccgtgtacnatggtcgtatgtataatgtatattgtcgaatgatcgagctgtcagctagagtactcgcgntatctgagtcatgagcgccgcaggcgcggngcgaagtagtagtgatataccnaggtatgtgagtcacgagagatagtgacgtgtatgtcgatatanatacatacgatgacatccgcangcatatggcgtcgtgactcgtgagaagcgnatatgatcgatcgtcgtatctgtccgcagctacgnatcagcgcgacacggcagtagctcacatgatgtatctatacgcgcgaatgatattagtcatgtcgcncgcngnacgtacgtcgtgcgtcagtcngctgatgtgcgncctcgcgcagcagacacgcgagctcgccgacnagtctagtcatatgtatgtgtgtgtcacgcagctacacatcgtcatcgctgcgcatgagtacgtgtgtagattcactcgttcagcgacacacaccacggcacg

SEQ ID NO: 9230 - DNA, 372 bp, Homo sapiens
cctagaccaccacatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattaaaaaaaaaaaaa

SEQ ID NO: 9231 - DNA, 1594 bp, Homo sapiens
  misc_feature (1)...(1594): n = A,T,C or G
agccaggcgcgagggagcatggcgagcggggagaaggagaggcgaaggaggagaggagggtctttgttaagatngaccnggggcgggcggggggccctcanggacggggcagaaaaccangaggcngggagggnagggagcggcggcgggaccaaaagagaanacaggaacgctgacagacgcggagagaaccgaccgagacccgcgcgaccangncgcgcacgagaagangaagagcacncgagcgagacgaagaacgcgccgngcggcggcggagcgcgccgagcgagcgcgcgaagacganggaggcgagcacgacgcagacgcgacgaaggcagacaaccgnacgccagancaggggcgcacgcgncacgccangcgncgagccgacggacagccagcgacacagcgcgagcgcagagaccaagcanagcgcgaggcgcnagacgancgacgagcganagcagccgacacaaagagagagtgtttctttcttattcgacgncagaacgcgacgagcagcgagcacgacacgcngacgcgcacgcagcgccagccnncgaccacgcagangagagaacgcagncagncggcgangcancangacgcgagccacgcaagacgcnacncggcggagcggcagacacngncacncgncaacagagagagcgagaggacagagcagggagangcacgcgcgacgacgcgcnggncnggcgcagcgcggcgcgcgngcgagcacacacgcagacgcgagacgagcgcagagcgcgagacgagcacagcgagagacggcncacgatcggcgcggcgatcgcgcgacgcngcagacnacggacgacacgcacgcgacggcgagagcgacgcgagcgcgcnnagccagagcgacacggcggtgcgagcgcgctgcacactggagcggcagggcaaaagccgcgacgaacgcgcagcgcgcgagcgacacagcgcggtcgatggagacggagaaagacgacgcgaacagcccacacgacgcgcgagcacgaggcgcgcggagagcggcaggatgagagcggtggcgcggacgcggaccgcgaaccaccgacggagaggcgaacgagcagaggaggagacgatcagagcaagagcgaagagcgacgcgcgcgacgagcacactcaagcgcagcgcgcgaatatgcggaccnacgcagaccgaagacgcgctgacgacgacgtacgacgaagacacacggcgagcccgacgcgagcgggccggccgccggcgacacgcgcgcagacgaagcgcaggnagagagagagagagagacgcgcgacgacncgagcacggcagagcgcagcacgccnagcgancgaagagagaacacncggcccggcagcacacacgcgcagcggtcagcggacgacgagacgacgcgcacgccgatggaggctccgagaggacgcaggcgagcggcggtagagggcgcgagaggacgcgcaggcgcacgcgtncaaagatgacacaatgaaaaacgcacgacacacgccaacagaaccgcnaggccggagaagcgcagacagagcggtgacagagagcgacgccggcgcggagcgc

SEQ ID NO: 9232 - DNA, 372 bp, Homo sapiens
  misc_feature (1)...(372): n = A,T,C or G
ccgctggctggaatcctggcagtgataccatcaagcctgatgtccaaaagagcaaagaatatttctccaagcggaagggagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtnaggagaccagcctttcttcctttggtaggaatggcctgagttggcgttgtgggcaggctgctggtttgtatgatgtattagtagagcaacccattaatcttttgtagtttgtattaaacttgaactgagacaaaaaaaaaaaaa

SEQ ID NO: 9233 - DNA, 1378 bp, Homo sapiens
  misc_feature (1)...(1378): n = A,T,C or G
gataagtagagatgattattgtctaaatgaaagtgtcagaagagtagtgacagnaagagaggacgggcgcccttgagtagtntggactnncgacgcgcaagnancgctgnnancaggaggagaataaccngcacgntggnngcggagactcacacgcaaagaaacataagagatctgtcacacgaaactggtgtaaagctcggtaaatcacagtaaaagagtctatgataccttctataggtcaatacagacagagacaagaggtacgtctaacactagcgtatagttgatatagagaaagcacgtacggatcggnagactcgaagagaattctatacggtatgtactcagcacaaggagacaggttcagagagcntctcctaaagagtacatacagcacatacgtagcgtagtctttgtatgttataacagagaggntctgcactggcatcgcgcgaagactaccagtgattatttggagtcttactctgagtgacacgcgtgtcgcaccaaagaacatctatcagcttctctactgcattacttgtcaaggcgaaatacgttgcgacatcgcgtgcactgtactgtcacatctagactatcatgagcgtagacgcacaacgtcggcccgagaaccttagcgcgagagtgagtgagaagggaacagcttagtcttaggcacgatgcgaggcttgtagaactactggcgtaagtgattcagaaggaccgtgtgaagatgcttgaatagcgagtcagcgattcctaatctgccgtgtagtgcgtcaaagaactatctcgactggcgagatgtagatatttgcaattaaagctaacatggcagcgtagacgaattcgacgtgttgtcancgctggtggagggagctatgactgatgcatctgagaagaagcatggcgcgatgtagaccgttatatgattgtaaattgtgacnctaacactgactgtgtgtcgcagtatgcgcaccaggaccgcacattgtncacacagaagagcgcncacgagtcagcagtggtggtgagcaccgggcgtctcagaaacagagcgagcgctggacgcgcatgatctagtggaccggacatcaatgtccaccttctggacttgacgctgtcgtgtatattanancncgacgtgcaggcgcaactcgttggtaatgggtgtacgagagctagaggctgctgtcttattacatgtcgtagtaagtgtgcgatcagcttacactcagatgagtgataagaggtatacacttagatcagacattatatgtgtgtctncgtagaatacgtgacactactgatatacatcagactaactgaattnccgcgtactctatatcatctaccgaatgccactcntcactcg

SEQ ID NO: 9234 - DNA, 1602 bp, Homo sapiens
  misc_feature (1)...(1602): n = A,T,C or G
cagaggngagcgagatgtacgtagtattcancnagcgagtgagttnntagtagatgtcantagtctcgatgatgctatacagtcattgtatagtatctcgtatattctcganagagtcatacgatgtggtacatctattttattataggtaagcnaatacgtgtcatatgtatgtagacgcacgacgcgacactagtaacanancactcatatacacgcntngncgatgtgcatagagacatgtacgtaattagtagtcaatcgangtagtgtgagangagctagaataatctagtagttcggcagcaagatcatatgagcacgctatatatactgtctnacttattatcgacgcagactactcacgntntgcagaagncanaacacgaaggancacaacgagangaagtacatatacttaatagtatggaggtgtatagagcgtaangcagtgagtagtgagagactgacacacatacgcgcgtcatcatgtctcactaatactagacaccttagagtcattaattangtaattgtaattgantgagaatagaagaggtgtaggcgtgtagacagcatgagagcagtacgtgtaagtgatagatcagtgcacgagtctgaagagtgcgagagtgaacgctgagangcggtagatgtagaaggtagtgaggcatagagatataaaagttagagtgatattatcagacagtatagagcagcaacgtgagaatganaactggagcgaggatgcgctantataacgacntctcgccnggacagtcggacgctgatagacataacaaatactagaagacgatagagatgatagagagtgagagagaggagacgantgtgaatgagtagaacataacagtacggantagcatatgcatcacagagatgtcacagcgtcagtgacgtatgatgatgatgagtagcactctgtgcncatacttctctcgatggttcactgagagagctgatgagatacattagagatgctctgatgagtgagggtaggctgagtatgtgtctgtactnacacagtatgaaatcgatactacggtctgnanagctcgcacagtcatgttgtatggtgtgagcgatagcgagtgagaatgacactagntcgtatcaggatcatatatacagaacgaataagatagctctactaattaagtatattctgaagattactatatatgaatcaattgatagactagtgtattgagtgcagggagatcgacgacggnaggtgcgttatagttgtccgataagagagttaganagagtgacgggcgataantcagcgtctaggatttgtttctctctgtgtgcttatatcaatctagaaggaggaaggacgggcactagactgaatncgcggcacgcgcccgcgctgagtttctcagaagcgngatcatatactgctggaatgaagaaatatatgtacctgngatactatcgaccgtataggtagcgtatcnggagtctcgatgtggtgttgtcttaagtttaaagactaagaatttagactgactgtgagatataaaagattatgattatgaaaatgtgaggtataagtatagaggtgaaggtagg

SEQ ID NO: 9235 - DNA, 1641 bp, Homo sapiens
  misc_feature (1)...(1641): n = A,T,C or G
cttgcggtcgtggggttcctcctctttcgttggtgtttcggtggttgttccgctttcgttcgttcgcggccgctcgtcngcgtggcgctctcttcgctcgcgttcgtgtgtctctcttgtgttgtgtcnagcgggagtgtctcttctcctgtggtgggcgcgctgtccgtctcgtcctgtggtggtgctttcggcgcggcggcgctgcgctgctcgcggctgccgctgctctgtcgcgcgcggctgcgcgctcgccggggcgtgtcccctgctccgttccttccgcgcctgtccctcggtgccgctgcgtccttggtcgtgcccgtgcgtagtcagtgcgtcgctggtgtggcgtgtgtctcgttctgtttctcctcttgttcttgcctgtcgttctgcctcttggnctgtgtttctcgcgtggccgccggcgtctgcctgcggtgcgctctgctcttcttgtccttgtcttgacgntgttcttgccttttcctgtcctgtcgtggtcagtgcgcgctcgcgcatgcggctgtgtgcgttggcgcggtgtgcggtcggagtgggtctggtgtccgcggtgctcgtctcccgggtgtcgtggcgcggagtcgtgtcntgcgctgttgccccgtgtgntttctctcggctgctgtgcggctctgtgtctgttggcccgtgctcctctctcttccctgctctccgcgcctcttcctatnccttctctccgtgtcttcgtgcttcgtctgccgcctgtcgtgcggcgngngtgggtcgctactcttcgtgccctgctcgcttgtctggtctcgtccgcgtggtcttcgcgcgtgtgcgtgcggtctcctgctggccgtcgcgcgctgctcgggtcggngcgcgtcgtcgcttcgtgcgcccttctgcgtcctgtcgttgtgcgtgcgctcgcncgccgtcnctctgtntgtgttctcggtntctcgtctgcgtgntcgtcctcgcgcgnctcgncttgctctgtcgtcgccgacgagcagtggtgtctctgtgccgtgtnttggctctgctccgtntccgctctcctgctgtctccgctgtctgctgtctgctggcgcgtgtttgtgtcgcgncgcgctctgncgntcggcgctgcgtgcgcgcgntgtgcgtgcggtcgtcgcgtgtctggggtgtgnccttgtcgtgcgnctcgtngcgtcgttnctctgtctgctgtctctcttgtctcntnntgtgcgtctctgtgtcgctnctctcgcgccgcgtgcgcgcgtgcgtgctctgctcgtgtntcttcgctggtgctctgcgcgtctccctgcttgctctntctcgntnttcgcggcgntcgnngccgcgctctttctcgcctggtcgcngtcttgtgtgtccgttcgcgtgtcgctggtngccgtcgtctctccgtctctcgcngcgtgccccgcgctctggcgctctctgtctgggttcgtcttcgcgctcccgngnccgcgcaacgcgcgccgctgccgctgctgntctctggttngtnctgctcgcgcgngncaggcggcttctcctcttctttgtctttcgcgtcgtcgcggctgctgccgtcgcgtcgtcntcgagtctgcctgctcttgtctgttgtggctgatc

SEQ ID NO: 9236 - DNA, 758 bp, Homo sapiens
  misc_feature (1)...(758): n = A,T,C or G
agtttacacgggacaccgtgcggccacaaaaacaccgacaccgcggggacacagagaaaaggcagacagcagacgcgacaagagagaggacccaaaatagaccactcgggaggagcaacatcccgaacttatagccagcagaacagtgaaaaaacacatcactgaagccaagacactccggtggngtgggatggtggagcagacagcctcttctaactaacacgagggtgaacacaagatacaggccaactgactcgtagcgctagagaaactgaaacaaagaaagcagagacagactaatcaaaggacttcagatggggatcacaggagcacatgaatactcaagatggaacaagtggacattaagacaagtatacgacagcatccgaataccggcgccggggctggcgtttttccaaaagccacgcaccccagcagaacaacacaggcctcactggccagacagagggagctatgccggccatgactttaaagagagcatgcttcatcacccggactcactgactcgctgtgctctggtccgcggctgccgcttaccggataccttcacgccatggtccctatacgaggctccacacaatcacgtgataacggctggaagaacctgagagcgaagggcaccaacggtcaagaaccggcaaaaggcccaacccccgggtaatccaaacggcgccgcccccctgggagcatcaaaaaaacaccccccggtagaacgatgaaaccccccggccaaaccg

SEQ ID NO: 9237 - DNA, 279 bp, Homo sapiens
  misc_feature (1)...(279): n = A,T,C or G
gcctagacctgcatgcccaccgagnattataccatctcagagatctcaacctctgaccacaattgttcagtctacatctcctagtctctctgaacaagcatcacatccctactgaaaccctgaagatcttgatgctcctttgtgctctcttcgaaactcgtctccctggctccactccttggatcatctcaacctcaatctgactagcaacctggaatcccttgacccccttgattttccaatactgaataaacccaacccctcttaaaaaaaaaaaaa

SEQ ID NO: 9238 - DNA, 1563 bp, Homo sapiens
  misc_feature (1)...(1563): n = A,T,C or G
accccacacaaccgacccccagccaccgacgaaacaaacaggacgcgccgcgcagcccgcccctcatcgggagcactanaanagcgacanncttcgccagcagggaacaaccacaaagagagaaagcgcagcagcccacccgcccgccacccacgacctccggaacaacaaagacagcacagacngaccacgcaaacaaccacccacgccacacaaacgccgccacacacacagagagagagaggagacaacaacaacacccacacaaaccgccccagacccaccaccacccacacaacaaacacaccccacaaccaagccaacaggcacccccaaacgacccaacacagcagcggaaagangaccacaccacccgaacttgtacaccacacaccccacccacgacgtggtccaagaccccaagtagaatacacatctgcccaacaccccgcacacgacgcccagccgccacaccaaccacagnccaccagcagacaccgtccgaccgaaggacgcgaacacacacacccanaaaacacgacncacagcggctgccacaagacagacacagnatcaanaaccaaccacggagaagacgacagcgagacacacnctccagacaaacanaacacacacccgacacacgaacgacgacccagacacagcncgacgacacgaaccacacgacagnangactcatacagcacagcacgtcacctacacacacgaangcaccacacgacagacacacagaaagcacgacccacgagctaatgagcacacaaagcgacgcacccacacacacanctcacacgacacgctaccacgcacactaccaggatcgcagacacacangtcgcgagaccgcacagcgccacgacgaccacagcaaccagccgcgcgaccacgcnagacagccagcactgcgaacacacgcatcccgacctgacacgcaacacctacgacatagactnagacacgcgcgcccacagccacacgcanacgcctcaccatcacgacacagcgacgacagagagaagagacacgncatgcgcactcacacacaacaccatacgtcaccgcgcccgcggcgncacgcactcccacgaccanacagacgacgagcncacaacgcgctgacgtacacacgagacgcaaccgagtagcgagcatgcccnacgcccgtcacgcancaacgcatcatcgcacccnctacactaagcaacgcgatcgacatgcagactacacccnagcagacacacacacagctcaacgacgcgcagacgcancagcagcacncatcannacgncgcactctcgacgcgcacgcccacgacgacgacanacacacancagcatacgagacactaacatacacgancactcggcagacagaacaacagcgnacgacgncgcaactgcaccaccganagtacaccagcacaacgcagccagcgatccacgaacagacnacaccccagcagagcgacganctcactcacatacaccaccaagcccgcgcacaccaatacgacaccgcacacacgcccacacacatcagcg

SEQ ID NO: 9239 - DNA, 1126 bp, Homo sapiens
  misc_feature (1)...(1126): n = A,T,C or G
cacaacaggagaccgaccccgaggggccgggaacggggaggggccttggaaggggacggagggggggggctttaggggggagaaacagggagggagagagaccgccgccaacaagaaagagcaggccaagcagcagaggagcccacgcccgagagcggaggccagagacaaagcagagagaagcggacgcagacacaaaggacagacaacaagagaggacgcacacagacgacccagagcggcaccaagcggggcgaccacgcccccgaaccgcanagggcaacgccagacaggagagacgcagagcagagcgagcagccggaggagttttttttccgacgagcaacggagagaggaagaggaaccacgcaggcagacgacgagaggaaaccagacaggcgagacgcaccgccgccgacgaggaccccaggacaggcgacaccgcccacacagcggagagagggcagcagagaggagggagccggcgcgacaggcaggcaggacacgcggagcggaagcagaggatgcgcaccaaccaccccgcaagccgcgaccaggagacagacgagcgagccacagccagagccgcaacggagaagcgagcggcgagtgtcgccgaggcgaagaccagaagaagaccgcgacagcacaggagcggagcggagagaaggagcgcggcgcacacacacggcccaagcacaccacgcgcccccaccgcgacccacgcgccaaacgcgcgccgcgcacacgccagacccgaccgcaggaacgcgaaaccccaggatacagaacctactccacacagaacacgcaggcccacagagcgagcggccgcacgaccggacagacaacctaaaagaggaacacgacacagcagcacaaagaaccgccagaaaccgcgcgcagagagaagagaaacagaacgacccagcgaccagcccaccgcgagcgaggaaggggagagaagagaggcgcgcgagaggagagaccggagagacgcgcacggcgagaacccgcgacgacgcaccgcncagaaaaccaccacacgcagcggcaagcaggagacgaggacagaacacgcaagaagggacgcgccccgaggaaaagcgacaacaacgaccgacct

SEQ ID NO: 9240 - DNA, 403 bp, Homo sapiens
  misc_feature (1)...(403): n = A,T,C or G
gctagntctcactttagaaaacttgtaattgtaaattcttcctctgcccctttgagatgtaaatcttctacaaccaaggagtatctttctcaaggacatggaaggcatccctttgaaatataaacatcaagaaaaacagcagccctatcttccagtctccgtgagaagatagaagcctaacttcaataagaaccaattagcaaacagagatggcctaagcacacaaaccaacttccgggctgatgtcctctaggacttttccagtagctcacctcagcaagcacaaacactccaaccttttgttttggagtagttgagttcaatttttgtcctctgttgtaacagtcttgacccctttgcaatggtcttaaataaagcctttcttgccttaaaaaaaaaaaaa

SEQ ID NO: 9241 - DNA, 589 bp, Homo sapiens
  misc_feature (1)...(589): n = A,T,C or G
ctgntttttataagacgcttcatgcatcactttacccgggggattttctggaaattgctcactttctttggaaaacagaagaaacttttttttttccaattgaagaatctctgaatacaaatgtggagtatccctctgtgctgcagcctttctcatatcatggccacctcataataatttagccccccagagagtcatctagtttcagatgcatgaaggcaggaaataaagtgaaggaggaggaaaaggtaggtcaggaagaaatgggggaaaaataaatatgccaaattcaagcaagttttcagtaataacaaataatgattatcagatagcaaaagcagttacacatgtgctaaaagtagaacatagataacatgatatttatttgaagagtcatcatgctttgtagaatgattaataattatgttgttcccataattcacacctaatcttgcaattacttttctataaagtattacctcctgtaaatctgtaatagtggccattttctctacacatgccaaatcatatatttaagttaatctcataataaaataatactgtactttttctaanaaaaaaaaaaaaa

SEQ ID NO: 9242 - DNA, 1588 bp, Homo sapiens
  misc_feature (1)...(1588): n = A,T,C or G
gcgagaacacagacagcgacgacccgaagagaaggcgcgaggngagcagaagccgagcaccctcnggggaggagcacaggggggggcgggggctccagcgggaggcaaacaccgagacacgagcacggaggcgcgcccgaaaaaagagaagggcggncaaaacgcacgcaaagagggcgcgccccgcaacgcgacgcgcgagcagagcggacaaggcgcagaacgccgcagcgagcgcacagagagacgcagcgacgacagggacaccgcacaccggacacaccgccgccgacgcgcaagagcngcgaggaagccagcgagcagccgaacacgaccgcacacagagagaggaccgagagagcagggagacggcgacaacgcacagagcggacgacgcagcgcgaccacgcgcggttctttgtcgcagacgaggaagcgacgagagaggacggacacagcacacacaaccacagagancgacacacgagagagagaaggncaagagcaccgncggcgcagagagcgggcgacaacaggcgacagccgcgaagcagagagagagaagaggcgagagagggcagaacgagacagacacganancggacnagcagcancacgacgccgagagcaccgnacacggacgcagancgagcgggacgacaaccacgcgcagaacgacgcgcgacagncgcacgaacggcacagccgaagggnancgaacgaccagcgnagacagagggagagcgaccccacgcgcaccngancgacagagcacgcgcccgaagcacgcgcgcacaccncagacgcagccacngagcgcacatgacncggacacaatcgacacgcacagagaggacagaagaagaggagcggcagaggagcgagcgcacccacggaagaacgagcgaccgacagaacacgagatagagacgcgcacaccagcggcgcgcgacgacnacagagcgccgctaccacgacngacgcgagagntagagaagcagagagacgagcagacagacaacgagagcacnagcagaacgaacgagagacgcgaagagcaccgnacaaagcacacaccagcaacgacgggtaacgccactctgcgggacgggaccgcagaacgatgagagagccacagcgcaccgcgagagtacgcgatatcgcccgcgaggagnagccgacgcgcgtgncnagacgcagagtagacagagagnaccgcgcncgcacgacgagcgtgccaccactacgcgagcgagcgagagtgcgcgacgancgcagggagcacgacgagacgctcnacagcgacgcgagagctaggacatgagacaaaggnagacgcgacgagncagagacaagcangacgagtaagcgccgaacgcgcgnngctgaggtagcgacgaacgcgtcgacggaccgacagacgcgtacacgatacgcgncgncgacgcagcgtgtgagacaaanacgacaacgtantagacagccgatgcagaagacgacgaggnaccaaagactcaanagacgagtacgcgtcggcgacacataacacacanacgagacacgatgcgacagagtcagcgcacacagt

SEQ ID NO: 9243 - DNA, 830 bp, Homo sapiens
  misc_feature (1)...(830): n = A,T,C or G
atggaaattacgactgtccgacatgtaagaggggaggggnggggggttaggggtgacaacggaaggactttttactggttctacctcaaaaagacatctggcttacctcgcactattgatctccgaaaggcgcaggagctgaggacatacactttacaacagaatcataccgaccaaggacaggtttttccttcttagatagtgatagccaaagatgatactaaacattggtgtgtttgaccgaatgcaaatggatttataaaccacatatctattgcaaatgacggggggatttgccttccagctcatcttaaacagtacagccctttcattatgcactctaacttaagaggtcacactgtatgaacagagacttattacaatttatgagcatactgagactatgaaaaaaatggcctctgggctctcaggcctgaagctttgagctctgttccctttagcgttgggtaatggataatcctcgatcattgatttcttactctctgggcgtccggctgccggctagcgggaatcggtaacatcaaagtcgaaagccggctacccgcagtatccangggataccgcgatgaaccaacatgggaccggtaagccaacgagacagccaagagccgtaaaaaggctcaagggactggtagttttctttagctctggccccctggcctgtgggaaagatagcaaaaatccgttcttaagggagaagaccgacggcatatggagatgcaagagtatacgtggaaacctgcagggtcgctttacccgttcaaattctatttttcctgtaccgaccgctttcgcttttgggattggtg

SEQ ID NO: 9244 - DNA, 863 bp, Homo sapiens
  misc_feature (1)...(863): n = A,T,C or G
aaaaactaagagaaacattttgaggaagcgagggagggctagtagtcacngccgggagccttaaaagcgnacnggagacgngnccaaccangcaggcaggattcaaacaccgggcagcccccagaaccagggacgaaaaccgcaannagagacaacagcgcggaagaaaaacaaccgacaaagaccaccncngccaagcacagnggaggaacacgaggccacccgcaggaaggncaccngcacangcagcaaaagaccctttttttcagggacaagngacaaacacgagaaaaaaacaaccgcaggcccgacgacgaaaggaaaacgaagggcaccagaaaaaaaagacaacaaaacagagcgaaacaagagaagaaaacaaagaaaaggaacaaaaaaaaacgagcaagaaagggggacaaagacaacgcgccaccacaagagcgaggaccaagagcccacacggcacgagaagcgacagaaacagaaaacaggaacaaccaacgacggagagagaagaaacagcacaaccgaaaccaaccgggggcaagacaccacagccccccagaagaggcgagagaggacaagacgaaaaaaccacaaaggcgccaaacgagagaaacgagagaaaacaccgggaagccagcgcaagagcaacccacacgcacaaggggaaaagagccggagaagcgcaagagcgacaagaagggagacgaagcacacgaaagccgccggggacacaaaagaagagaagcccaaacaaaagacaccacacacgcaaccaccgagcaagcacagaaaaaaacccacaacagacgcaacaggccgggcaaaaaagacaacacaaaacgcgagncgaaaca

SEQ ID NO: 9245 - DNA, 743 bp, Homo sapiens
  misc_feature (1)...(743): n = A,T,C or G
ctcgcttcccctaaccgcccggcacacctgccgaaaaagaaaagcacaccacaggcgacagcagaagaatcaaagcagggaggaaaagagaatgtaaagaaggaatataaaacaaactaattcaaaatagatataaaaaagagaaagcggaacagaagttaaataagacatagcaatgaaaagcagatgaaaaagacgaaaaacacaagaactacacccgggcacatcataagggagcagcaagcaacaacatcaaccaaccacagcaacccgatacaaccacactcgaacggcacaaacagcaaggaggcagaccacaaacacaacgcaccaaaataaagaaggaggtggagcgaagggcgacgaatggagcagaaaaaagaagacaaagcagaaaaagaaaagaataatagagagaaagaacaaaaaataaaaaatacacggcgcaacaaaaacaaaaatcaagtatcaaaaaacccaaaaaaaagagaaaataacgccacccagtaaaaaaccccgcctccccgccccccttggccgcgggtcccggctggcggcaccccacttgcgcctgctctgtgtgcctctccttcctccgttctcccctggccccccttttttttgtncccccccctcctctcaaacccccccccncctccccccccttccgttnccccttagttttttttgtttctttagttttttttcttattttttactaaccctttctttnctccttctaa

SEQ ID NO: 9246 - DNA, 1098 bp, Homo sapiens
cgccaaacacacaacagcccacaaaagaagcgccaacacagcacgggggctttgaggcggaccgcgggggcggggctttcggggggggaaaacagcacggagaagaaccacgcccgagaagaccagcggcagacgaagaagaagcagaaaagccgacccgacaccgcaaacgacacgacaacgagcacaagaaaagcgacgaccagagagaggagagagagaagcgaacacgccaagaacagcacaacgaagagcgaagagagcaggaccaacgaagcgcccaaaccgaacccgacccggccgaaacaaacgcgcaaggccccggcaggcacccccgcccacgcccgatttttttcacgcgccgacgccaaggaggaaggagcgggccagcaccaacagagacacacaaggcacgccgagcgacaaacgagaccaaagcacacgcgcccacggaccagcgccacggaacgaagcagggagcccgcggcgacaccaagcgcacgagaataaaaagacaaagaccgcacgcccagagagcaagaccgagcccgaggaaacagagcaacacacacgaccacgaccccagccccggcagaccgccagcacaacacgacaaccaacccgaccagcccgcgagaaccggcacacccaagaaaaaacaagcgcgccccacgaaccccacacaaccgaccacaccaagcaagcaaccgaacccgcaccgacaaccacacaaaagagaacgaaaacacaacggccggggcgagcgcaccaccggaccaagacagcgcaggaaggaaggagccgaaaaacagcgcacaacgcgcaaaaggccaaccaaaacaaaacacccgggacggaacaaccgaagcaacgaaagaaaagaaacccccccacaaaacccaaacacaacagcagaacgaaacaaagcgccacaaccgacgcagcgccccacgaaaaaagagcgcagagcagcgacgacacgcggaggccgcccgcacagaaccaccaaggacagccacccgaccgagcggaggaacgagcccaaccacacaaaccccgagggacacaacgcgacgacaggaacgaaacaacgcgcag

SEQ ID NO: 9247 - DNA, 249 bp, Homo sapiens
cctttagatggacagaggaagaaaaattgaagggaggaagagaaagaaggaagaggaaaatcaggatgacataacaggaagaagtttcaaaaatgttataaagattgtatagttgaaattactgtttattcaaaaatgtgccttctgatttgtttgaatataatgaaactttcgaaaaaatgtattgaaattgatatcacatttagatacagttattaaaataaattgtaaaaaataaaaaaaaaaaaa

SEQ ID NO: 9248 - DNA, 1250 bp, Homo sapiens
  misc_feature (1)...(1250): n = A,T,C or G
tttactattatatgcagcggatcagctacaccgtcggagaacttaatacgaccttgaacagtagaggaagcgtatcacttgcgtatattgagtatggtatgcgtcctgtctcgtcgcgggcgagaggacgttcaaggcgggctggcgtacgccgtgccgtcacacacgcantgctcgagcaggagcagtcatanacgcgccggtatcgcacggagacagatgtctgctacgtcggaatctgtagtgcatagcaagattgactgttatgtaaatgagcgtagagtaacggagtatctaagaggagcacgatcccggacggatggtatacagatttctgcgcgcacgcaacgcccgagacgttgtcgtctcgtcctataccacgttggtgtgctgcaccgagagtactcatggactgtcatcagacccgggtttggagatcgagttcaccacccttcgataccgcgcggcacgcgcctaaatctcccccgcgtacaacgaccacagatccacgtggtcggcgtgtgcgtgtatgcttgtaccagactaacagcatctctctaacaagtataagttcgagctgtccccagtgatctagccacgctttgagctttctacgcattagcatctctactatacgatatatataggaccggaacacgagcgtaatgacaacttgatcgtaactcatcactacgcacgaaaactcgcactcgttagcggtgcgcgatgagtccgcgcgcgcacccgtacacgcactagtcgtaccaccattcgcctacgaccatgtacgcggaatactaggtgacgtcttatagaagtttaatcgcgaagtcaagtgagatagagtacgagggccagtctgtatagagtcttgatacgcgacggccgaccgcctcctcatagcgtatgtgtactttgcagggtcggtttgcagcttgttccgacaatatcgagtcaaccccacacgattaacgttacactcgactctacccgcacgaagctagacgcgatgcgatgcactgtgaaccgcgcgacgcgcgctaactgtgtanagagccatacatactgacagcgaacgtagatactcgtcctgctcttgtctatgcgatcgttgctcacgtatccctgttgtgtatctcacttcattacatcgtaagtatgcatacgacacacccgtacgatatggacgtatggacaagctaggaggatgatgcagctcgccatcgctatcagaccgcaagaagtagagg

SEQ ID NO: 9249 - DNA, 270 bp, Homo sapiens
ctggaccttcgctacgctgctacctgattctgtgtctggctttgcagtatctcaaggcttttatgaaaagctggttctggactgttgactatggggacgtggagagtcggtggggacagcagcacagccaccagagaagcctcctagaaaagatgaaactacaacccacaattcggaacttgaacaggaaaataaataccgggaagatcaatttaattaactgactcccttggaaattaaaatattaattaaaagtcaaaaaaaaaaaaa

SEQ ID NO: 9250 - DNA, 1725 bp, Homo sapiens
  misc_feature (1)...(1725): n = A,T,C or G
ctaaacatggacgaagataatacgcgatcgctgagaacgatgcagaagagacggccngcagaggagaggagcgcggactatatggaaggagggtgacaccngcgcgaacgaagtatcttatttttgatagagtatagagcgacacattcgcaccacgtttttggtgtcaagagcgatggtgtttttatntgctagcgttatcgcgaggagtagcaagaagcagaagacgagcggagctgtacgccaggcacaccacggcggnagcgcacgaggagcgcatttatctagagttgtacaaaccgagaacgactggacacgatacttactcgcttctcgcacgtatatagcaagcgcgcgataatcaagaagcatagaatantacagtcgtcagtagncncgtagcacatattagcaccattgtgcagagctacgagtgtacatgcgaaggagtctcctcgctgatgtgngtgtgagtgcggtnttagcagcagtacctaagtacggtcagccgatgtgtcgacgcgcgtgttctccatccagtctgaggagcagagagggagcggcgcagaataaccgtactgtcagcgatgacgcgacttgacgcgaagagaaggaagtgacacccggacacgagcagccgtgcggcgcgacatgagcatcgcgacaagtggtagacgagagnatagatgantgcntgtatagaacnacgcggagtgatccangagacgntcaggtcgagatgagagacaagtcacgcgatatacacgacatgcagagagngaacgtcagacgagcggagacactagagcggtcgagcaagtgctagcagcgtgaagtancgatngctgncttgcagacgtgtaggggcactatatgtaacatacagactcgncacgcgaacganctatcgagcgatatgacacatatcagcactcntangtcacantcgtgagatcggagatgcagagctgacacagngcgntncgcgtggcgtgacgtcgcgtgcacgactagcntatatacgtatgcctgcacgtcataggcgcagtcgaagattatgacgtgcgactgcncacgagtcgtcgagtagtagagaagangagtctcgtaccagtgtngtgctacacacagatacgaacagnanagcgaagtagatattatagagaacacgncgacgataccgacatagcacgcgatcatagnacgcagcgacagctacgaagtgaggcgtagtcaggtactaacagacgactcgagatatcacagcgtgagtacggacagcatctactacgtaagcacatcatgacatgtaagaataatatacggtactagacacgaagctaagaaagtagtctgtantangnatctgcgcagatgcaggtcatgatagctacacgagatacgcgtcatagtgcgcagcagacnacgagcgtcacgaantcatgtgtaggtgtcggcgacatctgttgcgcgcgcgcaccgaagacgactcgacgagaagcaggagcacgcagacggagcgaagagcgacaagcagtgtgcagcggacatgcgctgtagcgcacggcagggtggctgggtcgccgccagccgccgacacacgcagcgtgaatcacggagacacgcagtacaagtggatagtagacgacaaagaggactgtgcaaaagagagaaagacagcaagccacgagaccggaccagcaacggccggcggacaaagcaagg

SEQ ID NO: 9251 - DNA, 1727 bp, Homo sapiens
  misc_feature (1)...(1727): n = A,T,C or G
agaagagtgagtgaggtgatgtcacgggacaagatgcgatgtcntcgcagngacngcagtgtgcacgcgacaggatacctgtgagtgctgtgcagcgcggtagagggatgtgtgttgtgtgtatgtggtccggtgatagngttactgctaagcgacgacgcgangtacgctagagcgtccggaactgtgatangcagagcggcgcgacgaggnagcgtactcngtacagcgtgctgctagtacggctgagcgacgacgangactcgtgcgcagatgaagttagtcacaagatattatacatgtgtacgaatgcacttattangctagatctagacgaatcagacctacgacagatctctacgatgctagacgtgcgtcgtcgacgagcgactgatagcgagcatcatgtcatctatagntactacgacgccgnagtacgtcgnaacagtgtagctataccagtcgcgtgcgacgcaggagcacgcaatcactgaganagctagctcagtagagatctagtagcgatacgnagangatgtcggctcatagcatacgaatgatnatggacgagcngacctgtaatatggaccgcgctcacttctgatcaccgtgantatacagtcactatgcacgccaatgttgactgagagctcgccagctgctagagtacgcgcactgcttacgcgtagcgntcgtccagcatctncctgtgacaggcacgacngtccngtngctccgtctcgtngtcgctgtntgatcatagtgccgagtgagtgtcacgacgtctgcacatatactganactgtgacatacactcgtactgcctcgtctgctctagactgacgcgagtctgtgtatgcgttngcctgacgtagtactctntgcatacagatgtatgatagtgcatacgtgcagcccgaccagnaanacagtgcgagacgcggatgcgcgttgataacggtgttgatctngacgagatcacgaggtcactcgatactagactgtagcgcatatatgagaagcagataccacggtcactggagatgcagattgtgtacgtgtcgcgcggtgcgacgtcgtcgcgtctatatgctntgctcgcagctgtgatccgnagctatgtgtgtgatatctacgtgcgcgatgactacgagtcgcaacatgtcagacgacacgcaccancgcgaatatcacatgtgagtctctcctctcgtagccagagtacgatctctcgtcattagtgactcanatagacggcgcgatacatgcnagcatagagagangtaganttccgaagcgtgagcgtacgagtgacaaggctaatgcacntagaatgaaatgcaattcattctactcagacganatgtcagctcacgacacaagagacgtgcggatagtacgatatctgtgaggggncgcagcgagcganagacacacatacgcacgccactacgcacgagatcactccgccatcactctcggaagacatatatcgacctgcgagcnancngtgtgaagccgagactgttgatgtcgatgctgacggcgcgnttantataagagatgcacgctgtgcacgcttcgagtgctgcgttatcagctctacacctgattgagcgcgcacgcgatgangtgtcgaagcagctaggatgcgagcgatcgagacgatantgaggatgggacggctccgagacgagagacggagagcagtggagtagtcgtatgtg

SEQ ID NO: 9252 - DNA, 118 bp, Homo sapiens
tctctaattaccccgctacaggggatggctttgccaggaaaagcccttcaatagcagcctggccaaagattctgggcaaataagttggctgggtccatgggcaatcaagattctgggc

SEQ ID NO: 9253 - DNA, 271 bp, Homo sapiens
  misc_feature (1)...(271): n = A,T,C or G
acgtcgcggcacccacccgcctcccccttctttctactccctcccccgcacgtcctcttatatatattaggcatgggacgaggacatctgccctacatagacacagccgtgtcacagttctgagccataactgtnccagtatgtaaggagcagatccgtagcgagcaccggccgaggcggctataagcatccgacagggccncagcgaggtacgccgatcgtgacgtgccgacggacgttcgacacgcgcgtggacggtgcgtatgcgcgc

SEQ ID NO: 9254 - DNA, 105 bp, Homo sapiens
acctggcctttcattatcaaaagtcccaagcaatataaaaacctttctttcatggatgctatgaataagtttaaatggactaaaaaggaaggtctctccttcaac

SEQ ID NO: 9255 - DNA, 1712 bp, Homo sapiens
  misc_feature (1)...(1712): n = A,T,C or G
tgagtcagcgtagtgtcanatgcatgttgacccgtacacgacagagaganagatatctnctgccggttctgcagtagtagagcgcgttgctggtgtaagcgcagtatgcagacgcgcnagtcgagtgtctgagtagagctatctggtcatgggctatatcaggtgtatctntcgctctgtgcgtaccntatcgagatgaagaggtgttgtgaggtcgcgaccgtccagtcacgcatcngtggacacgcgtctcatatgcttagcgttatcgccgcgtcgcgcgcacagtcgtcggtcgaaactatagtcatctgtagttacgagtccatctcgcgcttcatcgcactactgcagcgttgagtatgcgaagagctatgagacgtagagcgnagtacaacatcgaaccatgatactgattgacacgaggagtacgagcatgcgagctagatncagatcgcatcacgcgaacncacgccgtagaggtcatcgtctggcctggcgtaggcgatcgcgcgtgtgacgtgactgtgtctattgctgtccactcggtcgactctacgacgagctaatcgaatgagntgtcgctgaggttgtatattctgtcgtatgttacatcgtacgagaggtatgctcgatacgtgtatatgcctgacgcacctncgatgacacacgcgcacacantgacatcacgtacgnagcgcgagacggcatgatngagccgntgggttctanagtgcatgatgcgtacatgtgggtcgacgtcaatcagtggtgcagctgttgtngtcgtcgacgtatgagagtggctcgcgtatgaactgagagtatgcgcgacgcagacacgactagcgctcactgtcgtgcgggtacggacgaaagtatagccgcgcgtcacgtgccgccgccatgcagacgcgccagagngaatgctcgatatcagcgagataggacgcgtgattatagatcgtttgctgntgtaggcatcgtctctgcgtagtcgtagcgtggcgtagaggttcactgtatggagcgagagagctgagctgacgtatncaggcacggacgtcatgcgatcgtgncactatgagcgagcgtgtgtgcgcagatgggntcggtggagtgcgntgatcgttcctccatatgacatagtatgcatgtaaccagctactcgacctgatcctcgtacactgatgntggntatgtctgagtgcgatacgtgctgcgcaggtagtatagtgatangtacgtgntcatagctngngcctctgtgaggagcgaggcaggtagacngngatngtagacgcgcgtacatggcgtgcagagctgcgctgtgantgcatcgagcatatattatatcgtttacgatgcagtctcgataccacntgtanatgtcgatatgctagtcgccactacgtgcatgcgagncgtattatgcatggcgctgatccagcagtgcgaccgcgagagcgaggacggggtcgatcgtgggagtgtacagtgcaacctagtccgcgcctgcgattcctagtatgctaatatagtctagtgcggcggactctgcggtggtacagtgagcctcggtaaagtgactaggccctcgctcgttgagaatggagtgaaaccgaaagttctattctccttactcttaatatctaatcactaggcgatcagtnccggcgcactgctctaacangagcgcgacatcataagaa

SEQ ID NO: 9256 - DNA, 1275 bp, Homo sapiens
  misc_feature (1)...(1275): n = A,T,C or G
tataacaactatatattatgacttaccatcgtgaaaaagaagtcggcgttcgtgctggagacctagcttagtctagctcatctactgtgtggcggcgagcgataattactcagaagacagtcgagcgcctcggcggttagagaatgcatatgtataacgactagaacacatgagcactataatgtatggtatggggatgatgagacggcccgtacatgactatacactgcaacgaatcactggcaatcagcagtcctcgcgtaactatacggatggtgatacgctgctgaccgtcagaatacgtcatgagcagacacactatctctcacatacgcgtgccaagcttcttggcgtacatagntagtctgcggtacgcgtgtatgctgaacacaatgacgtagaccgcgantgtcgtatcggaccgcacttaccacgattacatgacgatatatacctccgctcgtagcttgccgctcgattagtgcctatgcgtatctacgcatcatgtatacctcagtacaagtacgtatcaatttatcaaccaacgcacggctcgtagatagatattactatagcggtttggtactctcgacttccgtctagtgttaattaagatactcttggctgatatgccgtagatgccgctcggccagacgcgcacatcgtatcaaacattctatagtctcgcacagcaccactctagcgagataccgatgcacatgcgctgagctattgtcctctgcgtcgtacagcgttagtgacttccgcgctagcatttacgtcccacctaagcaagcgtgaattgtcttatagataacgactgcgttattattgtgctaattaaccttaactattacgaataataacttgcttccagcgtcgtcatattatatatatacaagtcgtgtgaataagtccgtagatttgaagaccacgctacgctacgtatatgatgaacttaatgacatatagatggtctaagagattatctcttatattgtttctgatcttcatagntcntcatatataatgacgtcctgcgtcgtgaatgagcggacaaaatgctagccgcgtacacacaaatttatagacaactactatacgcagacacgatgcgctcgcataggacatccacttataccataataaatatcatatcgagcagatatggttgtacgtatgtgtggcagaataatacccantgtcgtatagagagtgtacggaatacgacggacaggcgccgctcgctcgtccgttccagccgatgacgtgcac

SEQ ID NO: 9257 - DNA, 362 bp, Homo sapiens
ctgatgctgaaattttcttctaaggagaatatcccttatttacttttgtaaatggtcattccagagactatgattttacgtgtactgcggccaatgaagaaaaccttttttcagaggatgaaaagaaacaattaaaaagatttagcacggaagagtttgtcttgctttaaagattagcacatttgtgcttgataagaagaattccattgaaaggggaaaaatgaagagaaacaagggggggtgaaatgtttattttcacaaatatcttaattttatatgttctttaaaaaagaacatttgaaaatataacagttaaagatatctttctaaaagagaaatgatttaatgaatcttgctttcta

SEQ ID NO: 9258 - DNA, 172 bp, Homo sapiens
ctaggtgtcctggggaagtgtcgctacgtttactatggggaaaaactcagagggcaacaggtttatccgagatgaccagctcggaagcgcgcttctgtataccttcacccatttcatgaaaataaaatcaaaagggaaatcaaaaataaagaaaacgctaaaaaaaaaaaaa

SEQ ID NO: 9259 - DNA, 108 bp, Homo sapiens
gctagttgccaccccatccagagtattcaaattcctacaacacaaaaaagctgcagcaacgtcaaaaactaaagaaagcaaaataaacacatggcctcgttggcctca

SEQ ID NO: 9260 - DNA, 224 bp, Homo sapiens
  misc_feature (1)...(224): n = A,T,C or G
ctaccnggagtgtctgcttgcatggacccattgtggaaaccttcctccgcacctgtgccaggctcttgtggatgccatgagcaaacgcctctgacacctctgacgggagcatgtgaataacaccgaataatcacaacaaatccttctcatcataaagccttgcgtggactggcactcgcaaatatttaaataaatattaaaacactgttggaaaaaaaaaaaaa

SEQ ID NO: 9261 - DNA, 248 bp, Homo sapiens
catcatgccttcaccaggcgtgacccaagagacccaacattctagcaacagagcccatgtcttggagctggcaatacacagcctctatggattttacataatgaaatgatgaaagctatttagtactgcagtatatttcatgcattaatctaatagcatttttaaagccagttccctactcttgtctccctggaatagaaaagccatgggcgaccaacccagaataatttattaaagacttatgaaaa

SEQ ID NO: 9262 - DNA, 775 bp, Homo sapiens
taggttggtttgaaccgagctttggaaaccgttcagcgctgaatacacttactgtaggctagatcgcgtgatgcctgatctgcgggggctcgaacgcgatcctgcaccacactaagctgccggtatctgcatcaagcgccatagcatctctgaacaaactaccacatgcgtgaacatagggaactacctcacgctgtgatcgaattccttatatcacaagaaaatgtatctgatctctgaccgcaagagtggagcattcaaaagccctaactatctaattcacttggcaaatatgaccctggtctctttgttcttacaagactgagctgtgtccgcctgttacatagagagacggaatattattgaatcatatttactgtctcgctgcactcagtcgttactgtgtctttagcggtatgggctcaataggaggcggttatactgatctccacaaattcactgctggacgcggagatagcctacgatcaaccgtcggcctaaggccactaaccggaggaacgctgcgtgcctttccctttagcgtaggctacttcatgatgctgagtatctgactatctgcgctcaggtgataggctgcgaaaccggcatgactaactgaacgcggcgttcccgtatgcagctacctcgggactctcctgataaacattggagctaccggctactgtcggcctatcccttaaagaaccgtgggtggtgtatagctacgctgcaggctctgagagcatgtaggcattactctcaagtagatggggca

SEQ ID NO: 9263 - DNA, 463 bp, Homo sapiens
  misc_feature (1)...(463): n = A,T,C or G
cctggtgaaactgccaatcatactgttggtagtgaataacaantggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgaaaaaaaaaaaaa

SEQ ID NO: 9264 - DNA, 444 bp, Homo sapiens
cctgatgcacgagccaagcttttcattctaggcagccatttggaagattcttctctgcgcatgaccagctgaaaaggaaaaaccccgaaacattggcactgtgatttctccatgtgaacagtttagttcgccgaggtggacatgcctcattcatgcttatggagtgaccgaccagcctttagtgacaccccctgaaatgtgagtcatccatgggtcactagtcattggagaagagccccttatacaaaacttggagctcagaccacaaacaacaacaacaatccaaaaaataaaaaaatgaaaaattaggagcagagactaaatggaaagatggaaatattaaaataaaaatattattttaaaaattaatatgtattaaaattttatttaaagtaaaaataaataaaataaaaaaattaatattaattaataaaaaaaaaaaaa

SEQ ID NO: 9265 - DNA, 1485 bp, Homo sapiens
  misc_feature (1)...(1485): n = A,T,C or G
ccggcacaactcgcaccagccacgcctcntattaatattntgtttcactctactgccggcatagtctcactctctacccccgccccnataatctcctcttatatgattagctgccaaacagttagctgaatcgtntagaaccgcgacgcgcaccatccgacgcgcagagcngcggtaggtagtgcgagatgtagttatacaacanatttaatctgcgatgaccctactgacgataagcatcatctcctcataggacagcaccgccgccgcgacgctacatgcagntatcaatatagtcgcacacgtcagatcagaactcaggtcatacacagatatgacatgagcgcacggactcatgctctcgatcactccatcgcgtcactctactgctgctcaccgtgcancgtgtcaaccgcactaaagcagtaagagcgtacgacctgtcgcccgccttctcgatacggcctcgtacagcgcaccgcgatacacatcgatgagattatgtcgagtcacgtacgttcgtccgtgcaggcggcgcgactagtgcctcatgtagtatatgacgcacatacacgagcatacaacatcnacgctcgccgtgtgtggtgctccgcagcgaagctctgacacatctgttgtgtgcgtatctagtgataacgattacgatacgaggtacagatcgagctgcgcaattcagcntcgntcgcgactcaagacactgcatanagtacactcatctggcgacgatagtacaagactgagcgtgcgcgctagcatgcgagaatagcatganacttagtctactncagctgagcgagcggcgtctctgncgtatactgcaagactggacgtctgcagatcgcgctaatcggatatatgctgaagtaagtaatgctgcaatgcgacgtgctgcattgttagcagtaactcgatgtcacgggcgtatcgacgtgatacgcgtagtcacgcgtagtttctctgctgtcaggtgtgcgcaacaccgcacatgatatgcggcgagacgttatgtgcgagcagacacgcagtcacatttagtgtcgcgcaatacagtcgagccgcgccgcggtatcgcgcccacgtcggaactcgtgcgcgcactgntagcgagcagctggagcgaattatccacacttacctcaccgcgaccgccatgataccgacatatcgagcgtcctgattagacaattacagtgagccgatgcgcgagccctcgactgtacagtcaacaagatgngtaatcgcgtcgctcgtacgtaccacgacattgttanataacttatacgacccgtcttgtcgattgctccaggcgcttaggctgcantatgatctcacacatgcgtaagtcgggcgcacagacngaatgtacgcagccacggcgtnatgacgcgacgatcaatgcgtcctaagaatagagagcagtaaatgctcgtagtgagacgaaactgcagagatctagctanacct

SEQ ID NO: 9266 - DNA, 1151 bp, Homo sapiens
  misc_feature (1)...(1151): n = A,T,C or G
gcatgctccccccctcgtatttttcttgcgcccgaactccatgctccccggcaattccgtgtgtatttagccgccactatgataaatatcacctccaatcatcgtcccgcgcgggggaagatgtgtttgtgctacacatcaataatcgtagaccggttgttcttcaacataatacctcgaagtaacccgcgcgccacatagtcgatccacgactagcggaactgtatcacgtgtatacagagcaccgaaatatttgatgtcctccgcgcaccgcgtcagtcagttatctcgataatatatagcgtgcactttaccgtcttcatatgacataacagacaagctaggctcaatatagagtacatatattatatgcgtaccgatccgatattgatagtctcagacacagaaaacgacgatcctcctgaacgtactatgagattgcaatagcgagagctcgacgatgtcagtcactgaggacgccggatcggcgagaatgaccggagcattttcctcctgtcagtcaaatatgagtgtgtcgcgaaaagttgcgctcaacacacatatctagtgcactattgcgtgctgaggagcgcgtgaccgtgatgcagacgctagcgctctgccgctgccatgtacgcttgtggggcttactctgtcagatgagatctcgttgttcgatttgtctcgatcagttattattcgcgccgcgcatattttctaacctgtactgtcctgttacgcgttcgttgtactctctatctacttccacacggctcgcttatatattccatttgtgatctcgtcgctctcgtagaatatgccgccatttaattattgtcngcggcgcaatgagtgacgcataatatgtcctatgatcgtcgctacccgcattgcacaacgtcttagcctggtcctcttattcatagacatgtgcgtataactgagccnagtacagatgtaacggttgcctagtcggtttatgcgcgtagcaatgattgtataattatagtctccggccagtcgtcgtatgactagattatgtagttattcgctcacacgcgcgcgagaccccgaggaagcaacaagtcgcggctccgtttagtgcaggtaacgaacctgagtacgctcgcgcattgtaagagacctagaag

SEQ ID NO: 9267 - DNA, 1072 bp, Homo sapiens
cgccaccccccgcagttatttactatccgattcccgtccccccccttctccagtatatgttaccgccgttgattccgcgacaaccggtacactcgccgccgcggggagtggcttatttaactttcgtcaacttcgccttcttatatatacttattatacgccaccgccggccggcaggaagatatcaactgcgacgtgatatctcgtaaccaccttaccgcgagatgcacatttacactagatcgtgtcgcgagtaaaatgtgtagtattaatctcgtccgccccctctccttggccagagaaccgctgacaccagcgcaaagtggtacgcttacctgccgccggcgcgacatatcaccaccggtccttcagtctttcaaccgtttgccatagatgttacaaataagttatagcatgttcagaatgacgatgagagcccgtctcaatgtctatgccgatattagtttcgtcctgatcggattgaccatgatcaagggccctctgcagtatacatcaacgtgtataccgcttagaattactagagcgggcgctatgcgatctgcatcccacagatgaccgcgctcatagactcaatggcgcgtgctgctcccattgtcaccgcagcttctctggcgccggcgctgtggttagtcgttcgctgctcctccacattcaccatcctcgtgcattgagccgacaacccgcggtgatatgattcaccttattctctcacatccccgtgatacgccgttgtgttggagtgcgacccgcgtcgggcgccgtatattcatcatgcgtcacgcttgatccggatgtcgccgagtcgttatacgacgatggctacatataaagcatgtagatcgcacgtcacaatcatctataatacactctgaacatcgccacgccgtcatgccattatcctgttcttttctgctccctgcacgcgttgcgctcccctactatattaactcccctcaacgctagagacgactgtatgagcgattcccgtctcgtcggatctactcggattgtatacacgtaggtcgactccaccaggttgcgtcaatgcact

SEQ ID NO: 9268 - DNA, 1109 bp, Homo sapiens
  misc_feature (1)...(1109): n = A,T,C or G
cggaatttaccactttcgacttttccacttctgctcaggctggaggattcttgggggtcaggaggcgcgtatattttatacgtttacacgattagccgtgtactacgaagtagttgacatcatattgtatcaattagattcgaattggtgaatgtgtcgtgtatagggtcgcaccatttatccgttagtagatttacactgtcatctcacatatttgctgacatcacttattaataattcatcgcagcgacttataccgacgcgccgtgatgtcggcgaggggtattcacgagcggcgtcggtcagtttttcacagggttgctatttatttggttagcacgatttcttattaatctcgtgttctgccctgccacgcgtctcacctgtctattatcgtggacgtatatctggcacgcctgtccgcgctaatagatgtgtttaatggaaaccagcagataaccgagatgacttgggtgagtagtatgttcttcctctatgtacgtcgtcgttatactattcttcctatgttatagcatgcgtgccccaggctgtagttaatcgctcgtccaccccgcgcgtctgtgtgtataacattgctgcggtcgctcccgtttgtttgctctctcgcgcccgctgcgctttttagcagtccgaggcggatctgatgtgcgatggatgtgcgtcgttcttatattcgcgatcgacggcggagtgcgttatttgtgtatttactcctcttatattcgtctacctccgctccacgcangataagaccaactgataattatagagaagtgccggaccgtgcatgctagtattattcgcgttatgctggtcactcgatcccatattctataagccgcggagtaacgcgcgtcgctatgctcacgttttctcgctatttctcacacgtgtattaccgcctttattagtgtctgtatgaaaaagcgaccgcccttgggctatgtcgccgttgtagagtgatagagattcgcagncgtttatcgtgtgtatatcccgatcgttagatctgactccgccaattgctaaatatgccgcggctaagctcctgagtttgattcacctacgttatctgcgtgcgacatccg

SEQ ID NO: 9269 - DNA, 632 bp, Homo sapiens
gcctggtggaacgacgaaccctatttagagcacgggacactgcgaagagatgcattattggcagcgagagccagcatcaaatgcccacgattcatccacatctgcagcttatagtcacagggctaggccgttaacataaaccatcacatctgcgctttgtggtcttatcaaatcatatgtgataatgtcacaaccagaaagtgagagtttaaggtgtgtgactgtactgacttgacattcaacctaaaaagggaccttgttatgaacatcgatactcccagatcaaataatcttatttaatcctatcactcttaatatttctaaacttattttcatcagtatcattgattcatctcttccatgtacataatgtgaaattatctaagtactcttacttagtagcatgtaaaaaatgtaacttgactctaaatatttgcaattcagtaacagaagatcttgtgtagctttgatggatccttgagcacatatattcgcaaagcctctctaaaaaatggtttttcagcggcatatagtgtgtgatatctcactataccatgtctattagacagaaaaacaccatattttttgaaaatataaaatataggtcacctttttcaataaaaaaaaaaaaa

SEQ ID NO: 9270 - DNA, 2275 bp, Homo sapiens
  misc_feature (1)...(2275): n = A,T,C or G
gtgtcgtggtgatgtggtgtgcgcgcgatgacgacgntcgtngngctgaccgagccgagtgatggaggacgtcgtgatacgagcgntatcatntcgccgcngttacgtgctcgtgtgtcngatgcagtagtcgtacttcgtatacgagcgagtgangtcgtacgngtnagtggctcgancggtncgtcgagantantgactgcgagagtgntgggctgtgcgcgtagacgtgcgcagtacacgcaggatngtgcgctgctgtgntannggngtagnagggacgatagcagagcagcagngcagggtanacagtgagntantcatgatctacnagtcgtgtacangtgcagaggacgntcgggacggctgcagaggancgacgctgtccacccatcgctgggcgcagcagtagagcatcgtaganatatngacgagcgcttactcggcgagtagcnatagtcagcaattntcgtngcgtancacatctcgtcgtcgcnactatgctcgantgtcgtcgtcgtactcactgcnaccgcgtgtnagtcngncgagngaagacggangncgtctgatcgtcnagtacacgggcagtacgtatangcngtngtancatcancgatctggagtgggacgtgtgtggtncgtcganagtgatctagacgtgangtnctgtntgacgagcagcntcngntaggncgagtgtcngcgntacgtcgtcgacgtgcgcggagtcgcgtgacgtcgctgatgtgcgtcagctncgantgtgtcgatcgctgccggcagacgctcgcgtgacagtagtgtgtntcgtngtggagtcgccgagcttagatcganganancnccgtctgcgcngatcntgtcntacgnggtncgagcgacgtgccgtacggcatcgtcgtnggggccgatgnactggcgcatgacggactnatgatgaacgtcgttgtgcggtattgagtgttanacgtgtgactgcgncgtacgctgcgggatgctagtgcgtcgaatgggatgagtgtacgtgctagagacggtatgtaagagncgcgngcaggagagaggaagagcaatgtngtgcgtcggacgacgtagcgtcagctagtcgcgcgatgtggagagagcngnctagcgacgngcgtcgcgtcgtgaccgcgngtccgcgtgntcngctcgtggtactcggtcggtactcgtgagtgcgangctatctgtctntcctactcgtngntgctctcgtcgcgacgcgcatcntcngtgtgctggctgctcctctgcgatnacgtgtnctggcgcgatatcntatgcgtcgngtngagtgtgncgggtgtgntgtgtgagtgcactcgatngcgtagtctggtgacgacntcgntanctgntgngtgttgctcgcgcgcagtcgcatctatgtatgtatcgntcactcatctgttatctacagacgatatatcanacancatctgagtcacaactacatcgantcactanatntcttatcgactaatgctacttctatgatanatacnatctgntatttagtcgctngatcgatgctatacnnnggacgagctagngcacaatangagtanagtacagcatgaanagcgtgncgatagtacncctctggctgntcatnacttnnttcnnnngntntctatcngtggttgtttgatcnctntangatgtgcatttgacgctcgtcatngntanttctagcatcttctnctcntctatcantcnctcanacgtacangacagnnctnnaacgantacntctcnactnccncggcgtncctaccancgcctncttgctncgcccnncctnctactnttcnctttattacttntanatctgatcatcnacgactatncnactatctacattttctctctatacactntacacnntcannacnctctatcatnatntaattatattcatacatatntatantntcattantnatttactntnttgcnttgtattatnatntttatntncactaatattntcttntgtnttnntactnnncntctnacnntnnnataaagagnnttnnnttttntnatnttntnntnttntttggtntttnttncncctctctntnttaaaggggatntnnttacttttttcnttnttnntnnttttttatannattntncttnnnatctnttatntacctctatttcacnanatattctntntntnatntnnnnntnnnttttnntntntnntantctnttatncncnnnttntttattattattt

SEQ ID NO: 9271 - DNA, 2682 bp, Homo sapiens
  misc_feature (1)...(2682): n = A,T,C or G
cgacagagcaggacagcgagcccgatagacggatgtaccnccagacacatcagcggcgcactgagacgacagcgcacaggccggcngngngaggcggcgcgcgcccttttgnngnanaagannnnngaaccnngagngngngcgcgcgnngnnggggcccctccnggngngancagannngangancaaaccnnnnagngccngnggngcagngcggngcgnngngcgacagnnggacacgacagcagagcgcacagcgcgcacaggcagcgtctcgacgacggngcggcgaagacgacagacagcaagcagacaacagccncagcacnggcgaccgcagacgagacacacgcaaagcacacgananagcggcacngangcacacgcacagagaagcgagcgcngcacgaacagagcgnagagagncnanncgcganagagcacgccgcgcagaggacggagcgangangcaccaggacgaacaagaangacnngcacaccagagcaccgcaccgacgangacagagacagacgacacancgncagacagagcacagcaccnncgagcggcagagaacgcgcaacncgagcgacgcgcgacagcgacagagnaanacncggagcagagagcncgacggacaacgnacgagaggagangacgagnangcgacngagccnggacgagactagtgtctgtctttcgttgntnctgnaggcagangcnacagcancgacacccncacagacccgngaacgacgcagacgncagnaacgaacgcgagncacagaacgagacgacagcggacgcanccgncganagcacgagacgancaagcagcgnnacgancacggacacgnccagacgnganaggcngaagccngcagcgaccaganacaacngnaacgannaanagngacgcacnancgancacgacaganaccagnnacgcacgagccggccgggcgcancgcgncgcagngcagggaganacgaggagnaaggangacgcgnaccngacacgacgcngcncncaganacgaagccaccacngacagacgagacgacgacgcgcaagnaancgcancagggnanacacgancaccgcgaagnanagcgcnagacgcgaacgananagnacngangacgagcagcagcganacgacgacagccaggcnancgcagcnagacgacgaanngacgagacgaagncanngcgcaagcagnagacagnaggnacnganagnnnagncgacgacagaagcaaggcgaacgnacngagnacgagcgncnagnccagcgaccncgaagagagcanccggcagcacgcangagaaanacgnacganannaganncggagacgaagcancgacagacaaccngacnagnngncagangcagnagagacgnnacgacanccagacgacgagcnncgacgagccagcgaacgaagngcgacagnaggacagcnngaacanncgcacgcgcagaagcagaagncancnancacgcacgaaggccagaccgncacacngaagaangcagccgcaaanacnacnancgnngcagcgccagcggcaancancagcnacanncagccancagcagcacnccgacgcganagnagcacnacagnanagnngcnncgaccacgacgacgcagcgacncgacgcaccagcgcncnncgcggcggncagcnncgncgacggnnagacngcnacgcngngcagacganagncagagacgacggcggcgcaagcggcncggcnacgacncacgacacnacgccggncagcagcggncgngaacangacggancnncgcannagcananacgagcangnaaacnacncannngcgcacnanncgncgcgncgacgacaacacgaacggcagacggcanncgcgacgnagncanncgannacagnaacgncgcgaacgnagcagacngcagcnncggacaaccncagncagncgangaanacgacgcagnngnccggccngacaatcgaanncgaagcacgcagcagcgnnacacnannannncgaancgaagcnagagcnncgnacngancgacagnngangccgaagncaggcnnggnagnacnacnnagagccnagnncggancngancgnacgangaccagnncagcnngagcagnaaccaagnnacnnacgagcaaccacngaggcacnacgnnagcagcngancagcnngannannacagcnacnngcannacgnacgaangaaccaagnagcnacnngnnncaggnnaggccnngncagncagncggacgacgncgacggncangacgaagcagcngaagnaaagncgnncancgngaaggnnncgnncagcnancagncgcnaggcggaagnccggagnagnncgcgancgacnaggcaagcangncancgnacngacngcnnaggncagcagncgaacgnangccgacnganagcngacaagcannngacagcgacanagaacnngancgaggnngcanngccancagaanncaacgnncagaacnngagncaccanngcncgnacggnanngcgcancgnagcnagcngcnncganccnnagcagncacgnncngaaanngcnnagcanntaanacngncagccaagcgnacgnncgaanngnntagnnacgnacntgntggangcng

SEQ ID NO: 9272 - DNA, 1134 bp, Homo sapiens
  misc_feature (1)...(1134): n = A,T,C or G
acagaaaagagcgagacgcagcagagaccagcacgacacgacagcacgcttcggcggggaaagagccgaggagcgccttaaccgggggcaaaaccagcaccgacggcgcgacgacagggcggacaccagcgcaacaccgccaccgacagaaganagcacacgcgacccgagagcgaggagagaggacagcagacccaccggagacgcaccgcgccgcgagcgcgacaaggacacaagacagcacaagggacccaacaagacacccacaggacaagggcaacacaaaccagccgcagaggcgaccacagcgcgacgaccacaacacaccgcgcacgacggcgcagcacacaacaggcccccagaacagccacgaaaccacacgccaccaaaagacgacgaggaaaagcacgaacggcggacgcgaaggaaagaggcacccaacgaccgagccaagcgcagcaaccacgcgcgacaccaccaagaaaaggaggcaagagcggagagcagggaaaaaacgaccggacccccgccacgccgaagcccgcaaaggcacacaagacgaacgacgcgagggcccgcaagagacgcggagaccagacgacgacagacgcaggagaggcagaaacaaaaagagagcgcagccgggggaccaccccgagcaaaacgcaacgccgaaccgcgaagcagaaccgccgcagcgcacaccagacgaggcgacgagcgcgcaacagacggaacaagaaagacgagaacaacacagaagacccagaagaaccggccccgcacccgcgaacgacgaagcgacacccacgcaaaagaccccccacgcaaccaacggcacgacaccccaccacggcagagaggagcgacgaatgacgtagaccgcgcgccagcagaagcccacacgagaacgcgccgcgcacccgacgccacaacaccacggaagccagaagacggcaaggcaaccaccaggagaagaacgagcaccgacgacgacactcgcggacccggacacacacgcgaacaagaacaacaacgtaagcagacacaaccccgcaccncagcgcgaccggcgcgagcacaagaagagcacgccgaggcgactggcgcggcggggcaggccgcacgaaacag

SEQ ID NO: 9273 - DNA, 462 bp, Homo sapiens
ctgttaatgcagacctagtttgaagagattacaagacaagtcatcagaacaacctgtgggcagtgtaatgaagcctggcagttatcacaactatcaccgctttaaaatattaagtatgatacacagtagcatcaatttttaaaatgtggtcctggtattcctggcagatcctgagatctttctaggaagccaatgaggtcttcttactcctctgtgtgatgaaatggaaggcactcacactggtcacagtggtcatctcaaggaaaagtacttgtgcatctgagttgcaagctaaactagcagctcttctcctggaatgcattttttttttttttttttttttacagaaaagaatgaacaagtgtcagaaaagaatgtttattcagacttggatattttaaagacattttatcaaaaataaactaagtgagcctgccacttcaaagaacaaaaaaaaaaaaa

SEQ ID NO: 9274 - DNA, 1265 bp, Homo sapiens
  misc_feature (1)...(1265): n = A,T,C or G
tccgaacagcgagcggagagccacgcgcgcccacgacacacgatacagaagcagaggcnacacaacgcgacagccctccngcccggccnacacacangacagggacggcagccttcagaacgagcaaaaggacacagaagaccgagaccacagacagagaagcagacgaacagaggacgagaggaaaagcagaacatagggcagaaaacaggaagacgaagccaccgcggggaacagcaatccgcagcgcccagcgcacacggacaccacacgcggccgcccccctcgcgcgcggacgtnccaagccacgcgggctacacgccagcaacaccaggcagccaggcgcagcacgcaccgaggcagcaagacgcaaggccgccacaccgcaccgccgatccagcgcgcgcgcgggacagacggccacacgcccccaccacaacctccagagcagccncacacgcgccccgcaacgcgcgacacagcggccacacccacgacaggaagtcacgagacgcccggcggcggccgacgcgacgcagcagaacgaggaccaccacgccaccacacnccaggaccgcacgagacgcgccccccagcccacgcccaccagccccacacaccaccacaacagcccggcgccccaacccacacacctccgcgcgcagaagacaaccgacagggcgcccagcagggccccggccaccgaaccgacagcagacccgccacgacacacagcccacaagccagaccaagcagagaagaccctcgaccgccgccctcgcgcgcgagcaggacagaggaagcagacgcncccgagcacgggcaccccgcagagaggcccgcgagctaaaccggcgtccaacgaggcaccacacagaagcacgccaccaaccgggaacaccgccagggccgcggcgcggccacagccccaccggccccagcacacaacagtccacaccacgcacagcagctccaacacaccaccccagaagcagagaggagcggatgcaggaagcgnccgaacaagacaggccaccgcacgcggcataacacacacccctacaaccgcaggcggccgcaacgagcgcagcgctcgacgagtgcgacgactgtcgcccgcacgacagacgagcgcgactcccacgcgacgcgcaaccgaggcgcaacgagcaccgacgcaaggcgntgggcaagagcagaggaggccttcgaacgggcgacacgagggtcccggacggtacgcgccgcacgacgaccgcgccacg

SEQ ID NO: 9275 - DNA, 289 bp, Homo sapiens
tgactaccttaccgacagccgtagggctgagacaaaacatgacgagaccctgtccgggagcccaggggaaggcgactcgccccagggcggccgctgcagatgtggtccacggtgcttgggtccacttaccgcagtgcgactggaaaacctgttggcttgactaacctggttacgttcgcgtgacactacgagatagaaatcataaatgtcttgggttaatggccaaataagttcatatctgtgggggaaatgaaaacaagtgtgttttgaaaaaccaaaaaaaaaaaaa

SEQ ID NO: 9276 - DNA, 1218 bp, Homo sapiens
  misc_feature (1)...(1218): n = A,T,C or G
cgcgggntgtgttcctgtccccccgcccctcccacnncgcccgcccccctccccacggcctcccccctgcgtttccgccgtccccctcccttccttcccncccctgtcctcccttcctctncctcgttccccggggggggtgggggtctgacatactttcgccccccttctgcccggtcgctcttctgtgtctttgtcgtgcggcgcttcttgcccgcgttgcgtgttgttttgcgcctcttgtcccttctcgctcgcccgcctttcttatttgccccgcgtctctctccctccctctcttcgcctccgttcctttctctctgtcgcggggggggggtgggctctctttcctttctctcccggttcnctcttcactaaaataatctctcccttctctttccncctcctctcttcctctctctcttttctcttctcccctatccctcttnctctttctctcctcccctacttgcccctctcttcccctctcttttgccgctccgtatagtctctctctgctccccatgccttggctcccctctttcttcttgtcccctcctctcgtcgcgcgtctctctgctctctcgccctcccgccctctgtcgcttcctctccctctttctttggtcctcctttgctccctctctctttgtctttttcctgcctgtgtgcagctttctcttgtcgtttctcnctcgcgttacgcttcccccgtgtgctgttgtcatcctctcggtcactcctgcgtctcgtctgcttcgctcgctcctctgtgccgtccgtgtctgcgccgtgcgcacgcccnccnccccgctctcttcttacgtccgtntcctgtctctctctctncntctgtcctctctcttctcnctctgcttctctctctctctctcttcctctgtcccttcttctctccttcagcgcgcctgtgtctatcggtctcggcttttcgtcttctctcgtctctctctctcntctctcatgcttcgtctctcgtctcacgcgctctctcctgtttctgtttcgtctccgctttttgtgctttgctccgcctgttggctcgtgcgttgcgtggtctccncgccctctctggtgctccgctctcgtctncctgtgctctgtctctctcgtccttgctgcgtgtctgtgcctgtgttttctgcgcgcgtgcgcgtcttgttgtctcgctcgctcctctcttncgcgtctgctctccgt

SEQ ID NO: 9277 - DNA, 1795 bp, Homo sapiens
  misc_feature (1)...(1795): n = A,T,C or G
cgacacaacagggcacagcanctcataagcgagcgtgaacataggaggccacnaangaacgacaaataggcacaaacagtgcgccgcgctggcgaggcgcgngcgcaaaacagcacgacncaccancnacngcctttcgcacacagcggcgcnagcacacgcggacacgaagcagcgaacgcgcaacgaggccgccncacactcgtccagtgaggatgcaagcgagcgcacgcgaaggtacggttagactccccaacagagagagcctcgcgacaagaggaggtacgaccgacatcatccgcacacgacactgcacacgagagaaggcgcagagcgaagccgctgcaccggaggagcgcagcggcagggaggtccttcccnaagcagtatgaggacaaagcgacagagacgacaggtaccgtgcgaccacgagagcggacaggagagncgtgnccngaggcacgagcaggtganaggcgcacaggaagtgagnccggagagtcggtgcggcgtcggatcggaggtcaacgtgangtggncgcgacggagcgcgcgtgcgagacgcgcgcaaacagacacgcgcgcgcagacgacaccngtgctgaaggaaagcgaaagaagggagcgatggacacgaatgagcaggagagacggcagagccaaggcgacagctgaggcaatgacggtgaggacaggcgncggtgacgccgcaggcggtaaggcttcgncgacccagagacgagcagtagagacacagncaacgagatgcatctaggtgagacatnctcatgatatgacgtgagcgaagacgacacacgtacgacagacgatgcagatgcatgacanccgcacgtataacagcgctcgtcgacgcgagaggagagcacacaagacacatcaacgcgagatanctatacnaggcgagcgagagccacgcactgccgatatatgtcacgcaggctaggagccgatcacgcgagaatacataagacgancgcagtcgacggcgagaagtgcgcagagatgcacgcgagaggtgccgcacgtgacgtgcgcgacggagcatacgatagcgtacatcgggcgcgacagacacganaccgacgtgcgncacacgtagagatgngcgagtagtatgtacggacgaagcaggagcgtatgagctcagacgcacacganatcggagacagacagcaacntacgagagagtagtcagcagcggcgcggagnaggtgacggtgacagncgtagagtcagacgcgagagtgcntcggctcagcgcagcgacaggaggagcacatgacagagacgcgacncactctgacacagtacagacagcacgccgacgtctcatgcagcatangtctcgantanatacngaacacatcgncacaacgccgctaccagagcagttgacgacgcangcacgcgcagagagatcggacagcgacgactcncntagcgaagnagagcgttgccgacgagcgaggcaggacgtgagagggagcgcgacagcgacnactgcgcacggancacancanctagntacnactanacacanagcgagagaggaagaagagtagagcaggagcgccccggagcagtcggcagtgtanancactanatagaaacagacataatgaacgagtagatgagacggatgagacgatgatagacgtagntgntcgactcangacacaaatnagcgangagtncgtactgatacgtacgaggcgcacaanganacacgatgatgatgagtcacacgcactgagtcgagcgagacancactacg

SEQ ID NO: 9278 - DNA, 1458 bp, Homo sapiens
  misc_feature (1)...(1458): n = A,T,C or G
gccaactcgcacatacacncagatcagacacacgaaccgacgaggagaagacagcgacacncagcgctcgcatgtggtgagaactaacanacacacaacaagtctgaacaaagagagcgcaagacactaagcgcggagcaatgacgagaacaggcgcagatccgaaacgagcgangtattttcttntacatatagtcactcgactgcacagcacgccgcactccgaagcttactaagaggagttacgcacacagccccgtccatcacgctcntgcgtgcgtatcatcagggacctcgntaagtgtaggtagacagaagacggcgcccacgtcaccgacccactataatagacaagtgaacgaaggatacacagaacagcggaatacgttaaaccgttaggcaaagagtataaccacccattctatttcccgtgccggacagggatcganacactcattaagtctctcgtcgtcttccatggcttcatatatgcggcccgagtgctactccggaatctacgtgattcgccgtcggactacaatcaccaggtgtgtaatctgatctaggtacgcactgcagacgcgcctcacctccagtaattgaagagacggacgccgcagtataaccgtctccgttccgcgatgcaccaagctactactcatcaccatcccaccatttatatctccacacgtcgcagatccttatcaccggcaacaattatcgcggtaacgtcccggatcatcgcgagatccgcagtgcacgcactatatcactactgactgtatcagcgnccacgtanatggtatgggaatggagataatatgtataccgcnacgcgcnacagagagcatgcgtcatgcccagtacacacggacgtatcgcaggtactccatgagantgacgaagagattgataatgcaccacacgagcccacgcggcatttaagatgacacagtcccagagtaagatgtcgtagcgttacgccctgcccctagaatattttgaagatgaagcccgactcagcgacaatctattaatagcacccgccgtgattacctgtatcttatttaatagtggaactccatccagaccgaaacagcggtnattgcagcagagnctcagcaatcgccacaccatgccgaatgtncactccgatgctcacacntgagtgatggaattcaccgtgccgcgtaagtagtgtatcgcgtcaggatgcgaggcgcatagtagacatcagtngactgacgtaaatgagaagtagacgccgacgcaacgagatcagancgcatgnagaagatgagatanagagacgngagatgcnagcccntccggcaatacgccgcgctaaacgccgtgtgaggtgtctctatatagagatagtgtnatcgactcgcagatcgactatatctgagcgatcaggctcacgaggcggtatatcagtaatgaccattntctacc

SEQ ID NO: 9279 - DNA, 1161 bp, Homo sapiens
  misc_feature (1)...(1161): n = A,T,C or G
ccaaccacccccagcccccacaaagcaagaaggcccgacaggcgctgtaagaggaaacaaccgcaacccacttagaaggcaagaacaaggacacccgcgcgcgcaggaaagnccaggccaagaccagagaaaagagcccacaaacaacaccacagcacgccacaaccccgagcaagcgagagnaaccccgaggggaagaccaacacaaggacnaaaggcaaagcccacgccaggagcacgggagccccacgcccccnagcccacaggagaggcgacgaccaaaaagcggagccncacacgccggcgccggcagagaggacgcgacgataacgacacacggcgagcacgacgccccagcccgcgcaccaggcacaacgcgacacccgcacgaccgcgcggcgagatgccccgccagaagacagagcggcagcaagccgaccccaaacgaaggacggccgccaaagaagcgaagcaaacggaagagccacgcatctacaccacaccaccgcacacccaaaacacacatccacgaaagacagaacaacgcaagacagaacagagaggccaagcaaaaggcacgcgagagcaagagccgacaagaaaaagacaaagcagaccgggaacgaacacacccccacaaacccagcagaaaaaagaccacgagcagcgaagagctcaacaccaggggcccacggagaggtccgccaggcgcccgcacgagcccacaagaccgcgctgtccgagggcgagccccgcgcagcgcagcaaagcgacgaccaaaccaggaaaacgccgcaggacacgcgacgcgcacggaaagactccacacgaggtcgagcgagacgcgnacaacacacgagcgaacacacggggnccacacaacacccgcgcacnagaccggagcacgcccaccgacgacgcgagccccgcgacacgccgccccaagcagcgaggccccagccggccacacaaccncacaccgagtgccggagacgagagagccgagcgaggaagcgcgagatctcacacgacgaggcacgcaccaccaaccacagaacgacggcgcgacgaagcctcaccacgacacacgacacagacgagagcgaangcgcagggagcacccaggaagacgaacagagcgccacgcaacacacaccgagc

SEQ ID NO: 9280 - DNA, 1225 bp, Homo sapiens
  misc_feature (1)...(1225): n = A,T,C or G
cactcctcatcccaggacatccnagccntacgggatatactgggccaccaggggggaggggaggcccctcgaattagtaaaactaacaccacacactgtctttcatcacacgattaaaacacttccaaaccaangcaagaattgcccaccantcggaatgggcaacctagtttccaccaagcgcgggaaaagaggggggtactaatataaaaaccctaaacatttccaaaatattaattttgccttattttgtcccatacaactcataactaacaatactatatcacgatctctctccattgctctaccaataatcaaaagtacaacaaaacagactaaccacaccacacctatataccctactacaattcctcttcgccccttagcaatcttttctttaataaaagaggagaggtggcctccacacatcacattactcccttaccacaataagaacaaaaatttctcccaatccctnttnctcatcctcactctatgtctctccctctatacacatctgccttcatgtaacacttaaaaagatataacgactccccactctcaccacaatacaccctgatcaccagcctcaccacacctcactttcctgtttcgtccacttatccccatacttccaccctatactcgtcctcccttactattctaaattattatcaacatctaccctccgacttactatattactttatctcttgcctcaccacctaccactctccacactcacattccctacactgttcttaatctatactacctcatctcactcctacaatccngttctaccctcctccactctatactacgatctcacttctccctccaccgtccatctncttcacatcgctcactataacacatacatactatttactccaattatataaatcatccatactcccatacaccacatactattacttaataccttctcttcctccttctccttcctcatgcatctaacctctccgaatctcactatgtacacccccctacctctctaccaccacccattactatatacaccacacatccaacataatctacctaatatacgttgtaatttaaattgttctctctctcgattctcccctcctatagtttcacctaccctctccacacctcctactattcacgacctacgcccatccaaacctatctatcttctttcattcacacatcctccctactctatgctatacgccct

SEQ ID NO: 9281 - DNA, 167 bp, Homo sapiens
ctagacccaagaaatatattctgaaatgcaattcaaggctaatgtaacaacaaggttgcaaatctgagcatatatgtcagaacagagagagttacagttctcatggtaacattatatcatcagcattatactgcctgcacaataaaatactggcctcgttggcctca

SEQ ID NO: 9282 - DNA, 1130 bp, Homo sapiens
  misc_feature (1)...(1130): n = A,T,C or G
actatatgacaatcactattcacccaaatatacaccagcaacaatcgggggcctgaagtggagaccaggaacgagcctttanagaaggaagacctagtccaaggaacacactagctcggctatcaggcacgagttcgcacgctaaaactgaacgatactcctagattacctagaccctcatcccacttctctcacttctctgcatcgtcgactttcacactaccaacaccatgatcataatgcacaaactcacgtaccacagcttctntcatgtacataagagagtgaacgtatacactctaactaatcgtagtagaacaagacctcaacacgtccccctatatagctactctcttatcgacatactactcagctcaccaacgtgcatatataattgcgatctcctcacaccactaccaccctatagtaaaacaatcatcgcacatatatctcctaccatcctaccaaacaatacacccgtaaccccaatatactaatacaactaactaatcgtcctccgcatccacaacggcttgaagtgcacccagcatcggtaggtgctgcccagataaatcctcactaagttagcctacaatacgatgcccccgatattatccacccgactaaagacgcacaaccaaaagcacaatactcaatataacccaccacaatcattcgtacacatgatacctacacacactaataccccacgccttccaaacctctactcttctcctccgtataatatagccatctcaacaataatacttcccgcaaacagaccacaactctcccaccgcattctaatgcaaatagcatcacataaattcaccccccatcacacatcgcaccaacgacctaaccctctacacgacactcagcacagcaccagccctaatactctaacacacaacaaacaagtccaacaatacaaagattctacaccatacgcatcttcctatattaatgccacacagctacactatggatgtgccaactacgatgaaatacatagacatgacaccagaccactacacctgcccctaatacgcctacccgttattcctagacacccgacccataagtcaactaaggcatatgaatcaacatatacactctaccgtactatg

SEQ ID NO: 9283 - DNA, 1309 bp, Homo sapiens
  misc_feature (1)...(1309): n = A,T,C or G
gggcacgagcgtgattccctcctcggcgagggganccgaaaaactcgtcaatgaaatnaaaagggggagnctgaagggggggaaaacngagcgcaggggaagaagagcaggaacaacanagagaatttagaggacaggccacggcaagaagggcccggcagcagaagcccagcccgcagcgaggccggagaccaccaacgcgnacccacccgangcactgagacagagcaagcggtgcacgagagcatgaggcgaggcagagaccgacgatacggccgctacggtatgagtaccctactatgagtcccaggtcgcctgtggcgccaggtatctagtatgttatactatcttttattntgtacaacaaggccctcccggacgcttgtggagatgtagtaggtgttaggccggtgtgtttggtttatatccgcagatggtgacgatccctatatattatgaatgccttgagcctgcgcctgtgtggagtgggagtactacattgttctagtgtattacgtgtggctatgtagcgtatctaactcatacttcttatttcatcttctgctactgcgtataggtgacaagtgccggtgcttgccgcgcgttgtggcacggcgcggntgacagttctctctatttcatcttgatcagtgggtggggttgtggtaggtgttctgtggggtgttgtttttcgcgtcgtgtaagtgctctgtatgtgcggtgtgctgagtgacgcttgatattttttagtttgtttcgtcaacatgtggcgttctgtgagctcgcntccgtgctcgtttgtgattgatagtggtgtgtcgttgcgtgcagtgtgctcagcgtcgagcctctcgccgtcgcttngcganctgtgtgcgtcatcctgtgacgtcgtcaccgtcgtgtagtatgcgtccncattaccgatagacgtgtgtgtatatgatgatnttgagtgcgagtatgtancaatgtgcgctgtctcgctatgcgacgttatgcacncttgtgactgcgtgtcactatgctctcgtgtgggttctacacactgacgaccgcgttcgatgtctgcgtgtagtatcatgtgttatctgatcgcgcgatatcgtgtgtatacacgcgcgccntnattgacacgcgtactccgcgcgcagctncntcgagtgagtnatactntacgtacacgtcaagtactatcgacacccacncctagttgacacgcgctngcctcgtgtgctnagcgtngcgtctgatctcgatagacgtatgcagacgacggagcgctgagtgtacattcgcgcgatcagct

SEQ ID NO: 9284 - DNA, 209 bp, Homo sapiens
  misc_feature (1)...(209): n = A,T,C or G
tagaaagctcaagcatcctgtcttcttcagaactcttccccanctgaaatggaagtgaaagactggtattctcctcctgggcacgagctgctggggcccttactgtgtgtattaactcctcacacccaggatttgtgtctccagggacaagcatcaatttatcctacactgaaaatttcctgaataaaactgtggccttattggcctca

SEQ ID NO: 9285 - DNA, 1156 bp, Homo sapiens
  misc_feature (1)...(1156): n = A,T,C or G
cgacgcacggagtcaacccactttaaagactaattagaacccgaaaaaatcgtacaaagacgacnaaaaaaaaaaggncctgaagagaggangataacaacagaagaccgaaaccagaatagacgacagggagaacgagagatttatagacgcacacagtacatactttcgccgcctctctactacatttctatatctgatgctcccagcccactaatgcgcgggaacatggtctatctgcagattattgttgtcgttaatgtgtgcgcgtttcgggatatcgcttagtcggtctttgattgctacgactatgtatatgccctctcgctgatatgatacctagcataactttgccgtatccagcatttattgtttggtgaggcgacctccactgatgccgtgtcgtcacttgtccaattcataacgaattgtgacgtatagaaggcgcctcgaccatagcaccaaaatagttctacgtatacatcaatgaccacacgtctatccaccttaatccttgtgtactactatcatattcattaaacgtagtgtgcgtagcgatgcggacgggatcgatgcctatgcgtgaacaagatcacatggtgagacacaatacaacgttcgtcatgagtgagcagacacacaagagatggtactgacttcagtgagcggccgtatgtcttcgcgtgacgcgtattatattgtctttcttcgcaagctattcaatctcttgtttgagccgagtgttagtgagatctgtactgtagcgctcgtctttgcgagctgtcttcccagatgacagatcatgatagatgggatcacgcgcgagagtaggcacgaatacatccagatccaaggtcgtaggcccttacaacgttgagtgtgatgagataggtaacaagtgcggatcgacgattccgcgtaactattcacattagcncaacctctcgcactatatatgagagagtatatagtgcagtcgcacgggcgcgacgtgtatgagtttgacagatgtatgtataactcgtatcatgagaatagncgtgtgcgtgcgctcacctctcaccatttgtcgggtaatgaatggttatattggagataatggtatgtattgagcgtgattgttacgagatatagtcgtaccagtgccattatcgtc

SEQ ID NO: 9286 - DNA, 272 bp, Homo sapiens
acggactctagaatagacaccagaggcgtggcccacagagaaaaagatcatgtggggacacagtgaaaaggcagccatcataagccacagagagaggactcagaagaaaccaactctgctgacacattcatcttgaacttctagcctctagaactagtgaaaaaacaaatttctgttgttaagacacccggtctgtggtattttgttaggacagccctagcaaactaacacaattttgtacactaaataaagtcctggcctcgttggcctca

SEQ ID NO: 9287 - DNA, 1864 bp, Homo sapiens
  misc_feature (1)...(1864): n = A,T,C or G
agtgcgcagcggcactttgtgatgcagacagtanangatactatgacggtgcggacactgtctatantntgattgntncgtgtgtacatgtnagactcgatgtactgtatacacgntnatgacacatatcgtcacgtgacggatactgtatcatcngtntcgcncatgtcatantncacatngagcgtacgttctactcacgcagcgcgctcacatnggtacagtnccactgatccttgctgntgnagagcatcgagcgcngagcgtgancggtcgctacnctttcacanggagnctgaatcaacnggntnactacatactaatttgatgngagagtggtcaggacatcgacancatgcggcactcacacacgactaccgcacgctagtgagtgacgacaatagcgagtgctntgagatgactcgtgagcatgtgtcgatcgcggagtgcactattatagtgaagtctgtangcggagtcatatnaacagtcgatggtnacagtcaattgttgatnngtatcatcacacgttgtggatgtctcttgatgtannatacacgagagacatgtgtaagnncgcgtngatgctgcgacagctgtgtgcgtcntngctatctttgtatgtggagactttatacatgcgtnggtctcgcgtatgatgttgagctcgcactcgcactatgatacctactccgatactgtgctactgctatagtcacgcntgtcgtatgagtncatcactatanatattatgtagtgagttgtactatggtataatgatatgacttgatattncctcaaatacaggagacgtcgtgantagnagcgcggtcaggacacgtngtcgattctacattgagcagcatacataacagtcgaatatgagacganggaagtactaacatcatcagagaacagtctacgtatatcgtcgagcagtgtcgcagtagtatcataattacgctacgctaacgcagatcaaagtnccgcatgttatcgcgngtagacctctcattcgtctctaagatgtacttctacttctgtatgtctcacggtctctgctctnacttacactccganctcactnctactatatatncgantctatatctcatgctnctgancantccttttatcgactatagtcgttctacnaagtatgtgantnnnaggcttntatatancctagacctcagaacaaatnangnaatctattgcaatgcacatagatacgatntgtatttactctgttatatatntagtantatgctatcacacttactacactcatactacatactctagtcttctanacttatgagtatcgatantgctaactcttatgtcaactcactactagttcgtctctactaacacatcatcgctacacatctacacgactctcattttagagtcacgacgcgagacacgatattgagacgctcgctctgnacgactcggtcganggtctagtacgtgtgtgagnagactctgacatgttcgtaatattagatggttgacagtgtgtggtgtctcgccgtatcgtcgagttangggcgtcttctgntgggtggcgatcaggcgtgtctgacgtcgctgtagccgtcgaacgacagtatnagtagttctgctggtagcatagtagagatgataggtgatggtgacgcggtgtgctgctcttttnngctntccggatgtgttcgagtgacntgtnataccgcgatctttactctgctgttagngtctgtgatgtganacatgacgtgcagacgcgtaacanacagacagacaggtgacgcgctgtgacagtcatcgagcgagtatgacanacaacctgctcctgatctagngnagcatacgagca

SEQ ID NO: 9288 - DNA, 1221 bp, Homo sapiens
  misc_feature (1)...(1221): n = A,T,C or G
acccacccgtcctcctactggccccagcggagagcgtgtggtgnccaccccgagcatcccgtgcgagctggacgaacagcagaataagcacagattttcgaaggtgaacttcnaccttagcgctccaacattaaagtttgaacgtnngaggatgaatgtattagtagcatgacaataacaacatatatttgccgcgccggnccgagatatccgcgatccctcatctcatgttcatacaccatcttcttcactctcccgttacttatatctcaagcacnctagcagtagccgactctatagcaacgctatcgacctctgccggacttcgtccacgagcgactgcggtcgcgctgccctccgtgaccgccttctcgtcccccgaacggcctctgttccgttctcccgccttctacctaccctccnccacagccgcgtcccagctgatgcagcgaatgaagaccacgactattgctccacatactctttccctctacgtgcagctcgcaggaggataggggnatattggtaaatattatgcgtctgtggtatgcgtatgataaccgcaagctgcatgtagtgggcgaactgtagaccgacttcaggcctacggaacagggtcattatagttgtgtaaagaagcccatggaatgtcatgtgacatcaatccccatcagtcntccatctcgctctccacgtctactcccttcccactagtgcctcatgctgctagcaggtaatacaatattgcctcacacgagatcgtagcgctgataggtcatgtatccgcatgatgcacgagtgcgctgctcgccgactgcgacnacgaacgctacaagggttcccaggttctgcatcgatagagtacatgggagcgccggcacatggtggagtcacgtgtctacgatcttcatgtcatctgtcccccgagcgcgtgcatgcgaataaagaacatatcagtagcaactgactcgtgagggcttcgtncgctgccaccttgagggtggctgcggttagtcgccgagtatgttcnnaaggcgtcgagggacgtggagggagagatannttaccttcgcatcggacggcccgctctgtcactcagtgccatgctccctncacactcctacgctctacataccacatcgactnttacctgcgcaggcacccgcacccgagtacgtcgctactagctactccgctcttgacctcgcctccccgtcttgt

SEQ ID NO: 9289 - DNA, 171 bp, Homo sapiens
cctaggattgaacgaacatagagatagagagccaggaaccacagagacagcaaagtaatggtcagacacacaaccctggagcctgcccaacttgtgtacctcttattatgtgagataataaaagtcttcattgtgtaaatcaaagaaaaaaaaaaaagaaaaaaaaaaaaa

SEQ ID NO: 9290 - DNA, 1224 bp, Homo sapiens
  misc_feature (1)...(1224): n = A,T,C or G
ataaagaacacacaaaaaacaaaacacagcaaagacaaagaaacagaccccttctgcagcgaacccaagccaccacaccactgtcaggaacgagagcagagagtaccaaatcactcagcaacctctcactgtcagagagcacgtaagcaaagcatcctcaccaccgcctctcagcggcgcccaatgcgaacagacccccactcatcccgcagacaatcagcaaagagcgaagttccgactcccaaggacctcgaggatgggaatggtacccgcacctccccgcagacagaaaacacaaaacaacagctcaataacgccgcaagggagacgccacagccagctccaacaagcgcgagagacacaacaacaaagagccgaatacacagacactatacgaacgtgacgtcgcgagccaacgccatagaaacgacgaagaacaaggtgacaagcatcctagcgccagccacaggtggcgaaacacgcgagcgtagagannagggtaagggatcgtacagcaacgtagggggagcctacgaatggacgcgaggcgacgcaaactgccgcgaggaatagtgacgcagagaatctagacgcgcaacggccgattgattggttaagggctcattgaggtcacaaactacgaaagggagatacgtagaacacggagaaccaaagaaaaataataaacgagaaatcgaagagctacccgcaagagaaggagaggcctaaaggacaaagagaccccatactagagcatgtataggacgatgcgacagagcagggagggatggtggagccgcagagtcgcgcacgaggtacgagccaaggctggacgcgcgacacacagccgtatacatagcacaacatatgtagctctgnctaataccctattgtcacaccgactggtagaccccccccccgaagacgcgactgacgctccaccccctgaggactatggcacgggagatgaacacacgagccaggcgcagaggatgacccgaacgcgcacccaccccacctggcccgactaaacagaacgacgcgtgactcagagcgaagagcagcgacagagcataaactcccaatagagagaaaagcggaacataacagacagccagaccggcagaaaagagagggatagagagtgcatacaagagatagcacacagagataaaatgagcacaaaaagaagacaagacagggagacagacaacaaacggccag

SEQ ID NO: 9291 - DNA, 266 bp, Homo sapiens
ccttatggaacgaggaataaaagttgtacgaggaagagagagaacgaagaggaaaatcacgatgagtaacaggaagaagtgtcaaaaatgttatcagattagataggatgaaattacatgcctattctagaatgcagccttcatgattgagcttgaatataatgaaactttcgaaaaaatgtattgtagttgatatcacatttagatacaggtattaagataaaacgtacataacaaactaacacggtctcgttcgcctcaacagg

SEQ ID NO: 9292 - DNA, 1869 bp, Homo sapiens
  misc_feature (1)...(1869): n = A,T,C or G
ccggcgcacgtgcgcggcgtngcgctaccgtggacgtcgagacggnagtgacgtagagtagcgcgtcggngtggtctggcgtgacgagtggtgcgtcgtatacgtgcagtgcggctgagctgtcgagaggngtggtgatcagcgtgcgttgcgacgancntgcgtgacggagtgagcgggtgcgactaggtgcgncggagtgcttgagtgcgtggtagggcgcggtggggtggaggacgtgctctagcgctcgttgtggngcgcgagcgtgcggtgagacgtagctncncggtcgtatactggcttcattcgcnctgcgcgcgcttggcgcggtagacggtagtcactgacagacgagcgccgtcgtcgctggcggtgtgtgcctggcgggttgcatcttaaggcgtgcgacgtggagtagcaggcggtgcgctagacgcgacgagagcggangggcggaggtatgngggcgcgcgtcaggcgtggcggtcggtctcgtgccgctgtgacgaggtctgcgtgcgagtggtcgcancncgnangcgcggcgacgatagctgcgtgctaganggtgagagcgtggacgtcgcgcgtgtcgtgtgagcnggcgacgtcgagtgtgcgacgcgcgntgtgagggtcgtccgggatcgtgangggccgtgcggcgggagggtaggganggagacgaggccgngcgtcggagagaggatgcgcgctgtggcgtgagtcgagcggngngcggtggcnggggncgcgcgaggcggcgtgtggcgtcgtgacggagtgtggagtcgaggtgcgngtggtgtggagcgtgngagcgtggagtgtgnggnggcgtgagaggagctgagacgatatcgncatgcggagcgcggcgcggcggtgcgcgcgtcacggtgcagtgccgtgacgtcgtgcggacgcgtgtcgacgtcgacgctccgtgcagcacggcgttcgtngtgtgcgtnacggtgcactgcagggcgcgngntgnngctcgcgtcagncgtggcgtgcgcgtcgcganngtgcgtgcgtcngtgagtgctcgatacgtatgtgcntatgtgtgtntcggtcgatgtntggctgngtgcggtgtcgntggtctatntcgtgactgtcgagcgtggggcgtgcgctatntgangcggtncgcgcgtgggngagcncagcggacgcgcggcacgcgctacncgtngctgtatngcgtactacactggtncnacgtgcnatctaacnccanacatctctttatcgtgcattcngctatcgttactatgtcactgtatcactacgatnntntntntaataggcatcgtgtgcgctcctgcggatggtgcatatctgtctgttgtgnctgctcagtgtcgtgtgctgggggcatntcgtctctagtgtctcatgatgggtatatcttgtagatntntgntntcgtgaggtctaccctgtttgatncntctgtatttcactacttctctctacaactactntcctctgttctntctngcctcctctactcctccnnacaacanctcacancnactntcttttatttctacactctattccaccctttctnntcctataanntntatcttctttttctttctnnntttatnntnttntttnttcccntcnctttttcctcttctnttctctntttggtttntnnnnnnnccnnttnttntaaaagacattttnntnttnntnttntcnttggtntnnnccncntntntaaagggatattctctatctntttattatcttantttttnntctataatctntcacctcacatatctcttatattttntatattttattntattatattanttaatnttattttaatttttt

SEQ ID NO: 9293 - DNA, 1135 bp, Homo sapiens
  misc_feature (1)...(1135): n = A,T,C or G
ccagaaacgaagagcgcgcccaataaacagaaacgcacgacaaggaggttcttgttggaaaacnnnaaannangncnctnaggggggnggtaccaggggcgcagggcaaaganggcaagaaccacaggacaagctcgcgaccgaagccgagaagcaacggaggcaaaaacgagcgccgcgagacgacaaccaccgccgcgagcgcgccacggggcagaacccgccgccacgcgcgcggaggcaggcgcgagacacacacgccgccgcagcgacacggcgacgaccgcgcacgccgaccagagagcccggcgacggggcaccgcgcgggcgcgcggagttttttaaagagagcacccaacgagacggcgccgcagccacgaagccccacaggcgacgaaacgcaacgcgaccgcacgacgacagcgcaaggacgcggaaggcaacaggcaagcacagaagagcgaanacccacaagaagctcatagacgcgcccgcacgcccgcgaccacggccgggcgcgcgcgcaccgacgggacagcgaagcgcgcccgcgcacacaaacggcggcgggagcgagcgcacagcgcgcggcgcgagccgacgccgacgaacccgaagagagcgacgacgcactagccgcggaaccggcgacgccaccccacgcggacgccaccggcaacgagcgaatcaaacgcccgccgaccgggcaacacgaacccgaggcggccacacagacgcagaagacagaccgggagagggcggagcgacagcaaagaccggcgagcgaccgcaacgcgcgagccggcacaccgagggacgggtcaaacgacgaagaccgagagagggccgancggcggcggcagacaagggccacaacacccacacagcgaatcgcaccacgaccaacagcaaaagacacacgcgcagaaggangaacgagacggccgagacaacaacgcggcgcgcagcccgacacaaggtgacgcacgcatgcagcgcccccaggcgcacgcaacacgcacacgcaacggcaaccacgcgccagagacaccgagcgagactcgctcccgagagcacgaaggcgggagagagacgagaacacaaaagatcacggcacaagcgaaccggacgggag

SEQ ID NO: 9294 - DNA, 1203 bp, Homo sapiens
  misc_feature (1)...(1203): n = A,T,C or G
gccaccccaaccacccgcacgcgacacacagccacagacagcaaagagaggagaggggcggggggcctggcgaaggaggaccggggcggcggggcgttgggaggggggggaaaccccggaagcggcgggcgagaggcgagggaacacgcaccacgcgaaggacgcgccgaccgggcgagagggggcaacgaggaacgcacgacagcgacaacgaaaggaaagaacgcccacaggcacagaagcgggcgaagagcccaacagggaaggcgaccacacgcgcaagcacagacggagccgcgnagcagagcggcagagccgagcagcccacagcaacaaagaggcgccagcggacgaacagaaaccagagagcttttcttccaccaacacacaggagaccgcaccgatagaaccccgacgccaagacgggaacgaaggacccacaagcagagaaaaaagacacacaacaacaacacacagcaacacccagcgcgcaaacaccgacgagcagagcggacacggccccgccactgacccgacaccccggcgcgagaggccccagcaaccgaggagcgacgccaacgagcagaacgaagcgaagcgaacagccccaacgagccaacgaggaaaccacgagcggccagagaagccgcacaggagcccgcacgcgaaagaagcaactcaccgcccacccagaacccgcctccgcagagaagcaaccacgacacacacacacgcgactagcgcaaggcagaggcgagcgcggaacgggccgcgcagcgccgaacgcgaaccatgagcacacgcgacacagcagagcagcccacaggacgcagcgagaagcaagaagcgaaggagccgaaaccacacagcgcagagggcggagcggacgaggcggaggagagacacagggaagaaacgcagaagcacgggaaagacgaaagacgacaccacacggacacgagcgcgagccgcgaaaagagaggcagaggagaacggagcagagcgcacagagaggcagagaaggcagacgagccagcgacgangacactaagcggacagaccgacgcgcgaccgcgacgcgaaagccgcacgcatacgacaccggagccgcgagggatgaaagancgagcaccgaagacaaagcagagaaagacacaggcggacacgcacacagcagacacacccgaacgcaaggcgcacagc

SEQ ID NO: 9295 - DNA, 1380 bp, Homo sapiens
  misc_feature (1)...(1380): n = A,T,C or G
ttattaccaatttcccttattagtatatgcccaaacagcttcgcnganacncagggagnccttaaagggaaaaccaggaaccgacaaaaacaagcaggccaaaagcaagcaagcacccgaggcaacccgccgccacacgcacgacccgaggcacccgcgcagccccacccgcgggcacncaaccacacgcgccggagaccgcgagaggcggcagaccccaccgcgccacgagagggcgaggacacacgagaaagaggcgcaaaggcgaggagaggcgcccagagccgcggggcatttttataaaacgaggcgcggcgcggcgcacgcgcacgcagccgcgccgccgcgaagcgccgcgcgacgcgccnacagcacggcgaaggggcgacgaggcagagacgaaggcgagcggaggacgcgcgcgcacaggccgaaggacggcgcgaccaacagcggagcnaagcagcgacgggcgagggcggcgagaggcagcacgcggaaggacacgcacggaaggaacagaggcgagaagcgacgaagaggcgcggaagcaagagccgacgacgcnccacccaggaagacaaggacagaggagcggacagagaagacagcacgcagcgcgagaacaaccnacgacagcggcgnaggaagcgacaccagagcggacgcgcgcgccgaggcggggagcagagggacgagagagaacgagaccacgacgacggcnagagaagcgaccacccgagagncccgcgacacagcgcgacacaccgagacagcgagcccagacgcgggcgcacagagagagagagacggaaagagggcggcgacacggcgacggacaacccgcgacgcnccggagccgcggagcgccgccnccaggcgngaacgcgcagcaggcncagcgagaaccgcngcacgcacacgcacacacgagancgagncccgcgaggccggcgaggagcgccgcgcgcngcgcncgagaacangncggagncggcgcgnagagcannacacagcgccgagacagcacacaacgagagcnaccacancagagcgaggncgnacgcgcgagcacaggcncaccaagnacacgcacagcagangcacacggagagcgaagcgacgagagagcnagcgnagcagcgccncgagacaagacaggncgacgcacacacagcgcgacgccgagcggnnancgcgcggnacacacanagacggccgagcagcanacagaccaangagcgaccagcncaagcgagaaaacgcgcnacngagccgcgagagcgagcnngcaagagcaagcagcgggcgcgacacgagacagnnacaccagcacgagnancgcgacgaggagagcagcgnagccacgaccgccgcgcg

SEQ ID NO: 9296 - DNA, 162 bp, Homo sapiens
aagatattctttgaatactgaggatatgttacatgtattgcaaggattttcaccaaatctgtactttttcacttggctttatttatagtatctttggacatataatttttaaaatatgtttataaaattagaaacctgtgagttttttcaaaaaaaaaaaaa

SEQ ID NO: 9297 - DNA, 1619 bp, Homo sapiens
  misc_feature (1)...(1619): n = A,T,C or G
cgcggcacgagcggagagcgcgcgaagagccaagcgctagacacgacgaagagagcagaccggagagagaagangnnncctttcntaaagtttnntaccnnnaancccgcnangngncgnctgngngnngangnnnagnntnatcnnnnagnnggnanngnnanagnnngggannnnnannnggcgaagggagagaagagnannangtttttgaaagaanaggagaggaagagggagagagnacccacgngnggacacgggcagagaaggggaagagagagagaagagagagaganagggaagagaggaagnagnggaacaagaggccgcgacgaaccgcgcagcggacacacacagagacacacacgagccaccaaacacgaacngcggcaaccgagccgccgaacaccaagagaagaacggaggcgagacgaacagcacgagagccacgccagagcgagacacgacgcgcccacaggcagccacncgaagaatatttcctcccntccggggacggaccgccaacgcgagccggcacagagccagagaagaacgcacaccaaaggaagcaaggaaggcacaggcaccagaccgcgaccgagccgggcgacgagcgggaacaggcgcggacgacgaggaggggagcggagcggcncggcggcgccggcgccncacgcgacgacaacacgagcgacangnaagaggaagcggggaggcgacagacggcgcgaggngaagaaccncacgacgcaacccacacacagagccagcacgcacgcgcgncacagcgacgacagacagcgagacgccagcgacgacccgcgcgacaccgagcgcgcagcgacacgcgacacgacncacaggccgcacaagacgcgcagaggngacggcgcacaacggcgaggcgaagcgacaagaagcagcgcacgcgacgacgcgagcggcgcgcacacngcaggagcangagagcncgaggccgccgcacagaccgacggcngnnacaggcgcgacacagagcgacacgcaggagagcgagangcaccacagcgacggcacagacgagcgaggcacggangngacgagacgaacgccgcangacgagcaagcagganncgacganacacgcgcggcagcgcaagacggcacgcgcacgagcagcagcacnacgcagagacgagcgcggnagaccgacgcgcggcgnagcangccancagacgcggacgcagcgcacgcaacncaccangccaccgagccccccgcgagagagcacngcacacgcgcacagcccgcnacacgcaacanagaganagaccacacagcgacggagcgaggcgcggcngaccgcgacgcacgcaagcggagggaggangaagggagcggacgcgcgaccgcaggagagcagaccacgagacgagggngagcgagcagccgacacagacaaggancaaaacgcgcgancaagngcacgagcngcangagagcancgcgcgaggcagagacgcgncaggcgacagnngcagcgccgcgagacacgacacacnagcagaccgcgacaagngacgcgcggcaccgancacgagcgaccaccgccgacacancgcagcacagacacacgcgaa

SEQ ID NO: 9298 - DNA, 222 bp, Homo sapiens
tatattactcatttctatattcaaagttataaagagagagaaggagagaggacttaagggagttaacaatcccccttgtagaggctgtagaatttccagcgagctgcaaatttgggtgccagagtatctgctggggtgtgggaagaaaatgttagatttctacttatactcatttctcaacaaaaataaaagagaaattgtgatttattaaaaaaaaaaaaa

SEQ ID NO: 9299 - DNA, 798 bp, Homo sapiens
  misc_feature (1)...(798): n = A,T,C or G
cacggggccgnnnnnnnnnaaaaaannaaannnnnaanaaactaaaaggtgcgggggggcccctccaacggagcaaaaaaagcttaaggtaaaaaaacacgttaaggggccgggtttnactgaaaaagggtctcncattnacctccncctnnnntctccnntcctnnnncctnncctcccttttcccctttccctnntccttctttttccccccttcttcctttcctcttnccncctccccccccttctttnnnncccctttncttttggggtgtggggcctccctcggggggttaaaaagataaaaaaaaaaatttccgggcctgcgggggctcgctctttcgcccgcgcggggggaactttccccccccttccctttgggggggggaatacaaggggcccggcccactaaacccccaccggggggggggagnaaaaaaaaccattttcctatcttaaaaggtggtaaggcgggatcacccaaaccgcggcgggggggggagagaacgtacaagaaaaaagagacaagggggcgcaccgcgaaagggccggggtgttggggatgtcaaagggccgccccctgggaaaaccgaaaaaaagggccgccgggggcgggcgggggtggccgcgacgggcgcctgcgcccgaggggggcgcaggaggggcgccgcgggagacggcgggagacaaccgggcggcggggaaaggcgcattcggtgcaaaaggggggggggggccggggcagatcccgcgcgaggtccgaaagcgggcggacgggcagccgggcggacggcacga

SEQ ID NO: 9300 - DNA, 1868 bp, Homo sapiens
  misc_feature (1)...(1868): n = A,T,C or G
gcgcacgggagaacacacacccaccaacaaaacggaaacaaagancaacaaacaaacgccgtgcgcggggggaaaaggcaagacgagaacccgttcaaagggggcaagaaaccagagagccgaagacacagagaagcaaganaaggagaacgcgagagaaangcagggaacagacggaagacgaacggaacgagccagcgcacgacccacgcgcagagccaacgccacccagcacgagcgacgancacgcnacgcgacaccgagccanacgacagcgccacagaaagcgggcncagagancgagcggcangcggcacgagaccagagcagaacacagcggccacgcggcgcgacgccgccgaacacggagcngcaggagagacaccacacacgacaaaccagcanccacgagacgagccgcgcgacagcgacacaaaaggaaagcaagagagcanntattctgttgtcgaccggnacagacgacagcgncaccaggaggaaagcaggagacgacaacagcaagngacggacacaggcgaggncacagacgacgangnganaccagaagcncgccacagacgcacagacacggaggcgagggagcggcncnncnacgcgacaccggcagacgaccgcncgacgcgacggcgagnacgnacgnnggaggagaganaggagaggnagagangcagnanncaangcaaagcgacacgggcgacaccgagcgangcaggcacacgagacggcanacacgcanncaagcaacgcgcggnganagcacgccaacgcccgcacncgcacccaacacagacancnacccgcgcaggcncacaaaggcagagcgaccgagagagnagacgacaagagagcacgagagacgcagaggcagcancaggacgacgacaanannagacgcaagcgcacagcgcggcaacgcaccacacgcacgagagcggcacggcgcgacgcgcacncgcagcgagagagcgagngacagagagaganagagagcgcgcagacagacagcgacngncacaaccacgccggacgagacagancgcgatangatacgcgagcggacncangacaggnagtcagtangagaagaggatgacgcanagcagcgctctaggccgagccanacacacnacagaggtacgagacgagactagcangacacagagcagacgcatgagggcatcacgangacgacgcgnacggnagggcatgtgacgngcatacacagcgatgaagccacacagagngacgagtcacacgacagacgagtcgnctcacaagacaagtcacgcgatcgcgnagaangcacnatactnctananatagcgcgacacgcgacatctcgcaggcacaccagaccgcacngcgaagcggcagtcngancggatgacgatagaagnaggactncncnactcngccgtcaggcganaggagcnacacccagancgngagcgacgcgcngcnncnnantaccgctgncacacgacgcagcnagtncacanactacgacnactactaccgtagcaggcgacgcntcntttaccgncancgggnnccgccncatcgacgaccgngcagcggtacagcactgcgctcgtcannactgagacgagcagtgatacgcgccgcaccagtctacganacctcngacaccngcgcacatcgagacgacagacgcgcagcagcatcgactctcgacatgcgncgcngcnacacgacagcgacacacatgtagcacagacacaggatnagacagcaaacgacacaccgcnacgacgacgagcgnccnagatgagtgcgacgcacgancncggtcagngncacacacacancagcgctggcacgagcgc

SEQ ID NO: 9301 - DNA, 155 bp, Homo sapiens
  misc_feature (1)...(155): n = A,T,C or G
acttaagtactcgccccagcctcatagnnntaatcgaaaagggggacagaataaatgttaccctaataagnccagagcaacaaggtacccgattagctgtttcctcttctggctcctgaatattaaagacagttgcactgtcaaaaaaaaaaaaa

SEQ ID NO: 9302 - DNA, 1172 bp, Homo sapiens
  misc_feature (1)...(1172): n = A,T,C or G
caagcgcgcaaaccgacacgacaaggcacacgcaacaccacacgcagagacaanccanaaacannagaaattgncnttgggagaacggacncccccgcccaangtgngnnagaggaaagaacaacgccccccccaggccacagcaagacgcgnccacaccaccatttgccaccgcagggggggaaggcgggnacaacaaacaacaaccgcccacacgggcccgggccgcccacgcagcaacaaagcacccgagcgccagaccgccccagccgccgccccgcgacccccgggccgcgccggcgaccccccccaagccggcccagcgcaccgccacccacacnancgcccttttttttataccggggactgtatggcacacnccncagcacacagcnnaccaccccacaaaagaaaaacagaacaccagaacacgggggggcgggcacggggaccaccacacaacaacaaggcncacagagcgcaagccaagacgcccacgcgcgctccaccgcgaccgggcgaggcccgcccgacaccgccgcgcccgcgcaccacgcatacggcccggagccgcccgcgagccggccgcgcgggggacggaagcgaggcgacggcgggccgagcgggcntcgccgcaggcgccgccgcggccctgngaccgccccaagacagaccccgcgacgcgtcacagcggcgcgcacacccgcccaccgccgccgccgaccccgcggctccagccccaccgcgcgccccacgacctccagcacagcaccccccgccaccacgcggccacgcctccaccccgccagcgagacagcggccggcgggagacgcagaccacacaccaccaccacacagcgcgaacgacaccgcncagcgccgcgcggcccacgccgcggacccgacccgacgacaacacaggcaagcgacgccgccaccgcggcgacgacgccgcgtaccaccacagctcagcgcccncaagcgcgagcacacccacgcccccgcacaccagccacgccacacaaaacgcaaccacctgagcagcgagacgcgacagccccgaccgacggcaacgcccgcgctgcgcgcgcacgcccgcatccgcaaccacaacagcacacaagccacaagaccgagagacgccacaccaaacgaagaacgagagagagaag

SEQ ID NO: 9303 - DNA, 1627 bp, Homo sapiens
  misc_feature (1)...(1627): n = A,T,C or G
ccgtacatgagcgcggcgcgcagagacgccgttangatacggacacagangaagcgacggcacgggcggagagagaatttcgttttaacnnngntnnaatctnnanagnananagagagnngnnncctcnnngngnnnngnncnngagnaancnnnngnngcgcnnngcgcnngggngnnggngngnngcgccgcgcgcgcgcgcgccgccgggcnccgttttcgcgcggcgncgcnnccgcnccggcccgcnngcgcggcgcggcgcggcgnncccgcgccgcgcgccgcnncgcgcgncgccggcgcgggcnccngcgcggcgggccggcnggccngcnccccgcgccggcgcgcgcncgcggcgcccgcgcgccgngcngngncngngcgcggccgcgccgcgccccgccgggcngccgcgcgngcgccgccgcgcncngcgagcgcgccgncgngcgcgcggcnncncgcnccncncgcgaancagcgcgcngcgacgcgacgcaccaaccacagcagagcgacgagncgcgacgacgagcaagagtttttcnttctatgacaaagaganacgcagcacggcgcccnccccggccacagcacaacgaggnancagacngcgnacgncggcagcggagcgcncaccgcacgacagggacgcacncgagcacggcgacgcagcggcacacacacgnacgccgcgacgcancggcggacctcgacagacgcgaacgncgcgcgacggntgcgcaaggcanacagggcgacggcgcgcacgaccgacgncgactgagaacagagagacgatacggagcgcagcnatgctggagcgggagcgacaccagacacgaggcgctacangacgancgcagcgcgtctgacgcacaaccgtggacacagagtgcgcaccacagaggtcacatcgagacatacgagacagcnagcagcgatgaccggcgccgccanacgaccagcgcacgctacgcgacatcgatcggatcgacgacaccaaggcangagacgacagcgcgtacgaacgcggcgacgcagcgacacgaagactgcaacacacagcacgcctgtacagcgcaccatcggctaagcggtctccaccgagcnactcngagacgacatagggagnaagcaggagcagtccacagacgcacgcatgacacacacagacgatccgccgacgaacgtaccggagtgcgcgnagnacgacgccacgcgacgaccgcgcgcgnggtacagatgagtctgaggagtgagggtgccgcgagggacgatgctgccgacaagccgacgacgccagagcgcccagagcccgccgaccacgcactggagaagatcagggcgctcgcgcgagagacgatgcactagcgacgcggcgtncgaggccgcgtgggtgcaagcgagcgagccactgtcgcnaccacaacgagaatctcatcaacgccgtcgtcggccaccaagccgccgccaccgaggccacgacagcgcacctgatctgcgcacaaagagcgactcgcgatctcacgccctgagcagatgagtgcgacacagcggcaacacgtacgngtacgagagaggagtagagcggtcagganactaagcacacgctcac

SEQ ID NO: 9304 - DNA, 361 bp, Homo sapiens
  misc_feature (1)...(361): n = A,T,C or G
ctagttgctacgcactttgtttgctcccttaaacttactcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcattttctattccatattaaaagctgtttttgttgtacaaaattcactgatgttcagttctattttattttgccttcagaaaagaagaaagtcaaaaataaaacttttgtgtactacagcananaaaaaaaaaaaaa

SEQ ID NO: 9305 - DNA, 348 bp, Homo sapiens
  misc_feature (1)...(348): n = A,T,C or G
ccccgaacccccccgnnnnnnnnnnnnnaggccnnnnnnntttcccctcgcccactctcctgttgcctccctggttttnggggtcctttccctcccccgccctggttcccgggcctcttagaaccgtgtccctcatcttcctcttnnnnnnnctccctctccctcccccnnccnnnnntntnnttntctctctttnnnggtnnnncttcccccntttcctttcccttctttctntcnnncctttcccccctctcttctcnnnccccctctctttnccctccttctttttgcggggggggggcccccttccccctggcgcnnccnaatatttattacctcccaaaaact

SEQ ID NO: 9306 - DNA, 239 bp, Homo sapiens
agtgacataaagcttgagaactaccagcctgagcaacatcatgagatcccatctctacaaacaaatttaaaaaattagccaggcatggtgttgcctgcctatagtcatagccattcaagaagctgaggcaggaggatcacttgagcccaggagttccaggttacaatgagctatgatcttgccactccatgagaacttggcaacagtggaagactctgtttctaaacaataaaaaacga

SEQ ID NO: 9307 - DNA, 506 bp, Homo sapiens
  misc_feature (1)...(506): n = A,T,C or G
acaaccttcttaaaaccttccacctgcccccctcttcctcatccccccccctctccccaactttaccctttctcnttttcctcaaagtttccttttcnccctccctgttgtcgaaaggggccccccatccctaaccctnncnnccccccctctcccccccctcttttttcccccccncccccnnncctttanccccccttctttccccccttcaccccaccccttttcctcccctttttttccccttttccctctccccccccctcccccctttccacaccctcaaaaanctctctcacctttcttggcgtgtcgcacccccttctcccctcccccctcctcccccttaaaaaaaaaacaccccctcctctcccctcccttcccctccatctctccctcctccttcacctcccctctctctcacacaccccccccccccccttctctctcttttccttccttctttcccccctcccccctctcctttcttctctccctcttccctt

SEQ ID NO: 9308 - DNA, 656 bp, Homo sapiens
ccgggggtggatgtcctggggcaaaggcagaggggaggccaccacagaagctgttttttctaggcactttgcaaggggtcggcccccggaattattatagaaagatcggctccagattacagagcccgtacatggggaagatgctgaaataatggccacaccaccccactcttttgcgggttcccccccgggaaaacacgggggatcgggattttttaaaaactcaccagagagggcgggcaaggcaaatggggggcttctcccctctccccgggaggggggacaccggaaacctgcttctaggccccggttggttttttgttagacacaccccagtttgcgcctcttcgggggtgggccacaaaaagaacgtgggggggggaggcttaaatcctttctacccccttttcattatcattgaaggccggccggtggcccttttttggtttaaacgggggaaaggccaattttctcctttgggaactcatcctcttgtgattagaaactagcgggattcccgaaaaacgagaaacaaatctagagcacgagaagaatatgtacatatgtgcaaaaccaatataagttaattcataataaaaggacggagcccgcccacccatcaatggggggttggcataccccgattcgaccacccg

SEQ ID NO: 9309 - DNA, 631 bp, Homo sapiens
  misc_feature (1)...(631): n = A,T,C or G
cttttcaactgatgtacttggaatgtctgatcaataaaaaaactgatattacagctgaatgttatgactgacttcatgtttttacagtattacacaactacaataacttttaaatgtatttccttgtactaatctattttcttactagcaagcatgtcactttagatcaacgtcagcagttgaatgggatcctggtcacctgctatgtacctgcacaggctgaatagcaatctagaagaactctaataaagaagcatcactgcaatactaatgaaggccttccataatggctgtgactgtgggcagttttagtatgcctgacataaaaagaaacaaaaacaaaaacttgaagaatttggggtacatatctagaagctcagttctaaccattcaggaatcaagagtgtaattntcaccatcacctgatagtcatgtgacttaaggttaaaaaggacattctaataccacaaagtgaagcatcaaaaggagttcaagtcttccaacatctctattctcttatcatctaattgcacaagccaacccaattttttttgaattttaattttgggggttctgcatatgattatggccctcaaaataatggcttctaactaaaaaaacccagatgacg

SEQ ID NO: 9310 - DNA, 476 bp, Homo sapiens
atttgtcctcaactgcttatgtaagggctccacatagatatatcatcatgattttacactcgtcctgccaaatgttctgaggtatgtgtgaaggtttgttacacaggtaaacccatgtcacaggggttcgttgtacagatcatttcatcacccaggaatgaagctcagtacccgatggatatttttgctgctcctctccgccctcccgccctccatcttcaagtggaccccagtgtctgttgtttccttctttgttaaactgttaaagtgtaatgttttcatactcttgtgtgaaatagatacatacatatatgtgtatttgcagcagtcccctcttctccatgtttttgctttgcacggtttcagttacccatgctcagccacggtctgaagatattaagatattttctgagaaaaatagcgagagagaaagaaatcacattaaaataacttttattacagtaaaaaaaaaaaaa

SEQ ID NO: 9311 - DNA, 917 bp, Homo sapiens
  misc_feature (1)...(917): n = A,T,C or G
tctaattttcccgctcagtatggtgcatcttctcatccctgagcttggggcctgtgtggtacccggagggaacttgattgtggaattagccccggcccctgccggacgtgctggcaggagctgctggctgggcacctcgaccttgcgagtcgttgctatattgctcttctctccatcttctccttatcctcctgcgcctactccgtcataatatgtacacttcgctctcttccataacccgccactctcacccttctttaggctcttaatggcgccatcttattaccattgacatctagagattctcaatgatgcttgcactccttatctactcttcgctctctcgcgtactccttatcgcttctttcaccgcgctccatctactctcccttcctccacctcacgtgcccctngcgttccacgctgctctctctatttcatcccagcacaactccctcgcctgtctctctccgccgatccgctctgcccgcctctccctcccatcttaacctcttcaatctacacagccaccccttaccttcccccgacacccgcctcgccttctcactacccgccccccttccctcgttctcccgtttctatctccgttcatcttccccgcgaccctccccctccctccactaccgtcgtccttcatgctccacgctcctcctctcttcttctctcctgtttcttttccccgttctctgcttcacccctgtattcgttccagtgactctctgattgtctgcctctttcccctccgcccctgctctttcgcccccttacttaccccccttctcaccttcttctctccctgctgctcccccacttttttccttctttcgagctatccttctcccttcttctcctctcttcatgcattcgattctttcctttccctatctacactttcg

SEQ ID NO: 9312 - DNA, 824 bp, Homo sapiens
acccccctttcttttaagccgtgccctattgtcgcgcgtttttctctacaaggcgtccccctccgcttctggaacaattctttccctccagcgcctttcggaacatgtcctcttccccccctatgagtatttcccccgtttcgctcatacaccacccagttagaaggtagtttcccggggctcccccaagggccctgcaaggggagggctgtttcctgggccgagagtttcccttttaaaaaattgaaacccagtcccctatgaactggaccaatggttgcacacccatgtgaatgtatttatttcttttacctgcccccaaaaaaataataaaatggttaatttcacgtatttttatattttactaaaaggtaaaaactactttctaaaatgaccagcctatagctatttgcaactggtgggtgaatatcacaaatgtaatgttgcataaaagaaagcagacatgccagtttgggcaacatagtgaaaccctgtctctcccaaaaatacaaaacaattagccgggcatggtggtgcaaggctgcggtcccagtgactcaaaaggctgaagtggaaggatatcttaagcctggtaggcagaggttgcagtgagatcatgccactgcacaccaccctggggaaaagaaagaaagaaaaaagaagagagaaagaaagaaggaaagaaagagagaaagaaagaagacagaaaaggaaagaaagaaagaaaacagaaaaggaaatcaagaaaacagatgtacaagtatacatactatataattttgtttatataaaatgctacaatcaaataaaatctgatcggccag

SEQ ID NO: 9313 - DNA, 330 bp, Homo sapiens
ataatatcttttctgtcttttccttctaagaggaaaacaatatttcacattccccacctccaagattccagaaactattgaaagaagatgcaaatcatcttgaaaatagagtcatggaaaaacacactgctagttgaaggcagatattcttatacctactgactgatttcagattgctacttcagagagaaagagctcccactgcctgcttacagccaaccagttagaggaaaggccctaattatccttccaagttctggcactcagactctgtctatttcttcttttggctccagaccaaacaaaatgtgaaaaggaaaaaaaaaaaaa

SEQ ID NO: 9314 - DNA, 814 bp, Homo sapiens
  misc_feature (1)...(814): n = A,T,C or G
cctgaagataaagccaaggggctggcggtcctgattgacgccaggagacagcccccacagcccggtctggtcagcgccctgcaggccacccagatgggcaaactggggcccagaggggcaggtcatctggaaagatttgcaacacaacttgaacctgctgctctcatgacttctaaccaatgattcacggtccaaacgtatcacacaaagattccagtcatggagggaccccactctgtccttgtgacccatttgcctgcatcttacaggggatgaaggaggaaatcaaagtgtgtgaggcttcatgaagccttgggcagagcaactctgcagtggttgtctttgacaggctcaggtcccagcctctatccgggctattctcttcctgggggagaaggaggcggctctccagctgcagacattacctgacgtccaggtggaggtgctgacctcattgaaggccctcagccaccatgtggacccccaccagctggccgcagtcccggaaggcccctttccctactgccacaccgagtgggttcatttctttcaaggggttaccgtaccagactttaacccctgaacccccactccttntcttcttctcttcactcttctgtccccaggatccctcaaccctggtatgcttaaaaataaaccggccctcaacaaatgtttaccggggacaaaaatcaacccccatcgccacaaatcacattcttcccatattactcctggaaaatcaaannccccctgcggccccttccttttattgagggaaataaaggcacccgcctaatacatcgcgccgctg

SEQ ID NO: 9315 - DNA, 1483 bp, Homo sapiens
  misc_feature (1)...(1483): n = A,T,C or G
agtgcacgagcgacgcgcgtgtcgggntancgatacatgctagtatatgattgagtgtgagcggtcgtgagtgctcgggtattgatcggtagatcgcgcgngcagatggatagtgantntggagtctangntcgcgatactgccagctagactgttaacgtctgcatgtgtgntntgtcatgntngtgcgtnantcaaccctagtatanagtgtgncncctcggtcagatcgaccgctcgtcgntgtgctcctaagncnactggcntatgcnggtgtatcaatcgtatnnaacactctatcatcatatctctccgatcctactcttatcagtcgactcgcatacagatctcaactgtcgttatgttctncgtctcgttactctacannacctacaacagtcatctaactcatatccacagtatgaatgctctanatattatatnactctacactcgnnnnacctcacatctgtagcactgctctagnaacatcgtatngctcatctacaccctactacctgtcgtcatgattaaagacactcatnancacttcgnggagtaataagcagctatgtgtacgcgtcattcgccgatgtatagaagctcactccatagtccagtcggaatgcgctgtcgtcacatacgtatccgtctctcacttgncgctccctctcccatatgtnacgccctcgcagagattctacangtatcggaacgctagnntggccgttgtgacgattctgttcggtgcgtgtcccatgtgggttggtgtggggtgcgagcgcggagagggctcgtgcggtgacggaacgctgtgggtatagtgctctgganncttctacgagatttatccgctgatagtcatcgttgtnctacagtgnctatatgcgatctgtgatcttatatcgtcgttctcgttgctcgtagacactccgcatggcgcgtctgtccgactctagggacacgtagaccgtagtngcgtctctctactgtaccgttcgttgnagtcatgagacgcctcttcctcgcccttgtctcggctcggggcgaaacttggagctgggcccttgcgttggggtggggnggtgtccggggctgacttgggggtgtgngtggttgatgtgttgagtggcggccgcgtgtgtgggagcgccccggcgcggcgagcggaggccggaagcggcgatcacgtaactaggttaaatggcagacgttggttggacgcaatggctatgtctacctaagttggtgtcttgtcacaactctgggccgaggagtcgtcggggccacatcgctcacggngccctatatatggcctcgtcctttcacgtggacctatataaaaggcctttcacgcactgggctgatctctcgnncctgtatcttgcggcttcggcgcccgtaaaaaatctcatccgtctttggttcttcctgtgaagcgtcttcattctgatggtgagtgctaatggaaaagttatcactg

SEQ ID NO: 9316 - DNA, 781 bp, Homo sapiens
  misc_feature (1)...(781): n = A,T,C or G
aaatggtgttcatcagtggcccaagctgatgaatgaatcctactcggtgcctggagccagacccagtggcaagagttgcaaagaagaaagactgatgccttctctctatttggctgccaaaaatgctcttgcaatttgctttcttctagacaagagtctattcaaaagtctatttggaaacattagggaacggctgtcacatggccggcagatcatactgcctgtgacaggatattatcttcctcgggagagactcgaccactcttttatttcaccgagtaactagcatctgggttgacggctgcggaattgctccgagggccggggacattaacatccctgtccggagtgaatgcaaaaccgacagccacttcagtgagcaggatttgtggaacgaacctttcaccagcattaagcaccagtgcccacctttctggtctccatctctagtgggacctggggggcctcctgcttgtccaaatcctccccagaaaccatgaagancccacttcctggtctggggctccactcctgaatcagggccttctgccccccttttcctctccaccaattccccggcctgccctctgggtaatgcaccaactgccctttttaatcaaatatggaaagttactgcccactcctccccatataccccggtaagcgaagaactgagagaaataaaaccaggcccactccggcttcagggaggaaggcttgtaaaagagcacaccaaaaccgacaaaccctgggggccgggaggaccccctggcggacaaga

SEQ ID NO: 9317 - DNA, 853 bp, Homo sapiens
  misc_feature (1)...(853): n = A,T,C or G
caagctgcagacgactctcttattgtgcctgtagtcccagctactggagaggctgaaatgggaggattgcttgtgcccaggacttcaagaccagcctagacaacacagtgagacccccatctcaaaaaaaattaaattcatatcaaaatttatatgttatccaaagtggtgtgtacaatataatctatatggcaccactgttaggaatgaggccagacaaggcatcccccaacacaaaatgggcattaatcattcagttcctgtactgcttccttaaagccaggaaccaacctgaaaatcattttcctgacagctccccaggaggtaccatataagttaaaacctatctgacgactttggacatttaacaaattaagagagtgacccactcttggacttcacaagaatctactgcaaaacatcacattctcgaattccccacctctccgaccatcccaaaccaggagcatccgcgccgtcagtcaaggcgggagccgaacccaacccaccaacctcatccgaccctcgcacgcagaccgtgcctatcctcccacctctagaccacagccccaccctcgctcaaccctccattatacccccctgctcgccacattctctctccttgtttctctctggtgtttcctccggacaaagcaacgccgcaaccaccaaaccctcctgccacctaagggcagccacactagattctaatcctgtccaatgacttccatgcgcaatcacccctaatcgttactctacaactcttccacnactaatacacttattttctccacttccctctacttcgccactcgcactcttgcatgtccccgctcgcctcgtatactccatt

SEQ ID NO: 9318 - DNA, 160 bp, Homo sapiens
cttaaaccctacggaatttaaaaatccccctgcgttgccccactaactctcccttcgccctctcccgtctcgaccttcccactactcggaccccgcgcccctgttggcttccggacggagtgcgctacgttcccactcgcatttggattattgaggtgtt

SEQ ID NO: 9319 - DNA, 1236 bp, Homo sapiens
  misc_feature (1)...(1236): n = A,T,C or G
caccgtacgcgagagccggagcagaccagaaccggcgcgaagagagaagagcctcgaagcggaaaaccacaaccacngcggccctcacgcggcggcagaaaccggaggcgcggcggcggccactgggcgcgacgaaccaagagagatgggtcgcgggaatgcgcggaagaacagccccccacgcggacgtccgacctaccgagatagggcggcccaagggaagcccgcaggggcggccgaaagagcccgggaagcgcctgcacgacagcgggacgcgcgggggggagcaggaaacaaaaggcggggggggggggcaaccgagacgcaggcgcggacgaccggggacgagggcgggccgttccccgccgggagacggcggggagcaggcggggaccacgcggcaaccggtccatccgcgcccagaacggagcgcacccaacggcaggtgtgcaccgcccccggccgcgcgccgacgcaccgaagcccggcgccggggcggccagcgatgactcgagcgccgctgccgcgggagtggttccccgcgccgacaggcgcgtggggcggagcgccaacagacacccgcgcgtgaccgactacgcaagcctgcgctgcacgacgatgtgccacaggacacgcgggcaagcagaaggaggcgcacgacggcgcacgcacacaccgagcgcgggcccgcagggaccgggcggcacacaacgccccgacccagcaaatacacaaccacacacggaggcgcgcgcggcagacgacactcagatagaggcgccgccgcgtctccatgccgaaggacgcaagccgccaacgccacaaagccgccaagacggcgccgcgcgcctcccgcccaaccgacacagagcacgggaggcgcccagcaccgggacacggccccgacaaagcgggcgacacacacgagccggtgacaccgggcggtgtcgcccgcgcgcgcgagcgccccgccgacgtacgacggccggtccacgcagaacgcgagccatcaccgacgcagacgtgcggctgagtacagtcggcacctcacgtcccgccgcctggcgcgcgcnccacgcagcaaccncaccgcacgactggagacagccgacgcaggagcgcgtagagagccggcgcgtgtacagagtagagacaccaaccggcggcgacccagcgcgcgccccgcaccacgacacatgaccgggcgtctgcgcaccgacacaccaccagacaaat

SEQ ID NO: 9320 - DNA, 266 bp, Homo sapiens
gaattgcctccgcccgtggcattccggataacaccccgccaataatcaaagctcaaaagtgcttatcttgcgcaacgtctttcagagcaaaaagtacaaggttcttccgctggtcagaaccctgctactggaccatgcgtgcccccccgggtctttttcctctatatccttcccctccttcttgggtaagcataaaggaatgtagcgcgcccatgttgggattcagggggcgcgggtggtgtccgttccagagagaaaaataaaaa

SEQ ID NO: 9321 - DNA, 471 bp, Homo sapiens
cgcgtcggaaactgaataaaaaacagtatttacaagggagaaaatgagaaagctaatatacaaacaaccaagacggctataagaacacaatgatacaaagaccacttttgaccgcagcaattaggataggaggagattatgcaaggtaaacaaaagagaaaagtggtacgcacaataatagcgtatgcaacaattatcattataaattctgcaaagcataatgagagacacaaccagttgtgaagcaaatatattacaaagctatctgtttacattgtatcaagacaagaaccaatgttcacaaactttgtacaaacacaaaatagtagatcaaataatcaccacaatcaatgtctctattatcgtgttatcagtgttataccactcaggggtgtggacagaatgcaataattcacaaacaaacaatgcaatcagaaaaaagcttctactgagacttgtaagactaccaga

SEQ ID NO: 9322 - DNA, 878 bp, Homo sapiens
  misc_feature (1)...(878): n = A,T,C or G
atgttttagtggcgtggttggtgacccgtggttcagagttagctgcacgacttcttattaaccaccgctcagggcgatcagttatgaagaagggaaagctttggcagaatcttggaggggcaggggttttggaatcttctgctaaagacaatcacactgctgtcgatctttttcgaaggatcattgcggaggcagaaaaaatggagcggggcagcttcacaaggcacgtcttactgctactccgatgtaattctgctgcaaagccttaggacactgggaggggattctacctgaagaagcgaactgcccgttctccttgaagataaactatcgcttcttttttcttctattaacctcaaacataacatttggggcagagcttccctccccttcagataatattaactctgactctgtccaaatgactttcactgccattgtcaaatattaagccagtactgttgcactcgatatatcacatttcttaataactatcaccaataatatcatccggcactaatgtttcactggatggaggttgttgaagataacccaatcataccaaatggatcattattcggtacactactttaaactaggcttcagcatcttatcagtaattcatactgctttaaggtgtcctagaagaaaaaaccccagcgccagttcctgtaagaagggtgaccgcacgagttagcgacttactccttgcccacagtagtcgcgacgcgaaggacaggctaattgttaatagctctaccagccgattcactgcattgttggttacccagaaacaataacctaccaaatggccccaaaggcctctaccgcagactgcccgaggctttggagatgtaagcccggcccccgagagncaa

SEQ ID NO: 9323 - DNA, 1267 bp, Homo sapiens
  misc_feature (1)...(1267): n = A,T,C or G
aaaaaaannaaaaaaaagtnnaannnnnnnnnnannnaagtattangaanntnangtttgnnanntnntaganantaaanannatanngttnnnnnngnnnaagagnaaattaataatatattannatattaanttaataatnanatatanaaaataatatctnnnnaaatagtaagtatcaaanntatttagatagtataaagnntatatagaaaaagnagagactagtatagggcgcgttgatgtgtgggcttgttcgatggcactatggagttattgggggataaggtgtntagtttaagataaatagataaacgtaaaaagaaaaaccacaatcagtaaatactaaaagnaaaanatgaataaataataatattnanataaganagaataaaaatgnataaaatttataagagtaaatgaatcgtgcacaagctatcgaggtgtcatatcacgatgtgttcctcatgtgtcattaataatatggagagtaatttactatctacataattacatcttacacttatatcgcattattccagagttctctcgtgtctctcactttctatctatttattgactttcatatttcctctctcgcacagtcgctggcactattccgcgtctcgtacttttcgcttctctgctgccgttgtcgctttctggttacttcaatactcttatttanattttatgatttgactacgtgagttcaggatcgctgtatagttgcattgatagagagatgttctataatatgatncaagcaccagtttntcatcatttaaattaatggatagacgacctggaggatagagtgtgtcntgtataaatatgtccnttgacgtatctgacaatcagtagctaagctagcgtatattccacagtatatgacaatcactatgtacttgtagngtgtccctactattatcacatactccccccgtctcatcataataacgacgtcatatctcgtcgcgcgcctcgcgctcgctctctcactactgcccattttccaattatactatcatttgcccgaagcataagccaccgccacacccatcaagtactcccactcaggcgcncctcctacctacgtacagttgtgctgtttacatacacttacgtactgtatcgcataccactgacatgtatgtgctccatatagtacngatgagcnacatgtgctcaatcagtaaatgatgtgttcgatgcgtagtcgctatcatctgttacactacttattatcccantattagctcctgt

SEQ ID NO: 9324 - DNA, 810 bp, Homo sapiens
aatcaacaagtggagcactctacaataggatgtatcactactcctttggcttgatggacatgatgatggattctgacgcctgggtaccagcccatggaaagctggagcagacgtatttaggcaggttgaccaatattctgagctgaaggctgcagagctggctataactgtaagacggggacatttgagcttgtgttacgataaggggggcggataattaagcaaggattcatacttaccacatgacgcataactgaagctcaccgttaacaaattaatgtgggatcgttactctgtcttcccgccttctctatagtgatctgaatagaaataatttctgtactgatcaaatgactgggtggagagttatgttgccctttcctagagtgttggggaagagcaatactcaattccaacccgtctcgagagaaaaaaatgctgaccattggtcttatatctgaagcagagcagggtaatgggtcggagggacgacatcctcgaacgagcaatactatagtttttttggacgccttgactcattgtggagtggggggagtcagtgggcacgttagcgccgtcttcccaatctcgagaagcggggcgcgccccacggtcgtgatgttgtcactctcatgaaggatcatatctgccggcgcaaccagctaagaaccctgttccgtgcggcacgcctcgcttggcgccctctatgcacgcgcatagctgatgtgagtgttgaaatcggagaagtgcgtacctgtattgttgctccgccgacccttatgttgcgtacccacgttcggaggtgtgcgc

SEQ ID NO: 9325 - DNA, 822 bp, Homo sapiens
acccagacctatatgcacctgaaatgccaaggaagaggaaccaggggatgggtgaggaaggcatgaaaaaagatgcatccttaaactagaccttcaagatggaatagagtttttaagaaataacacttacactgaattgctttaattatataaaggaaccatagaacattgggaaaaatgtaaatacgaataatctatgaggggggcgggtgcctttaatgagggagtaattaaagaacctaggtcagtgactggtgtaggctggggtgcttcggttgaggacgagctctatggagaggccgagcgacaaaaggaccgggccacccagtgtagtgtcgtgcttgcggatgcaaataattggctgaggagcagaagggagaacgggtcttgcacgcaaagttagcccacggcaacgaagtgggcgccgggcggggaaagaacggctagaggtggggaggggagagggtgttcggagctgttagagcgggaagcacgaagggagactaaggagacagaatagacagagtatgggaggtttaggtagaggtggaatcatggtcctggcgctaaaggtggagcaatcaggctgcacgcgcggcgcgtgatgagcggagagagggggggcacggcggatgaaggggcggcggtggagacggggacggtatgcgttggttgacaagaatagagcttagagtcgtgtagtccgcttcgacttcgatctggtgaagagactgatgagggagaaggctggggtggcgatgagggatatgcgcaatactagtcgtgtgagtggtgacgactttacgaggaggaggagtgtgg

SEQ ID NO: 9326 - DNA, 826 bp, Homo sapiens
aatacagtcagccctttgtatcctgggttccacatctttggattgaccaacacagagagaggaaaaaaaagacgaaaattttctacctaaaaattcctgtatatctatctatatataaactgcatacccctctgatatgtgcagactttttttcttattccctaatcaaaaccaatagctgctattgtacatagccttgtgcgtggggtcagccctccataagtcgcctaacaaatgatttccaccgtactgcgcggtcggcctcacattatcttccaaatacctagtccctgcgtcgtccgcgaatgcgcaccgtccccatttttgatccgccccccacccccctacttaccagcacctccagccggggcgtcgcgcaccgcgtggcgccgccggccccacccatagccacccctggtctttcgtgaaatacacatccgacgacggacagcctacctacccgctcatcgctctgtcttcgcgaagctgtcgttcgattcacagccctattttgctttccattagcccttctgcttcgttctgttgtggtcagctcgccgggcccccctgtcctcccctgcatcgtgcgtcgtttgccgtgccatccgggtgtccccgctcgctttgtcctcctcagttctgtgtcgtctcgacagccctctccgcgctccccctcttcgtctataaacctccaactccgggcgtgtgcgcgctgctcccgattccaccccgtccaacgttaccccacttccgtgtcatgagcgccgcctcttcatgtggctgccgcacggccccgcacctctagtcctccacgacgtgtatctct

SEQ ID NO: 9327 - DNA, 1249 bp, Homo sapiens
  misc_feature (1)...(1249): n = A,T,C or G
tttttgggaaanttgtatnannnnaatnntatnnnnnntntaaagtagaaatgtntaatataagtataantantttaattttaataanntttaaatgtnnntnnnnnnncanntaataaattgtaatgnanactataaaaaanccaattaanaatagancaaaagaaaatttntcaaagataatctttaaataanaagagagagaaaaagagcnntacaagaagaaatataagataagcgaagagagcgaccgaggagatacgagcccgcaaggcgcgaccggacgaaggcgcagcacggggagacgaagagcgcaaagaangagtaccaaggacgaacgagaaaacaacacaacggacgaccncgaacatccacaacanagacatgatcaaccaacacataaaataaaaagacaacataganactaatcaaaganacccgagcacaaattcnccaaaanataacgagatacggcgaggcnagccagagcgcgacctgcatccaacacgcacgacgcacaagcagagcaaaagccagaaacaacaccgacgagaccgacggcacgaggagcaacaccagactacgaacacaacgcaaccagcccacccacgacccaccgagcccaccgaccacgcaccgcaccacacagccaacgccccaggcgacacccaccaatcacaccacgaccgacgagcgcgcgcggcggagcaccaacgtgcgaggccaacgcagatcgaaaacaaagaagcaagccgaacgtccagaccaacgacgagcaggaagaagataacgcccacgagtgtacgccacgcgcaagacgacggagaacgtccgcggagagcacgaggtacacgagtagacaggntcacgcgagtgaaaagcaacgaaccagcagcacgacacgcgggaacacggcggagacgacgagcggacaccgccatgcgcagcgaggcacccgcggcgcgcgagcccgtagacgacnacgcgcagaccgccaactcaacgcataagccgcccacgacganggcgaagagagagcacaagagaagcggtcgagcagacgtacgcgagggcgggcacacattacagcgtagaacgaggacaatcgagaagacgcgcaagcgaggccgngacgacgccgacccaccgccgcgcacaagacgcggcaacgccgacgacggcgctgagacgcggacnggaccgcgacccgcagcgtgcgcagccgccacgaagacacaatatacgtcac

SEQ ID NO: 9328 - DNA, 1037 bp, Homo sapiens
  misc_feature (1)...(1037): n = A,T,C or G
acaaatgaccatggaaacagtcgaatcccagcatggataggcaagcgtaaccagccttcttttgacagagcagcaaggtctgctcatgtggcagactccagactggcccaaaatgtcaatcccctgcctcttagcctccacctccgcacctgggtgacactcgccaaccttacccacgatgcggaggctcctaacctcgctgcttttggccacacaggcagctgcgctaattcggcctcgccagcgggggcgcgggtaatcttctctccacaacgcctccgctacctcgacgctcgcgacaagaatggacacgcgctgctaccgtcgtcgtccgtcagaacgtctgcaagtgcctatatgcaactgacatcacncgctcaggtcctatctcctcatcgtcgccgctctctgtctcggcctcacacacacctcactcattcgcggggccgctgggttcccacatctcctacgccttcgtgccctncgacgtcgcagggcgtctgtcgacgcgggtcgcgcgtcgtgcgtcgtcctctcctatcctgtctgtttgccactctgctgtttacactccacacacttctgttgcatgtgcctctgtcctccgccctccacctcgcgcgccgcgctcacgcccctaccgctgctgcctttactgggactccaacgctcgcccattccctcgtgtcgcctttgccgatcctcggcactcgtccgcgcgctcgccgcagctgggcagaccgtcgaggcgtttccatcgtggccctgccttctgctgtgcaccgcgcctcccccccgtcacttcttatgctcctcctccgtgcgctgtccgccctcatcgtgcgtacccatccttatcgtgtagataaggcgcgtgtgtcgcgtcacgtctttgtgtccgcatcgatttgtcgcctaccgacgcccgtgctctccgcgcatggtagaccagccgttcatcgtgctcgctcatatgagcgcctctccgtccgctactatctgaccctccgcttctactccgccacgggtgttgaccc

SEQ ID NO: 9329 - DNA, 1920 bp, Homo sapiens
  misc_feature (1)...(1920): n = A,T,C or G
aagaaaagnnnannnnttttaantnngnnnnnnnaannnngnnangnnnnnntannaaagagtgtagaanagnnnnannattaaanagggnnnnnnnnnnatnatatntannnantnnnnnnnnnnttttgtaatnnnnnnannnnnnnnnnnnnnnnnaanatgttnatatattgtattnnnannnnnntattaatntaanaaaatatatnntaatatccggaannnnntacanagatgatgagnnaganaatatagatgtataggtnaatgtttcnntncatataggaggaagagattaatatataggannntaataagaagaaagaacgaggnaacgnagagagaaagagataagacgaccgtgcacgcttgtcgttgcgcgtggaggttgtcgaccgtngcggcgcgtgatgacggtatctgacnngacgcgcgcggtcgagancgcgcagacgacgnacagcggatgagccgaggcaagaagacagctgacatacgagnatagcacgnactatgtacnactgagaaaagtangcanctacaagtanactagtacannnanatnnanantantagatnacatnangtcagcgtccataataantccacnanagnnccacanacannncgttgaccagcaantatgaanacangntanacgtagtgtagtgncnangatancagtagatgcganaggtggcgcaggcgcgtgtacagaggcagatngncncgggcggnctacgccttcaggcgatgcgactcgatgctacatnacacgtgcgagagcacgcagacagacgncggagactnacggtagacncacacacaccactgccacaccccacgtactacacagcaacgcgctcacagatagagcgccgctgcacntcgtcacgcacacacancactactcacactgactctctccacatcactacagctatctncnctcgtcagtatcgacagatcatccacncgatcgacactantcgncgcagaacgacgaagcgntgacgtgcgagtgcgagtgcangcgtggcagtacagtcatgtgagtgacgtgcgcnangagccgtggcagacgagcataatgcgcgcgtcgacgtcgacacncagagacgcgcatgtgctgacgncacgtgacnangagcgttgngtgtatatgagtagacgcactctgagaatcgacgagcgtagctcgcgtcaagcttccagagtacaatcgtacgagcgtgacgctacgtagaacggacgcagtngngtgagcgccgaacggagatagcgcgtagagcggcgatcatctgcatgtaatcaacttncaccntggcgtgtctagcgatcgcggagacgcagcacgaacacgaagtantgatacggcacagacgacgcgnacncngtatctactcncgctgcatctagtcgactgatcgcacgccgatcgatagtactgtccncncgacacgcatccttcagtcncncagagcaacgatagaatcatatgtanatgtatctcgcgtgctgcatacatgccacgctcacagagacngtgtgtctgcgcgcaacagtcgacataggatgtcacgccgtgctagcgcatcgacgtaccgtatcggcantacacgcgtcacgtggncgcgagagatagtcgagatngancgtnagcgcacntgatcatcgcncgcgcacgcgcgtacacactcagagtgtatcacangcatcagtcgcggcgtcactgcaccnatcgacgctcaccatgatctcacggcgcncacacacatatgtacaccaacatangcacacgctagcgncaccgtacgtacgagctgccactggataacatccnacncacacactctcgtgctgagtgagaacgtaagagcgtaggagtagagaggacacacgaggtagacgcgacag

SEQ ID NO: 9330 - DNA, 148 bp, Homo sapiens
ggcagaagctggcaggctacagaagaggaaaagacaagtccagatttcggtgtgcattcttctgtacctcgtgaatgtcctacaagtgtgttattcctgatgtctttactgtgattatttttaaataaaaaaaactaataaaccccga

SEQ ID NO: 9331 - DNA, 639 bp, Homo sapiens
aatttattacagcagcaataagaaactactacactggctttgaagatggaagaatgggccgtgagacaaggaatgcaacaagcctctagaagagcttcaagaaatgaacacagcctgaagactccttcatttaacccattgagacccctttggacttctgaccttcagagctgtaagataataattttgtgttgttttaagccgggggtacattattaatctgcccccagatccaaacacacacacaagcgtgtgctctcacacacacacacatagctctcttgacaatgtgaattcctactcactcatcaggtctcaacccagatataccatccttcaagatttcccactgctctctcaccctgcagtctagattgtgtcctacttatgtttctcaacaaaatctgtaaatagatctaatttagcacttaatttacaaaattcaaaatctgtctttgtctgcctttctcactacactttaagtcctctgggaatagaggctatgtgttgtctttattgctgcttccacaatttctaacagaagtcaccagtgtgtattggtgtatattaaaaaagtgtgtattaaaaaaggtatattaaaagtggatattgaaaaaggatttatagaataaatctaga

SEQ ID NO: 9332 - DNA, 841 bp, Homo sapiens
  misc_feature (1)...(841): n = A,T,C or G
cctangctgcaacgactctcttaatgttgtgagttttcctatctctgccaatctgatgcttaaaaatatatgcttttttattcatttatagtaatgtttaaaatattttcatgttattacattttttattttttaaaactgctgattcttaacattcttaatactaaaatgttcatcacatatattgcatatattgaaaatttttgaatatttgtttttcatacttgatcgtggtgcttaatcattgagaaatataatcatttgaaaaattttatcacaaagcataaattgtggctgcttcctaaacgagtgggtaatttttttaatggctagctgcaaatgaatgcaaaatagttctacctgatccttgtttaggagcctgttgcttgagctgaaggaagattactgagcacgccaataaactaccacagatgcttggggcttctgctcttcagcaactgagtgatcctttgtgcttgaagcttggaggctgcacacagctganactggccctgcacagacaggcagcccaggcagcanagcactgnggaccatgccagtccctgacgccactggatggcaggaggnggtagaactcagcatgcccgctaggtgcacttagcaccagngagcanaatagtgatggtcactcntgcatttccttacctgcactgttcaagcctggaatagatttgcttcaggtgcctccgctcatgggctgtcagcagcccctttgactcagaaaacaaaacggatttgagagcaccgagcagatctccagctggcttggggataaggatccaaaagagctgctctgcgtgatctgtggaataccaaccac

SEQ ID NO: 9333 - DNA, 587 bp, Homo sapiens
  misc_feature (1)...(587): n = A,T,C or G
caaaagacatctactagaagctttcttcgataccacctgagttcactgtagaaggcaactttggtgaggaagtaaaagttcaaaatgcatttgtgtggaataaattgctttctagcattctttctcatagaagacacataatatacctacactaaagataaaatggaatttttaacctatgtagtcattaacaatgttttaaatgagtttgtgtaaaacagaaagaaagaaattggcaaggaaaataaaaagttttctaaatttgggtagggaagtgggatattgtgattnttctttctcttttaataaactacttaaaaaaaaaaacatttagaaaaaactaagaaagtcaaagaatgaggtaacatttgacagattatcaatctttgtatttctgctntttattcctctacttggctttttggtattggatggttctcttaacccagtagatcattggataaaggtactgtgcttttattttaattttctagcatgttggtattcattttcaagggcagacactattggggattaatgttggtgaaatttatggcattgcagttgaaagatggacaaatggtgct

SEQ ID NO: 9334 - DNA, 823 bp, Homo sapiens
agatgggatctctcttctgtcactcaggctggagcatagtggtgtaatcaatgatagttcactgcagccttgaactcctgggctcaagggatcctcctatctcagcttcctgagtagtcgggactaaagaacatttggataccacttacctctgaggcagttcttttggaaattataaatatatttctttccgggtatcaaaagaggccacatcaacttgaaagatagagtgttgaatctgaattcacagctgctttatgcaatctggaaaaaggtcaagctggagtgcagtgggccaatcctggctcactggcacctctgcctcctgggctaaagcatccttccacctcagcctcccaagtgactgggactacaggaaagaagacaatggaggtcagttagaatgatggtttgtcctcactggggcacggggaaagggtttgaccaagccattggttgttctcccaaagcctacagaattgcggctgaatataatgaaagatattttggtgctaatgccaagactgaagcattaagtgccttgggccctcttggagagaagaaggtgccaacgtgagacttgacttgcggggcccccccggcgcccacttgcgggactttgtgggggatggcccagcctctggccggacctcaagcgcctagggacgccagagctcgggttggacaacgtaggagccgtgagcgaaaacaatccacccggatcgggtcgagtcttagagtcggcagggcaccaaccctacgggtgttgcgggtggcgcatgagacacgcggacgtgtatgggcgaagacgcgagagccggcg

SEQ ID NO: 9335 - DNA, 883 bp, Homo sapiens
tccctgaactttgatccaagcctgaaatttgtaacacacctgaacttgtgcatggaatctgcaccggcctttaagaatttccaaaggatggcctcgcttttgtgggcccgggccttggatttcagtgggcatgatttgacttcttgggtcatttgcaaccctccaccttcctggattcaaggcaatttctccctgttccaggccctcctggagtaacctgggaattacagggtgccctggtccccacaacccaatctaatatttttgtaagtttgagtagtaaaaagcgacggtctttcccccttctggacccacgactggttcttaaaactcttacaccttcaaaaggactccacccgccttaagccttctctatagtgctggtgaataaccgggccccgaacccttttgtgcccaatcccaaaactattactttctaaattggttcattgctcctctctagacaaacaccacatagcctttcccaatttacgtaatttacaaacttaccacctttattacgacaggacctgctctacaccaggtgtgttctcgatttccttcgcctcaatagtgtgtgttctgctgaactaccttccgtatcgtcccttctcccccactagccggtacattgtcccgctgtgcctccctggtcgcgtctcccgcgatcctcttcttgccacgcgacctagaatccccttccattcccccttatccggttaatccgagactacccgctcccctggtaacacgctgctttccaatttcatctcttacagctcagcattacatcattcatcattttaatccttatcgcattatcatcttctactatgtcccactatcgattgtaggcctcttgatcgccttgtcctacactagt

SEQ ID NO: 9336 - DNA, 1020 bp, Homo sapiens
  misc_feature (1)...(1020): n = A,T,C or G
gggggaaaattaanntttaaaanttggaggatgaanaaataagtnnnnatttggttttgtntttatgttanntnnnnnnnatttgaatattgttatttaatatttgagttagatttaatgttttgtaataatttatttattattaataaggttagaagtaatggagataataatagggggggtgtgctcaagtgatttgttgatttatatatttggggttggggtaggtgagtgcggatggtgttgaaggtaggaggtgcaaagagtgagagaaaacgagagttgagcgataaagtgtaattaagtatggataaataacanataaatttgaagtaaaaagaaatgtaaataaaaggcgacgtggtccccgacccagctgcgtgagaccgaaagagaggtagttcctagttacgacaaacatccccgttccgagccctggtggtgaactagccacagcaagaaacaaccccccacgcgtacaccaaaaaaacgttccaaccacggaaggtcaggcattcacacatactattacagattacatacagcaacagtcttgagatctcgtgcagataagcagggaacgagtagcgaggtcaagggtgagaggtcttgtgggggatagtgtgacttgggggagggatggggatgtgatggcaatgctgagagcgtgaaaggtacgatagttatatcggcaacggggcgggggagggcgatagagatgtgccaaggtaggtagatagagagagtgtctgctgtgatagggtgcagtcgggaagggagggcgactatgccccaccaatgactcacggacgagatagcccaacacaagtagaactgacactacacgcgccccagatagcgctaggcacagcgcgcaccccacgctacagtgccaccggtgcagccacgcgctggtctacgcgtgtcgaagtagagcgagtagtgtcgcgnctacagctggtcgatattagcnccagacgacacagatagaccgactacagagtgtcaccttgagttcaa

SEQ ID NO: 9337 - DNA, 1758 bp, Homo sapiens
  misc_feature (1)...(1758): n = A,T,C or G
aataagggnnaagaagatanatgagaggagnnggnnngtggtggtnggnngagtaaggnnnnagangtggagggnnngtgagggnnnnaggnnnnnangtgacgcancacncataaananagngngnaanagtgggnagttgnnnnttgagaggtagaagggnaagaatgaagtgggaggnnnnaagtgagcgagngagaggtgagtgntanatggtgaggtagaggatacgtttagtgagtagtagagtagagctggcggtgtnngaggatagtagaggtatgagagagaggagagaggnnacacagataggcgacacgcgacagagcgctgctgtgggnctcgctgacggagtagacgagagcacgggagacatagcgcatcattgccaacacctctcgcgagacaatcggagatgtatccntcattacatacgtatatatgtatatagactatctcngcacgcgcccnctgtcnacctctctgccgagaaggccgaagagntagcgagcacnnnnnnacgtatagtctcctgctcacacnacatatgaataagtacatcacaatgctcccanagtatattagtacccttatgtacggtgtctctacgntcctcntggtctatgcgtgcaggtggacacgaaggctnnntcgtagtgtgcgtgtgctgtctcgcgcgtnnccacgatancggatccgcgccgcnctctcacgcgtcgcgcacgcgctccgncgtcgcncgcgctctgcgctcgcgagaggatggnagcagatgagcggtccgtcgcgacagatgtgcgcgcacagacggccgcaacggggcgcagcacncacacaagcgtatcgcgctcacatatgtgtnnattagatggttantaagacgtancntcgtcgcgggcgtatagtanatctagtgcagnangcgcgagtgtgtgtggtgntgtnatgcnggcagtgggacactgtagagtaagtagtcgtgtcnctcatgagaggtctctgtaatgtcctcaagagtcnccaccatcgacgacctcnccacagtagagtccatcntctcagaggcctctcccgagcgattatgtaccacgagtgagctctgctgatctgcncaacgatagcgatgcgcnatgatgaggctcgtcnccntcgcatgtgtcgtcacatcagaagcgggtctgcatgtgcagacgagagtanccgctctctcgtcgctgcatgatggcnncagtgtggatggctggagtgtgatatggcgcgcgntctcgcgtggtagcaagacaggagtcggcagcagtganctagcgagagtacgtgtctncgtcgacgtgcncagagagcgatttacgagatnnattgcaggaagtatactcatcgcatgcagcgcacacgagcgncnnacgcaggcgtggcgtaacacgtacggcataagtatcnntcatacgtnanataagagcgancacgctcacgcggtatatagcacgtagcgntctacgctatgagcnctntacttgcagatagtcacatatatcttagatagcgangntcantcnatgagtagagagtgtgtgagagtgtgcncncntgttgagntnggcaacgcgtacaccgtgtcagacggtactgtgcgncntactacgacgcgcgctagacacacgcacacncggacgcgagcgagcgacncatcgacnanagtaagtntntactttgagaggtgagtgaggagcagagtacgtggggacagatgtgtacatgagg

SEQ ID NO: 9338 - DNA, 799 bp, Homo sapiens
  misc_feature (1)...(799): n = A,T,C or G
cgcatcaaatatagcagcatgtgatcactgcagctgcacagaggcaaatggaagttggtaccatcatctgaatctattttcctttatttttgtaataggtagaaactagaatataaatgcagccattcaataccactcaaaagcctctgaatggaccaaattagaaggaagcactaaaacctgcctaaggaaccattgagaaagcagttgcctaaagaggcttatgttcttgacctacctcagtgagccactatttataggacccaaggcaatacagtgtggaatattaattgcatttatggcctcaataattcaccccctctgtagtcattcctttgtcaagtgaattttgagtacttcctgtaagagcaaagtacatttgaccaccctatgtgacccgcttcagacaacaggacaaatcagaagtgacagcataacagtgacaagcatagacctcaagaggtcttgtatgtttccgctttccttcttgcacttttgccattgccatgagaagaacatgcccagactagactgttggtcccaggaaaaggatgaaaaacacgtgggggcagatctgtcaaagctaanggatgccaaccaagcccagcctagcacagagcctgtggtcatccttgagtcagtgagtgatcccaggagagatcagcgaaaccactgaactaagcccagcctagttcagtgaaccctggacacatatgagaaacaaatgtctttggttgatgccactgagattttgtgattgtctgtacagagcaccaaatctactgatacatacttttca

SEQ ID NO: 9339 - DNA, 643 bp, Homo sapiens
aggctcaaaggaatgttttaagggccaagtagaggaaaccctttctcatccagcagaccaacaggcaggagttggagaagaacctagagagacaggtgtgcacccttttgagagggctgatgtctgcaatttcttctaacccctggttatggggaagttggggagagcggggacatgaaatacacgtggattctgaggaagacttcaggctttcgctaggagaggctttggtgataacatcagagacaaactgcggcccactaggagggtttctgtgcctctccccagtgccctcctcgtgcttctcccagggaaggtttcatctcaacaccagcaagaacggagggactggccagggcaccctgtgctgcagggagaaagggctgatgtctgcgttctgggattgtaggagctaagtgggaaacgtgagcaagaacacaaagacaggcatctgtggttcaaagcagacattaaagggctggaagagcagctgccgagcatcacctggagaaggctgaggacgctccctagtgatggagaagggacagcactgaaagtgtggctcagggtcacattctgacgtcatcctgtggctcctgaaagcattagaaaaggcttaattttataaaagcagatggcggcg

SEQ ID NO: 9340 - DNA, 334 bp, Homo sapiens
cgccgcgggaattttcacacgctaaacactttaataaaatgcaagggaactctttgcccaaaattttcgggcccccatggggttatcaatatcccacccggtaccaaactggtttaaaaagggtgtcccttgaacacacttgtgttgcaaccccggggttattatttcttaataattgtgccccaaactccccccacggggaaaacagccaccatttttctgggtggggcagtgactgagggggttaaaatatgtggttctaagcgaaccccttttattttctttccaggattttaatttaacttggacctttatatttttaaaaaaaaaaaaa

SEQ ID NO: 9341 - DNA, 788 bp, Homo sapiens
cgggggaagattacattcaacttcagacagcttggaaaaagttagaagcaaaagatgaatctgaatgctgtctgatagtccatttttaatcagaggagagcaattttcccttctcaaagaatgtctcttcacatcaggcataaggcagccaagaaggatgagccggtgatctctgcagtctgcccataactccacacaaaactttacccattgtcacaggagagtataagcatagcataaagatcctcgtagatggactttcagctccatgcttaaagcaactgacaagaatccatttcttttcagtgtacaagtgaagggtaaaagacagagaaggaagatagagcataggaaaaagagtggagtgatatttgtccattcatttgttgaagaaatggttaaataaaggaatgaatgactaaagaccaggttggcaggtgaaagccagggcaggggcctggggcagcaggcagagacacagctctcacaaatgcaagaggaagacgaatcaggcactcgtctgttcttcaaaggatacagaatggttttattgaccacctgtacatgtgatggctttcatcctggaggagaagggcatatccacacctaccgagcatcattatagaaagaaggaggacttagagaaaagagaagcaagaaaaaagccgatccactaggatgtgaaacttggaaggactggattaaagaagatttcaagcttgaatgagcacttgatgaaagtattcttttcagccctggggacacagaatattgggaatgtcacacaa

SEQ ID NO: 9342 - DNA, 368 bp, Homo sapiens
cgcttctctgtacagctcatccacttcctcatccgtaaaccgatcccacatggttatcggcagctctctcagctcacctctggacccagccttgcctctacgagtccctccagcctccctaaacacaacgagcagccctcgcagcggcaatttgcacaaactctcctccaagccccaccccatcatcgcccatccgcagaccctaggcctcccacgacaaagcacggccacctggtcagcacagacggcccttcgaggaccccctctggagaagaaccattcaggtcccaacggtctggctggtcattagttctgtggtgaagcttgaaaagcagatcagcaacaatagtaataacaataaacaaaga

SEQ ID NO: 9343 - DNA, 964 bp, Homo sapiens
  misc_feature (1)...(964): n = A,T,C or G
cgatagcgcaggtatactgagaagtcggagtggtgacggagattgantgaaacggacggatgaattggtacgtcgttattcattatcgtatctgtatcaacgttagactctagtctactctagaatacgtccgtaatgcggagagagggttggccgacgaggggtggacctagctcgagaggagagagacgcgttcgtgagggacatatcgggggcgagcgtgctgtgggcggaagcattaggagnagggcgatcggtattgtccatttgtaatcgtgtgcgaatgagagtgttatagggatggacgggagggagacatgtggatggaatatacgagagagtgggtctatcggcgtggatntagtgattgtggtataggtaaggtgttgggggacgttgtctacaagagtctggaaatggttgagtagagacacggaattgacgaaataactacaagatgaaggatagttaagagaagaatggtcggaggaatagggggaaactagaggggggtgatatcagtctgagtatggtgtggacagttatgtggcctaaaacgtggccgttggccacaacgttcggcgtctcagtgtcgttatttcaggggtctttcgtcnatnctatctcacaacttctatccgagcggctcaaatttacccgcctccctctcgtcgcacaccgctctcgtccccgatgtagcttcggtcttggtggacacgcatatacttacggcatgtgccgtgtgggggtggttgtccctgagtgggatatggggtggcgtcgctttggtggttcgtttgtcgggttcgcgggccgcccgctgtggggcctgttgtnnaaggcgcacccccatcgtccgctgggcggcggcgcccctctcccncccnnncaaaccntnnccgcccccccgcctcgcnctcnnttgacgcgnggttntnnnnnnnnnntttgtanttgattggtg

SEQ ID NO: 9344 - DNA, 582 bp, Homo sapiens
agactcagagggaatgaaacaacttagcaggactggccttggcgttttttatgccccaagcaagcaaacaagaataagattatagtggccctgaatggaatcagaaatgggagagaggttttctccccccgcaagaggcttcttgaagaaaaacaactttaagatgcaatctgtaacatctgggagaaagacactcgacacctgctagaagttcctgtgattttgcagtctgtcctgagcatcaacacctgaagatatagcccttgaacttctgtttactcctggacatgagtaactgcctggttgtgaatttgggaagctcgaggcaccctagactcattgacagacacataggagatgccataggctggcttcaatttcagcctgaagttttccatttaagaagacaaatgaacagttttacctgttgacttcaatattgacaaagggaaagcctgtggtgccccctgcccctggtagtacttggctcttatactggtgggacccatgcagctgctcatttcaatgagcgcagggcctgccttgggatttaaccccaaaccattcccaccatagagcgcc

SEQ ID NO: 9345 - DNA, 314 bp, Homo sapiens
ataaaaaagccagctctctggagatgcagagccactgctaaggttctccttggaagtcactgaaaactgctgtgaaatcgccttggcctttgcatttttcaggcaaagccatcccaggcccccatgtctcctttagttgaaaaacaatcatggactgaacactaactaatatatgttatatgctaagcactaagccacagggcaggctacaaacaagtctaacgccaggcctcatcccttgaggatctatgactatacttctgagggagaagtagaggctgaaatcaaaatattactctaagaataaatcgaga

SEQ ID NO: 9346 - DNA, 801 bp, Homo sapiens
ttgcctaacttgcagtgaagtccatagctacattacaagctggtctgaccatctgcacgctttgctattgcgatacctaaagacacattctcaccgagtcctgattctttaacttgtttccaaactgacgtcagggcccttcgcgaagatgaccctgcaactgacatctgctcagttctcatgataacttggtgccaagctactctggtaataaggtgggcttcactgaagaagcgcacttactgcgcctgctgtgatggcttttagaggaacttcttatacagctgttgaccatgattcacttaccaatacgaatgtgcactgtttaagacatgtttcatggagaatatgtgtgtacgaatggatgctatctaggcttcataccaacccattgtaagaaagttctatgagtttaagctcagggtttaggaatcgctattgtagtatatgactggcttatcacccttttgacgcgcatcagagactgcttataacgtatccacttgatcaagttagtactttatttagtggatagaattactgtagaaacttagtagtgctatataattctcttccagctcttacctgccctcatacttttttgatatgaagcggccagtaggggctaaatctatgccggatctgcccgctgcctttaaccaggggtaattactggaccttggtccctgctggcttcactcaggttttcgtttacggggagtgttgtagatcacaacagggcggataagggcttcccaggatcatgggggacccccgaatgacatgtttctaaaggtcact

SEQ ID NO: 9347 - DNA, 1859 bp, Homo sapiens
  misc_feature (1)...(1859): n = A,T,C or G
ataaantnnnnnnaannnnaannnnnnnnnnnnanaannnnnnnnnnnnnnnnaggaataatnnnnnnnnnnnaannnantaantnnnaannnnnnnnantnnnntnnnanatnnnnnnnnntttttanannnnnnnnnnnnnannnnnannnaanaaacataacatttttatannnnannnannatnntaaanatcataacannnnnannaaactatanantgantaaaaaaannanannnnnatataannaaaanatntatatttatncaatanaataagannnagaaacnanncncannnaattaaaataccnnaaaaacacagcgcagagcagngagacacagaccaaagcactagtctaggtcaacgaatacagccgcgtagtgccntaggctcactgggtcgtcgaactgcagcgacngcgcgcncatctgcgcgacagtgtaatgagaccgtagcacgananntagcgacgcacatancacgcggcagcacgacgcaacanancacancaataattaacatannaacacataaacnaccatcagatagaanatataaaagcnnnaannntccatacnanaaacaaccccaacatnnnanatacatcaaatagatanacgaaccctgacgagcgacgcgtctcccacgactgagcaatgctagccagacctgcgacgntatgacactctccggtcgngntncacgatgcagngganatcgtcactgcacgcaacacgcgctccacctcgcgtancgacgacgcagacgcgcgcaagcgagagcacgcacagcagagaccgcagngagagagccgtccgtcgccgcgccgcgagagctgatgcgccgncacgaccgcacggtccacgacgagcgcacgcncacgaccacngcgtacgtgctcactcgcgcagctcgctccactcccggacagcgatcacgctccgcatgacggagatcgccaccgacacactnacactacggtcgtgcatatcattcagcngacgcggcatcatcgcacgcgtctgaacgctccactagcgccacacgtcgcggnctgncgactgacagcacgcacactagcagtcacagacacancagcaagcgacanancggagacacaccncagacgcnagcacgacagagattacgtgcactacacagngccgaacacgaacatacgcgataacacgcgtcggtcactacagtgagatgtcgatacangcgtcacgacccagcaagagctaatagtntagacactacgcngcgtgagntcgatagtgtgantcgcgngagcagaccgacacgagtcgggccagcacgcagccacgtagatctagatgatcgaannccgacctgggaactatcacacnatacagcgcagcactcaggatgcgcgcncagcagcgtgccacgcgncagcngncccagcgcgcgcagcgggtatgngtgcgtncagcggngtgtangtcngtgaccacgtgagcgctatgcgcacagacactggtcgacagagacttgancgcgcagcgccncgcagcggangtgcacatcgcgactcacgcatcacagcnccncnacaatgtacgacgaatgcgcatacactctgccaacgctantanangncacngcgacatgtacgaatgtagcacagagatacgtatgttcgcccaacagctcgaantcgctcacgccaatgtggtctngctcgtctcacgtctactgtcacagtctgagtatgtgcgacatgcctataggtctcgcgctcacaatactctccgcacnagagacagcgtggcgaccacagangagcgtaatgacgagtgatagagtgacacgcacagcgagctcacgag

SEQ ID NO: 9348 - DNA, 420 bp, Homo sapiens
  misc_feature (1)...(420): n = A,T,C or G
atgcagttttgccacgttggccaggctggtctagaactcctgacctcaagtgatctaccctcctcggcctcccaaagtgctgggattagaggtgtgcaccactgcccccagcccatgagccactgcacccagctcagtaagcactttaaaagaagacctggacatcagagcctctctcctgctggttttgaagaagcaagctgccacaagtctacagctgtaaggaaatgaattgtgccaacgatcccatgtgcttgaaagaggaccctgaacctcagatgagacccagtcccaggagacagattgagtgctgcctctcaggaccctgaacagaggagccagttgaaccatcaacaggctcctgacccacagaaactgtgagacaataaacgtgtattgtcttananaaaaaaaaaaaaa

SEQ ID NO: 9349 - DNA, 1183 bp, Homo sapiens
cagctacctcatccccctctaagagacacttctctcttctgcgtccccgccgtgagttatgcctcgctgatcgaactcctactctaatgtttctcacacgcgtacagcgtatctacatgccaagcacacacgcatctacatattacgtccatgatcgtctcgcttacgggctgctctacacctgggacacgtacgttcagtaatattccttggtttttaacttggactctaaagctctcacattggcctggcggaggcccttcaccaatcatcggtagtggaggccacaagaacactttgattacgatatcgctggtaactaaataaactcgttgtgaactacatctctaactcctccaaaacccgcgtggatgaattcctcgaaccacattcttcatcgagcatctacagtcccattgatcaactgatgaatatctactgggcgacgagacatcggcgcccctctcgaactgttcgtctccctctacctctcctgggtctgtggcacccctacaacctaccatccgttgaattattcgttccaccattatctctcaccattcctgcgtcgtatctttgagggacgtgtgtcatctgtgtgatatcgacctgacgcactctcgactcttgctccgtactctttcctcaacctctgctccgcatcgccaccatagcgcgaacttatgctcctcacacatcggacgccctcggttaagtttacatgtattgtatatatgctcgttgtagtcgtcactatgaatgagggcgaccgatactcttaagatatgcccgttatccgttatacacgtatcgcgctgtgcgcgagtgatttatgctctacccttccctctgccttccgcggcgcgcctgctctcaccctccaccgtcgaagtcgtcgaggcgtttgttagttgtatcgtaggtgtccgcatcgagttagcgtgtactccttggcgttttcataataccttcctcactcataatcatggttccatatatgtagcactccttgtattcaaatgctgcttctcgcatcctcacattcttatctactattcatcttttcttatctttctatcgcatatagctccgcatcgcactctatcgtctatctatggcgttaggacgcaactctctgtatagctgactcccgctcataattattatatacacctttattatt

SEQ ID NO: 9350 - DNA, 1166 bp, Homo sapiens
  misc_feature (1)...(1166): n = A,T,C or G
aagagaaaagagaagaaagaaaagaagagaaaagaggtagaagggagggnaaggaaggagaaaaggatagaagagaaanaaaagaaaaaggaagttgccgcaacaaacgtaaccacaaaaagaaagnacataacgagaaggagagaaaaggatatagagagagagagtaacaagagatgagcngcgagtgggtagtgnacgaaacagatacaaccnacagcagcaacgagcggagaacacgccccgcgcgacgctgncgcacccgcgacccgaggcgcggngccgcacaccaccgccctgcacaacacatccacccgaagaaccgagaggggcggtgcaggtcgcgcagagagccgacagcgtacagtgcgaggccggacgagcaaagcaaacgtacgaagaggaagcgcgaagacgaccgagcgcacgaagcgggagcagagagagcagacccccaccaccgggagaccggaccacccgcccgcgtgcagtacgcagcgccacacgcaagcgtcccacaacgaagagagagcgcgagccccatcccacggcgcccccccccccccgcacactgagacagcataacggtaatcgcgactacatcctcgcaagnacaacgagtcataaccccacgctcccacccccgaccctccacgtgcgggtcgccggnccgggcccgaggcgccacggcccgcgcgagagccacgggccacgactcgcacgcgcggatcgcgagacgaaccgcccgactcggggcgcgacgccacaagagcgagaagcggagccgcaggagaggagcgccggagccgcgaccacgcacggacaaggcggnagcgccggagaagagtcacgcgccacctagccgggccagcccgaagtacaatggggaggcgcacggcgcccacatgaccgacgcgacacaggcgccgcagacccgaccgcacctccgcgcgcaagtgccaaccacggcggcgacggcctgccgcgcgccgcaagagcagccccgagcccccgagccccccaacagcgagcgacgccgacaggccccagagcgcagcgcccaccacactccatcaacgcccacgagaaggcagnccccacccccactagagaaggacaccgcgtagacagtcgcgaagagaacggaaggagaccagcgagtcccc

SEQ ID NO: 9351 - DNA, 1031 bp, Homo sapiens
  misc_feature (1)...(1031): n = A,T,C or G
gatggtcggcccacctggcacggggaagacgctccttgctaaagcagtaccctacagaatgcgagacaacattcttccatgtctcttcatcaactttaacttgcaaatcctgaggagaatctgcgaaactcgttcgtattatgcttgaaatggctcaatgttctattatccacgccaccatgatttatgtgatgcaaatacgactccgctctggtaagtccgcccgaagtgactttgtggaacaacatcgaacccatgcgagacaggctgataacccgttagctggctggtctcataatgggatgtgtcgttaggaggaccctttttgagaaaatatacaccccatcccaaaacggttgctcgtttccgggacgcgctacataactattaactctgcagattaattgaagtagggctgcgacgaccggcccgcccttagcgtgaagcgaaagtcgtttgtttccgttccaccacacaaggacaatgcacaacgaatgtgagcgttgctaccaacgtctgtctcgaccggaaaggagagcactatggcatggctacatacgtcacactctacaactcttatgttgacacagatatatatgggcggagcgtatgtgatgacggctgcgtactactacgcggtcgcgctagacgacgctggatacatacacgtacgcagaacctaggtcagtgtagttgcgtctcgtacgcagcggtcagaaacgtctggtgttaatccgattatgatctataccatcaacagtgttcacacttcatctacggattatcgacatagtctgcaagatcatcggtcgagcctccttcgatccttattagatgaatctaatctctatgtcgcagcattctnatatatgacatcgacagagagtatcacgagtagtatagatgtctctactgacgtctgtgacgccgctcgtcggcgtggtgactatatgtaattgtattcagggctatatagtgtgactgtctatgtccaagtgtcagatgatctgcgggctgncagcacgcagtgt

SEQ ID NO: 9352 - DNA, 1759 bp, Homo sapiens
  misc_feature (1)...(1759): n = A,T,C or G
agagggannnaaggggagagnnanggaggngggnngggagggattgggaggggagagagaggggagngnnganagagaanaggaagagngagagtttagagngnnnngnnacannaagnanatgtngatggttgtttgtgnatcgacgaggnnaaaagtcagttagaaaatgagtggtggagcgagntgtagtgagagaatagtgatattangtagagtttagaagngagaggtggcaagtaatatgatgaacgcgaagagtgagatacgancagatacggtcgtgtatgactgcgactacgcgtctgagagcgcaatggtgcggcactgcacgaacaggncagcgtatgctatgacattgngagtatagtcggagacgcgtaccgagtgccacgtagtagcgatattcgatggagatgatcataaatggataagacgcanaaacaaagcgaccagacgcagagaaccgcgggagagagtgtgtaggacagcatacgaagacagatgcgagcagcgacaagctgtgtgcgagtgangacgatcttgtaggntctatcggtgagncgagaccagaggagatgtgagagcacgaccagacgcagcgctattctagtggcgncaacacacctggcgctcgcgaatcttgatatggagtactcccgtgcggtagattgntccgatgcatcagtaggcatacggattacgaggtgactcgtcncgcgttctattgtgtgcggtgtcgtccccacgacaggcgctgtcgcgagctgcgcagcgngccgtcgnatgagacgagagagcaccaccagcgctgtcgtacgacgcgaantncgtgctagctcgacggacgcgatcgtcagacgcacgcccctgctgcctacgacgctctttacatcgcgcgtcgcagtcacacatcatctactctcgtctcgctaatattgcgtcgagagtgagcgagacataggntgcacgcgagcgcacgagancgattcgtatagcgcntcgcatctgacggtcgtgcgcagtgtgagcatgctctcgcgtcatcancntactatgcgcgtcgncttgngacgcgncgtcacgacagtangtatcgtactaggcgctggacnatcgcacgtcgatacggagcgtncgaccgtnctagcactatatatgnctacgacctcgtacgcacgcgacgngtgtgagangtcgccgactgcagacgagacgangtgangcgacgagcggcgacagccnacggctgtcggaccgtaccggttantcggtatacactccgatcgagcnanacgcacactcataanatctgtattacacgtatcgtcaagcgcgctcatagactacngctcactcgatcgaagctcggatcacgttaccntacgcaatgctctacctcactacgcgancgagatcgagatgtagtntcgcagactngntctatggtgcgcatttntgcngnantctaacatatggttgtacttagacatcnatncgcttngagcacatgactactgtatgactgtctcgtcgagatccggtcnnctatgtacacattctcatgacgcaaacggtcgatatgataatcgtagcagcgcgacanagagagagtgggagtacgatncgnactacngagntacgacgcgtacccgacttcagatgcacgtctgcacgcgtctcntcgcgagnagagagacgtggacgtcgtcgtnacgccgtcagtgatagtgcacgagcgtatagnagncgagagcat

SEQ ID NO: 9353 - DNA, 235 bp, Homo sapiens
agaccaggtttccctgtattaccctggcttgtctccaacacctgaccacaagtgatcctcctaacttgggctcccaaagtgctggaattacaggcatgggccaccgcatccagctgatatagatttccgcagaactttaaatatggcatctcattgcctcgtggcttctgttgtttccagtagaaatctgttgctaatcttattaaagattccttctacctgaaaaaaaaaaaaa

SEQ ID NO: 9354 - DNA, 801 bp, Homo sapiens
  misc_feature (1)...(801): n = A,T,C or G
tttaaacctgaaggacatactactctctggagttgagaacatagcaatgagcctcaaagaagaaaatgagcctcagtgttcatggaggaaggtcattgcttagcaccttgggaagacatgcagctgatggatgaggaggatgctggatggctatgctgagttggctttagactctgctcaccagctttggaaatggttacccagaaagatgacaatatcctgataacccctccatgaccaaattcttcagcaaagcatttcaacaggccatcaccgtggcatgtggactgatgggttgcacagctgttattatgtgcttacaagggaaattaggagtaattaatggactgggatcaataacagtattatattgaagtgaatgatttaattttctaagtgaagaggtaagcacagatatttcacatcattaaaatagatgtgaatcagcatagcaggtttgaagaaactactccattttttgttgtatataaaagtttaaatttttaacttctatttactttntgaaaaggtaacgcatgcataaggtaacttgaacagttcaaagtagtattaaataattgctccccagagacaatcactattgctagtgtattgagtgttcttccagaggtgccctatgtatttgtgtgggtgtgtcccttagctggaagtagttttgagaatccaagaacttcctggtggtctgctatatctgttngggtcatccggatatctctgggtgttcccccaggaccagacctacagcccanatttatgggcatattatatattgttgggtag

SEQ ID NO: 9355 - DNA, 1851 bp, Homo sapiens
  misc_feature (1)...(1851): n = A,T,C or G
caaacttcaccagtaatatctcccaagtcaattatctacgaagaacacaccagggacgccaagaggcgctcnccacgagaggagaccaaccgcccgccngaggaaagagttataccatcggcacagaagaaccatccangaggcgtaattcncagccgcagatacgtgtcgctcgagcgcgctccacacctcatttttattctacangatacacgcgcgcagcgcgcatcgcccgtctccggtcagaataagcgacgagtctgacatagtagcgcncaacccgtgtggagatccgtaaatgcacatcacanagctcgccgcactcacatcgccatatctattcgacgccgcgcgtgaatntacgcccattatgtgactatatcaccacccagtcatcattagacagcgcaatagcaatacacacaaccgcgaacatccaagcgagactcgatcaggcgctcacacgatntcatagagcaggcgacacatagctacaagatcacgtcatatgcgagtaggacgtatacttaccntanagtaccgctggcgcccatcgtangccgacacatatcacacagaggcaacacggccagcctgggaagctgaggtcaagccacacnaacagagtacgcagagacnaccgactaattacgaggagcgacagccaccgacagcgtcgagtacgcattagtgcaagatgantattgttccactacacgctcactccatgtgcaggtccatcaggcgagagagagtatgtgtccagtactgtcanaccacgctgntgtacggtcgagcaaggtctatgtcngatctacaggntgtgcgangtctcgtttattccccacactagtgcggtgatgnangtcacgagcagcaccgactagcacgtgttgtatggngcagcgtagacatctcgacagatgcaagtagcagacntcgatgntatgcgacacncgtgtagtccacacagcgtancacgacgccgaatgctcgcgcgtangagtgtatgatcagctagacgatacacgncacgtacatagtgcatgtagagagcgcncggatngctagtagcgcgncncntgctatgtgaccacanagnagtantgnagcgtcgtgtcgntcagaactcatgatatngcagntaggcatctcgacacagcgcatagacgcgacacacagacgatcaatcgactcgntagcatagatatagnctgtgtggtcagaatagtgtcagacacagnaacgcacgacagcagacnagcnagatatgacanagagcatagantcgtcagcgctgcgagcgcagcaagacngctcgctacgatcagcgatgatcacgcatgagcgacggccgacgacgcccnttcgatgaagnatcgtgtagagtagacntacgacgtcagatcgtagtagcgaacancagtatancnntaacgaccactacnaagntgnacangtgatgcacatanacgatggancgcgagtncttactcaatgcngagtcagaanctagcgtatagtcagcatactctacgctcanagcagatagtatatctatcnacnacacaacgcgacngtcgatctgcgatctacatacatatntacgatnctcgcgcagcagcgtatgtacacgacantgtcgtagntntgcgactacagagttacgacatgcacagacactctccagaacacacacccgacattgtgantatgtcctgcgcgncngcgctgactactcncacacatcgtatgtatcagaagcgtacgacgagagatgantagacgtccacccggccatcgcatacgatcgcgcacagtatctgatctgtcgctcaaccacacacgccg

SEQ ID NO: 9356 - DNA, 800 bp, Homo sapiens
  misc_feature (1)...(800): n = A,T,C or G
aagttgatgaactagtagaaattaaacctgggattttggtagttatcttgctgtcacctggaagatagcagacctgagaatcaagctcaaggaacctagagaaggaggcaatcaaaatttttatgataacacttgaacacctgcattcagatgcacacctctacaagggaggagagcagtgagaaaatggccaaacaaaggaactagagaagtaagccagtaagtactcaagatttgaagggaagaaaggagaaaatgtactgtttggattatttgaatatgaggctttaatgaatgtgagagcgttctcattgaatgcattgttcttttgaaagagcagaaatttctgcttttcaactctgcttaaaagatgggctccctgccatgctctaaatattcccagattagttctttgttggcgaatggaaggcaaggcgtttcctaagtgagggctttccttggaagagtccctgcctctggttccctgtagatggaagctggaagctaggagcagcagaccaccagctgatctcaattgccctgaagntgcccaggaaggaagactgatctctcagtggtgaagacccaccatttagtgctttatagaccatagactattgcactcagaagcaaataggcaggccggattgaatgcacagtactgatggaatgtgctccctgcagctccatccacagtagccaaacgaccccacattctggcccggctgtagcttctggattcttccaagggagaggcagtcgcttaacccaaacacagaatgaagtggactaagcccgtg

SEQ ID NO: 9357 - DNA, 875 bp, Homo sapiens
  misc_feature (1)...(875): n = A,T,C or G
gagagatggtatattgggatgttgtggcaaataaagggtgtggggggataagagaaaagattaagatgggggaggactaggttgatagagtgtatggatggagagagggtgtgtgtatttttagagtgtggaaattatatataatggtgtttgagaaatattgatttatgtatgaaaaaaaaatggggggataagattgattgtgttttggggtaagggattaggaaaattttagaggggggaagaagttaaagggttataagttatggtagttaaaagttaaatgaggtggaaggtaaagttaggattgtgagaaagtttggaagtttaattaggatgatgggttttttaaataatatgtgaaagtggaaaaggttaaggttggaaaaaagggaaaagaaattatgggtttaaaagaaagttttttgagaataattaggtttaaattaaagagaattttgaaaggtgggtttttgggggggaagtatgttttaaagagaaggattattttggtaggtaaaagattggaaatgggggtttagatttgtgagtaaaatgtgagtttattttttaaaaatgttgagggtatgaaaacccccagggaattttttttgatgagtaatggatagggttctaatcatatcncaggttttgttggttgggggataataagttgtgttttgaagtgtagtggaaaccggaaaggaatttaaaataaataattttgaatggattttaagttggcttcccccatgccatgttgaaaaatgggaaaatttttttagttatgttaaaggatatgaagggtaaatagttaaaaaagggagatggcggggagtttctttttnttttttggttttagttagtgatgtggt

SEQ ID NO: 9358 - DNA, 1060 bp, Homo sapiens
  misc_feature (1)...(1060): n = A,T,C or G
aggttgttgaaatgtagggaggagagcacagaaggacagaggagcttgatgggttggcctagagctaaggattagaaggagagaagagagtagtttggcgagattggaagaccagtggagggtgatgagttctactttgaagaggagagagggaccttggactgacaggtaaaaatgggtataaggctattcgatagggcgagattagtagtgaagtgagtttccgggtggggagngaagtcgtggtgaaacaggatcgcaggttgagagggtgcggtggcgagatggagttaacgatgccggggtgcggtagaaaagttatagtaacgggcactttcggttggaggggataaattgaataatgttagaaatagagagaggtattgagggtgggaggatatattacggaactgggttcatcaagcaagggttattggagttatggcagttgaggcattgatattgtgagcacaaggttttgtggtaagcaagtgacaagctgcatattcatccaagtcgatatgctgtcaagaggcttgtcaaggcccacaatccagattacttgcaccagagtcgagtgatcgttgtgggaggatagaagattcgagagagacgtgttatgcgcataaagtcagacagaggggccatggagagtataggacctgggcctagaagagtctgaggtgtccgtgcacgccaagacatacaggctagttttactcataatggtgcagataaagagtagagaagcgtgagtggtatactcgctcatgtactgcgcctcgaagtcgcgtcgttgcatgcggagtactaatgtgctgtgtggttcagttgacatcaatcatgatatgagaagtagtatcaagcacgattggctagtgttacgtgtatttgatgaatgaagcggtggagtggctgcatcgatagtggtcgcatagagtctggtggataatagttgtgacctgtggagcgcgggacggtgcgggtggttgtggggtggttaatataataggagaactcaaaaacagagaaatgaaatagaggtagggaatatgtagag

SEQ ID NO: 9359 - DNA, 1348 bp, Homo sapiens
  misc_feature (1)...(1348): n = A,T,C or G
cgtaacggagacggtggatagcggctgttcgcctcgtgnagccaagacatgtaagataacatgttcatctcttcacagtgtataatgatattaccatatntaatacgcttgatggttcagtgcgggttgtagctcgtacggatcttagcttggatataatggatagcatgaagtgacgcgggacgttcgagaactggtgagtgtagggtgtgngtatnttcgctgtgtgaataacgtacgtgaggtgattcgtggactggctacgatatgtgatcatatgtagcgtgtgagaatcgtgaagacttgatttacacagtataacataatttacgtgtatatcgcgcgtgcgtcgacgctttcgtgttggtcgtgttgtgatgaggtcagtcgcagagncgagctatgtacgtttgacaattatgtagagtggtatacggtcgnggtgagagagggagtatagcgtgtaggagtgtgagagcggtgtgagancgtgtcggtgatgtgcgtcctatgtatactgtaagagtgatgcgcgatatgctgaggcgtgtcgcgtcgcactcntaaggtggtagatgtttccgtatgagtagatccgatgtgtatcgaatgcgcgagcattgagattattcctcgatgcgcgtgtcgcgatacgcgacgagcactcaatcaagttgatgcagtcataaccacacgcagaaacttggtatgtaagagtncgactataaataggatagatatgatatagggagacgacacccttcgtataccgcgagcgtgcccgcgcacgactcggcatcnacatgtggagaccgcaacaatgatagcacggacagtaagatcacgcttactggctggtggtcatcgcacagacacatacgtggtgtatgcgctgcgccttagtcacactcggcagntntacatataggaaggaaacagggacaagagtgcgaggcgaatacgtactgtcgctacattagtgtgataaagtnggaagggangaagtgtccgggagtaacgaatataattggagtgttggtgtattgagcagagcttcctccgcacagcggctctcgcggactgatgcgaaagaggtacgagatgcacgctcgagagtaccataatccgaggacctgtagaaggagctgttttcagatacagcgtttattgtgctacgtatcagtgtcattctctaataccgaccacttctatgcaccgccaggatctgcctatctgtcctcacacgggcggttctgtacttctacgcaaccagccccgcctcccctgatacaatagcccgcggcgcgtggacgcgccctcgccacacgcgtgaagtcgcgcgacagcg

SEQ ID NO: 9360 - DNA, 341 bp, Homo sapiens
atacttctcccctggaccttgttcccaggctccgtgtgaagctgaacactccgcatgatctccctgccaccatagcaagctatgaagttcattacacatgcaggtagcagacaatacagctctgcttccatttctgagcacctacggtagactgccattattcagtgtgccagcctgtttccaagcctacaatgtatagttcctctagtacgtaaactcattttttttctcagagagccaagtagagacacaggcagttttcttctcaaaatgtgccagaaattccaaaacaatctccaagcattaaaggctatgtgcacaaagtaaaaaaaaaaaaaaaa

SEQ ID NO: 9361 - DNA, 844 bp, Homo sapiens
agatgacggggaactaaatgtgatgaacagacacctgcaaaacagctaggatgctggaattttagtcttacaagctagtgactttgggcaagtcatcaaatatgcatcgtactctgtctgcttactcataaaagcggacatcaagaaaggtgatcaatgagttctatataacgtctaaagcctgtactggatgttctgtacatctaagccaatatattttttatatcagcacaaacactatggccgaagcaccgcctaccatgcccgctgccgagaggatagactgagtacgcagcataactggatcccgccccgccccaactaaacacagcataagacctaactaataggcgacgcactccgtccaaatatcaacacccaatcaatccattggcaccgaccttgaacaccccactagtgcaatgaatcactccgatcaccataatccctatagacagcgaatcataagaaccctcatgaaaacggcacaccatatacaacaatacatgatatcactattggacgtcctcaactaattcgtacactcatcggtacgttgcgaccccatgtcgaactcattcaagatcaagaacatggtaaatccgccgcacttcctaaactacttcacttcgtcacacagcatcgaggatcaagttcagtacagactatcacactatagacagccaatagtcgcaggagtaaaacacatacaacaactataaacagactgatacatgatatctctactatcgacccgccacacccgccatcatcgtccgccgtagattatttacaacacgtcaacatgattacaagtactcgaagacccacccataagcaagct

SEQ ID NO: 9362 - DNA, 1399 bp, Homo sapiens
  misc_feature (1)...(1399): n = A,T,C or G
ggaggannnatttttganagagatagnnaaaagagtaaagagaggnnnnaaagagagaggannaagaggaggnnaaagangaaagggtatgaagatatagcagagaatggagngganagacagaagccgncgagagaaagagagagaantatntatcatacatatnnnatataatgtaatgctataagattcgaagaaggantaacaaatagctcagcgcgtnataatagcagcgacgataccccgaatcaagatactcctatgatgaaatgtantatangagtatataatntcgtaggttcatggcgccgctatccgcttctccgtactttgtcctcctcttgcattctcctcctcgccctcgctgccgtcctcactcctgatgcgtaggcacgtctcatagcgcncactgacaaantgangcagnncanatcgacacaagcgcagcgtcgtgnnacagagattatgtcggcagcgcancccgacgcgccgtacactcacgcgtgatgcacagcacaacactcnacgtcgcaccgcgngngtggngtataagagtacatctagcgactcttcgcctgttaatcgtgntactttcatntaggcgttncacgagaggaggatgcgagtagtgcgngtgaggagttagaacagataccacgtctcatggtgatcccgtcgtgtagagcgagcgcgcgctcagtggtgntcgccgtgcgggtcgctctgntcatatcgcgtcgcgtcgtgactctgntacgtatgtgcgacgtcncngctctccatcctctnctcctacgagacgaccgcgcgtatgtgcccgtgccgtccgctcgtcgtcccnaacacgtcgcgcncanctcatgtggcgccaacagtaacggtcactcaccnacgactacaaccacacgacgagccgcaggtgcagacgacntgcgacggcgcgtctcgagagcgacgctctactgctatgggcgtgcagtgtcgtatntnactatattgngcgactctacgacgcaagtcagtgtgtcgtagcgaggcnccgcgcgggatcgttgtacgactcgcagcgcatgaaagcgatgtacttcgacatcgctgacgctcccacctgngtgtcgaggtccaagagtcagaagtanntntacgacgtcgcacttgcnctccgaacgacgtctagcgtgagtgtcgacagatctcantaagaaacgggnatccgacgacgagtgcttaatatgaacgccgtctcgctgcgtggcgccgtacggtgggagggcactagntgctcgagtggtgcgtacgctaacgtcacccatcgcgttgctgtagcgtcgtagcgncagcgagtgcgcgcgtacgcgagagatgcgagaccacgcagtcgcggcccgaatacatcgag

SEQ ID NO: 9363 - DNA, 1461 bp, Homo sapiens
  misc_feature (1)...(1461): n = A,T,C or G
tggtcgtggaaagtgaattcttctctaccatatcgcgtgacacggcgagctcagtgtggagccgtcttgttctcttccgaggaaatgctactagccataattaatgatccgatctcgagcacgcatatcagtcttctggccgtgcgacagcgcgcgtgggcgctatcgtncgagtcctgcgttctggtttgaggangagaggtgaagtgagagaaggtcatacagttactgcagacgtgtgaggtaagtgatattgaagatgagggagtctactacatttaaacatcaataacaccgcgatcgaagatcatatagagggagtatcgtctgatctacattaacagttagatgggagcgacgcccggnngcgagctcgacgtagactaatatcagacgcgcaccacgacgtngccacctcagtgactagttcagcgggctgggtgcgagggtacgacgtgcgctgcgtaccgagacgttgccgtacgaggggccgcggcgcgatgagaacgcctatgatgataggtgagagtaatgtggacacgcgagagtgagatgactattcgtagngtgcagggtagacgtntgagagtgaggctcgagcgaccgtanggcagggcagatagagggaggtggagaacagtgatcangcccttctactgtatgtatctgcatcgtgtatgagacacagggcgcgacgccaaactatatttgtaggtgaagagtgaacacattacactatcatacgctagtnnngctcaaactactagggtacagtaatatcatgaccgctaaagccacacgaactcacatcagcgacnagctaacgaattgccgcgctgactctatcggacgactagtncacgttcgatctgtgcagatgncagacatatnggggctagatatgggncagctagagtaataataacgcaggtatacataggctccttattctcactttactctatatgtatttgacttcggacacttccgctcgtgtgncggcatattagagaaggctcatgcagcgcgagcgactacagatgcatggcgctactctagttatggctatggtaggtgacttgngaccagtcaatgcatatccgcaccacttgtgtgcactgagagatgacgcgtgtcagngcgtacttantgcngtgtcgcgcattggagcgcgtgagatagctantcactagtagatacatcgttctnagcagtgggatgatgaggctagtagattaatgatcgtgtatgacataggttacgtgtcttgcgacttgcgagataaacagtgnacttctatatataagtcancgagctggagctgtcagctattgtatgnagtacngaagcgagnctcgtgtgntgtgagtagcaatacattgagttcataaggtatattgacatcgtatacgantncattacgncaacgttatctgcgtacgtgcactgaacgaaccagtc

SEQ ID NO: 9364 - DNA, 1338 bp, Homo sapiens
  misc_feature (1)...(1338): n = A,T,C or G
gcgcccagggaggagagacactcacggaacccagcttgtcttcgccgacaccatcctctgatggcgcacatccggcactcgcgtctttccgtctcgtcgctccagcatcgttgcgcctagaggaaatatatagaatagggaggtggtgtcgagtagttagaggaaggggaataggagatgagtatgtgtagggtcggcggcgcgccgtagggcgagcgagaaatataatacgatatacactgtgttctcaacacgcgacgagaacagcattaatccacgcagccgagtctaatgaaccggtctcagactatagcgcggatagtcgcagagacgcacgagcgagcggcggaggacaggaggtccacgtcttgaatacgtaggggggtggtgtcgcgactgtggatgctgcatgtgtggcactattcgtatggggaagacacttcatagactctctccagcctcactcgccgtgcacgcactcctgtcgcacataggacacagattgatngacgatgtcattatctgtcagttagtgagtcactggccgtggtacgcgttagnttctcctagacgaaacgaagancaagatatataccactacactatacgatatcgccctgtatgaagacagtataggtaaagacacgatggcggcctcatctaagagcaccatagaagtgcgatgttgtgtgcgagctatatgagtacagganacatacatcgngtataggagtgcacgtgcggcctaacaacgtctgatgnagctagattatctattcttacagtaagacatgtacgagtaacagtatataatcgagtgacggggcgtcttcggggggggagggtgagacggtaagatgggcagagtagacgccggtagagcatacacgagcccggcgnngaacagaggtaacactaactgtntctttntgccctgtgcgttcctgtcctttgcctcgtcctcttggtcagtctattgtgacttcgtgactcaagaaagccggctcacgcggccttctgcctacagcaatatgacataccgcgcgaaaacactaacatggtcgcgtatggcgcatggtgttatgcatagtagtcagatattaaggcgatgaccgacgagacactgtgcactccgagaggaccgcggaacaggagaattgatgtagaggagagctcttgggacgcggcgatggtggttgacatctaatttacagatgtcantcggcggagtggtgtgngtctacaacaagtaccacgaggtctatccataatgctaagaaatcagaaattggagcagaacagatatcatatgcacatcgtatacgataccgactactc

SEQ ID NO: 9365 - DNA, 1420 bp, Homo sapiens
  misc_feature (1)...(1420): n = A,T,C or G
cacaatatgacgcagcacaanggctatggtggatgcgtgggataggtagacgcgaggatatgagacgtgtatggtatacgtcaatactagtattggatagttggtagagtaagagtgagatggtagagcgcaatcatacttctcttcattatgatgagcctattagaatntttactaacgtgcgagagagtaggtgtgtgagagatgtgagcgtttgaaagtctgtaggagagtgacttgatcagtagaggtcatatgattcggagagcagtagagggagaggtcgggatngaggtcgaggaagctagttagcatgaatgataagagtgtanaatgagatagatatgattataagcatattgtcgactatatgtgtgagattgatgttanacaacntctcacagacaccgagtgaatcgatacgatctgtacgtagagcgtagaaatacattgattctatctggcggtaagactagtgagagcaacgagtgtagcagtggtctggtgcacgaaccacgtttntcgcgctgtttcagcatatgagatacagactgagtgtctgttcactgcgtgagtagagtgntaatcgtatcatgattaggttaggtatcatgcgttaattatataggcagaagaggtgatcatgcggtggcggcgctgcgtaccattgcgcgtctggtgtacggcttcgcatgtcatacatcatgttggagtgagaagagagacagagagtaagcgcgcttggggaatgatgaacatgatcgtggatgtgtgcgttgtggtcattagcggtgcgcgtctgtacgtcatctcagtggctcggtgtacatacaacncgaaatctacatcaatcgacgttgagtaatctgagtgntgtgtatgctgaacgtcgtgtttgacggcgcctggtgtggcggcggggcgtgcggtgaggacgaggagtgtgtgtacgacctcatcctgccgagaagngacgcgaggtggtgacaggatgcagaagcactgacatgaggttactctgctcatcacggcgcagtcgatggtgacgctactacagtgtgacgcgcgtgtgagtacacgagctgttgcatcagcagntgataacattctattactactagattngaggacgctcgactagtgacgnaacgtggagtgttatgcngcattatgctcctgagcgtctagttaggtgtgtagcggtgntctctaggtggtatcgagtcgcagagtataaggtgtatcttacanatacnatacaccanacatcntgntggggtctattcatngcagcgtctcataaatatcacaggctggaacgcgctgtatgagagctctctagaagacgtntaccaaggtactgattnatgtctgagatatggtctctatcatagtcatgactctatgttgcactggtcac

SEQ ID NO: 9366 - DNA, 1639 bp, Homo sapiens
  misc_feature (1)...(1639): n = A,T,C or G
cgagtgagcgcgctacgnngatgggtgtacagagtgtggtngagacagantagtagtgtnggtgtgaagcggtggtgatggcattgcgatgtgtagctngactacgtctcgngnggtgtcggttgngnggcgcgccgtggtgctcgtcgtctngacntcggttgattcgtctcattatagacatactacatatatctatgtgcggtcgggtgaggtgtagtgcntagctcgtctngagangtgagacgtgacagtgtagacatgtgttagtattgtgtgtgatgagtatggatatgatagttgcgtgcgcaggtgcatgagtacatgacagatgctctagtagattctatgttctatattatttaattaccaattattaatataaacttacttgttggggtcgatctacacgtagcatgcgtgtaggaggagtatggagtcgggctcgtgtgcgtcggcaggaaagagcgagaagaatagcggagtaagagcagataaggagcgcggtgtagnagctgtagaggtgngtcgattctagtgtcatgntatgtgagnatcgtatgttggttagatgagtacgtcgagtgatcgactgctatatctactatctctactacaccatgacgatgatctattacanaactcatgagacctctacgcgggtcgacacgttgctaacgtacttggagcagcgaacatagatgtgcgcacagatatgatatatgacacatcatatatgatctcagcaatgcgctactctgtcgtganagatgcggtaactcgcgtcaaagtcaaacagntgcaatataacgtaatgttatacgttgtngtctcgcgcgggtgcactccgacgactctctgcntacgtatctgtgtctngtgctgagctactgagtctatgatattctatgctctttctatcttctccttcatgtacctcccctattcttacatctgttatactagtaatatcactttacagacggcgatcatgtgtctctccatatgacgcttgtcacgtcacacnagtgtgcatacgggttgtgctgatgatattgtatgggatcataatatgaatcagtcgttatacggaccagactagaggttgatggtagatagtgtggtctatgttggcatagctagcanataacatcgcatgatcgcgacgttatataatgtagtgtagcattcccgcgcggcgcatataatatatcagtgtcacatctggtctgctacgccgcgcgagcgtgtgagtagtagtagcgggtaggcgagatgcnactgcgtggcaagtgaggactaatcactgcanaatcgactgtgaacgagtgagntagtcatgntcacgantcacaagacacncgcgcgtaggagtacttcacgagnacgagtgcgagactatgagtgagaacggangagatatactgatgattcctgcgacaataatacacagacatgtgagctatgagcataatcagtgtatggactgacagacaacatcgacctgagcagatcgtcggcgtgcggatagcgcgtctatgtatcgcatcggatacatatatctcaatattacattaatanacactagaacaaccgctaataaagtgatatcatcacggggtacagaatagagacgtat

SEQ ID NO: 9367 - DNA, 1704 bp, Homo sapiens
  misc_feature (1)...(1704): n = A,T,C or G
acagataagtaacgacacgcctatattatatatttcattcaattatatatagagaaagacattatacatgatatatatcagacgatatcagtgcgagctggttacgcgcgtctaagtcgtctcagtatcagtcgtagtagtacgtgtccacatacagttattctcgtacgcatccttgtgtactcgcacaactcgacacactacgacgatccactcgtgtctgtttctgatatataagttattactgttagagcaatgctcgagcttctatnaagaacacatatctaagtatactataagcgacgcgatggaagtgcagtggctacaagaaatgggtacagacgccacgagacagagtccatagacgatattaacgtcaaaacatagaactnaacagcagcgcggacgngacactacgacagcgtgagactgacatacgcagcacagcgtgtagtagcatcgctagtgagagcttaacgtaanttcgacgtcgtacgcacgctatcgaacgcgcgntgcgtgcgaccagncnctcggcaagcagacgagagatggcgatagcgactatgctgttctaatgtagtgtgcatagcttatattcttatgaaggtgtagtgatngatagttagcatgacgtgaacatagtaatgcagnacgtgcgaccgacacatagaacgggtcgnatactctgacgtgcgcgtcgaccagtcagtactgtgtcgcgtgtgctggctctgcgacgatgatantagtcaggattaagagcgagcatcatgtactgtacgtcacatatatatgcgactgtagtgtgtgagcaagtctcagcatggagctctcgcatagcgagatgcgtgcgtcagagagagtacgagggatgagacgtcagacactaccagtcaagtcgctgtcaggtacaatactgagcacanctgtcacactacatgtcagcattatctacatctcgttgtagtgcggtctgcgcgctgagtgcgacgtgctgacntagcacgtgtgtatcgtgagatgctgacgntagtatagatgtgatcgtcgtcgacactcgcgtgctcgcgagatatgtgataatcgtgattgagacgatacatcacatactcagtccagagtatgcacaagcgtctaggccgatgtcgcgtgcctgccgctggtcgcgagnctatacttcctagctcacagtcactcgtaacgtagancaganacttgagcaccggtagtccgtgtctggtactgcactcgtgnggcacgcgcgggggtattcntcaatcgattatcgcttcctcgactcctccacctccacgcgtcgtatcacgatatcacacatanacacactcgacgatgtgacaagaantagcgccaaccgtgatctacctgttctcgcacncactaccgacagcacagtggangncgtgttacgacggcatgtactatgtctctggcgtgcgtgagtagtgatgcgggtttggagtaatctgtctgccaggcgacgagtacatggagaaagtagacgaatcatttggctggccctctgtgtagtgatcggctcaacacaataagatacggtgagtacacaccgtacgtccgacgaactacgatacactcaacaatactaccgcgagtctatctatctatttacttactctgtnatctcatcntactcttctaatacaatctcacactcacatccgc

SEQ ID NO: 9368 - DNA, 119 bp, Homo sapiens
  misc_feature (1)...(119): n = A,T,C or G
atagtagattntngggtngggtggggtgggtgtgggggggntggganaggnatgcagcctctgctaaataaaaaatataatttatgacaatcaaaaatacaaatagaaaaaaaaaaaaa

SEQ ID NO: 9369 - DNA, 1454 bp, Homo sapiens
  misc_feature (1)...(1454): n = A,T,C or G
atagagaaggaagaagagaggagggagaggaaggaaggaaaagagagaacgcccctgcgtgnaagananaactaggaggnacgaaccgncgccctgcgccggggggcacagcaaccagacaancgcggacgagggaagagacacaagagaaggaagcggaggcgagaggcttttaaaaacagagaggccgcaaaggcacccagagagcggaacgagaacacacggcggacaccacgccacagcgggacgggaggaggagagagaaagacaggcaccgcgggcaggagcagagaagagcgaaagaacagaaaaagggcaaaggagcgagggacgaacggcggaagcagggcggcgggaacgacggangacgagccgacgagacacaggagagagcagttctttatccgcaacagcgcgcccagaagagacagcgacgcgagaaaaacagaagagaagaggggacagagagcgggacaggggagagggcgagaagaaagacgagacacagagaaaagagaaccgtggacgagggcggggcgggccgccgaccagcggagcggccgtgaggaacgaaagtacacgggacggcgacgacgagcagcaacaaacacgacgangcgggaggcaggagcgcgcagacgccgcacagcgataagcaacacaacaacaaaccgcggccgccgcgcgcggggagaagacggaccaggcagaaagcagagacagaaaagcgacacacgacaaacgtgaagacggggcaacgaggagagggagcgcgcgggaggcacgcgtangaanagtacgaagcacgacgangaggtagtaaagtaagcgcgcggacgaacacaacggacgaggaaagagcgcgcgtggcagaggagagnagatagtctcacgcagcgcgacgtgcgagacgggtgcgactgacagcgcgagcgcagacagacgccgcagncagcggacgacgcgagncgaggcgangcgaccgagccgcgacggcagacggacgaggagagcaaagcagcagggcggcgagacccncncgacgagagcaacatgcagagcgaagcgagcgcgatacagagaacagagancgagaggatggnagagagagaagcgcacagaagggaagagagacacgagcgaagcgagatgagcgagcgcgcggctgcacggagcgtgcatgagnggagacgagcagatagacagagagagaacgcacagagtcaagagaggagagagccaagaaatagagagacaagaggagngngagagcggagaacgagacgnagcgaagccaccgcagcggagagtanagagatgcatctagcggacagcgcgacgctcgcacagacgagacgaccaggacagaggcgccgacacacgggtcacgacgcacacgaagacgcacgaagcagaggcgcggacgaaaggagagacggggtagagcaggagcg

SEQ ID NO: 9370 - DNA, 797 bp, Homo sapiens
  misc_feature (1)...(797): n = A,T,C or G
agatttctcaggattctcttgttcctgttctactgaggatcctcgaggtgacctatattgtatagaacctggattgagaggctgctcaccccactgggcacaattatcatttcaaaatggaattccaaggtcacgtggttagcgtatgaaaggctcagacacgggcattcattggggatgcctgacggaagagggagaaagaaaactgctcaagcagggctcagattctgtcaccttctagcagagctggcttaggaaacagcgaattgtgagctataatttcagggatgcttggaagacgccctccctcaagctaaattatttctagaatttccaccatcaacgtttatttcttgggtagatggattatctcccatcaacgtgcaaatgtaccttgaaagttatcacttgtgcacagggagaactaatgggtagatggaagattctggaactagacctgtgttcttatcctggctcttccatctcctacctgaatgaccttgtaccagtacctgacctctctgagcatgggtgtgctcatgtgaccctgcctcatagaggtaatggacttaaaaccacttaggcataatgcatgctggataaatactggctgcatcccatccaatttaatatgttgggttatcattttcattcaattccatgtagttntaaatttcctttgagacattgtaattcagagccctaactctgagagttagactgtcaggatttaaatgccaccacctctgccacttgctagctggcagacctgggcagtgaattatggttctgtgcct

SEQ ID NO: 9371 - DNA, 797 bp, Homo sapiens
tgctaccttaagaagcaccccgctgcttcggttcttacataccgtaagttggtgtgtctatagttgtattttttgtattatctcgtgtctggattttggtaccagggtaatgctggctttatagaatgagatgaaaagtacttgtcctgttctttttcaatttttaatggaagaactactataggagggtataattattctatttatgtgaatgtttattgagaatcaaccagtgaagattaccctgccgtgtgggaacgtccttagcctactagttgcagcgcacgttagtagaaatgcggactatttagtgcgaaaaaagcggcttgcgagaaaaagcttcacaattcccgggacagacactcggcatttatccctgccttgctctgctatcgtccgtgttccgaataaagagtatcccagaaagatggtttgaatccgctaaagtcagggttccgcctggtcctataatggagttgaccacgcaggtacgccgtccagatcggaccttctcgcatcatggtcaagttatgaattcgcaaagtggctgtgacagtagaatgattacgtaggtgtatccgtcacgcttacactatcctggggaagatttccagcgatcccatgcgggttatgtgtggagtcttggtatgcccgtagtatgtctctcccgccgtcacatgccctgagatggtatggtgtgatacactttggcagttacggacgcaggcccaagaataattacgagcatctctcccagataatggtagtctagaaagccgaggagggaaagtcgtggt

SEQ ID NO: 9372 - DNA, 611 bp, Homo sapiens
  misc_feature (1)...(611): n = A,T,C or G
tcttaagctagactggggctagatataatcaagaagaactgtggcacccagaaataaacaaaagataatggaacttttgctgagccacaaagagtatttttagtgtttggctaagggttcaatttcacacttgagaactttctagtatgtcccctttttcactggtttgtaccactcacacttcaaggagagatggaagaaactaagtcaagccgacaggagccatgtctttcaagcaagaaatacagctgccagagaacacaaatgcggactttacataagcgtaaagccagcagggtgtctgaggacatcaaatttcattgcttttgtctgtttactacaagatgtaaaaacagtcatttgccaccggggagatgttcatgaattgaatgttataatttcataatcagatactatgactttaggggactaaatgaacttttcaggaagatttatttttttcatnctgtgttcctagaacaggttctaggtgtctttcaataatgaatgttattgctaaggagctcctgttagtcctttctgcctacacaagaacataggagtcctctgttctctctgccctggctggcaaacagtgtttcttttctatt

SEQ ID NO: 9373 - DNA, 676 bp, Homo sapiens
ttccaagatcaagaaaatagagccctggcagagtgatccttgaggttcttgaccccagtgcagagatccgcaaaggtacactgcttgacctcccctgcttgaatttccaggggttaatcttgagacaaaccaaggatggagactgagcttccaaattccacagattacctcaaggcagttggtcaacaactaagccattgttgagaggatgccagtccatgctccaaatggaccacggctcaagatagcaactggaacaagacacacagaccttgtgctcagcactccccctgcatgcctcccattgtatcttccgttttcaaagcccctcctccaagcctaaagttcgaagtcatttctggagttgtaaactggctgcttccccactgctagctttggaaatgaaaccattttccttttgctgtacttcatccttgttattggctacaagcagcaagcagccaaacttgtgctcagttacagttttgtcaggtaaataagatgaagggaaagtgtgcatacaagagagtgaccatcattgtgggccataaaatctaagctggataataaagtacgtaaggacatgaaataggtgacagacaatgaaaaggtgatgaaatcagtgaatggttgatgctaatgttgttgaatgatatttggaaataaagacagatgc

SEQ ID NO: 9374 - DNA, 507 bp, Homo sapiens
cttttaagtgtgtgccaaaattctctcaacgaagataacctggtggagaggattagttcccatgctgcagaagctgtccacatcctttggataatttttgaatattcaaaacagcttaaataagctcaatgttatgacataaccttaacataaacatgttgagaagaacatatcaacagaagatattcagtgaacaacggaacttatattgcttcctctaatggtccacaaacggattattgactgaaatatcaaaagactgaaactgtacaatcatgatcagaaacaattaataggcatatgccatgactctgccattcctgccaccttagcatcaatgatcataagatgccatccagtgtaagacatcttcatttcagagatgttaaaatgtgaaatatgtgcttcttacaattgaagatgcaacaaatgcagtagatatttacctgtatatatgtatattcaatgagtgtatatattcatgtatataaacttaataacaaacga

SEQ ID NO: 9375 - DNA, 905 bp, Homo sapiens
gtttaaggctacgtgactctcttatttaaccaccgatccagaatgagaacctagatgacctgagctaaatactcttctaactcatgggcacccagactctaggtatttcatgattgacagctaggacctgatatgtttctgatgaccatacggtgcgatgcatccatttcaaccagtttacttgatccaatgctcatgacttcattgactgacactgccgttctatattgtttttggcgatagataataaggctctgtgcctccggaatggtgagcctgtatactcttaatctttaaccttaaggacttacctggccacagtgagctgctgtgccacaccaccggtcatgagagactgggtctactctcaatgcattatcaagagacatttcatatgctgctgaaactgagtacgacaaagcatcattgtatattatgtcatacagaacggctcacgtcgggcggagagagtaccacccacttaacacatgatccgatcaatctgcgtgatctgacagatgactatgattctatagttacagcacatctttttttcggatgggggatggagggatgcaatggtaccgtggaaaaagggggagcaatgcgttgaactagggtcaaaagaggtgagtatgggatgcccctttgtttaggaatgtatgtcataagccggacatatgcattctagagcgctcttggaactctattcatgttatatttggctgtctaatcttggctataagcggaagtcgagttaaaacctaataacataagctaattttgtcttattcctgtgcaccatatgccagttttttacctgttgaaggtgtatataggtgggagattcgacggcgctcaatccgattggagggaccaatatacaaaagaagctagtcttcctg

SEQ ID NO: 9376 - DNA, 1194 bp, Homo sapiens
  misc_feature (1)...(1194): n = A,T,C or G
taggggnnnnaagagannnnnnnnngnngnnaaagaggtggaaaagnanaagaggagnnnanacctaaantganngantatagtnannnannnnnnnnnnaagacgtgtttaananacctagaacggataggaaaagaatgagcgaataggaagaatgtaagaatgatttgtaaggataagtgagatagaccgcaaaatggagggaagatcaaagaacactaaaacatcactgacaatacgtgcatcatgcacggtccacaacgcactctccttcccccctgtagagcacagcgcncccgggtgggccacgggggagagaaggaaggaagagaacagaggcagtgaaaagagagaaaacgagacaacaagtgacacgaagtggagacgctgggcaggcaagcaggcagttcttatccgtggcgctaaccatatatacccataaggtcgccatcgagcccgagtagagactgatagatagtaataccgcacccgaaagtccgccccggaccgcgcgacacgcgcgcgccccactagcactgcgcgcccgcggcgtcgcggaccgctcccccccagcccccccacccccaccccgccccaccacccaccccttctctcctccccgcacaccgcatgtcgccatcttcgccctgcgctttcagctctggtcgtgtgatgcacttggtcgtccgctcgccgcggtgcgttggcggcgcgcgtagtctacgtgggtcttcaatcaggcaaaggctgagcgcggcaccagatagcagagctagatctgtaatagagccgcagagagacgacgtgtgcgccgcagctctcgtcgtgcttcgctctccaccccatcacaccagggttgcttcacagctcttcggtgtcgcgcaccgcgtcagtgtcgtccgtgtcattgacgtcttgttgttgttatgtatctgtgtatgatcgtctgcgatgcggcgactcgtacgtcctccacgtccgtcgggcgttccggcgcgatagcgcgacagcaggcttctgcctatctgtctgatggccgataagtggcgcccgcgtaggcatggcngcgagcacacgcggcgcagtgcgacgctgggtggagcggcanaatgtaatcaggaaatagtgtaatggncacgccagtattagtattgatgtgcgagaggcggtagtggcatcgaagagataacacg

SEQ ID NO: 9377 - DNA, 142 bp, Homo sapiens
agcaagatctgttcacctatcacctatttgaaaaggtacatggaagttatactgaggatttctccccctgagaacaccaatgaagtcgcagatgtcaaaatatgtataagaattttgcctaattcagtacaataaacccaga

SEQ ID NO: 9378 - DNA, 1542 bp, Homo sapiens
  misc_feature (1)...(1542): n = A,T,C or G
gacaacacaccacaaagactaccgacaccgacacacaccacacggccgcggaggccaaccccttcctacaacccaccaagcccccgcaccccttctaccctaccaacaacctgaaaagaaccgctcaacatcaaccacaaacgctcaacacacaaccaacaccagcgggcccccgcccgcccaaaaaaaaaacccccacaaacccccccgcaccacagcacgaaccgaacacacaaacgccgaacaacaaaacacgcgaccaacgacccacacccaccaccagccgccccgaccacacgcacaccatacaccgccactcctccgcgctacgacgagacagagatctagatagacgaagagacagcgacaacgtagagacaacaagnagactgagnanagagccgcagctganacngacacacacacacaccgaccaggaggtgatgccgctactacaatcaccaacatancacaacaccacatccgcgacaccagccaccggatacaacggacacaatatattccaactactcacgtctcacgcgcgccgagaggatcgctcgtanantgcggantatacggagccatgcagcgaacaagcgcagaacgcgaacccgccgacagccgagattcaccgaaacgacattcgcacacacatacacgccaccncagcactcatnanagcnctacgcacatagcacagcgcaacgacagagatatgcaacaggacacacacagacaaccacaatcacangcgcgcatcgaacacactcganatcgcactcgcacagcaaccaccgctagctcacccactataacactctacatcgccacacactaaccttcacacaacacgtcaccgacgnaccagcgtgactcgctcacacgtcaacacgagctcacacagtactcaaccgtacacgcgactgactcaacacaccgccagacgctacacaactacatcgacaccgacacaacgtgcgcccgaagcacgctctctgcgccaatgcancgtgcgacacacancctgcgccactcgtcacacccgctcatcacgtcgcaggactctcnaccgctaacntnacacaccgacatacataggcagnactcaatcgccgacacagatcccctgacaacacagcgctgcacntctgacagacgatcatcgatgagacnctgcattccgatcacgaccctcacggcatcgccnctagctcacatagagtacacaacacatcaacgcaatcacgcgncaaccaccgagctatggtgacatacgacgtacgatatcagcgcacgtcacacctccgacatcacgcacaacagacgtgaggcaagatacgangtgaagcacgacaaaccagcgcccacacctcagcataactcaacgactgtancgtcgccacacacccatcagcgcgcacgagcnanacggcacaagactcgcacgtatcaacgcgcaggctcataccagcgcctcgaccaccgtcacacaccacatacatacgctacacatctcgctaccatcactacaagactctg

SEQ ID NO: 9379 - DNA, 323 bp, Homo sapiens
ttacttcggtaacaaacagaaagaggcccatccgatgccgaaatccaaagaaaaatagacactcgacacagaataaggtagataccaggaaagatgtttttaaaaacctggtgaaaagcaaagcatgagaatttcaggaaaagagaaatgtctgtatgtgaaatgaatgtaaacatgaagatcttccatgagcaaatgggaaaggcaaaagaatcagcaaaacaccccacccagaacagaggctttggaagaaagctgtggtaaataaaagtaaactggaaatctggagctcctcagattagaaatgtgcaaatcaccacaaa

SEQ ID NO: 9380 - DNA, 791 bp, Homo sapiens
  misc_feature (1)...(791): n = A,T,C or G
atcttactaaactnaccctcttcttaaccaccnctacanttttanggccatggctnatcctaggaacatatnannnatccgcgaccccttgagctaaacactactccctactcattntaaaaatgtactgtatatctcctttcttctaccataaccaaacagacttgctaactcttaaccaacctaatcctcaatactcaaaatcctactcactccttctcctaaaaatcttaaaacctggcgtttccaacactatttcaagcttctaaaattttataatctacctgaagtcatctaaaaacttnaaccatggagcactgttttggaatccttcccaactcttctgagacatctatatcaactctattctctctaacaaccataacttacaaaacaccccattagttggagaaaaagaaaaatctcaccatcccaaccacaacacacaaggaataaacaactaccatattctcaactcccaacaacctccttcctaaaaaaaaaaacttcatttaaaatttcataaccctccctctcccttagaattaatcctaaatctcattcaaaaaataaccctcaaataaaaaaaaaataaatttaactccaaacaaatccttccttgaatcaaaattactctatataacatcttccttaaccattgataatcaataatttaaaaagcgtcaaatccccacaataaaatttacccccaatctttaacatactaacctaaactcccctcattaataattattcaattaaccccccaaaatttctttaaatacacatta

SEQ ID NO: 9381 - DNA, 418 bp, Homo sapiens
tgagatgtttcccaaaatgcctcacaaatattctgggatgtcaccttttgcaatggatctgcaggttccatcgtgccctagctttttgcctgaggggaggctctggccatgggtcccttttcaggtcagcaagagtgccgtgcagagcaggagccccatccaatgctctacaggtataccatccaatactgtccaatattgtagccatatgtgactaatgagcacttgaagtgtagctagactgagatgtgctggaagcacacaaaacacaactcattgtacaggcttatacagtactagtcttcgagagaatgtaaaatatctcactaataattttatattaattatgtgttgaattgataaaatttggatgtactggattaaataaaataccttatcaaagttaaaaaaaaaaaaa

SEQ ID NO: 9382 - DNA, 1548 bp, Homo sapiens
  misc_feature (1)...(1548): n = A,T,C or G
cggcgcctgcgtggtcctcgtcgtncanatcntcgctctcggttctgtgcgttgtggctgctctgcggggcgcggcgagcgcttcgcgggcgtagcgcgctgcgtgtctgagntagtgatgtatcgtgctgtggtgcgtgcgacgcctcgcgcctggtgtcgtcnggggtcattctgccgtctcgtctgttcgcgttggtcgcgccccggtctcttctctgtcgttgtccgtcgtctcggcgcctggtcgtgtgcgctgcgntctagctttcntttccggctgatctcgtgcggtntgctctcggctctctcttattctcgtgccgcgtcttgtgttcgtgttgtctgtgacttgtccgtggctcttgttggcgcgtgctgcgctgtgctgcctttcggcggcgtttcttgcgcggctgtctgtgctgggtgcggcttcttttcttctcgttggcctacggcttctcttccngttgntttcgcgcagcgcgcgtgagctcgtgtctctctccggcgcttccggcgtgtctgatcgtgtaggtcttcgtgtatgttgtcgtcgtcagcggcgggttgctctgcgtgttgtcgtggttcctccctctcgtgcgcgggctcgcgtgcgcagttgtgttgtgtgtgtgtgctccccgtcgttctagtgtcccttccccttctctcctcctcgtctgcgtcttatctggtgtgcgcncgctgcttcgctttgtcgtgcaccgcgtgctgtcggtgctcttcggtgccctctctctcgcgttttgtctctgtcgtcttcgctgcgttgtttttcgttgccgctgttgcgcgagctcgtccgttgctatgttggtggttcattgccgtctgtcttctggtgtcctaccgccgccccgtgctcgcgtggctgctgccgtcgcgggtgtcggtcggcggtgtgcttctatcgtctccgcccagggcgtgntgggtnttgcgtctaatgagtgtttgtggtggttcgtgtggntcgctgcgcncccgttccgccgcgtctcgcctcgccgcttgtgtgnggcgtcgtcgccgtcggtggcgggctctcgcctcgcggtgccgctggcgcgctgtgtctgcgtcctgtgcngttctgcgctcgcctgtcgttctgtcgtggcctgcgtcgtgggtggcgtgcgntcgcggtgcgctgtgtggtttccttcgtttcctctcgtctcgcctgcctcgncgctcgcgtgctcgtccntccgttgtcgtcgtttccgccgcctgtcctgtccgcgcgtgtcgtgnggtgggcgcgngtgccgtgtngtctttgtgtgctggctgccgtcgctgcgtccgcntcgctgntggcgtgtgnttttgctccctcctccgctntaacacagnngttgggngtgngtttgttcgttgcgtctcccgccgcntcgacgngngcctctcnctcgtgtgttgtgtctncttcgcttcctctcttcgcgtcctgctggtctgttgctgttgctgtcttntgactctgtgttgctgcgtgtctctggctctgtg

SEQ ID NO: 9383 - DNA, 782 bp, Homo sapiens
aataagggcggagtaacaccccggcctttttttttcccgggcttttaaaaaggcgagggatctcacactcggccgttgggtttttggcccttatccacaacgcaaaaacgcctcacaaaatgttttttgcagccactgggagaaaaacccgggggggaatcccaggatttttttggccctaggcccaagaggccgtcccacgttaaaattgtagccccgcggtgggtttttggccccaccattccaacattaagccccgggggcctttttttttaaccccccgcgcagggggggggttttcccaaaaccccccccaaaattttgggggggcccccttttcaaagggtttccggggtccctttggccccagcttttttccttaggggggggtttggccccggggcccctttccgggccccaaaaaatcccgccaaagcgggggcccccccccaatcttttcgggggaccccccccaaactgtcccaaattgtgcccccctggggttaaaaagcccctcaaagggggtttaatttaaaagggggggggggcccccaaacccaaccccttgggcggggttttaccgcgatttgttttttaaaaaaagtaaaaaattcccaccaaaaaattttttttttattttgggttggattaaaaaaatttggggggctggggtttaaaaaaaaccccttcccaagtttaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9384 - DNA, 704 bp, Homo sapiens
  misc_feature (1)...(704): n = A,T,C or G
cgtgggttagcgtnnnaccttaatnnaaacatncttnaacaactcactnnaaactctnataatcaanatcctctcccccaatcaaaaantnnaaaactcaacaaaacactcaanatcacacacttnatnccaaataatataaacttcantcatntaaagcagtgcatcaaacanacactgncantactattaacacaacaaaaaccannatctccantnnccnactcaatctataacattcactctaataaatctaatcatattacttccccgaatttaataactaaactcttctatcctaacataccttactaaaatctcaatttcttctctctctccatataccctaaataagaaatccttttttcatatgaccattatatttataaaaaaatatgttacactaacttcctaaaacccaaccttaaatattcttaaatcccctaaaactcaacctttaaatcacaccctttaaaaatatttcttttttccatctaactaaaaaccttcttaacttcctatattttaactctcacaaatttaaaccccacccaactaacttttaattaaaaaaattcactcaatccccaattttattatccattcccaaccccctttctttttaaattaaaattctttcattctcaaatctctttcccccacctctaaacccctcccacttttcttaacccttccattaaact

SEQ ID NO: 9385 - DNA, 1602 bp, Homo sapiens
  misc_feature (1)...(1602): n = A,T,C or G
cagagcggaagtgcaaagcgccagcgacggacgcacaccgcgcacaagagagtccgagaagccgagggcggcgcggctcttagagggggagaaacggggagcggagggagacctccgagagagangaggaaacaccaagcgcacacggaagagacgcaggaggcgagcaaagcgagggacagatcttctaacacggagacgaggagacgagaaagcccgccgcccgnccacgcacagccanacacacaacaccaggagacccaccacccgacacggagaccggccaagcgagcggagcgagacgcgaggcgnagagagccagaagcacgagcacccacgacacagcgacgcacacgcgccaagcgacggcgaacacacgggacggcacggagggcggaaagaaacgacacgaggagacacgaaagcaagaacacggcacgcaacacgcgcgcccgagcgccacgcggcgccaccgaacgcgacacgcccgccgccgcggccagagcgcgagcacgagcacacgancgaaaacgcnacagagtccggacacagccacacagcaaccacgcagacncaccacagcagccgcacgagcgagacagcgagagcaccgccggagaagngcgcgagcagcaacaccagacgagccgcagcgacacgcgcgagcagagcgaagcgaccagacaagcgccagggtaggcacgcacaaagcaaccggagcacggcggcaaccaagacgcgccgcaccagacgccagagcacgcgacacgaccgagcggcgacggcgtagacggaagacgcggccaccgagngaacgcgaacgacacgcgcgacgtgccagagcacacacgcgcaagagcgagncgaagcaangagtgccagagtccgaagcaagagcaagagcggccacgagacggcccaaacagacagcgcacaggaccgcacgagacggcgcgatcgaagagcgccgcgcgcgcgccgcgagcagcgagccagcatcaacacaggacngagacggacnatagacagacgcagacgcactcgagacagacacaccgcagcacgcnangagcgcgccacgcacgagcgagcgcactacgaccagacagagcaatagacggacagcagacgccaacgcgagacgcgcacagacnaggcagncgacgacaagagatcgcgcacacgcgagcacncgagacggcaagcggcagcacgcgacgcgaccncaacagagtagagagacgaganaggagagagagcgccagcgaagcgagcgaaggagcacagcncncangacgcagacggcgngcgagcgagtcngcggagccacgtaccagccaaccacgagacgngacaacggccaccaatcaacngaacgcaccgcgagcggagcacagaggcacagcgcangcggcaagacacgagcgctagtagcgagcgagccgacaagcgactacgagcgtgcacacacgcggacagcgacgaacaggaggacaccagccagcgcgcgcacaantcagacccgcgagcaccgcgacagcgcatacgaagagaggacgcaccacgcgacatgagancgcgagangcagacgagatcaggat

SEQ ID NO: 9386 - DNA, 547 bp, Homo sapiens
  misc_feature (1)...(547): n = A,T,C or G
tgggcacgaaaaacaactccgtgattcctctttgctgagtaaactgatgcgtgaatggacaaataaacctctgagagattccaatgccagggggaggccccagagcttttagcttgtgacttgtgggccacgagcataagtagtcacggatgaccctggattggttagtggctgctattgggtatagagcccccccaggcttgggtgacctggaggcgctgattatcaacgggagtgccaggctagggacttaagcccagaccctgatagagtgattattgcgggcctagaaaaatcgccaagggacctgccagaatgaagaatcttggagcnctggggtgggtgtcggggctgcatgcagccaccgggacgagcaagtcaggaggggcccgccttacccgcagggaatcggcaccctatagtgaaccaacaacgagtggcgcctacgatattgagggtgaggagtaaaatcgcaggggttgtggcgcaatagcaaaagagatgcgaaattggagcggggagatgggctatcaaagcgcaaataacc

SEQ ID NO: 9387 - DNA, 811 bp, Homo sapiens
  misc_feature (1)...(811): n = A,T,C or G
agaggggtgataatttgggttgagaggatttaatattgatggaaggagtaatgtttaaagggttttggatttttttgtaattattagagtgaaatggagaagggggagagtggaaaaagtgggtttttgtgaatttgttggatagtggtagataggttatataaaaggttgtggggtaaggttagagttggggtgagaaaggagaaatgggggagttttttttatgtgaagttatatttttgggtaaagggttggaaatgagattttttaagagtttttaaagggaaggggggggttggaaggttttttttttgttgatttgtgtgggagggaggtaaaaaataatttaggggttgtcgttggtatttgttagtgggtttgttatggggtttttaggaatacggaggggtttttttaatgtgaaggtgttgatttgaaggggagttaaaggggttgtgaaatttaagaaagaaaatggtgaggtgattattggaatttaaagaaatgggaaatttgatttgtgaaaattaagattttttggagtttgggggcagttgttggtgttgcttcaagggtttttattgtggagttttttataagggtggattaggnggaaggaacccccggtttatagtgaaaaattttaggttttgtaaacacattgaggagcaggaaaaaaataaaaggtattggtttgaaataaagaaaaagatgtaaaattgaaatgaagaaatggttaattaaatgtttaaaaaanantaggtttattttgttcattacctttgttttgattaaaattttactggttttt

SEQ ID NO: 9388 - DNA, 1382 bp, Homo sapiens
  misc_feature (1)...(1382): n = A,T,C or G
cgtgttgtgccgtggttgtaacgaattaatccgtaagatcgccccttcggtcggcgtcgtactgctcatagatcttcatggatctctggtattactctccgctcggtgtagatccgatgactggtagatgtcagtcgtcgtcctctctagtgtgtcatgtttacattcatgtggtcttgcattggttgtatgcgtctggatgcggactttacatattcgcgatacgtgtgcgtgctgattccttcaacacgcggcgctgtgggcgttggcatcccaacgaatgatcgtgcgttcgtccggcttcgtagacaacagtgaagcgcgggaacatggcacgtactctcgcttctcgctgcgtctaactaatgctatacgacatcnatagaccatattaatacgtggcggcgagcggtgtggaggcaatgcggtcttcgggtattggttagcactatcttgagtttcgtgtatcggcgtcgcgctctacaatgatttggattgctcttcggtcctatactatctgcgacgtcactcgatatctgctcagccattatttggtggcggttatatctgttcnaacgtactctcattctgcagtcgtctgtctaattgtgagtgagccactctcatccgttaccgtacacacaggtgtttgcgcgctcgctgtcagcctacgtatatgacttcggcccgctcgtgcctggtgtacgtctacggtggaggctgtgtcacgactactctcactcggtgtattagctttgatgtcgtagtcagtgcgccgctctaccgctgtcagtcgtcggtagataacactctgcatctttactcgctgctacactcgtgccgtcgcgagataacgccgcattccttcgaatataacttccgcacgtgtacttagngcgccgttatgtgacgtctaacaagttataatcatatttacagatatcttatacaataaggcacgangcatcgtcgcgcctctgtctcgcctctacatctctccctatacactgtcctgccacatatgcatggtatgattgtctatcgcatctgcccactcaacttctcagtcacgtacggtcagtgaataacgcgcacgctcactgcgcgcctctgcggttctcagatataccgcaactgcgcgttctgtgttgtatgtgatgtgttgataactgtcggatcctgttctgacattganagcagtctatacacgctcacttcgcagactaggatatgcgaccatagcacattaaagacctgagctcctntcctctctttctcgccgcgctgtcaaacacactcgcgtgtcgtggctcaccttcttctctctctgagttattatctctcgtcactatcagacaagtgggattgacactcatttatat

SEQ ID NO: 9389 - DNA, 731 bp, Homo sapiens
tacctgtgactagatctggccaagaagacctaagtggaagtttttgggtacccgctgctttcttgaggcatatacaagaggagagctactgatagcggttcttctccacttctttctgcctaggaaagattatgtgatgttgggatgtgcagcaactattttgtgatccttaggtgggcagcacaaagggggcagagcaacctgcaaagaatggcagagaagaaaaataataagagtctgggtcattgagcttccagaccaaccctggggccatctgtgtctggattttcttactactaaatagtaaatatcctttttttgaggaactactggacttttgttactttaaggcaaaagcttgcataatggatataccagaaaagggcaactggagtaggattgcccaataggatcaacacaaataataagcagagagcatttgcaaggccctttcctcaaaaacctcatataacaggagcatagagccgattgccaacaacattgtcaccgggctgaaaagaccagataaaggtgcagaaacatgaaaaaaggatatcaaacgctatatcgttaaaatctcactgccgacagactatgaacctagtatcgctgacgacctgcccgatttgcctgggctttactgggaaacgattagggccgcaatttatccgtgtcggctaaggataagagaatggcgtgagtcacctgatacaaagttacggcagaaaaat

SEQ ID NO: 9390 - DNA, 388 bp, Homo sapiens
ctgttcatgtttttcaactaccaagcacactagagacaataactggctgactttgaagaaacaaacagcgatgttatgaactgcatatggaaagagtcacatggtagaaaactgagcctgtaggagccaaccacagtacaccacaaatgtaatcaaataacatgtggaggaagtttggaatttttgaatgataaaatgtgggaagatagtaacaggtcagaagaaacaaggagttgaggaacagttgtgtgtccatattaataaaagatactgtaaaaaggtacttgcttggagggctcaagtaccaccactccacccccatggaatattccctaagaggtctaacgagatattcctgatgcttaaggtatccagaaataaaccagga

SEQ ID NO: 9391 - DNA, 739 bp, Homo sapiens
ctaaagaagcagttgggtgatcatgaagctcttactcaagagagggcgggctgagcccatttggagattatgctttgaataaggcttagatgcagacaatgaagatcgagctggacgatgtcacaagaacacgatcaagtggcttctatactgcaagttttttgataaatgtcgtaacagtatgttggagaactcactggtgaaaatgtgaatcacatgaagtatgccaaaaggaaggcatcgtccatccataattgttaaaagaatgggcgagactcctcaggccagccctgttggaattgcacatgataatgatcttgaagaaaaagaatatgctggagcatcctgtctagcactcagccaactcaccatgatcatattcaacttatgaccgagcgaccaagcatcatgcaagctatactgaaatacgaatgcctgccggcgcacactctaccacctaaagagcggtaccaggaccgccacaacccatgggtcgcgcggtcatactttcacaactagccgaggcattatagcgagccaggatgccagacttgtcaagtgacattaccaacgaggaagtacgctacacccagaggactttgctagagtctgcgcaaaactggttcagtcaccccggtcctcgccgactcaacacgcagcagacaggcccccacctcataggcgccacagccccgcgcacaaacaccgcccacggctaggctaaaagaccgaatcgttt

SEQ ID NO: 9392 - DNA, 869 bp, Homo sapiens
  misc_feature (1)...(869): n = A,T,C or G
ggggagttattnnnnnttggnnnntnnnnannnnnnnngttnnnnnnnnnnnntnnnttgtttnnntattnataaagctacttnatanatnnnnaagncnatatatttatgtgatctgtaaaccgtatggagncaacacgacagaggcactacaaaataacaaaccaatgggaagtagacaagaccagagagaagcggaggcgcaggaagacgacgagtccctcgctaaattaaatgcacacgtaatggaagancccaaccgnagatcaaatcaacattgaccgatcaagcccgcaaagacaccacgaacatcaggcgcctaatgcggcgatcgcggcgagcaatagaccaccccgatcattccgcccccccacatctgccttccccatctacccacaaacttccatcccccctacaaccacaaactcccccttactctctccctatccagccgccgacgcgagcacaccctcgacgtatcatgcgccagtacgccagagggacggagcgaagcatggaagtgcaccgagacaggttacgaggtagatacagagcgtttgatagtaacgatacgacccccagccagaatcggatcgcgtagagtcgcgagcaaccagcaccgcctaatataatcatacgaagcgtcccatcccccgaacccgcaagagacgacttgcacgccaccatcaaaccgcgcctctagcccagaagctccgatcgcacgccactgctccactcgctcgagtacgacgccaagactcttcaagcgcacgatcgtcattctagacaccgagcaccgccggataccgcctacgccgaattctcacgcctcctcccagcacacccattccgatgaactatagagttcg

SEQ ID NO: 9393 - DNA, 926 bp, Homo sapiens
acccacgcacacccccgatcgcaccgccccccgcggggaggttgaactgcccggctctcttattaaccaccgtcaggaggattgcagctaaggatattgaagaaattattgatgaggtcaaggctggcgacatcccaaaaccagggccaacgagtggacgcttttcttgtgagccaacttggaggccatacctcctttgactgagccacccacgggaccttggatttggtgtacaagcatgccccttaatttatatatgaactgtaaatatgccagtagggagaaaataatatattgagactctccaatctacagaaaaagcaaaaaaaagaacaaagtaaacaaaaaaaataaaaaaaacacaaccgtccatcgccgcccgttcctcttcacctgagggcttaaatttatagaccccccctttaaccgcacctcgctacacgcacgcccactccggagctacgaaacatgccatacacctacatctaccgctgtagtggaggcaccgcttactccacaaaactattgggaagagtcgcgcgaaagaacccttggcaccgaaagcgcgaccaaaacagggcaaagagcccgaaaaacaggcccaaaataataggcactttttaccactagggcccccccccccctagacaagcaatcgaagaacttccgccgctctggagtgataaggggggcgcaagacccgccagcgaacaacaaaagagaccctgtaacagtatccaccctgcgaagctcgacctgatgcaccatgaccacatcacgccaccggcacgagctacacaactcactaaccgcatactttccaatcttaacgccccgggcctatatatatattagccacacgacacttcattgtgattctagtacacgccgcccgcccccgcatacgtactccgacgaaacagtgg

SEQ ID NO: 9394 - DNA, 851 bp, Homo sapiens
  misc_feature (1)...(851): n = A,T,C or G
ttaatattaataattaaattcaaataaccagaccaaagaaaaagaaacctaaaaatccactaaactctcttaattaaccaccgcctacatcaggatcatgacacacccctatgcatgactatattccacctcgggacaggagcagtgcaaaaaaacttacattataaattttaactccaaataccctccaaaaacaaaaccaccaattcccctagaacccacaaacttcctcaaggaaccaaaaacttaagagaccccctcaaatactaccttaactttaccccaatcctctagcggaggccctcccttangaccctcctaaaaaaaaaaactccttaaatacatacctccctagcttcttcaacatccctccaagaaacccaactcaagccccaaaccctacctactacctaacttttcacatcccaaatttccctcttaatccatccctcaacatagcttcccantcccctatttacacatcttacccaccctttcaaaanccttctccttccatcctcccccaaatacctttcaataccaatataattaccctaacacccctttttcttaaaaccaactcttaaaatccaaaaactccccctctcctaccctctccctctaactaaattcaccaaactttcctttttccatccaaaaaccaaaaaaccccccccaaatttctcaactcctttcttaacaaccttataattttcacttctcaatagccccaaatacccaatcacaaattccctttctacaaaccctcaaaacctaccttttaccccccttncaaatttacttaccaactatccacaaatacccacaccccaaaacaacaaactccactg

SEQ ID NO: 9395 - DNA, 824 bp, Homo sapiens
  misc_feature (1)...(824): n = A,T,C or G
ccccccccgtctcgacttaaggttcaaggtctttcttcattacccccccctccaggggatcatgccagccggaaggccaggattagatgccagtccccgccaagaccagtcggggaagggctcgcattgtgaattttaacctccaggtcgccgcgaagaccaaaccaacaattccgaggccccccagactccctcaaggaagcaagacttggagcccccctcaaatactccttgggctttacccaagtcctttaccagagccccgcccttaggagcctgctgaaagtgtcactccctgatagataggtccctagcttctgcaagatcctccaaggaaccggactcaggggccgaggccctgcttgctccctgacttttccaaagccaagttgcctgctgtatgcatcccccaacatggctgcccagtcccctgtttccacatctttccagcctgtgcagaggctcctacagtccatgctggtcccagatgcctttgtgtaccagtgtgattgctggtgtgccctttttctgtgagccagctctttaaattcaaggacntggccttgcntagtntgctcctcccccctgaattcagntgagctatgcttcttgctatccagagaccagagagccacagctgaatttctgactgctttgctttactaccctgctagtctccactggtcaataggcctaaataccagatcaaccaagtggcttattagacacagtacccacccagcccgtttgaccacacttgtaaagttaatttcctagggtatcgaccaaagtaaccaaagcacaaaataaacaaagatcgcgca

SEQ ID NO: 9396 - DNA, 782 bp, Homo sapiens
aaacacaacaattaatcaatgtaacccagaaggggggagtgtaaataatcttacaaaaaaacaatcggggttagtagattcattatacaaaccttgttttcgatagtcaaattatatggtagatattctatcggattcaaaagaatagatcatacgattttctgaagtgtgttggttaatattctgtccaccccgcgtaattttgcttgcagaaaagaaatggacagtgtaatattcaaacattattaaaaaaaattgtaaatgtagtattacgtatgtatacatatgtataaatattgtgtatataagaaaattatatcctgtgagcttggcaaatgtcattaatttctaaaagatgggtacactttcaaggtgtttacataaagtttctaagaatgcaagatttacatctagattccagattgtgataaattcattaaaataatagggaccaccaggccatttttgctgctataactgccttgacattttctatgactgacattagaaataactacaactcctactcggaagtctgggctcatctaaagtaactaaatttcatagactaaaaaaagtgacgtagaataggtaggaattttgtgcacccacctaaaaatttcaggaactgtttttaagtctgagacacttgttttcccaataacctgtaccaagcatgctttgtttttaaaaagcacatgataaaaaaaataaaactgatgcgtccaattatgtttgttaatatactcaactaatttaatataaattataatatatgttgt

SEQ ID NO: 9397 - DNA, 750 bp, Homo sapiens
atttaatctataaaattgagcttggagggggcactgggagcaatcttcctcctccttgaactgctggtggtcatttacaaatgctacaacattgaattgatgctcttctacaggcagcactttggagctgatgaaactaatgatgacaacaaggaatatgatgcctatctctcttacacaaaagcggaccaagatactttagactgtgacaatcctgaagaagagcagttggctcttgaagcactgccagatggcctggacaaacactatggatataaactctttattccagaaagagacctgattccaagcgcaaatccaacttctaatgatgaagcttccccctaactaatttctttttgggagcccaaagaaaggaagaaaatgaagagtcacagccggcgacaccatgggaaaatatttttccactcttattgaacccacctaccttccttgcctcctgtctaacaagtgtataacggaaattacatatggacaacctccccatcaccaattgcaggggagttacttagaaaaatgacctatagacctccgactgttattagttcccgcgaacgttaatcgtcaagacacaacaagcacaggcctccccggcccctcccctctctgacctgaccctacctcgaccacacagcctttaagccactcctaacaaaaccccgaacggcattcctgacccctcccgaacctcccacccagcaccaccgcgcctagcaccccaccgccagg

SEQ ID NO: 9398 - DNA, 754 bp, Homo sapiens
  misc_feature (1)...(754): n = A,T,C or G
ctggaagttaaagcaaccatgagcaaagctgtangaaactgcgtgtggggggaacaggacaagatctaaaacttcacaccgagtgtcatgtggcaggatggggaagcacaaaaagagactcatgcaaagttttgaaaacaccttgagagaagtgaacaaacatcactatgatggaccaaaaaacatgcaatgatgcggggcggtataatttcaagctggttgttgaaaactgcatgatctgtgctagggggagaaaaggggaagatgcggggaggcttccaagatggccaaataggaccaggtgcaggctgcacgtcccacggagatcaatgaggaagacaagggatttgtgcatttccaactccgatgtctgggaaaaaattatcgggaggaaatgagagaacctccccattcaaaaaccctacatgggtgctacttaggcgttggacagaaaaaccctctgccctcgggcctttaaatgcaaaaaaccgggggggtgactgcactccctggagcctggacaaaggggccggggggtctttgggggtgactacgaccccgggaacacccgcacgccccctacggctagttagaaaacaggggcctttccagcgctcgcccccggcgcgccaaaggggccttaaaactttacgctccccctaacggccgaagtcgccaccgttcggctgttcttattgacctaaaggggggcgtaatcggaacccgaaacctttcccgcccacaggggggccgg

SEQ ID NO: 9399 - DNA, 815 bp, Homo sapiens
  misc_feature (1)...(815): n = A,T,C or G
ggattaagcttgatgatcacaaactcaccctcctgggggcgggggatatcttacacctttctgggggtggagactggcatatcggttacgttctactctatgggcctcgcaaaggggaaataatgggaacaggatagcgaacactaatcttcattctaggatatatgcttacatgcgaaaataactctcatggggggagcattcctatagtccagagctttagacgaagacacacaggcggggtcatgtcgcacctcatttggaacacaacaggacagaagcggaccacgtcttgccccaacctaaacaattacagcccacacaagattatcctttcggattgggctgggcctatataaagcgcggcagaaaaaccttcctaaaaaccttattttgttcttcccttacgccaaaaaaggtcacaacgtgaaagagcctttagacgcatggcgcttctggtgccattcgttcctggctactctttagccgcccaacatcctccgattcagatggtctacgtggacaccgaagtagcctattactcgggccgccccgttcgccgcgtcgaacccgcctcttgcttgtggacccggcacccttttgccgctattctaacaaagaccgttagagcggggaggggcgtgacagcggccnacgcgggctgttccctcgtggagagcctccagagttgccggagcgggccattggcagagccggccacggcgccagcggacgagccccgcccaacgccaccgccgcggtcgccctccacggaagggaggaaccgaccgcaggggccgcggtctctcacgttg

SEQ ID NO: 9400 - DNA, 1912 bp, Homo sapiens
  misc_feature (1)...(1912): n = A,T,C or G
aggggaaananaggnaggagagagangagngaggngnggaanagggggggagngggagggannggggggaaanggaggagggggagggnnacganaggngaatgagnnggaggagannangnaagangagggganagagagaaggngtgnagaagagagnnannnannnnaagagagagnagagagagaagagnnnnnttttaagantnnnanagangnanaggananacaaagatagagagaaaaaagaaanagnnaananaagagtgagagaaaatgnagatagagnggagagagtgnttcngacgggaggnggaagaggagnnggagagagagaggggcagagagaanagaagagngaganaagcgtacagtagagagcacgacngagcgcgacgacaggactgcagagcagagaagcgcagcgcggagngagcagcagacgagcgcagcgcgactatcgacacnatagacacaatgaanttaatagcgaagacagacaaacnagagactancanaanacgacgcaacancaancagaaagagaggagagcgacagaacagagnacngacagngagagacgacagcaaganangaaacgacctcnaataagcagaagaggaggcaggaaggaacagagagngaggaggcgcagncgtagtanaantgnagagaggagcgacanggacaggaaancagcgcggcggnggcaccgacacgacnccgcgacgcgagtactccactcgcgcacacgaacgacgcacacanacgcacgagacgcgagcacngcgacggacgcgcagaccagcgcagaagctcgaagcaggccgacgcgactagangcgacgacacagagctcgcagcacgacgcgcancgncgcgcggctcagcacacacgacacaacgcacgcacgcactcacagcgcacgcagcacgacgncncagcgcaagcacgcagccgcgagcgcgcncgcgcgcgagcgcacgcagcacgcaccgcacgcgcgcgcacactcgcgctctcagtcgacgcgcgacgcgcgcacgccgactaggcgcacgccaccacagctacgagcaggcgcacgccgacgcgaacgctacgacgcgccngtaacagcgctcancgacacgcacacagacancggagcgaatacaaacacacacaccagtgcgcnacgcgcnacgcggcacggatcacgtcacacgccgngaggacgcgagnggcgnngcnccgcagcgagcgcgcgagacgcagcgcagctgaangacgagcgcngaacaacgagcagcgagaggagccgtctgacgcgcgcgcnacacacgatgcgcacgcccgacatcgaagcgccacgacagcacgcacacncgngagcagcacgcacgcgacgacgcgcgatccgnacgcgcgcacgaagncgacgacacacgacgacattcgacgacgagagcgacncagcgctctacctcgagcnacgtcntgcgagcgcgcnacgccagctacagctanacacgcgcgcgcaanaccgnacgcncacnanaccgacgacgcgcgacnagcgcgagcgcggccgncacgcctgncgcgacgcgncacgcatcgcgagcncnatcactgcgcagacangcacagcggcaccagcacacagcgtacagtcagcagcatcgcagacgtgcncccagaccncgaccgcgcgcctgnctgcgacgacgngnacgacgtacaggccngaacgtnancgacagcgagcagagcgaaagacgngtgcnangtaggcgnagngcgacacgngctaagagagaagggacagcgccnnacgcngagancgcagcgcncggcnangaatgacngcgacgaccgcngcnacgccggnacnacgtngntcgatgacnacgcgagcgcgcagcacg

SEQ ID NO: 9401 - DNA, 750 bp, Homo sapiens
  misc_feature (1)...(750): n = A,T,C or G
tacgctgtgtctgggcgttgaaaaagggcaatatcagcggtgcggaaatcccggcgagaatagagataaccacaaaaattccgctccagtgccatgtatcgagtactttcgccagcgggcaaccagaaagcgacgccctcagataagcaaacaagccgacaaaccccgtcgtcagccctgccgtctatttggggggggactttgccgccgccataccgattaacatctgtgggccaaagacagatataccgacggtgaagaagcaggctgcctgcgtcaccatactggcatatggaataatccacagggatgcctactgatagcgaaagtactgagggcaaaattaaattcatcggccctcggatgccgttaaacaataagttcgaagcccaaccggattctagagcaccgatagattctgccaggtgaaacatccgacactggccgattagtcgtgaccagagcggttgattttactaaggcaatatctttaaggattgtgggggtcctgaaaccttgaaccgagtggcttttaatttaacaaaacaccccaaatggggtattgatttcttcttaaatgaaattaaactccaatgctttaagcctttttaaaactggggtactggatacttgttaattttaacctgggaagaaggttgacttttttaaaaaacaagaggcctggtaatggtttttaaaaaaaaccaaaantggggaaggcttgtaattctttaaatggaagtccagaag

SEQ ID NO: 9402 - DNA, 785 bp, Homo sapiens
  misc_feature (1)...(785): n = A,T,C or G
aatgtacatccaaacacaacacttactgtctncataantttggggagggggggggtctataaacattctctatatncccaagagttatattataatttttcatccaaaacaaaatgttcaaaaaccccagaggagccttcaaggctgtggtgacatcctccaccattcaaagcaaacttatccaaaaataaaatcaccggggggggggcaacctcaaaatttaactctaaaaaatccttaaaaccagctggccgttctcttttaaattgtccaatggccaaaaccgggagccacttcctattaaatcttcctctaccaaaacatcatatatcactttacacggatcctttccatctcgaaccaacgaaccgccacatcctacaaaaacctccgcatctcattcgttaattataacacctagagacccccacaaatttattccttcgaaaactccttaaactaacatcccgcacaccgattgttgcgagttggcgaggacagatattatacttccacccccaaggtttaattgaacggggaatttaaaaaaccctttttttactccaaacccaagccttgataaacctcaggtgttgctctgtccacaaaccttgcccaacagacgtccgaaacagtactcccactctaactcctgacgaaatacacgcctacacgaaagatacagaagagggacaagactctgcaagtgagtagcaaagaagcaaactccacgacatcgaacccatagagtacacctcacaccccactcccccacgcttgtacaa

SEQ ID NO: 9403 - DNA, 1141 bp, Homo sapiens
  misc_feature (1)...(1141): n = A,T,C or G
aaaaaannggatgataggnganannattgannnnnnnnnnnnannnnannnnannttttttnnnnnnnnnnnannnannattcaatttttttannncanattaataagcacacnatacaggtanatattggataannaatatcgataataatttttttanacgagatgaatacaaataaagcgatcagggtaaaaagcaggaagaagcgaaagaacaaaccatatcgcaacactgaccgctaatcaagcagccgcggacgcggccagggagcgacgcgtgggaacaggagagagcgcggggcacgccaccgagaagagacaacaaaaanaccccagagtgatactcgcgccccctccgagcaatcccatctaccgtagagcatcaaaagggccggccagccgggcacgggcgccccggtcgtgcgcacgacgaaaaagagcgtgcgtggtgaaagacggagtgggcacagggggcagccaggtagcaacgcacaacagtctaccaaccagctcttgccacccgcctcgacactcccagctanattatatctgtagttctgcgagtaacagcgcacaagcagtgccgggcggcgcgcccgcgccgcgcgcggcgccctgcgggtacgtatcgcgtatgttcccgcgaccataaaagagacggaaggtagacggacaagcgcgcgggccgcaggagagtgggcaaggagcgcgacgcggcgagcgcgagcgcgtgagtacagtgagcagggagcaggcgcaggtgggaagcgtcgtgtacgtggactcgagcgagagtaaagaatgcgcagcaccgccgaggcagaccgagagctggcgatgcgcccacaacaggttggccggcgcagagcgagacgcgcggggagtagagagagcgcggctagcgcgggccagccggcgcccgcgagagggcgacaagccgcgcaacacttcgacgactctgccagtgcgaggcgcctcagatcagagctaggcgccgcgagcggcgctgtagtccaggtgcggggcgggagatcgaaggatgaccaaagtatggtccgccccgcgtgcacgcgtaacacgcgacgaggagactccacacacatcaaaaccatgcgganaccaaagagtctgcggtaccccg

SEQ ID NO: 9404 - DNA, 582 bp, Homo sapiens
  misc_feature (1)...(582): n = A,T,C or G
gggcgcgaagatcacgtagtgcggattccaaacagaggtgcccgggcccccggcgatcgcaaccatgtaactctaacgcgcccgccaattatgtgcagatctctcatgcgtccttgggctgaagccgccaccccccagcctgctctcacgcctacggtcaagcgtgatttgcccagtaggcccgtatacttggcgagatcggagtantcaaacgagatcagactgcccggtaagtcgatggcccgcgcccgggcattcagagacgaggcgcgccatacgcctctgaaccacgaaggagcgccccctcgcgaccccgcccctcccagcgtaggcacattataagaaagcccaatccgaatttacctccgccacgcggccgagtggcagctccgcactagacgtgaagagagacaccagaccgtggcacacgcggcntcggcggggggatttacgaagtcccacgccgaccacacaaccgcgcccacagcagcgccccacgcatcggggctatccagcgagtggcccaaacgagactacaccagaagagggggaagacagtcacacacacgaccaacggaagga

SEQ ID NO: 9405 - DNA, 1244 bp, Homo sapiens
  misc_feature (1)...(1244): n = A,T,C or G
gccgcggaaggcggggaggggaccaacaaaaaaaaaaggaggctctttggggtgacacaccccccacagctcctcgagggaaaaaccagagacncanaggggcgcaaaggaaggcgaagagagcccgaaaacgcccacagcaccaccgccgcangcacgcacgagccagcccacagacgacgcaagcgagaaaggatcaagaccccgagcagaccgcacgcagcaaaagagaggcgcagcgggggcgggcagcaagcaacggagcgggcagacgcgagcgaagcacagcggcggcaagcggcgagaagcccacgagaaggaatctttaaagagggagagaaagagagcgaggagaaaaccggaggaaggggcacagcaagggaggcccgggacgcgaagggcgcggggagaaccgcgggagccagngcgccgacaccgagacgagaagaccgcacgagagcggacagacgcgaggaaacagagcacaagcaagagcccgtgacgaaaaagacgcaccggagacagaaagaaacgcgaaacagcagcaagagggaagaggcgccgggagacgacggcgaacggggcgcgaaacagacacacagcgaccgaggcagcaacagcgcagcgacgcgccagcgacaaatgcgcacacaagccgacgacggggcacaccgaaacgctaccccgaagagancgacagagagcnacaacgtcggagaacagacgacgacagagaggggagagacgagagcgggagacggcgccggcgtggcccggaggaaagcagcacacgacgcaacgacggggcacagcgacgcgcgaggaagcggaggcaagcaagacaacaacagcacgacaggntaagaacacgccgacagtaaatacggcgagaaggagacgggcgagcccgcacgacagagagagagagagagaaccggcacgacaagacaggcgagaacacgagaggaacggacacaagacgacacgccagcagagaggagcagagactgagnagcgcgagaacggcgggctacacgcagacacaagggatgaagcggcaacagcgaacgagagcgacagagaggaganaccgcacgaccacgcgagacacgcagagacgcgacacaacacacagcaagacacagacgagacgaacacagccacacataanaggcgagagagcgacacgacacgagaaatggaggaccagagagatgccacaacacacccgcacagacacgaag

SEQ ID NO: 9406 - DNA, 772 bp, Homo sapiens
aagcttaccagaaacatggatgagctcccccaagaggaacatgtctgaccccccgtacgatcagtgcgtgggagaacggcggggggtatggccgggggggcaagcaagagcgggggcttggggggcgcaccactggggtccctgtcacgccacgattcttggagcctgtcgcctcggcgcaagctaacactgcagcttacgtcgtttccgccggtgtgggggatgaagacgcaggggtcggggccagacagggcctgatccgcggaagcgacaagcgcgtggcagggggcggctttcgccccgctgaactagcggacagacgttatagccccggcagtcggggatcggggtgtggagatagccgcggaggacgcgtcccagtggagccgagggacgtgtgagaggcgagggccgcggcattaccacggtggacgcgcgcagtacgccatagttaccaggtagggtggactaacagtagggtgaaatttattgggcggccgtcggtcgcggaccgggtgttgggggggtagggatcgctgttggttttctaattctgtagcattctgcttgggggcgagtgagtgaagggtgtacgggaccggagctggcggggaagtggcggagcgcgagacgtcgcgtcctatgggcgcgtggatgcggagaattcgtgtatggagggagtggattgcgcgtgagagagaacctctagaccgcgacgtgtatccacttaagtacgacattattcgctttcgagcatgtttctcgggggcgg

SEQ ID NO: 9407 - DNA, 591 bp, Homo sapiens
  misc_feature (1)...(591): n = A,T,C or G
aagcctcttcacctcttttgaaattcagagttccaattctgctttcatgacctgaatggcttctgttggtggaaggagactacgtgctgagcataagtttggcaatgttttccatgaaaaactaagaaggccaactctcaccagactcctatcatcttgtcatattcatgtgatgacccaacttacccaaccctcaaaatgagggacacttggcaaccaagctctgctcctctgctgatgtgaatgtgttccgaaaattcaacatatgcctcctggaaaatctacactcaaggcccagtggaagaatgtacgatctgcttcctgaccttgagtggcttctgatataataagcatgggcaagaaatgcattggaatatagcttgtacatttgctggattgtgctgaagccaatctcagatgccatttcatcagaaaatgtttcagtatgtctcgctaagagattaggatttaaaaaaaaacanacacacaacactactatgcacctaaacaattaacaataatttaaaaatattttctaacattctgtcagtgttcacatttctgtgggggatcaataaatactgatgccgt

SEQ ID NO: 9408 - DNA, 217 bp, Homo sapiens
gccctatctctcactgctcactgggcatccagctatcaaattgagtaataacatggtgtttgattcagtgaatccttcaacgaagtttttatatggcagacacttggtctaaacatctggaggaatatgaaaaaccaaataaagcctgatctctgcccttgaagcaattataattctgttgattaaatgagacttaaataaatggaataaagtaaga

SEQ ID NO: 9409 - DNA, 880 bp, Homo sapiens
ctagggcgcacaggatgatcctcatgtatctttggctctcctttgatactgcttgattttgtgtctgccatatggagctcttctattacactggatgggagtgtgtgaaagcctttgtctccggaatatgatgatgactatagagtatatgctccgtctctacgaagcgtacccagcaggaccttgagatcatctctctgtgactccatctgggacatatatgtatagttggccttatttgctatttctgacagatcactatgatacggctacctgcacatcgacctctcagaagcacagatttaatcctatgaaggtagacactgttattctcctctatttatgcagcaaaagactacacttctgctttggagatacttcagaaaatgctgaaaagaagaaatactgaacctccatggaatattctctctaattatcaattattctactgagaagacacatgcatacgtatgtttattgcagcaatattcacaatagcacagacgtgaaactaacccatatgcccatcaatgatagactggataaagaaaatgtggcacagatacaccatggtatactatgcaggcatataaaagaatgagttcatgtcgtttgcaaagacatggatgaactgggaactatcattctaacccacttacacagggacagataatcaacactgcatgttctcactcataagtgagaagttgaacaggagaacatatggacacatcgagtgcaacatcccacactgaggcctgtagatgggtgttgggcaaagtggcaaaaacctttttacaatcctctccgcatgcaggccttaaacctggatgatgggttatcggtgggccaacatccttgcacattttaccttgtaaca

SEQ ID NO: 9410 - DNA, 1566 bp, Homo sapiens
  misc_feature (1)...(1566): n = A,T,C or G
aaaannntttnaaaannnnnnnnnnnnnnnnnnnnnnnnnnnnnggaaaaatnnnnttngnntnnnnnntnnnnnnannnnnnnnatgngnnnntnnnnnannaatatttttnnnnnnnnnnnnnnnnnnnnnnnatannattanncatttttannnacagnnnataagatatgattcgnaanangacacntaaannatagtacgtnaanataatatatantaatgatatactttttttnactacaagatgataatataataannaaancgtaataaantangaaccgtacagtagtactgacgcgnagccgtcgtgatctcgtcgccggctgatgtgtgaccacactggtcgcacacggcaggggcgctcgtctgacgacgctgcaacacggcgtgtcngtagtcactgaacagtatcgacgcnacgacaatctaacagaaggacatccatcngacactcaacgaagagtaanctattcgaatttaagtacatgtacacatctccaanacacnagacnnaacncaaagacaaataccantctacacacatatcatantaccacatatgcaaacaaaacaagaagtattactatagcgataaccgctgtcgaacactctacacgacacatccactctcggtgagttactccgctaccagtagtataacgacctggacacagcagccacgancacagtgacacacnctcacgtagccgccgcacccaagcagcatcctcccangcgctccgcagccgcagttacgatccacacctccctgcgctcagcgctcctctccctgcgcttgcgcttctctgcgcgtcctcatcacatagtctcgtccttatatcataattccacgcagccctctaagtaacgtatcgatgttagacatagaccaatcacattggtatcaagatatcnaatacacggcacatcactcgtcatagtattatctgtctaattcacagccacgataattgantctcatgtagagcgcatggagtatacagcagatataataagcgtcagctgtgagtacatcagatatagttnttgccacactacaataagcgtaatgtcaacaagacgatctattagaaatatcgtccatcgatccacgagaagntgacgatatctagcatgcgtcaccgacgccgcatcgaancgccgcttattcacagacaggtcgcatanataagacancttctacgctacctctcacgcgagtgtgcttagatagcagaggttgtgacgtatacaataatctctagcagnacgaatgcattaatgtcgtcccntacaccntcatgtacactctacgcgagactgctgcgagacactcacatgacagttgcncgcnacttatactacacgctcgacgcactcncgtacnatatctgtatgtctntatancgtgcgactganagagagagagacgtgnatgntgacgtcattcnatacgtcgcgatactgagtagtgagccgatgcatgccagtacgacgtgagagaaaggtgagtagacgtantacatgatatgttaatcacaaaactacagtgtatctat

SEQ ID NO: 9411 - DNA, 1618 bp, Homo sapiens
  misc_feature (1)...(1618): n = A,T,C or G
cgtatgcgtcggagataaccgattatctaaatgaagagtgtggtatagagatagtgacgagatgcgttcggtgcggagtaacatagaagagggcggcgccaacttttgcgcgcgagtggagagcnactcgagatcaagcaccatatagatgcgtgtttgcgtagggatgaggtcgggtgccgtgatatatatcggatatttagtaatctcgcttcacggctgcgttgcccaattccgtatctgccgcgtccaccgtataacgtgtggcgcgaggcgcgcgccgactaagatgtactcagatacgtggcacgctatcgacagcactcgcnagcgtgataacaggacacatacatactatttttgnagtgagacggctggtgacgggttagatgagtggtgatgagcgaagctgagtaatagtatatcagntacacgcactacaggttatatacacaacattntatgttcggaggatatatcgtgctcgctaattatacacgcacgccagtacggccaagtcacgtcntcacgtatcttgcgtcntgtacatgtactccacagataccaatcgcgtggtggatnagtatcatagcgccgttaagacagaacagatgagccttcgagagacaacacgcgcctcacaagagtattcatagtattatattgacactctcgctgcacgctgtgcgaccgtgttatgatagtcgagcgtctccgtgctgctcacgctattctccactgtattatcggtgnancttctagaagttcgccntgctgcgcgtcacacagaagatntgcgcnattgtgtctgcgctggcgagtgatgtgtancggaccggcatcaatcgtcgtgcgagcggcgantctaatactgtgatcgatcgctcaggagacgcgtgcagatgggngatacgcactgccgtcgacatacagcgacangnataattcaggggatatgtntcagatagtattagacgcggtataatgctgctatcagagatgatactgagangcggcgcgtgagcgagagcgaggcggagtaacacagaatanacgnatgtatncaganacaccgcgcagaccncattctacgcgagagcgacacactntccgtgattgncgacgagtcgagtgtagcgtgatagtgatcgtgactgnctagcatattgatcttcncgccgactgcagcacagtgcatcgcgcgagtaantgcgncgatatgcgatctcgcagcacgtatntagacaggtcctactaatgtgtattgtcntcctcctaggtatctgcgcctccactcgtctcgagtgtgtatgtcatgcgacaatatgcatcgacgcgagtgaaccaagaacgtggtaagatgtcatctancagcaacgcaccgcctacatccgcgatgctttatgacggtcgactagtcgtcacaacttcgtatcgcgatcgataatgctcaccgantatacgtagtttgtgacacgagcacatcgttacngtgaccccgcctgtgatggaaagcacgatgtgaggataggatagtatgtgttgtaatatctgtaggcgaagagagagatcgtagcaaatgatggtgtaatagtacacgacgtatancgaggtacaa

SEQ ID NO: 9412 - DNA, 359 bp, Homo sapiens
acagaaaatgacagaaaaacatttgctgcaaatgaagaagcttgctcagacagccattcatatccacaggagacatacccctgtggccacctgttgggattctgcgtgtccttcaaggcccagctgaaatgatacctcaccagaaggccattccaggcagtggagttcaaatgcccctcacctctggagtctggaattatccatcaggatggctctggaccacaggaaccgacgcttgctgaccattcccactgggcaggctttacgccgttaccatgggtgggccttcaaactttattcagacatgcatgggggccgagtcctggacctctctgaacctcaggggcccttagtggaaa

SEQ ID NO: 9413 - DNA, 850 bp, Homo sapiens
gcccaaagcaggatggagataaagatgcccagaagaaaccagggccggggtgggggaaactgtaagaagtcaggagggaattctttattagaaattgaagatcccgctgggcgtggtggctcatgcctgtaattccagcactttgggaggccgaggtggacagatcacctgaggtagaagttcgagaccagcctggccggggggggcaaaaccccatctgtactaaaaatacaaaaattagccgggcgtggtggcacgcacctgtaatcccagctactcaagaggctaaggcaggagaatcactggaacttgggagggggaggttgtaatgagccgagatggcgcccttgcactccagcctaggcgacaggagcggagactccttcttggaaggagagggaatttcaaaagaattgaactggacagaggaaagaggggggggatgagagctggggccaaggactttgaacaatctggccagatttcaaccccacctagaaagggaagactaattatgtctacctgagcctaaaaagaacccgagtaagaccgttcgcgccggttcccttagggagggatagttaagatcctcgtcgagcgtgatgggtgggggcgtccttcgattggggagccggatctacttgatgagggcggtttcgaggtttcgggatagtgggttgtccgaaaaaatcgtgggcacaggtcgccgaggtccgaactggtagggcgagggggtggtggtttctatggcgccgcgcctgtaaagaaaagatgaggttgtgttgagtggaaaccatcaggattaaaacgccggcgtgacctggagctcttggcgtgttgtgcggggggg

SEQ ID NO: 9414 - DNA, 859 bp, Homo sapiens
  misc_feature (1)...(859): n = A,T,C or G
ccccctcaagcacgccgccccgtcacgccccctcgcgacagggcgccacacccatcccccacccgtctcacgggtgtgtttcctcccactcgacggcagcccaacgaggcctacaacaacgcgcccccccgccgctcagccccaccaaactttcccccaccagttgaccgcatccctctgtggtgctacccccaaccaccgcacgttttttttgaaaggggttgagaaagagaaaggaaattttgtatgtaaaagtggggaagcggaagtcaaagtgattggtttaaaaaataaggttaaaaagttggaaagggaaaagtaggtttggaaaaggttatggttaatggggtgtggtgtgggtaataattttttagagatttttgaatgtaagggtaatgataaatattagaagaatggtgaggtgatnaatgagatgtattaaaaaaagtaaagtntgagaggtgtttggttaagagaaagggatttattttaaagagtgaatggttgttggagaatagtanaatnaattattgaatatttttgtgaattgggagataaagttttcccccccccccccatatttatttgatatctagctacccacagacgagcttattgtaagcatctcaagacgtgtttcgcagggataatgcgccccaacnaagaaggaagtaaagaatgttttcagatagttggtggaatttgaaagattggttttcccccccccagccccgaaagagcttatttttagaagggaaaaatgtagtgacagagatggttcttattctgagtaataaacaaagatgcggccgaactgctccgctgtttgcccccnccgccgccccgaccgccgcagccc

SEQ ID NO: 9415 - DNA, 757 bp, Homo sapiens
  misc_feature (1)...(757): n = A,T,C or G
attgatcgtcatactaaccttttagagtagcccaggattatgagtcaagcattctatggtgatcatcatcgaacagagttgagccaagcatgatcgatgatgtcgtacctcccgatcttagcgaacgtaaagtctccagtcagtgtgagtacattctgtagtctgacaacaacaaccaacctctctgcacgctgttgaccacagaagtgagtctggaatcaattggtcagcccagctcagtgccgtatcaacagatcagctcccaagtcgcaaacccatacttgtccggtaaaggtcacggtcatggagtatgtcccggcatgatcctcacagattctgattcccaggctcaccataacatctgagaagcatgcgacacgaatcagtggagcagtgagacccaagcttcagccgtctctggtcaaagaaagggtctattctcaggcgaacggttgcggcgcatagcacaatccaagattcaagagtagaattattgggatgcaaagttttgcatcgtccacaatactcactctgatctctcgccaaccaacgaccgcttattgtagcatctcagcatcttcttgcacagatagatgcgcccacaaccagcaggatgcaaagaatgctttccgagagtttgtacatcccgaagctaagatttttattctgcaggaatgacagaaccaacttctagtagacaaaagtgcagtgacagtggtggttcctttncagagcaataaagaaagttccggccagc

SEQ ID NO: 9416 - DNA, 224 bp, Homo sapiens
ccaggagtttaggaccagcctggcaacatagtgagactccagctaataatacaaaaattagcagggcatggtggtgagtgcctgtagtctcaactacttaaaaggctgaggtgggagaattgcttgagccctggagttcaaggctgcagtgaaccgtgattgcaccactctactccaacctgggagattttcaagagcaagaccctgtctcaaaaaaaaaaaaa

SEQ ID NO: 9417 - DNA, 701 bp, Homo sapiens
  misc_feature (1)...(701): n = A,T,C or G
catcgctgcagggggttcggaattaggtgcccgacaatctccgtgaaagttcacatttctcgggaaagggaaagtgaggttggtttttgtttgttcgatcaccttcgattgttaagtttggtttccggggaaagggaaacatttgtattggtaggggatttcaaattggaaggcaggggttagtaaataggcatattaaaacaaaccgttgggtgggggaacgtaaataattaaccatgtgtaagaaagggcgattcttcaaagactaaaggcagaaatccatttgccccagaaatttgatacggagtatataccaaaggaaatataaatcattctgttataaagatacatgtacccgtatgttcatcgcaggaacacttacaatagcagggacatggaataaacataaatgcccatcagtgatagactagataaagaaaatgtggtacatgcacatcatggaatactatgcagccattaaaagggaggagatcatgtcctctgcagggacatggatgaggttggaagccattatcctcagngaactaacgtagaaacagaaaaccaaacaccacatgttctcacttacaagtggtagctgaacaatgagaatgcatggatatatgggggggaacaacataccttgggacctgttgggagcatgggggagggagagcatcaggaangatacgctacgactg

SEQ ID NO: 9418 - DNA, 1522 bp, Homo sapiens
  misc_feature (1)...(1522): n = A,T,C or G
gcccccacccccccgttcgcgctgtcgcctcgtttttttatggagaggcggcagtatagcattatcaagacccaggcttggcacgtatcctacgtcgatgatattcatgtatgggcagcatactatgcaaagtactggtgacaaggcaatagtgatgtggcccagtatgcacacgtcagcactcaggtatattcntcgccacagttcgcacttagctcgtatcatcattgacattagactattgcagttacgtgcacaggatcaccatagtgtcgtcnacgatgcgcgtgtatgtcagtgtgtgtgtgtgcgtcgaggagagatatatnagtggatccgagttcacatacatagcatgaagatataggatgcacactgtagtcaaggtgtatnagcacagtctgtcgtagacgtaacaggcgcaagagagtagcttatgtgtgtcagcatgtgtcagtagatttgcgccgcgtgttgtctatagtgaccacgttgtgatagtgtcaccctttcatgtagaagatgcatagtgtctgaacacgcgctcgctatacttgtactgaaggcatgtgcgtggctcaagcaactatccagtggttacgcgatactattacatacgattgtaccacgtcgaccatgatgcagtctctcgcccagattattcatcagtcgagtttattgtcccatctgcgncgtcctcagtgtgcccaccatgaaatcacgtgtgttcccgtttatccccacataccgtcatatctacgcactcgagttcgccagcctcggtttccgaccccgactgtattcctcggcgttccccgtcgttgagtctttttacgacgcacccgttgctccatcccgtattcaccatnttatagtttattccgcgccgcgcgcgcgagtcgattgtacgacgtttcccgtcgtcgtgctgaccgcgtccacgaccgccgtagtatagcgcgccgtctgtctgtgtccgcntntccctgtcgactactgtcgtacgcctatgtgtgcggtgtgttatacacgcgcgtgccgctcgctgatgttgcgcacgatatcggacgncgcctatactcatacgcctgtcngccngntntatctnacgcttcgcgcgattcacaanagttatcacgcagcacgtnatacgaatatatactagnacgtgcacaccgatcttgctcgggaccgctgtgctcgcgtcttcgtcgtgtcattatgtgtctcatntgcgcgcntcgtatgcacgctcagtccgcgcgatgtcacgatctcgacgcacagatattcacgactgccncacgccactatctgtgtctcccacacgcacgtatgtctgctntatgtttgcgtcgcgtcatgcgagcactgtttgagtgntagtgagtgtgtgacgcgcgttgatcacatcttatatcctcatgtagcacttccatccgcgacacttcgtcgcntctntgtgattgcgcctcacgattcgctgtcgcaccgtgtgttatctagtcactgtatgttctcg

SEQ ID NO: 9419 - DNA, 241 bp, Homo sapiens
  misc_feature (1)...(241): n = A,T,C or G
ccactgtgcagatggagggcgggaagctggtggtgaatttcggggacggggggcgcagacctcananatcntnnntgacaagctggtggaggtctccaccatcggaggcgtgacctatgagcgcgtgagcaagagactggcctaagcagccaggcccggcccagggagctacaaacccaccaataaaactgatgttnggggggggagaaggggncaaaacccggggcccactcaaaaaaaa

SEQ ID NO: 9420 - DNA, 1109 bp, Homo sapiens
  misc_feature (1)...(1109): n = A,T,C or G
ttttnnnnntttnnnnnaaaaaattnnnntttaantaattngttncnnnnnnccncnnttttanttnnnanaatntttnnntnnnncnnnnttctttnttttnnnnctttnnttcatcctactaatnagagctttnatancagaanttanaatttctttttaactagatatgaaccgttatgatcaaacgctcagctcatcataagctagataggcgtgagagggatgaacacaggatataaattatatattttgatatgtttatactatgcgcgctagttgaccgcctcgtcttcagaataatccccacttctacttatatattaattatgaagaccctaaacaatatttcaccctcactgtctaaacttccgcacaccctttatagataccaggtcacattccaatgtacttccactcccgccttccatttcgtttttttgaatcctatttgtgtttaaaccgagatatttttattttcattttttgttttatctgtttttttatgtagtcttttacacctaccatggtttcaattattatcttttagttttgttcgtgactactctctagccttagttgcgctacgtgcgtattgtttccattaatagtatgttctaaacaagaagatcaccacagcctcagtagtgctacaacccatctctatcacataacaacaatcagtcatcgcagtacgagtaaagtctcgcttcaaccgtagtctcatcactgctagatgtgtttcgcacgcagcatgcgatgggcacaatcaatctagaatcatacaaggtaacagagcgaactactgacccacagaaacacaagcggactatttattcgttttaagtatcaactaccacagaacgattcaggctacacaatcttatcatcaacatatattaatctacattctgtcgcctactttactctcacgatagcgatagtcacggtggactgttatattagagatcgtatccgtgaatagttttctagatcgtgtctctatttaagcatgaaattgctagagtgctgttagtgttatgttaagtaggaggagtatgagaaaatatagtgagtacgaagtatgaagtcactaattatatgacttc

SEQ ID NO: 9421 - DNA, 818 bp, Homo sapiens
  misc_feature (1)...(818): n = A,T,C or G
ccctatgaagaaggttttattttatcatcgccattttacanaagagaaagggcggaaaaggaaattcaattatacactaactttaaggatcatcagtgcatctcactctcaggtcacagcctgtttcttctcacatgtgaccctggcccacccactgctgatcatttatccctgataatcctgtgttcacctgcatggaagccgcaganagcagctcanaggatctcanaaatggcatgggctctggaacagtaggaagacagggaggcatccaagagtgaagatgaaactgccttcacgaggaccggaagtggagggtggcaacaaaccatgtgtccagggacaaaactgctgaatctggacagactgcacagaacattgtttgagtgacatgaaaagaaaggcggtgagctgggcttcaatacaggaaactcagtcacagtccacgagtggccacaactatgttaagaggccaatatctatctctagatgcctgagttccaaaggacttggggcttggtttaaaaaggtcaagaaaaattactgtgggagagtcactggacagcccagataatactgactttggcatagacacaggggnggggaaagagaaaaggatggaaaaagagaagaagtcctgtaagagaattgaagagccctgaggaataaagtgggcaacaccaaaaacccaaatggggaaactctagaaatgggttaagtgatcagcaaccggtttgataacccccaagttctaacacagggcctgcacaatcttatattaatcaattggtattagggccggagggctaacaaaataa

SEQ ID NO: 9422 - DNA, 844 bp, Homo sapiens
  misc_feature (1)...(844): n = A,T,C or G
cttaatgaaggcaccaacttaaaccattacctgatactactgcgatactggacttataatcataatcctcactcaaacttantcaaaacananaaccttattccaaactttacctatacaaaattatataaccctccaataaaacttatattcctcctccattttaccatataattaaccattattctcatnttccaaacaccgggcgtaaatacatttccaaaattaaacaaaaaacatatcccattccatcattngtaaatatttccatctacaatctccttatttattctcacacaanaaccttcttaccctactaaccttcacttcacttatcatataaaaacccaattcccttcatcaaataaattataaactcttctactaaccttcaatatcactcctntccttatctcttaacaattcacatacatcaacttttttatccaaactaaanttcctnaaccccntctacttaatnacttatacaattatttatttttccatcactcccacnnaaaccccatnactttcattaatccaaaacaaataaattcttcctacttccttattcacctttttttttttattttccttccacacattttataaatccttcctaacttcctaaaaaaattaaaaaattaaactttttctacctactaaccaanaatcctctttcctaaatctttaaaaaactttctcttcctataaaaatttcatcccatttattcttaaaaaccccacctcttttttaaacccttatttnnaattttttttcttttacatactttcccaaattnttctaaatttctaaaaaaactaatcattttctcttctcctt

SEQ ID NO: 9423 - DNA, 1304 bp, Homo sapiens
  misc_feature (1)...(1304): n = A,T,C or G
aaaaggggggaannnntggnnnnnntaggannanaaggaggaatggaagagangattattagagattgtgcatannngnagtgatgagttannnnnaaannnanannnatcgantaataggtttantatagatataaagagaagagagagaagtagaagggnanaaaatgatagaatgagagtattttgacggggaagagaagaaaatgtagagaaaaaaataccacatcacaacaccgacacgtacacatactagcgcggaccgaagcgacgacgtgagcgcactcatcacgttantccnccggcagcagagcacagagcagacacgaacgcggtgacgaggaacaagatagagacaacgcataacaacatcatagaaangannagaatcancgagntacattacagaaaagtagatgtatcgaagaagacggcgcgaaacaacgcgcaggcgcgcggcggcaagctccagtcacagcactgcctgcgagccgactgaccgacctacctcgcgcacagacgcgccagccaattagtcgcctataccttaccctcccccacacacccaccccacctcctcaccccgtaacttcatctcgtctccaccgcaataccgtcccccacatcggcacgcagaggatgcacgacatgcgcaccgacagacacaccgaacagtaagcgggcgtatgtgtcagcagacgggaaaagaaagagagacaccagaacagagagcagcgnacgacacaaacgataagtacgtacagtagacgcagcaggattcaaggngcggaaccagagaggagtgagagagcacacaggaagcatgagcgacagggagaggacgagagagagagaatcgcatacgacgctcagtcgcnacagaaacaacatgnagacagagtaggcaacgcgacgacacgggtcggagcggagctagcgacagcgacagcggtccacacgcagcacggacccgagcggacacgaagagaaagacggcgaccgcggaggcggagacagcgagaacgagagtancggcgtaacgcacgagcaatgtcgtagacctagaccagcaacagcaatactctcgtccgcagctgcggagcccaccacgaggagagcgtagtcatacgcgtacgcgcgcgcacgtcgtccncatgacgcgagccatgcccggaggacagcaacacaacataaccacactgttctcgcgggagctcgcagcacaccatctatggancagtncnactacgcaccgctcgactgacgcagccacggaacgcagaaagtattaacgtagaccacat

SEQ ID NO: 9424 - DNA, 802 bp, Homo sapiens
aagggatatctctctacagctatcacagctgaggatatactggggggcaggggaggccagcacttctcttattctcacccaagcctttcagcaagtacttcctgggtaccacggctgattattcaatacccaagggcttttaatgcatcagatgatgaattctgccaggactgggttcttcccttcaaagctgcatattccgggggcggggtggcttttttaaaaaattcatacaaaaaaatactcctaaaatgggggactcgcaattctggccatgtactaacctcactgagctgagcgtattcatccaagtacaagacatggcgcctccttattcttccttcatgccctccacaagcaaaaaaaaaagacgttccccgaagccgggcgctgacacgtgctgggggtaggggggaggaaaaaacaagagactctgagacaccctgaggtgggtttaaatgagaaagcggggctcgcgacttggggcatggcgacaactaaacaagagaggagggaacgggactgaaactcacgtgctatatggcccaagctggggttgaaacgttatctactagccccagggacttttagagcaatgggggagggaatctcgggaactaaattaggctgcttgggggggacgatcgggcgtgacccgtggggggatatgttcgggttgggaactgggcgaagtggaggggaggtggagtgggcggggtgagggagccagagggaaggagagcgggggggttgggggtgaccgcgaggcactaggtgacggtgcgaacggggagaaggggag

SEQ ID NO: 9425 - DNA, 1180 bp, Homo sapiens
  misc_feature (1)...(1180): n = A,T,C or G
atttaaaaaaannannnnnnggnnnaagaaaaatggaaatagtgagnntnnnnanttgngttannnaaaaattaannnnnnaatnnatattttttatttaattgtaattagtctgngagaagaagaaggatanaaaattaagagaaaatttttaaatagttaggagacaaggatagggaaaaagggagagggagtcccatttaacttaagtaatccccggacctaaaagttaaaaacaagcacaagttaagagaaaatagagcatagaaaacgaacgtcgctctgaaggaggaatccagccaagaatagaagaatgaggagaaaatgaancaggaatagatattnttaactgagacagcccgattgtgtgggcggacggccgcgaacacctgacccagtcatgaccgactggtagacattcactagatagatcaaatagcccacaccacgctaggtcgtcatcgtttaatacacctctacatctttctgccattaccttctacgccgtccgctaggatcgcgccatgatctcgcctgatgtgtatataatcggaacacagacatgcacgagtctctacagtacgagacaagaacagatagcgaagaacacacgcacatagcgtacggtacagtgcatcagactggagtagcgagagaggcaaatattatgattagaagtggtacatgacgtaacggagataagatatcatagtaagagtaacggcgcggagtaccagattgaagacatcggatacagatcaggtgngatataagtagtagcgcacggaccgacgaattatggctacagcaacctcgcacaccgncgctaataccgagaacacgaacgaatatagaatcacgaacgcgatgatgacgaacagtgtatcgacaatgtatagaagtaaggcgatgagtggagaattacgggagtctganagagtagctgagcaccatgtacgtgatgagacgcattatatgtacgagaccactattatctatcgacactatcttactccgctctcatactgacgancgacacagatatctcgcganatcaagtantcgtcagtctgtgttatgtgctggacattctcgactgaagacgtgaacgtncggccgagtctaacacactgttctgacgtcatctcatctaactaatctaccnacantacgacacgca

SEQ ID NO: 9426 - DNA, 379 bp, Homo sapiens
aattagctcccaaaaactaaaataattatttcccccattaatactttccccaacttttttaccattcctcaaacttcgaatcaccccctccccattatattaagctcattcaacctccctcccaacaataaaacaattaccttatcccccattttatcaaaaaaacgttaatttcttctctccctcaatcttttaaaaaaataagttgccccacttttttacctacattttttgtcacactttatatttttttcctacttccatcctaaaattcctttttcaatagttaatcccaacccatatttttaaaatttaatccaacaccaattatttttccccccacattatacaaaaccaccccatttctcacttttaactg

SEQ ID NO: 9427 - DNA, 1564 bp, Homo sapiens
  misc_feature (1)...(1564): n = A,T,C or G
ttgatgggtannnnaanagatattggnnnnnnnaattaataggngtatangtattgtgggagatggagtttngnatgagaggggntnattganatgtagtgtattatgtntaattntatggatgtatangttgatatagtgatnnaanaagaataaaanatgtactatataatatttacggtcttgtactatatacgtatgatgtatctattctaactacaagatgatttggtgtaggcatgtgtgtatgatantgagtatgagctntgagatgtatcatattatatttatagatcagtgatatctgatgtgtatatacacgccatnggtaatntgatgcgnaanaacagttgtcgcactcgcacagacgcagcacgagtcgcncgtcgcgtctggcaccactgtacgagagaggcggatgagcacagtgcgacacatatactctatagcgtntatgntntgtagtattcatttncttcagaagcggagagacgtctantgcgagtaaacgcagagcgatgctaatgattcactacatntcatctgagtcgtatacttncatgtnttattaagttnaagctctaccataattaatgcgcatattaatatgtttctactacgtatattcatcatcgactgaaagtggacgtctgctagcatataacacatgagcactaagaagtacgcattatgccggatcacatcatccaaatcaccaaaantacatcactcgcgaagacggtcnacacgcnatctcacgactcgtatctactgcgtcaccgcagcgctgcctcggacgagcggacttccgcantatgncgcgacacacaagagccaagtaagaccgagtcattggagcgccagcgggaggaggagcgcgcggggtgcggtgatcgtatggccgcgcgctatcatgcagactgcgccagcgtcgtgtgtcncacgacagacgatggattcacttntcagacgtcgttgtacttacatgtctgagtcgttgctatatagtacacgatcagcgttatacggtacatcatctggatgatctatgccctgattcgcctcgcantacagagctgtagtgtaatctctgacgaggacgggtcatgatntacggacgacgatgtggtgcgcgtcctagcgagacgtgtatgacgacgtcgcgagcaagacgagtcgtgcgtgttctgtcgcagcaaccgagcntagcgcggcgccgtgtatcgcacgacgccgtgcaatntgtatgccgtgctttcaggcggaccgacggcggtgtgacacactccggagcaggtctggctcaagcggcgcggcgcacgtgccacgcccgtatatcgccgctgtagtgacacactcagtgtcggcgaagtgatgaaccgtcgaaggacgcgagtatggactaatgatgtgaagagtggnacgtcgatgagtgtgagaagttatcgatagatctgttcccgttcggtcgctgattaatgaaggagaggtgtagtatgagacggagtgagcgatgctgggattggagcgagcataaggtgatgggcgagagactaagtagcgt

SEQ ID NO: 9428 - DNA, 995 bp, Homo sapiens
  misc_feature (1)...(995): n = A,T,C or G
cgaggaagacggggagcggccgggcctctccacaggaaaagaaagaagctaggagggcgaaaaaaattaaagggggcgaccacgcaacagaagaagaaacgggggggagtgctggccacggaacggcgcaccggccccccaggcaaagaaaagaacaaaataaagtaaacaaagacaaaantnnaggtaagggggccggcgcccgtcgcgcgcgtcngcgtagaagaacagaatggaagatagacaaacgagggcgacaaagaacaacgatacaaagagcgcaggagagttgacntnaggttaaatacaaaagagaaaggaggcagaagagaacgagagagagagcccgcggcgaagaagacggacgacgaaacaggggacggcnataggggaganagtggctagtggtatgaagagaggaggctggaggcgaacgagaggggggaggagaagtggttcttagaggactccaagggatggggaacacgccacacgcacacacaacgcccaagtcggcacccgcgcacgcgcaaaccaaagcatactagccgagggggtgacggcgcggatgtcagcacactgaagaagcagagccaaaacgagagtcgccttgtgctgggcgttgagagagagagaaagagtacgtaaacaggtgaaaaagctgtagggactagaaaaaacggcggccatagggagagatagtaaggtnttccaaggtttgatttagttaacacgacgcatcagagacagcacgagaacagacacagcgctcgagtgccgcgacagcctcagagagctcctcccaagacgagactaacggggtccctgacgcgaagcagagccaacaagcaagcgcaaacgatacgaactaagaagaagacccccggaagagaagaanacacgataagaggagcagaaggacgaaaacgcacacgaagaacagacggcccgaactaagaactatcatagtagagttaaagtgcncacatggtagg

SEQ ID NO: 9429 - DNA, 1156 bp, Homo sapiens
  misc_feature (1)...(1156): n = A,T,C or G
ccgcagcttcctccacccctactaacgatgccgggcgagggggggcctagagtgcgcagactctcttacctaaccaccgctacacgggtctccatgtgtctgacactagtcagtaacaagtaatgcaccgttaccggagcaaagcataggctacagtcggtatcgagtatggcggatagatcgaacatctcgagcacaagactcatcatgatactgcaatctcttattcgccacgcactcatcgacatatgcttcgccgtattcttagtgatagtaatcgaaactacccttatgagagcgcaaatcttcactacatgcgaattgaaagactgtgatttttttatgtaacttacacactggtcgtngaatcgcacatctcgcaacactagatggctgttgcactctacaatggaacagctacgctattgcccagtatctccagttagttgctctctgcatactcgagtcgcacggcagctagtacacactcgtccgacatcgccactagctggcgcagcatcgcccgatgggagtatatgatccccatggtctccccacttggcaccgtatgggaaatcgctttacgcgcacaccgatccatctctagccgagcacgtcccacctcgcccgaaacacctcaacacgcctatatactcttcccaacctctcccacccactctcacgaccatactgatactcttatacatcatgggcgcctcccacatcaatcaatactgtcgccctccctcaccgctcagcgcacatacctccactccgcagcgacaaattataaacgtacatattccgcaccattaatccagtacctgctcctccgacgccgcgcctacactcgacgccaccactcatgtagactcatccgaggctgatgttgagaggttgtctcagtacccccgtaatggttgggtgtcactcagccacaccacgtcgctccgccgacttcacttccctccttccggcatgcctgtgctagcacaacgctacatccttgctctccgaccccccgcgatctcttcnttttcttcaacctcctttcactcgtcatacactcacctccagcctttcttatgacggagggtcacgcatacggtcctgagtcggtcatacctgctacagacctgagtctctactccatatg

SEQ ID NO: 9430 - DNA, 557 bp, Homo sapiens
  misc_feature (1)...(557): n = A,T,C or G
tgttttccagtggtttgaggtcagagagacattgccatcaggctactaggagcctaaaaactcacgacaacccaaagaatttgcagaggtacttctgctgttgctgcttggtatcaatttatcaacattaaggtttctcactgcagaatcttacctttcaccaaaaagcctggacgtgagttcccaaatggtacgggttcacaccttcagatccagcaatcccactgctgagtttgtacccaaaagagaggatatcagtgtatcaaagagacctctgcactcccaggtttgctgcagcaagtattcacaacaaccaagatttggaagccacctaagtgtccatccacagaagaatggcaaagaaaatgtggtccctggggagggcnangcagggcaaatcacgaggcatggaagatcagacctttctggctacatggtgaaacccgtttttataaaagacagaaaatagccaggctgttgggcgcacctgtattccattattcgggaagctaaggcagagaattcttggactatgaggggagggtgcaggagcctag

SEQ ID NO: 9431 - DNA, 670 bp, Homo sapiens
  misc_feature (1)...(670): n = A,T,C or G
gtgggtaaatgatttacacttaaaaaggaaaaaaagnnaaagnnccttcnttggtaacaacacatacgggattgtatagtgatatcttcaagtgccagccttggaccaaaatagcatcctgctcttatgaaaaaagtggtatggactcagcagtgctaccacatctgtacttacctccagttacttactgaccactcattaagaagatgacgcttttggggctttgagttgatctagtctgtatgattctatcaggcctataaagcatcggctcaaatctcacccatgtcctgtgcaccagatgtggatcacaaaatgctattttctgaaatgttgcactctttattacgaaatgcaaaaacaaaagtaaagttattgctcgcagtgaacgtccactaacaggccatcagtgtaaatacttatagaaccatgtaatgcaaatagagaaacactgagggtcataaatcaatttattctcactactcaagggagataaaaatgcctgagtttgaataccctaacacaaataggtttataatttcaggttgctacggtaagactgtgtttttatagtatttacttatcacaaagcacgttgcaaatactttacacttttttaaggactggatttgataaagacccaatggcatgacaaccaaaaaaaaaaaaa

SEQ ID NO: 9432 - DNA, 1507 bp, Homo sapiens; identical to SEQ ID NO: 6266
  misc_feature (1)...(1507): n = A,T,C or G

SEQ ID NO: 9433 - DNA, 267 bp, Homo sapiens
ctcttttttcctatgggcaagtggtaaaccctattaattaacaatgccctggaacgttaccgtgtccactcggctggtccccttttagctcgtcgatcctgttcaaggcggcaaacgttcccccaggcagcgccccttcggggtggaccacacgggtgttaggggtcctggtactcccttgcacaagtcggcaccgcctgcccctcatcgcaggccagttggtttcactgagcgttctggccccgttcatccttccccaacggctat

SEQ ID NO: 9434 - DNA, 1003 bp, Homo sapiens
  misc_feature (1)...(1003): n = A,T,C or G
actccctctttcacagaacatccactcggcgttctcacggcgcagacttcgccattttctctcatatctcttcgagcttctacgtctcgggacctcccagtgagctcgccaacgtaccattatcctggtgctcagctcttccctactcacctccccagcacctggctgagtacatccccatagttcttccttctcctcgcattctccccctttctgcctagctagttgttccacatatctccgtgttgcgccaccatgcatatcataaccctcttgtcacctacaatcgctaggtgtgatttatctcccataccttcctaactcgggcgcctaggtaatcctgcctctctataagtcttatcgtataatgtcatataccttgtttctcaccccctccacattatcatcgcgctgagactgaaaggcgcatttcttcgtccattctcctccttttcatccccacctaggtccacggctcttcccccgtggaccaccgcccacatcattctttaattctattgtgcagtaacacgcgtctcgaaattcctatgtggatatgcgacacccagcgaccgaatgtgctcgcttattagtgtgggctcatgacccaagttgctgctagcgaaggagtgctgcctttatcgcccctatctctcaggctcacccgtcctgtccaatgccagacgggtattcttggatctcgcattcaaaaaaacgcggcgncgtttcgtctgtgtctggccgtctccctngctcgtgcttgttttctctttctcggtcttcttnggttggccgctgtcttccggcgtgtccggtcctggtctctcgggcccttgtcgccccttgcctgttcgtgcctctcttttgttcgctttcgtgccctcggaactgtcctgcggtgctattccagagatttttttggtcttgcggcncaaagcggtggagtagtntccctcaaantttctttcttcttccaatttttgttcgcttgtcccttcccacc

SEQ ID NO: 9435 - DNA, 877 bp, Homo sapiens
  misc_feature (1)...(877): n = A,T,C or G
gaagaaaaagaaggaaatcaaaaaanagggnncctggtgggacgacgaacagtttggagtgaactagttgccgctttttccgagggcatcatgtatgaggaaacaggtgagggagtagaatgtacacatcgctacgcattccagtgcttactgacccacatatacaagatgacccttttggggcttatagtacgtattacgctgttcattactataaagcctataaagcattggttcagagctgacccatgttctgcagaccggacgtggtccacaaaatgctattttttgagaatgttgaacaatttaaaacgaaatgcgcaaacgaaaatgaggtgatcgctcgctggaaacgtcccctaacaggtcgttattgtaaaatcttatacaaccattgactttaaatatagaatcactcaagcgtataaatcaatttattctgactactggagggagataaaaatgccagagattgaattccatacaacaaatgagattataagctacagttagctaagataaaaactggtggatatataggactctcatctgtcacaaaagcacgttgtgcanattgacttttacaggcttggttaattgccatggatgttagttaaatgactcactggacctcgacaaccttnaagaaagaaaagaagccggtgccttcttcagtactaagcccggagaatcctccttctggcgattaacctttgagagagaatgcaagattcctaaacttacgttcaactgagctactctacagatcagatattaccattaaacgagaactggattgatcgtcactgcacaaggcgaatgatcgctctgttccagtactactgagatcactcaggaaccatatgtgggacaaaag

SEQ ID NO: 9436 - DNA, 1120 bp, Homo sapiens; identical to SEQ ID NO: 6270
  misc_feature (1)...(1120): n = A,T,C or G

SEQ ID NO: 9437 - DNA, 845 bp, Homo sapiens
cttgctgtggtgctgggtctgcgcgctgcgtcctctgtctgtgctgctcgcgcctgtcgttccgtcggctctctcccctcgcgtgtcctgccgctggtctggcgtttgcctgtcggtgtggtgcgtgggcggcggtggcggtggcaccgcggacgtcgttccgttcgttatcgcgttcgcgtctctctctctttccgggcccgccgtcggtgggtccggtcttggtctgccgctgcttgttttctcttccgttcttttgtccccggtccgtctgtcctgcttgcccgtgtgcgttgcggtccgttctgccctcggtcttgccgcccccgcggtgtgttctcccgccctgcttctctagtgacccggggggctgccgctcggtctggtctgtcccttgggccccttcgccctgcttgtcttggtcgcggccttggtgttccctccctcctttcccccctgtgttttgtttctccgcccctcgctcttggggtgcggggccggcttccggccgctgcgtcgtcgtcttctcctgctttctgggcggccctgggtgtcccggtcttcggttcgccccccgcgttggcgtgggcccccctgggttgttcgctcatgtgcgcggtcccgggttgtgttttcccttcttggtccccaccagaaggcttctgcgggtgcccgcttgtgcggtccctgtcattttggggttttacctttcaggggtgggggagcgctcgtttctggtgtgtctgcccctggtctgtggcccttgcttgtcggtccccggcttttttgctccctgtgctcctcttaataccgtctgtttgcgtctcccaaaaaaaaaaaaaaaa

SEQ ID NO: 9438 - DNA, 859 bp, Homo sapiens
  misc_feature (1)...(859): n = A,T,C or G
tttgtcgtggtctcgtttctccttttctgttctcgcgtgtttggcgtgtgcggtttgtctgtgtgctgtggttcttgtgtctgtgtttgggttgttctcgtgccttcgggtttggtgttctggtgctccctctgtcgggtggtntcgtgtggctgggttggttgttgttggggcgggttcgtggctgtgctggggttctttgcttgcttccggcgtgttgggttgtgcttgggttcctctgtgtttcctttgcgtgtcccgcgtccgcggtcgttgctgtgcttccttggcctgggcttgtttggtgctgcgggtgtgtggggcgcctggtcgggtgtgcttctgtggctggtgggtctggccctcttcggctttggttttgctggtcggcgtgtgtctcggcgccccggggcggggttgcgcttctgtgtgtggtctgttggcttgggcggcgtttgcgttcctttggtcttggttttgctgggtggcgtgtgcgccgtgtggtttccgtcggcggttttgttgtgcgttgtgcggttcgcgccttttttttcggcctgttggcgcggctccgggtgccgtgtccttttcttgcctctgaaaaaagttgggcgctttgcctgtgtttgggttccgctggctccgctcggcttttttgtttccggggctgggtgtcgttctgtctgtgggtggtctttcnctttcccgccgccgttggttcttgcttttgggttttttttgggggttttgggttggttaaagtggnggtttnctnnnnnnnnggggnntgttccgcggccaangcggggggcgttacgaaaanttttctgagggctgggttgtttctctgctgctgtct

SEQ ID NO: 9439 - DNA, 1547 bp, Homo sapiens
  misc_feature (1)...(1547): n = A,T,C or G
aaatatgtaatatgtattacgtgcatgttaagtagagacagaaagagnaaaaaagagcctgcatatgggtaaccgngcncacaccgncagcgtgacaaggcgaaaactacacaggccataggtctcagtctagcgtaatcggagcagctcatgctccactgttggtatctatcggtggaggactcgaaacactctagaattgcactcccnttgggcagcgcatggacatgaatgcacggagtgagcatgctcgtngacgctcacgacattggcaggcagtngaaaacatacttggatgccatactggtacataacgagaagtagagtgcgctccactactgtcgacacctatataccngcactaagcagtcggttggacaagatgacatcatagggtgactcgctcttttgttctctaggccgaggaatngagtgcagcagcaccaatagtcgacaacttcgtgctcgcattctctcatacatacgagatgtagtgaaatcatcctctcacgtgtgcgatgtggccttatgaatgacaccattgggtagcctagagttacaacaagcacagctcagcctcagatggcagcgcccagtagtgagcgaaggacagtggcacaacgcttagttgccatgacggtagcactcgcaacgctaggcgcagagataatccacagatgacggcttcgtgatacgccttgagagngctactggcgcacaagagggtctcactatgcaagtctaatgacagtagcagccttcattcaggtgtgtagtggatcgtagctagtaggtacgtacgcctcactgatgtgagctgntgcgncgagtcnccagtcgncnagaacgaacgacggtgnctagcgctgactacgagagtatctgtgtgataaagagacacgctgtagagcgcgccgttgctgtcgcgcagcacagggtagtgctaanagccgtgccacaggcagcggtagctgtcggccagatcgcctagagatgcgtgtgtgtatactatttccaataagtctggctatgtgaactgcgtnttcgagagaatgacgcgtcgtgtggaggctgtacncgagagattgagtaggtagcnctgctgtcctagagtatagacagaccacatttgacgcatgcgtcgcagctgccagctacgtntagaccactacgcaccatcgagtacggtctcgacgcgtgtgagcgcgaagtnagcatactaggtcgctgtcagtgtccgtctcacagctcncgtgcncgntcgagtntctcgatccgtgactgatacgganggntgctgcactgattgagtcgtgctngaagatctctccataangttgagcagatgtcctgcactatagcacagaattggactgacnagtcatacatgtagagntgncgtagcgatagcntgcgtcagctttcatcacctatcngtgatcgacnatccgacagtgtcggcncacatgagtgacacgatgctntgtaggtcactcgcgtcgaacntgtccagtagaagtgtcgatactggtagctgatagtatgtg

SEQ ID NO: 9440 - DNA, 1246 bp, Homo sapiens; identical to SEQ ID NO: 6286
  misc_feature (1)...(1246): n = A,T,C or G

SEQ ID NO: 9441 - DNA, 330 bp, Homo sapiens
cctgggcatacgctgggagcactgttgaagcacagccttctttctacgggggttgctgagaaaagctgctggctgtcggtgggggaaacctgtctgagtaaatcccacacagaagaaagctgagccgagagatggagagacacgacgcctgcagacattgcttagatccagctgggcgcaaagccaggccagctcagacttttcaattacacgaacgaaccgcctttttgttttacacttatgtcaatttgaattggatttccatctcgtaaccaaaagtctgactaatataatcaaataccaacttaagtattggtaaaaaaaaaaaaa

SEQ ID NO: 9442 - DNA, 856 bp, Homo sapiens
aagtattacttaaccgacaagaagagaaaaaaaattgttaggcaacggcaacctcgctacaacgaacagccagcatatcattaggaatgagacctgtacatttttatctgttgagatcaaaccttgaagcccccttggaggctgcagaagcagaggatagccgtgcatacacttgagcgtgaaaaatggtcctctgtcattggagaggtcttgctatggacctaaaccgcctgagtggtgaaaagaagaagggacccctttgttgtgcaagattatccacacaatgcaaatcttgccctttccagctaggagtggaacatcctaatggtggctagatcacatgttctgctcacaccaccactgagcaaccttttccaagactgccacctatgcataggtcctgccctgtgcgagaccccataaagggggagctgaagtcctggccaagctgcattcaccgatcagagattatgtatgttgtgagtgagtgtctacccagaggatgtgggtcctttttaaagggtgcaccactgcattttgtctgatctggcactagctcgggacatggcaaccttaataccgggtagcgagggaggggtgtattgtctaactgtgcaagatcaaatcatttcgatagaacggactgtgacggttaagaggagatgataggtattacgctaatttaatgtgtagtgcgaagggtaacggggcttataatcccatggcagctaattgcttggggtctcaatatgccttcagagcgctatcgtcgcgattagatttggtgtcttgacaactagtagcataaggccatgtgtagtttgcgagcgtacgctcagtgcatctcaaaatagag

SEQ ID NO: 9443 - DNA, 1405 bp, Homo sapiens; identical to SEQ ID NO: 6291
  misc_feature (1)...(1405): n = A,T,C or G

SEQ ID NO: 9444 - DNA, 746 bp, Homo sapiens
ctcactcgcttatgatcctgtagggtctgactaacggactattccgttcaccgtctcaatcacccggtacacttccatgttccttgattcttttcagccctctatctcctgttccctggttatagaccgctcgcttgtgtgtcctattacgcgcgacctcaggcctgtacctatgtgcttttttactcactcgccgtcaccgatccaacacctcctcgtcgtctcctaaccccacctctttccgccgtcctcatcattcaatcttcactttttcatcctcacgctccttcttgaccacgtcctttttctacctgccccttggtgctcgctcgcggcccgtgcctctctccccgccacttcccctccctcctcgccctcggattctagtggtaccttgtgtccctccttttaatatcgccccctcctgtggagcagcttgatcttcacctcctctcttacgcgtctctatcccgccgcccccctattggactgtttttttcttatcatccccacacaagtctaatgaccccttgcgaaaaaaactcgtccgcatgcaacgtcaaatatttccagacggctccgcttgcatgttatgtttttcttccatacacgacctctcttctgcacaaaccgcacaattcatttctaagcgtcgataaaaggtctaagtcggtcatcacaaaaaaaataggcgtctgcccaacgggggtagttacaacattttttttccccttattgtaacctcc

SEQ ID NO: 9445 - DNA, 1570 bp, Homo sapiens
  misc_feature (1)...(1570): n = A,T,C or G
cctgcgctctttctgcctctcgtccctccccgccgcgccggcggttctgctctgtgtcgctgtgcggcgtccctgcctcgctcggatcgtcgtgctcgcnctgtagcgtcctcttgggcggtgctgcggggctggntcctgttttgctgtctctcgctctttccgggtctgtctcgtcgtgccgcgtgttcgctcgcgttatntgggcggtgctgttntccgtacgcgcgtggtcgtgcggagcggtgcgtggtcctcgggctcttgcgtgtctccgttggctcttcgtctctcgtcgngcggcgctgctccgcctcgtcncgtcctagcgcgctcgtacggctcngcgtcgtccgctcgcgtgcgtcggctgttcctatgcggtgtctgcgcgtcgttcttgttgtnntcgtcgcggctgatccggtggcgtcggtcttgtctgctccgttcggcttttcgcgctgcctctgtgctgtctggtcgctcgctcgtgtctgtnctctcgtctgtttcgacgttgtgtgtgtcggtgtgtgctgctgctcgtgggctcgccgctgtgcctacgctgctcttgctgtnttcgcgtcgtctgcggcttcgttgcctngtgtcgctggtcgccggtctgcgtgnccgcgtgccgctcgtccgtnttctctctgtagcgctcccgtcgtntgcgctcgcagtcggtgccgcgtacgcattgcgagctcggttgtcgtgtggtgttctgtccttgtgctgcgcgtcgccgcggtccttctgtgcgtctngcggactctctcggcttcgtatgtgtcttgcctggttgccgtgtgtgctgcgtgtgcgtgtgggtccacgcgctctctgcgccgtggtgtagttgtcgtctctgctncgtcgacgcctgctgtgcttctcgcctctgaggcgtcgccgtgcgctgcggctgtgttcgctggtggtgngtccgcttntgtcgtgcgtccgccgcgctctcgtcccntctcgagncctcgacctcgccgcgcgcgcgcgcngtcgtcgcgcgcgtcggctcggcggctctgccgtttggtcgtgtctgtcttctcgttgtgtgctgngcgctcgtcgttgctcgttgttgtggttggccggcggcggctgggctcgggtgcgtgtcgtcgcgctccgtnngtgcgctgtgtctgtcgntgttgtgctgctgctcgcgtgtgtcggtcgttgcctgtcggctctgcgctcggcgtgccctcgtgcttcgcgcggcttgttcgggcgtctgggtggtgtgtgttgctgcgcctgtgcntgcttgtcgtangcgggctgctgcggntctccgcngcgtcctctgctgctcnccctctccgnntgncgncgtcngcntctcgggttcttctctccccctgcncnncnnccaccgcncccnngncgtgccgnncgnctcggtccnntcccgtntctctcgcacgcgnctnngttcgctcgctgntctctacngcggcggtgtgtgcgctcgcgcctgtgtccgctgctcgcctgttnngggcgtgtttgtcttgacgcacgcgct

SEQ ID NO: 9446 - DNA, 164 bp, Homo sapiens
tccataaatattaaatgatttgtattttaagaaaatttattatagcccaaagatagagcctacaatatgaggtgcaatgaaagtaatctgtgccctcctcaaaatgatgtacctttgtgttaactacaattaaaagcactaatcttggtgaaaaaaaaagaaaa

SEQ ID NO: 9447 - DNA, 186 bp, Homo sapiens
aggacccggggaagaaccaagagaagacaagaactgaagttcttccattcccacctctgcatcaccttccctgctttctctttccccagaagagactcagtcaacatcccaaagaccaatgatttcattgttttacaccaaatatccctcctctaaatttttcaagaaattgggaataaacataga

SEQ ID NO: 9448 - DNA, 204 bp, Homo sapiens
cggtttgcccatttcagattttttataaatacagacatgcatgatataatggtgtctctgtcaaatatgcactgtatatacatctattttgccataataggagctaccctatataggtgtgccatattttagtcttttatgctgtatttttactgtactttttctgtgttaggtctgtttagatactgaatctgaatgctctca

SEQ ID NO: 9449 - DNA, 566 bp, Homo sapiens
ctacacaggacctctgctaagctgttgctgtgcatgctgtattgtttcttgacctgtatcctttcttaaatctaagtaaacctggtgctgggtgaatgcttttgcgtgctgtgagtttgttgatctcaacccaagatcagtgcagagcagatgctgcacttagatctgtgtgatctataagagacacattcaacaaaaaggcacagagtttgtaaattaaatgataccaaaaagaaagctagagtaacacttgtaatacctaaaaaaaaaggggcaaagaatgtcaaatcctggtgttaaaaggaacagagaaagaagagctacccattatgaacataagtataattatgcaaaatattaataacaactaataaaactgctgggagaagcaggtcaatcaacactgtagtaggagtcctgacaattcctctcaggaataaaatgaacccaaaaataaccagggtagtaatggtttgaataccttgataagcttaattatcagaaattaaagactctgatttaaatggggatgtttatttttccagcctccaccgttaaggactgac

SEQ ID NO: 9450 - DNA, 186 bp, Homo sapiens
aatgtatggaataagtatatgctaaatgaggtgttcgcgtgaccaattcaccacgagaagtggccacactaaaattgaaaggtgttaataattttggttagaactttcgatttaatataagtgttaaagtcaggccgcaatcttataaccacaagagactgaacatcggcacaaaggcccatatta

SEQ ID NO: 9451 - DNA, 671 bp, Homo sapiens
  misc_feature (1)...(671): n = A,T,C or G
ccctcaactattacagatagaagttaactcttcggaatcctgggactattcaggggcaaagatatgtcgcatacctggggtgtgaaaggctcctgatcgagaaggggactccctttatgcaccgtatgtagcattttgccaatctgaacacccacttgtaaaatatgctggatataatcaggtcaatcggcctctctattaggcgtcatgccaacatacatctcagggaataaaatgaacgctgaaacataaccatgggatagtaatgtgtttgaatacactcgataagcttaaatcatcatagatataaaacctctgtatttaaatggggaatgtatattttttccaagcatacacacgtttaagcacgtgaccatgtattaagacatgtgacaacttcggactcctaaagattaatatagacaatgctctcaactgctatgtaataaaggtaagaatgaagtgacaaaactctctacatttgaaaactaagcatatgattaaatgacattgtgctaattaggaaatcataaaggaaattaaaacatacatacaattgaaagataatgaaaatctgaagtacagctaaagcagtacttagcagaaatttatagccttttaattacagccttcaatataggagaaacaatgaaaancaaaaggtaccattc

SEQ ID NO: 9452 - DNA, 772 bp, Homo sapiens
acagaccaaatagacatagttcaaaaacaagggaacagcagccaagggcctggagccagggaagaaggggttgacacccagaagttgggccctggagttacacagaaaagtgcttccagcattccttcagtgctcatggagcccctgttgcctggatgcagtggtgaatgagatagaatgagacagatgctgtggctgccctcatgggcctgatatccacagagggatgacagctatgatgggggagccaggcaggtgaggggctgtgtgttcaaggctgtaggaatgcacaggtgaaaccccacctgaaggccaggtaaagtgcgcatgttgagtttggggaacagaaagcccatctcatggcagaaacagagcaaactgggagagacggattggactggagtcacagccagctcccagggaccattgcagggagcagaagcacaacatcccaacatgtcttcaattggttagaaaaccaggccgggcacggtgactcacgcctgtaatcccagcactttgggaggccgaggtgggcagatcatgaggtcaagagattgaagcctttctggccaacatggtgaaaccccttctctactaaaaatacaaaaatcagctgagcatggtggcgggcacctggattcccagctacttgggaggctgagacaggagaatcacttggaccccgggaggcaaagggttgaaatgaccttataacacaccactgggctccagccttggaacagagagactccgtttaaaaaaaaaaaaa

SEQ ID NO: 9453 - DNA, 426 bp, Homo sapiens
  misc_feature (1)...(426): n = A,T,C or G
gtctatgtggcactgactctctaaatcttcacggctaacgaaatgtcagnggnggagtatgaaaacggacgctcttaggctggtcaaaaaaactgaagtgtactggcaagaagaagactagaggctactgagtttctagaagtgctgtcagctcacaccttatatacgggcacttattgtttcatgcagaaagcaacaactactgagttgaacatggtcaacatggggaatccctcctagagacagacaaggctcaggaagacaaaatgttagacctggatgggagcctgacagtcacctaattgaacaccttcttttgggggaagaaaattgaagctcaagatgttatgtaacagagctaactaataacatatatataaatggatcagtgagaaaaactacatgatcatatcaactaaaagttga

SEQ ID NO: 9454 - DNA, 576 bp, Homo sapiens
agagtctctctatgtcgcccaagttggagtgcagtggcacgatctcggctcactgcaacctccagctcccatgttcaagccattctcctgcctcagcctccagagtagctacagctcagcatccagcttgcctgtggtaccagctgatccactgtgtggactcaggactcaggcagcaaggggtgtcttcacagctatgggtttgtatcagtggagacaaaaatgattccatcttggatgctaatctgccatgctgacttctgatcagccccagtctcatgaatgccccctggtttctacattagttcttgtcctttggtaaaaacaaagcacccttgatgtatcacacaaattataggctatgacacacatagcattcttggctggtctggaggatacctttggttgtcttgctggagcacgtatgcctcttcttatgggaggtagtcttgagtctagggagtcaccggcagagatctgctggttttggggtgaccaaaacacacttcatggtaaagtttttaataacaccgagccggcgtttcctttaagggggaaatcatgaccctctcactg

SEQ ID NO: 9455 - DNA, 225 bp, Homo sapiens
gttgtgagggtacacaccagggttttccccaaacaccatggtgtctaagggttttcaccacccatggtctgtgtataaaaagtaaggggtgctaaccgtttgcttttacccatcatcttccatccattgtgccatgtgccatttgttctgggaaatatgacatctctattgccctttgcctatgtcaaaaacccttacatctattcctgccaaaaaaaaaaaaaa

SEQ ID NO: 9456 - DNA, 1017 bp, Homo sapiens
  misc_feature (1)...(1017): n = A,T,C or G
gctcctaacactcntagtanntgtaagaacacagaccccacaccagcagccgacacaacacccgagcgttgaagaaaaagaaagagagaaagttttaaggaggggagaagagcgcgcacaagacgccacacaaaacgacaagaacaaaaagtttaaagccggcgggccgcggcccgcaacgagaggagaggaaagaagacgacacgcaccgacaatgcgcaaccacaccgaccccccgccgggagacacagcgccccaaacgacacaaacacaaaacagccccaaacaaaagaagggagaggagggaaaagaagagagagagatagggggagaaatnagaaagaaaaagagaaagaggtaagagaaaaagaggatgagtcaggcgggcagagggggcccgggaaagggaagtcgaaaagggagtacagcagcagaaagatgtaagaggacgccgggcagccgcggaagtgcagaaaggaggcatgttccaggccagatggagacgtgggagaagtccgcgcacacaggcgaaccccacgccagcaacacgaccacacgccgactacgcgacaagggcccacaggagaggcgcgacgagagagaaataaaatgaagagaaggatgaagaagaagagaaagaagagaaagagtaagtaggagaagaaaaaggaaagaacgaaaagaggtgagaaaggcgagcgaagatcgtagaggaagaggagtagagggagagcgaagtggaaggataacgaaacacgagattcaagagagtacgcgagagcaccgccgaaagcccgcgccacgcaagacgagggcgggcgagcaggagatcacgcggcgaggaaagcgggggggccccgcacggggaaagaatcgacccaccacaaaccagaaaacgcgcgtacgagaaggccacgggaagaggccccaaagccatgagaagcgaggatacgcagcctcacaacgcatacaccacagagaggagncaacggaggaagaaggaagaccagagagaag

SEQ ID NO: 9457 - DNA, 839 bp, Homo sapiens
cctacctggtacaaacgccctataattttattgactccgccttcgggatatataacagggggcgtatccagtgattgttctaggcattataagcctaccataactaaatggatgccgcacgctgtgcttttatcgcacaaggttgactcacattcccatgactcatgtctattagaccgcctctacgacatgcttcccatagggtggagaccacatatcggttctattcattgcagggcaatattgaacatctgttagcgttggttaagctgcccatggaatccgccctgaaagctaaagcacctcgaatgagtaccttgccaactagatgtctacagggggtgtctagtgactggtaccccttaaacaaatggagacgggctccactcacctttattggctgttcctttggaggacttcaaatatcctttgacctaatcttgatggagacacttctagtagaatcgtgagtgtttgctcccacgtatcagactgccaattgggtatcttttcttttagcgaattagatcttgagtggaccaagacattaaacctcccctcaaaaaaccacttttctttccttagattacacaggaccatgcactgggctatagacctatgccatagtccctggttacttttcctctcctttatatagcattgtttatttctacacagcaaggtaacatgttattaagaacactaacctttaaaaaggattgaacctctctcataccttgcataataatatttgggctggaataaaaaagggccctatatccaattttcccagcccgggcatttggttatagggcccttttctcttaaatccctacttt

SEQ ID NO: 9458 - DNA, 938 bp, Homo sapiens
aaccgcgcagtattttcaccacacacctccacatccacttaacccacgggcccccaaagtccaattcataaaacaccgtcccttaacaaccccctcccctgtatccccccctgtcaactttcccccctcacacttatcacattaggttcccttttaatcccttacctaccacactatagtttttttatatgacacccccttctaaataaatacccatttcaaactgccaataaagatagcttttagaggaaggggcctatacaaatgtccagatgtttttcttaagtcaacggttcaccttattactccccatattttcttttccttgtattaaagcttttccacctttctaaaatcaagattccttaatactgggacctccctttttaggatataaccttctaagccatgacagagtagacacaccctgggcccaaagcattgttttcgttcaaaaagccttctccgacaaaatttttaaaaaaaaaagggcagagatgtgaaagccaaatattttggtcccccagaatcataaagctaaaaagaaaattcaagctgggaactgttagggcaagcctgcctcccattttattcacagtcatccctcttttgagataaatgcatatctgattgcctcctttggaaaggctaataagaaactcaaaagaatgcaaccatttgtctgttacctacctgtgacctgcccgcccctgtctgcttcaagttgtcctgcttttgcttcaagttgttatagctttttggacagaaccaatgctcattttacctatgttaattgatgtctcatatctccctaaaatgtataaacccaagctgtgttttgaccacttcccgcagctgtcatcaggacctcctgaggctgtgtcatgggtatgcgtccactaaccttggctcaaataaagtacgagtcgggccggaaa

SEQ ID NO: 9459 - DNA, 777 bp, Homo sapiens
ggaagaacatcctttcccggcaacaacccagtctaaatttaatcccttacagcaggtcgcctatgttggtgtcatgtatggattgctgccgttgttactattgacggggctgctgtgtctctatccgcaagccgtgggagatgtgtttcctggcgtaagatactggttattgcagacacattttgctctggcatttataagcctcttttttatcttcggtcatctttatctttgcaccacggggcgtacgccacacgaaacctttaaaagcatggtcgatggctatcaccggcactaacgaatgatcattacacaagcagacctgcgagaatggcgtatcggagcggtgatgtatcgctggttcctgcgccatttcccacgcggcggtagttatgccgatattcatcatgcactgattgaggaaggatatacggactgggcggagagtctggttgagtatgcgtggaaaaaatggctggcggatgaaaacttcgcgcatcaggaaatttcctctatgcaaaaactggccacagaccccggagagagaccattttgcagtcagtttgcccccagcgacgatcatgctcgcatcggctgttgtgaggataaccccagaatcgcaaccgctgggtatgccgtgccaattggcagtatgggttatagcgtgcggtttggaagtgcggctttaaaatcacattgccagcttccgggaacccccacggttgctgaacccggtattctttccggttaacacccctggaaaccattggattgcat

SEQ ID NO: 9460 - DNA, 605 bp, Homo sapiens
atatctacggattggatgaatccctcccacaacagtgagagcttaccttctttcctgagactactgattcaaatgctaatctcttccagaaacaccctaacagacacacccagaagtaatgttttaccagctgtctgggcatcacttagcccagtcaggttgatgcctaaagctcatcatcacaagggggacccactaggaatttcagccccatttcccaaagtgtggtaccaggatacccatctaataggatgttaattgttaccctgcgtagaaaggttgtataaatggggtatgatggctcacacctgtaatcccagcatattgagaggccaaggcaggaagaccacttgagcccagaagttcaacaccagcctgggcaagagggcaagatcttctctacgaaaaaaaaattttttttagccagacatggtggcacgtgcgtatagtcccagctacttggaagactgatgtgggaggattgcttgaacctaggcatttgagatggcagtgagctatgattgtgccactgcactccagccagggtgataaagaaagactgtgtctctaaaaaaaaaacaggttgtgtaataaacacagatgcg

SEQ ID NO: 9461 - DNA, 345 bp, Homo sapiens
attcataatgaggattcaacgagataatgggcttgcagggccgtgctcagtcaatcagctgacgtctctgagccccatcttctcacatttgaaatgttcagaataacaataaagccttcacagggagattatgggaattaaccgaaaggaggaagtgaaagtgacctgactgctgcagtgagtgtcaagcacccatcacatgttctatgtggaaccacctaaaacaagagcatcacatagtgcgtgtttcctccttcacttaggatggcatcacttcctctgagattaaaacttatcaacacgatgacatatagaaaaatgtccaccctcactaataaaaaacga

SEQ ID NO: 9462 - DNA, 348 bp, Homo sapiens
aaaaatgatcctgtaatcccagttactcgggaggctgaggcaagagaatcgcttgagcccaggaggcggagtgagcagagcaaccctcagagggctgttgcgaggtccattgagaccagatctgtaaagacgtcagtgtaaggaattcccataggaagggccctgctcccacggctgctgccacgctgtggttgatgtttcattttgtccactgcatgatcttgaacacttcacacttccatttcctgaactctaaaatggggatattaaatctacgtgacaggctttacgtagaaaatttaagaagagaatgttaggaacattaaagcaataaactcttgaagccgc

SEQ ID NO: 9463 - DNA, 850 bp, Homo sapiens
  misc_feature (1)...(850): n = A,T,C or G
tgcacgcaaaggatggagagcaggggccctcggcctctgcatctactgagaactccagtgcaggggggcccagagggagcagcattggcgctggcgagagcggagggcaagacagcactttcgagtgaaacatcctgcttggacacagcacaacgatgccatccatcagcctgtgttggacacctattatgttggacagggtttacatgaagtggtttggagaacacaacctaacaaaacaaggcgtggcactgttttgcaaatgatgggatatagatcaaagacaaggaacnctccggcctctatagtaaggggaatatactcgaacaaaaggctcaccaataaatgataattcctcactgtaaactaaaaggaataaaatatataaacttatacaacatccaagtggaagacacaaggttatataaaaaagaaagaaagccgaactaaaacaaagatagccgcgaatatcaagcacaagaacactcgataatattacttatacatatacacaaaatacatataaagagaggaaaacataaaataagcaacaaacaaaacaaaaacatagtaaaatacgcatcacctaaaacaatcttactaaattggtatattcacataaaaacaaaagtacagcaaaagatataatacccaccagaacatatcatcgttaataacaattagagaaaacgtagaacaataaattaaagaacataaagctgtattacggcgttccgtcgaatcagcaaaattaagtaaaaaagaatatagtcacataacataagataaaacagtactgacactaaaataaattgcacgagaattcaagataatgaacatttaacatcat

SEQ ID NO: 9464 - DNA, 1389 bp, Homo sapiens
  misc_feature (1)...(1389): n = A,T,C or G
cgacgcttattcacatcttgctgtataattacttactcgtttgaactactatgtgttgtgcggatggtggaatattattgcaatatcccctgacatctgtcatgatgtgttnccatagttagagtgacggcgtgaatgatagacgcttgcgctccgattgcgtagttcatgctaagcatgcgtagagatgtagtagtgntgtggatctatactattacttgtgaggtgtgcgcgcatgacgacgagtgctgcatgtgcgtcatcggacagtatatgcgtatacccgtactatctgcgcgtgctgtcccacagcgcgtctactacatatgcntgtgcggcgtctagagacacagtatatctctcatagtacgttcgaatgtgtatcttcgtcggcgagtattgcgcatgtctcatgacgcgaggagatatatagtcggcctacttcgtcngttcgcgcgccggtctaatattgtggtatatatantctatgtgtggttgcttatacacgtgcgctggtgacacgagctgatcactcgatggtcgcacgctcatacgacgctcanatatagcggttatgatagatgtacagtcgcgcagcgaagtgatcatgtgatccatctgagtcctatcttcactccgcgtccgcgcatactccttgccctgtgttcatatttagcaccgcngcataataacatgcactcagaaaacggcttcgcaggtgtgtgtggtagtatcgtcttgaaagtaatcatcctatctcatcgtagattcgagttatggaagtagtgttgatattgtataatgattctatctattagagcctcgacgttctgctgaactcgtgtgtatgaaaacatttctaggacagtgtagctttcttgtgtttgtgctgttcacaaaatttattacgtttatcacaattgtttattgaatcaaccgatcttcgaccatattgagtatcgntgaagtaacatacacaagtacaatattaatcttgtcctccgtcgatgttgtgtgcactccatgagtatgttaattatagtgtttgcaatctatgggtcgataagataagttgcattgttcagcaactagtcacttgctgtaaactctgtgtgacttggtacaagcacgtcgactacatatcctgtgagtgttgtagagtaatgcttacttcttggccagtatctttgtactactgactaggctaatagaagcaaggtattatttgctcattgtatcagtaagagtctagttccatttagcgccttcaccgagtgtgtattgaaagagtggaagaaatgagaatcctagtatgcgggccgaaatatcccctttttgttatcttccctcatttatgaatttcttgactaaattctcctttaaccgctc

SEQ ID NO: 9465 - DNA, 1990 bp, Homo sapiens
  misc_feature (1)...(1990): n = A,T,C or G
ctgctggctacacgtcgcgtgatgcgcgtgtattgcgagnngnacgcgngatgaagnaggcggctgggagcgtctcgntggagactcagtatncgacgcgcgtgtgactgcgnnngacgtacgtcgcgatccgagacgacatntgagagctatcgtagctgnaccanacgacggcgacagatactagcanngcacagacacacctctgtncgcgcgatcgcgacatagcatacngcgacgtgactggcatatgacgcgacacgtgatgagaagcgtcagngctgcagnnanagcatacatngnngtacacnagtcgngngnnntcagctatgtaagatgctctgcgtgtgngnnactcgcgtgantagcacagccgatgtngcactacgtggagtacgacgnagtatggtcgagcggtccntntnnctctcacanagcntagtagcgagaacatagacgacagcgngacacgggcngcgcgtatcactagcgtgtatactagtaccggacgtnatggagagatgatgagcgtcgacgcgagcagtgcactacgggggtgagccgtagtgatgtcacacacacgtcgtgagctctatcgtacacacgacngccgcggganggtaganaantacacacgacgnnagnaagcaaacgcagtcgactacgctgctatagcgantanntncgctgtcncgatatgatananngtatatnnnncnacgtctctaggagcgccgtagcgcagacggcggaagagaggaggagagagaggaagngnagcaggtagnggnnacagagcgctcacnaggtgaacantgctgagacgaggangctgcaggngagcactgcacgtgtgactggcaccgcctngctggcntgnggagacggacgtcggcactactgcactcnactcctcatcngngcngacctctccatcgtacatacacactggnnnctganccacatatcgctacaatcatccatatatnntagccagatcaacgtnannnagcatnatcataccaacanagntnannntnntnnnagatatcttgcncttcgcggtatnntncacnatacgtagantcatcgtgntnantntctngatacaactgangatcgtctcgncaccgagacgtcgctgacgagcagagncccatagttnncacgcgacatctaactcgttgtatacatnntactcgatgtntncgcctctacagtatatgtanangggactganctcantntctnanactntggtgcatgctgttcgatcccgcagcacatacgctcacatcgcagngngcntaganacgtgacgcgcgctgtgaacgtgagatcgcgnggacgacaggcgtgtgacgtaccgtgggacggaaggtgaggagaggccagagtgacgcggtgtgcgctatcatcgagtgtgcgacggcgnggagatgtgagtaggntgactgtggcgatgtctaagcnanctcgccgtgngcggnnnggggtgngnggacantnggagcgcgctctatagcgngcagangaaacgggtnnctngnnngtaaacgtanntncacnttgcatnggttntcattgtnacatggtggtcctgtgcatgcgacgtgtnncatcngcctcctgtnactctctnctcctntnnncctnttttcnnanctctntnccatcatnatncnaagtgcgtacttagtcttgttnnnnntntcacttnnnnnanttcatctcntacgctttnctactcntgncncacttttcatatatcttctttnnnnttccactnnnnangtatataactcatatgttcatcacantncntcnnncgtcattnncnnnnnnncnnaaaaacctctttcttnttnnnnnnnnnnnncctctctcctcctntnnnnttnnnnnnnnnnnnnnnnnctctnttnntnncctctttnnnnnttnnnnnnnnnnttnnnnctntttnnnntnctcttntnnnnnnnccccc

SEQ ID NO: 9466 - DNA, 573 bp, Homo sapiens
acacaatcttgggaaacattttataatacagagggccacaccagattgaatattgcccccaggaatgaaatgaaaacaggaatggattctccagtaagagttgtttgaatcagtgggatgcagaacccatgaatatggagagtcaattgcatttcattatgcccaaaggtgaagtctgggaccatgaagttctgacgtccactctctagggggattaccttttaccacactaacccggaagctgggccctagtttggagacaggcatctttcacccacctgaggatgagggttactactctgcctctcgacttgttcctttttttgcccctgcttagcaaacaaaaggggttgtccgcccgcacatgggtttggtgcccctcaagaaggtgaggaagttccaggccctagcttctcagctgctgccttcaattgttttacggccctgccaaaagaccactttgagccactataactgccaaactgctcattaggactgtgtcacttggcctaaggcttccttatagaacccttcaaagaacatctttcttattacggaacacattcacaaaat

SEQ ID NO: 9467 - DNA, 738 bp, Homo sapiens
  misc_feature (1)...(738): n = A,T,C or G
ggaagataagaggaagaggaaaaggagttgctgcaacgatctcttaattatccaagctgtgaagctaattggcaatcaccaaaaagatcaagaactgcagaggagaagaaagccatctgccactattaaagatacaccagtgactcctgacatcccgatttccttggaagacctggccacctcctaactgattgatgacccctgtggnaaacaaaaataaggggaaaattctttgccaggttgtgactgcanagttaacagaagagttttcttcttgaagtggcttgagtgaaagtggtacagaattgnatcctggatatatttagagagccctcttcattttaatgaaaattcaccaacaaacactgacaacttaaccaaataggccaagtgctcaaggccggagagcgggtggactcaaaccagaagtatcctggacagctttcctaccttccagcttgctacttcactattccggggaaagcccgtaggaagaatcacatggggaacaccaatgaccgctagcttgaataactatccccaattcatcagaatttctaaaaaaacaaaattgtatgaaaaaagttaaaaaaagaagactttttttcttaaaaagcaaaaaaataaaattatgtccttcaaagagattctaattacaatataacgccgccttctagagaaactagaggctgatagtatttttttcttaaaaaaaagtaataagagtatcgccatagg

SEQ ID NO: 9468 - DNA, 1872 bp, Homo sapiens
  misc_feature (1)...(1872): n = A,T,C or G
tgtgatggcgctctgctggttctnctactttgttgtcngcgtctctgtccctctctcgagtctgttctcgctgtctagnatgcncnactggctgtgttgcncgcagtacnagcgtatgtcgccgccgcgccagcctcgctactntatctcatctntgactcttcatcatcgattcactctcttctcanatncactttgtntaataatatagtacatatttatgtanattanctctatactcgctcgtatcacntcgtagtcgtcgctcgctgtngntatattatgatgtagtgtctgttgaggtgatgtcaattatacgctggatgtgagtatcgtgttagtgtcacgcgacttngaatccgtaccactatacagacgatcnatcgacgcganggatanctntgcancngacgtagatctcgacgccgcgcgacacgcgcagtcgacatcgacatactgctcggtngataggacagagtttcgcgctatcacttcgcangtatnatatgtctttccctattcgcagcnactcatacaccctatcgtacgcgaganactactctcgcggcctncatcgacgcggtctcgagcctcccgataggtgctaccgacgcgncgcctcgcggcgcgancaacttctcatgtgtaatccgcatctgctatcttcctactctatcagtctatgatactcgcacgacacgtccaaancgcactttgttcgcttcgctgtgttcttcnaccggtactgcagtgtgtatggtggtcgtcaccgctctagctgcgctcaacgtcactatctaagttcgtctctcgtgcgactctcgtgtcggcgtctnttatagagagcgtggtgcgtagtgagttgcgtgcgantgctaatacgtagcatgctcgagccgtacaccggctcgttcagtgtgtagccaccgttacancggaggtgcgcgtcggcgtgtcaggnggcgtaggtnaccgtataacgcgagtcttcatatcctcctgatgcgtcgcgtatctaagtggtagtgacacatgtgtatgcgtacagctacgtacgcntnctacctgggcgtgtatnattgtgtatgtgatgcgatcacccgttacgacaagttacaccacattagatgtccatgaggcgcgtaacgcatcgtgcatatcagtaccacacattggtcacgtgatgtacctacgacactctatcgtcgtcgcggntncatgacgcgcgtgcacacacatctcactaatatcagtagcgtatgttacactcgctcgatggcggagtcgcgctctagaagatcgttatctcacactgatgcacttacntgcttggtagtgcagtcntgtctcatcgtcatcactgcactcatttggtcntaatatgtatctatattcctatcgtgtcngtcacgctcactcgactatgtagagccgtcgtgagcgtgctcacngatgtatacagatgtatgtatcgcatatgtgacgcgcgcgcgagcaaactctccgtgacgtatatctcatcgactcatgtagctcgntatcaggcgtgacnactcacnctactagcatgtatnagtgtcatgcgagtgagttcggacgagacagtatanatgatgggtgagatngnacccacgctactgngncaacatacgacggggtggagttgtttatncntcctgtatatatagatntctacgtcacgtgacaggtctacgtatgtntttgatnaggtaccgtcagcanccaancgtttncgactgcatagacattatcgtgcngtgtgtntagtcgcttgntatattcgtcncgatnagtatnatagttgcattgtgcgctgcgcgcacagcgcgtgcgtcgganttagncgcgnct

SEQ ID NO: 9469 - DNA, 216 bp, Homo sapiens
  misc_feature (1)...(216): n = A,T,C or G
ccgaaaaacatgtgaacaaaagcccccaaaggcatagacccgtaaaagggcgtttngctgccgttttcataaggtccgcccccttacgaagctaacaaaaataaccccgcaggattttaaaaaccccggcgttaccactgaagtggcttggagcgttactggcccaacctagcgttaacggatacctgcgttgttttcctttagaaagagagcgct

SEQ ID NO: 9470 - DNA, 1419 bp, Homo sapiens
  misc_feature (1)...(1419): n = A,T,C or G
caccaccctctattaaatctcgctcgtgagaattccgatagtcgtatcgaaaatgtgctgataaatacggtagaggagaaggcgctcgcgcgacccaacagagagagagagcgcggttttgatccgcgctgtctggcgcatggcgcctccgctcggtctctcatacattacaccaccactagctcgtcaatcgataaatgatatcttctatcctatctgcattgaataaagcaatgaacacaacgccgtcacccctttgaatntatccgctgtttcgaccctcctcgtctcgagcatataacctattactgccccttttaatctgtagtttgtatcatcccgtatntcgcctcataatatggtcacacgatagttagcccgttcttttttcttcctctcttcctatttatccgtcttttcctgttttctttaattgttgttttattactatttcacattagtaccactatactttactctttgctactatgtgtgtcgcggcctgcattctgtcgatttacgcgtagtctcgtagtgagcatgcattcttattgtagtaaatcgtatcgagttcgtgctgcggcgcgtagtgtttgtcatgcgtttcctttatgttatatattacatactgatgtcttggacgcagatcatatggtaacacgtatatatcaattttgttaccgccgcacgtgtccatatgtacttagttacgcggcggataaccctatattgcgccgctnttcgttacgtccctctctcttccgctacgtctcntactctttggtgtctcacctgctcctgctcaccgctcatactattctgactgcgtcgtagtatacgccaactaccgtgtgcgctactctgtatatttcaacactctntattgacttatatttattgattagttcagttgtttccnattgtgcatcacctgtacatcgcctatcttngntgtgcccgtagtactcattgtaacctgtcatatcgctgtgcagcgcggcttcgatagttcgtgtatctatatcaccagcnatgtggtacaagcgtgtagacccanatatgttatgtcgcatcttctggtcatcgtcatgctgctactatgtgtttnttatctnacgctcacattcgtgcctctctcgtgactncacatctcctctgtataagtgtgntgagtggatcgggtgtattggatnccacatcgcgtgtgattgnctcacgcagcactacatctcncactngtacncgcncacgtcatatnatatncagtaatattntctctagttgtgcatgtgtctgtcagcacctgcagttagcnatcgttatcatacnacattgcgattgtaggtacttatgtgtacnctactcaccatatgtagactatctcatagtcgatagcggnatgagagactgtncgnatat

SEQ ID NO: 9471 - DNA, 1561 bp, Homo sapiens
  misc_feature (1)...(1561): n = A,T,C or G
aaaaatatataatntaaantnanatntgatagtgtgtttggttgtgcagagaaantagcgccnnnnngggcgggnctcttctcttcttatttctctctctcanagacatcnancnnccccnctctctcctcactgcggngacatcagggaaaggacgccgccacgatgtgccatgctcgtgagtgcgggacgtgtgggcttagtggtaacaggagagcgaagacaagagaaaaccagagaaacataacntcaccgcgcnccgcctcgcactcacatccnacaagccagagcagccgcacggccngacggctagccgccgggatgacaggaaagagaaagaggataagtgagagagacaggtcacagagtggtccaccactatccttcaatactcgcaatctactacacaccaccaccaccacaatcacgcctacatccttcgtactccccatgaccgtccacgcgcgcgccgacgacacacacacgtgagctcgcgacgacatggagcgaagttcgacaatatcggtcagcacggagagacacacgcgcccagatgaattgaacaccaacagaatcgcgcgagagaaatgatatatatcanagataaacacacataaacacacaaaaagaacaaccacggacacaaaccccgtaaagacatgaggggaagaagaacaatcagaggggagagaggggggtgggagcgcgtaagcctctcccaaatagatacttcttgtgggagggtgcagggggggccatacaccaaaggagggagcgtggcggggcctccacaacaaacaacacacacaacacaatcagccgccccgagcgcatgcagcacgagcagcccagacgaacaaaggggcgacgctgtgtttttancgtgccttcagcagcagcaccacaaacacgacaaaccttccnnncccagatcattcgccnccngggccacagagannnacgaagggtgagccggaaacgngggccaccgtatattcncctgcncgcttgtgggaggcaggaccacaggcccgaccgcgcaggcaaaaataaacccccgccgcgaggtgaaagagaacgaaagaactctttccggcactcaaacgcaaccaaccacatagaggcatgaagtgcgacgcaagagctaacgacanacacacagataaaggctcgctcacaaacaactcacaccagacgacagacacacaatccacatccacacctccaccagaccatgaccacagctctcagcaaacaccgagagacccaccaaaacccacctacgcaaatgagactaccaccgtattattcacgccaccgaaccacagccaacagcagantacaaagaactccagcgtacacctagcataccagagaaaccacggatatcaggtcgtccgcagcaattagaccgcgccggagccacaggatccaccgtagaggataacaaaccacaagagacactgagaaaagagatccctaccataatacgtgcagagaggtcccaacgagaaatagctggccgagactagcaaagtaaacaccatccgcacacataagc

SEQ ID NO: 9472 - DNA, 1335 bp, Homo sapiens
  misc_feature (1)...(1335): n = A,T,C or G
gcgggccgcgaccgaacaatgtgtatagttcgaccggcggagagagtgtggtcgtagcgcgcaccacagaaatttgcgcgcgacaggaagagggaattagggaaacgaacttcgactggtcttatagagaggccctatgagaatgggacatatgctgcttacgaaaaagtgagctgtatgcgatgtcctatgaagacctgttgcacgagtggcatgacgatggaagcgcgacaattttcgaacgcgtatgtgaggtgcaatgtaacgtgtgatgtgcctgactggaagctgcgtgcgtgtcgtggctgaagggcacgatggtgcacgctgtacatgtacggcgatgtcggtgcgagaggaaggatggtggtgtgatagtaggtacgacaacaaccgggatttaaagtatggatgaatcgttgggctcctcgcccgccgactctccggcgttcgtgcaaccagcctttcaaacctgcgggcgcgtgcggtcgtctctctcctgtcgcctcgcttctgatgattaatacctcctgcacgcgtgcgcgagccggcgtgccggatatagtcgatacgtgcatatgtgacacgcgcagtctctgaatgtgtacaccagcgtgacccggagcacgcctatgcctcgtcaggatgatgtgcgctcaagctatatataatacagacaagaggtgatgtatatgtgcagattaatcattatataggtttgaaggcgtggatgacgctgagtaacgctgagtgcgctatagacntgctctcctctctctctacgcatagcgactgtgtagcataacaccacggaggcgagtgatgcncgtagtcatctcgagcgttgagcctcacgtgtctgtgcgtggctagtntngngtgcgaatgcgctagtatcagatagnctccatcagagtacggctagtcatgcatcacacatacgtgatnttgaagtgcgtctcatgatcgagtctatacgctcagtggtcagttcgagcatagatcggcggcgcggtgctcacgtacgtgtgagcgancttcagcncgctagtcacagacacgtatcgtatcgctagngtngcgaggcggtcgagaccgacngntacgagcatcgatgcgactagtacanctatacgcgngctcagatacgcgctgcgcgcgcattatcatgtatgacacatcactatggcactgtacgtagttccngctncatcatacacacgcgtgctatagatacagncgctctgaggtgagcgcacgcgngagtcatcgacacacncactgtatcgacnacngtggcgacgcatcgcagcatcgtnggatacgagtcgcatt

SEQ ID NO: 9473 - DNA, 2018 bp, Homo sapiens
  misc_feature (1)...(2018): n = A,T,C or G
aaaaaaaaaaaggaaagacanaagngaganganagaanaangannaaaangnnnaatngnntnttnntgngnngaaaanngngnnnagnnctnngcgnnnnnccnngttcnnncngctaagcngctgntntnnnacnnngaangttncnnctcnccgngaagcgnntactncnnngngngnngnncngnnnngnngngngngnngnngngnngnngnngnnnngcngnngnngnnncnncgcnggcnncnncncnncnncgncnctttcnttccgcncgnccttcgncgncgcnncncgccngcgncgngccgncgccgcgcngnnnnggngttgggncgngnggnngncgccgcngcggncgnggngcgncgnnccngcgcgnncnccgccnngnnngncgggcgccgccggcngcgcgcgcngcncgggcgggcgccgccggcggnngngngcnngccgcngcgcggcngcgncggggcggcgggtggctngncgncgngcgcgcgngccnngcggnncgcnggtgncntcncgngtntncngttgcctgtgtcgtcgtntnntccgtgtcggtcncgccgcntggtgtgtcgtgcgtcgtcgncgtccgtncgttcttcncgtgcctcgtgtntgttgcgcgcccngcgctgctgtntngntgctgttcgtgtnttgctcgntcttcnctttctgtctccntcgctgtctcctccggcgcctcgtcggttcngctctctccgnccngtcccgtntctncgttgctcctcntnctgccgttatcccgggggctgngctgttgttgncgttgngtcgtgctgttgtntntctgctcgntgcntggtgctgtcggcggcntntgtcgcgccgtcngcgtcgtgccgtcgtgtctgccccgtctctcctcgtcgtgtcctctgcgctcgntntcgcccgctgctgtgtagtnctcgctgtngttgttcggtgcgtgcgcgtccgngtcgctctgcccngcgtccnctnttntctgttctctccntcgtcttctcgtgtatgtgtgcgtgttngttttngtcgtgtcngcncnttgttgtggtctagagtncngncgtcgtgtcgtcgnctgcgncnnctaacngctgtcgtngtnctctgttatctcgtctcgctcncgcntnctgccgtgtgtttgcntgtcggcgcgtgtcgtggcggtcgtcngctcgcggtgtctgctgtggtncagtcgtgctcgtcgntgatgtgcngcgcgcgngtatcagtcgtgctgngntgttgcagtactcatagcgtcgtcttctgatgtgtgtgtntcngctgtngcgagtgtggctcagactagcnatnttctgcgccacgagatgtgttgntcgtgtacacgtgntcgcgtctgtttcagtctacgccngctgtagtgtacagtcntagaaacatagtgctatatagcgaggtctngtcgtctnctccgcntgccgcgttgcgtgntgcttcgtagctgctgtgnctcgtggttgcggtatcagngttgcgtatgancagatgtgtctcctgtagctcgatctccgggcgtgctgagagtacgatgtgacgagcgtgggtcngtggtcgtctcgtctctgtgctgtgntcgtagatcgtaacatagtgtgtntacgtncgtcgcgtgtttagatgtgttgtgatgcgctcaacagggtgtgntctncgctcgttcntcacgttcgtaaaatagacacgaatcatactgtctgtgcngtagtcagcgataccttgtcgttgatcaataagtgaataatgagtttcttgctctggagttctccgcacgcaacgtccnttggccgatcagtgtagagtgatttcagtgacgccacccacacttgagaggctagcctacggtgcatataatggttgatcgaatgaggtcgatgatagaagtcccgtacgctagaacgttgaggagaggccgtaattaaaaagcaaacaaaaataataaaaaagaataactgtatgtga

SEQ ID NO: 9474 - DNA, 649 bp, Homo sapiens
cttaaaaccgaaaagacacaaatactctcatttcggagaggaagcttctgagaatgagaagacttctctcaaaagaaagtctgaaaagttgtgactggaaagcttggcaaataagtctgctgcgacgcgcaagaaatctggtgccatgacttggatcgggggaatcccctgtcctcctgtcctttgctccatgagaaagatccacctatgacctcaggtcctcagaccaaccagcccaagaaacatctcagcttgctacaagtgccagaaatctgaccaccagggcaaggaatgcctgcagcccaagattcctcctaagccatgtcccatctgtgcgggtgttcaactcacctggtagccactcccagagcccctggaactctggcccaaggctctctgactgactcctccttggcttagcggctgaagactgatgccccgtaaaccatcacaaacgcccagcttcgagtaactctcacaatgggagatgggactaattgtctaaattcagaattccttttgaatgaaagagcaatgaaaagcccagggatttttccatttggactatttttaaaaatatacctggtcttaatggagatataaagacttcctccctattatttataaaaatgggaccttttactttgac

SEQ ID NO: 9475 - DNA, 782 bp, Homo sapiens
  misc_feature (1)...(782): n = A,T,C or G
atatatatggacataaagagaatggtatggtgtgtgttcctgcaaagtctcaggcatcgcgttcccacaaccgcttaccacgttggaatagattgtgtatataacttaaaccctagttctagctatatgaactaggcatgacacaagcatatttacgagcaagaagtgctgcctcattgaaactttgctgcctatgtggcgatggcgcaagcggcgtcacaggacaatgctcgctcgcgcactatgtgggacgccattggggctttaggaacttttatgtgtggtgcgagccgcagcagcttgggggcgggccactccgggactggtgcgtatggtgtcccacagaagcactgctcgccctgcgcgtacgactgctacgccacngctcaccgaggcccctactgcctgctcctcggtgtgttctactccaccgctgggtgccggcgacgcagcccagctcgccccggcgcgcgcgcagggcccacgcgtcctagcgctccgaatctctcgcgagccgcgccgtgtcggtggggcgcgantcggaggggtgagtggcgtggcgaacgcactgtgtgtgtcaagcactaggacatgcagcgcaccatcaggtgggagggggaggagaggggtactaagggtgggtgtaacagtgcctctcccgtctctgaccgctatgccggatgcgcgacggcgtaggggccgccacacacaacataccgcaccagagggtgggcctggtaggacccanctgcagcaccgcgggacacgtgcggcnacgcgat

SEQ ID NO: 9476 - DNA, 965 bp, Homo sapiens
caggagcgtactacatatgtattagttaattatgattctagttctagacgcgatctatagtacatattatcatcaccaggactcattaacagactactatgatacgtatccacaaatgtttagatatagcacgcgcatagattacagcttaggaatgtcatgatgcactataaccttgaatagccgagtagtaccatccgagacgcacataattagagacactatcgcaagaatatataggtaaactatacgtgtaaaggtaaataattcgcttttaacgaacaaatgctaacccatatcttacaccattctgtagaagaagatccaagttaatttttcacatgtggatctatattgaaaaaaatataacatgctcattcatgtatataatataaaaatcacctcaagatattatttttattaacagacagttaacagtaaacttttgatcctcactccagatgataatgaaagagcaatcatgctactagcattttattttaaatctcatctgcagtcattttatacgataaatgctttcacatttttattcctggaactggtgttgtttatgatagcctttttccttaaggatgatgggtattcacttaagttgaaatttgacatttcattaatttttttagggcaataggagacataataaatattcaaatattcagactgcaagggaaccgctgcacatatttggacactttttggacatactctagtatgactagaagtaatacggtaactttaaagtgagttggacataggccttatgtttgcccactacttcaataaatatgcttattttaaactataaaataagttaatatttttcttagcattagcatagaaaatattattttatcaaacattattaaaatgttttcaattattagcataataaaaaatgatgcggccgaacctctttttgttttttttgttttgtagaaaatatg

SEQ ID NO: 9477 - DNA, 565 bp, Homo sapiens
tcctataaaaatagcactccacagtcatcatcataatttcattgtgaatcccaacagagagacaacagaaacgacccctcagggggatgtagcagatgccatgggcctaaccagaagcccctcctgcccacgtgtctggagcacagcccaccctctaccatgaggcccagcccgcactgcctgcagagttttgggcacagggccagccctggccaatagcactaataggaattctgccatggactccaaggaaaagaggaatggctgagtaggagaactctgtttttctgctgcatggaaaggccgcagtcttcctgcaaccactgagagtggcatcacagcagacagcagaaaccagtggggtccctgaggacctctggagcgaccacatcaactctgggaccaccacacctatgcttttgctgtggcatatcatacatacccttgttcttatattgctttcaatccaagcatcttgaattggtgttgttgtctttgtgtggtgttaaaaggttgtttaaagccatttcctggttgtattcctatttccctgctgaggaaccag

SEQ ID NO: 9478 - DNA, 1060 bp, Homo sapiens
  misc_feature (1)...(1060): n = A,T,C or G
gccaaacggagaaaaacgaaaggagagcgaagagaaggcaaaaaggaaacgaaagaagaaaaaaaaaaacttaaaggaaaacaaaaagaaaagtttaaaggaggggaacccagccccccgcgcggaaaaacgccccggccaccgggccaaggcccaccacgcgcacaaagcaacagggagagaacggaacaccccgggaaaccggccgccccaacgccgccgaagagagaggacggacgacgccagaggaacgcccacgggcccgccaggaaccacgccccgcaccgcccagcagaaccaccccagcacgccaaacccgccacacgccgcaccaaggttagcagaaaaaagcacagcgccagagacgacaggcacgcaggggcgggaccacaggacaccaggacaccgagaggcacancacgggcggaaacgaccgggcgggcggcgggaaggaaagacggaggacaaagcgaaacaagcagaaaaaaggggcgccggcagagcgacggaacaaggaaggagaccgaggagaaccaggacacaagagggggagaagacgcgagcgggaaggggagcaagcaccggcccccgcacagggcaaaggagggccacggacccgcgcggcgcggggagcacccccgcgggggccagcagaacaaccaccacagcagcgccgacgaggaaaggaggcgaaccgagagacagacaaagaaaaaggggagcccgggaaagggctcgaaaagagcagcagagaccacacaggccagcgcacccaggggcgagccgcggacccggcaggaggaagagcggacgcggcgcagcggagagggacagcgaccagggcacaacagccacacacacacggaacagcaggcggcgggcaggggcgccacaaagggcgaggggcaacgagcgccacgcggcagaacgcagacacgcaaacgacagagacccaaagcaggaagagaaccacaccggcaacgagggacgctaacacacacagggaggcgggagagacacaccagaggaacaggaagaaagcaagagacagagaacagat

SEQ ID NO: 9479 - DNA, 1408 bp, Homo sapiens
  misc_feature (1)...(1408): n = A,T,C or G
gcaggagaaattncngtctttgcggccgtgtgcgggggattaaaaaagaaattatagggaaaacgncnccttcaagttctcnnnannaannncaaacaattttgggggggnnnnnnnnnnnnnnnccccncgcgcgcggcgcggggcggcgcccgcggcggcccgcgcgggggcncnnnncgncgcngggccgggggcgcggcggggccgcggcggccccnccggcgcgcgcggcccggggcggcccccncgcccccgcggccgggcggggcccccgggccgccggcgcggccgggcgtgcgccgcgggccccccccnccgcgcccccccccccgcggccggcgggcgccggggcgccgggggccccagcaggctgggccccgggcgcggcgggccgggcccgccggggggggggggggggcccgggcccgacgcgaaaagcggggcggcgcccccgcnggcgcccgcgcgcacccggggcgggggcccgcccccgcggggcccgcgcccgcggggccccccgcgccgccgggggggcgcgagggcggggcgcgcggcgggccgcggggcgccgggcgagggggccggggcccgggacgccgcagaagcgggagacgggccgcgcggccgggggcgcgggcgccggggcgcgccgggcgcggggggcgccgccgcggcgccgcggganccgggcggcggcgcgcgccggcggcgacgggcggcacggcggagcagcgacgcgcgcggcgccgcggcccgcgcccgcgacggcgcgagcgggacgccccgcccgcgggcggggggcgggggcgggcaccagccgagcgcggcgcgnnccggcgggccgggggcggggcggcggcccggcgcggcgtccaggggccgaagggcgncgggtgaggaaagacggccgcccncgcccagagccgaccaggagcgcgcgacacaaagcgaaaacaccgcccgaagcgcggccacgggtcggcccgagcggtaaccagccgcgcagcgggccgcgggcgcagcgaacangcagtcccgaggnggcggcgaagaccgacaaccggagggaacgcgcgccacagtcgccgcctcgcgacggcggcgcagngtcgctcgacgcaggcacgagagcgtgcncctcgcagcggagaggaacgcggagcaacgcgagagagacaggtcaggaacacaccgccgtagatgccgncagagacacgcgcacacacgaanncaanacanacaagtagagagagtgaaacctcgcgntggacagagcgngacgnggaggaaataggagagccgcgacccgnncactatacaagacgagaaagagaaacctaagaactgcgcgagcggnggcccgcgcgagaggaggagacgcaaaaaagaacaaagagagagacag

SEQ ID NO: 9480 - DNA, 322 bp, Homo sapiens
gggaaggaaaggagagggggagaggcgtagctgcagacactctcttaatttccacctggttttaggtgattggatcatgagggcagtttcccgcgatttgtgttcgcatgagagtgaatgcgttctcacaagagctgtgaaaaatggtgcctgcttcctctgccttctgccataattttaagtttcctgagacctccccagtcatatggaactagatgtggggtcctccctctaccacatgaagtttgaccacaaagtttggagtcgcatcatcactcctgttggaaaattctgccaagtaactggaattaataaacatgga

SEQ ID NO: 9481 - DNA, 1619 bp, Homo sapiens
  misc_feature (1)...(1619): n = A,T,C or G
ggggnggtttaaggggggtttgggaggaaaaaaaaaaaggacctttatngnggnaaaaggncnncctttccagctttnggaaannnanncacaanactctttaagaggagagngnngncnnngcggggcgcgcggcgcgggggccgcgccgggcgcggccgccgccgccgcccgggcgccgccgccggggcgcggggcgggnnnngcgnggccgccgcgcgcgcgcgcgcgccgncccccggggcgccccgcggggccnggggggcccgcgggcggcggcggcccgggcgccgcgcgcccccgcccccgcgcgcgcgcgccgggncncccgcgcgcccgccgcgcgggcggcggggcggggcggccgcgccccgccgccggggggcggccggggccggggcgggccgcccgcgccgcgcgcgcccggggccgccccgccccccgccccccgccggngcgngccgccccgcccccgcgcgcgccacgnngcggcgccggccgcgcgcgggcccggccgcgcggnnggcccgcgcccagggcgcaagccaccggcgcgcgcccgncgcgcgcgccccgccccgccncgcccccgncgcgncgcncnncccgcgccgacaccnccgcgccggngccgccgcgccgccgcggcgccgcgggngngcgccgggcgccgnaggcgcgggggcgccgcgcccgcgcgcgcggggnccacgggcgcgccncggcgcgcgccgccgcccggcgnggngccgtgcgccgcgccgccggcgcgccgcggcggcgccgggncggggcgcccggcggcccccgccgcggcgggcgcccgcgcgggcgcgcgcggcgcaggcaccgggcgcgcccgcgggcggcgcgcggacgcgcgccgcgcgcgcccggcggcgcagcgcgcggcggcgcgcgcgcgggngggcgcgggcggacacgggcgcgccacgagngccgcgcgccggcgccggggaggccggagcgcgggggcgccgcgcgagccggcgccgcgccgccccccgcccgcgcccgcgccgcggcgcgcgcggggcggggacgggcgcggcgggacgcggcgcggcggacgcgccgacacgaccgnaccgacaacncgcgcacacggcgcgccgccgcgngcngcgccagcggccgcaggcagcgngcgccgnggcgcccgcgcggaccagcaaagcagcgcgggcgacgagngggccgcgaagcaccgcggagcaagcgcncgcacgccnccagangacgcgccgccggcgcggcccgccgcgcgcgcgggngacccagaagaacaagacgggccgcgccgcggcgggccgacggggcccaaagcgnggagcacggggagccgaagcgggcgaggcagcgcccgncgccgaggnggngagagcgcgcncgaagncagcngggccgngncgcncgcccgnngngaggaggcggcngcgcccccgcgcgacacgcgctgagaacaaanncgnagagcccacgggcgcgcaancgacgcgaagcgngcagcgcgcagcacaagccgccngcnaagcgcgcgcgncacgaacacacaagaaagcaanacacaacaacacgaaaacacaataggtcaccga

SEQ ID NO: 9482 - DNA, 476 bp, Homo sapiens
  misc_feature (1)...(476): n = A,T,C or G
agggggccattcagggcaactggggccttcatcagttgcccctttattccccccaaaggatgagcttgaccacctgaccaaaaaaaaatccacctgctgacaaaatactttaggccctgtgctcggtgtgaagaaaacgtaattggggaaggtacaagatgcactgccatggataaagtacctgcataatctagagcaacannctccgaaggcgaccattctgtaggtgagaaaaaaaaaggatactggaaagccctgatacattaatgctctcaagacccaatatggaccggttttgccagccaccgggaaggatataatcctcactgttacctgctggaagtccccccaaaccggaggagacccatagctgaaggtgaggatacccaaaaaagtccacaaagggctgagcaaagagccattttccacaccagagaaaaacaacaggccaatgaggataagaacaaatccatgcc

SEQ ID NO: 9483 - DNA, 1390 bp, Homo sapiens
  misc_feature (1)...(1390): n = A,T,C or G
gcgggggggggcggtacngaacacggacgcccgacaccagacgggagagcgcagaagacaacagcgaggaaacaggacgtacgagtagaaagagagangaaggggnntgnnggggnnaacgtncaccgcaccgcgaggnnngttnnnngnngggggnggnaaaccccgngncgnagnnnngggngcacaagagaacagggagacgacgggggaggagagacgtttagagacgaagagagcagcggcgcagaacgacacgcgcgccgggagccaccganaacgcggnnngggaagggcgnagncgggacgcgagggagcgacgcgacacgccgcacgcggcgcgagacgagcgaaggagggcgcacccgacgcacgccgccgaggcaacccgagagaccccacagggaggagaggaaggangaagagnagnaggacgcgaggcggagaggcacgagagacggcgagcgcccccgacgagcggacagcgaacagaagcgccggcggccgagcacgcggacggaaagacaaaagtttatttttataaagaagaaggcgcgnggcgnggccgcggcggggccgcgccgggcggcgcagncgaggcgcgcagccgcgagaagcgcccggcagagagagcgcgggcggaggcagcgaacagcgagagggaacgagaggccgcggggggacgcgcggccgaccggcgaggagcggcccngcgcaacgacgagagcgcgcgcaaagacgcagacggaggcggggcacggcggcggggcgacaacagggaaggacgcccggcgcgccgccgaaacaggacgcaagcgcagaggcggaacgaccccacaccgggcgcagggagggcagaaaccacacgcaacgccccaccacgccggcccggccgcgnccacgcaccgaacagcgagccgggnagccgggggaacggcggggggcgacgccgccagcaacaccgccggggcgggcggcagagaagcggggaggcgcgcaggcgccgacacgagagcggccacgtgaggaggcgccggcgcgcgcacacagcgcgcggggcggcgctaatagacgcgcgcggcacacccccacgaggcggagcaccgaacaaggagcagggcggcgcccgacgagcgaggcgacaacagccggaagaccgcgaagccaggcgctctccgcggcgccacacaccacagacagacggagcgagaggcggggcggcgcagagggcaggagggacagacgcagaagcgccgcgagcgcgagcgcgcgcggaaggcgacgcgcgggccgaagaaaggcggaagcgacaggacgccggcgcgagaggggcgagccggggggcagccgaccagcggtagaccggagggcacgggagcgcacggagact

SEQ ID NO: 9484 - DNA, 2020 bp, Homo sapiens
  misc_feature (1)...(2020): n = A,T,C or G
gggggcgcacttttactgtttttttttgganggnnanatngngtganaagcagcaccattttatctgtgaaggttcnctttttanacaagganaacaancacaagaccngnggttgnananntgntnnncgcnnnnnnnannnnnnancnnnacnnnnnanantttctttttctggngngngnngnngnncncncncnnnnnncnncncacannncncgcccncnnnncncnnncacnannggacgagngcgnngngcgggccgacgagccgnngcccggtttcgccgncgcgncgcggcacggngcnnngngcgggnagacncncgacaacacggcgcgncgcggncgcgcgcgnggggggagcgncnnnccgggnggggnnccgcnnncngcgggcggcacgacnagangacgacanagnaggcgggnnncnnccangngncacgcnccgcgccgggcggggcggcgcgnggcgacacgacgagcggcggagggaccgacacggccggaggacggcgcgacggnacgcacgcagccaggcgcggggggggcgggnnggccgcgnggagagagaaggcgcgacgagnagnngcgcgcgcgggcgcgggncgaggcgcgccggcgggncggcgcgngcgcggggggcggagcgcacgcgnagccgccgcgccgcgacggcaggcgacgcgcgccgngcgcggngcggcgagacggcgccgacggaaacngccggagacgancgaggnnagcggcggagggcagagngcacaggcaannccgcgaggccgcngcggnnnaggcaccgcccccncgcgcgcccagcgacacgcgccgaggcncgagcgngcgcgccgcgaagacacgcgcggcggggnggcgcgcaggccgaacacgaaggacgcacgaacggacgcccgcgccgncgccggcccgcgcgcgcgcgcgaggagcngcacagaagagcgcgacgcgacgcgcgaggcggcggacgggagcgcggagcgcgcacngcgcgcgccgacaccaccgcgggcgccgcgcgggcgacggcgcgccaccgcgcgagcggcgggcgagcgcnggacgcaagaccgcgcgcacgaccgcggcgggcgacagggagcggccgcacgagagcgggncagaggacgagagcngcggccgngggnggccgcgcggnagcgcngaagacgcncgacgcgaagagcgaggcnngcgngggcggcagcggcgggcacgcggcgcgcgcagcacgaanacggaccagcggaggagcgcgggcacagccgcgcgaacgaccgcgacagcgcggcacagcaagcgagcgngccgcgcccagacananggagccgaagacagacagcgcggcgccaaacaccgcgcgggcgacgcaccgccgcacgcacggaccgcgnggaggaggaagggacgcgaacgaggcggcccgcacgcgcaggggagcggcggggcaggaggcaggcaggaagacgggacggcgcgaagaaaggaagcaccgaggcacagcggcagcagaccacggcgcgagagagacgcgccacacgagcgcgcggggcgcagcggcggacagcagacgcgagcgcagcgcgcgggcgcggaggcagcgcgcagagagngagagcgcacaacgcaggagctccgagccgaacgggcgcgcgncgacgccgccgcgtgctccgccaccgcaagcgcgaccgagagcaccgcgcggcgagccacatccagcagcacgaggcggcccacgttgtccacagactggtatatatcgtgcgatatcaggattcacaccatcataatttatgattcgttctgtccatacacccgcgtatacacttnttgtttgtatagagagctccgttccgtntgccgctgtggtgttgtatnagacgtgcaggtggcggtgctcagttcaattcgtcgtgtccgtacgattcacctcgttcggtccgccgccgctactcgttatggtgatactgtgcaatatantcctatatctgattt

SEQ ID NO: 9485 - DNA, 1070 bp, Homo sapiens
  misc_feature (1)...(1070): n = A,T,C or G
gtggtggcacntngtgtgtggtgctgtgtggcctgagagtcgacctacatcgggagtcgccaccgcacactatctctcatattcaccgtctgcattccccattcccgtcctttcctctaatccaggaaaggatacaattcgacgatcaacgactggcagctcgtagctccgatgacgtgcggatgaaatnacgcggcgagcngctgtcgtcgtagccggtggacgcgtnctggacgcgacggacgagngnacgtcgacaggcaggacacgagacagaagacgttgagaagtgtgcgtcaagagtgcgtcttacatatgcacacgacgctcnntgccataagacatgatccacaggtgcgagaattattctgagtnnaaaatacgtaacccggtgtgttagttgtctctcctatatatgtagttagttaatgcgtatagcacggcatgatgttagcgtgtgatatgganaagatgccgtttcggtgtgncggggcgtggtgtgatatgtctcctgaccctgccctttgcgtgcgcggtgcgctctctcttccaggccgcgcgcgcgcgggcgagagcccacccgcgagatgcagcgnatgcaacaccgacacgacacaattcagcgacgcagcgacgttccgtcgcacacggcgtccctgtgcgcggtgtgcgtgtggtagctggcgcagatgccgcatccattgcgtaacgacgctcagcaatgagtcagcagtggctactggaagcgcatcagcgtgtcagttcagcgatgccgtgacgagtggctcagactgatatagagtgaagagtcatcgagttgtgtatggattacagcttagacacgatatacgttgccggcctactgctccctccgcgcccacgagtctccggactccgctagcaccactccctgcatgcgtcgcgccgcgcccgagtcccgcccccttcctctctgttggcgtcacattgtgtgtacgatgctaggacaacgggcgatgtggtgtggtggcagagacacacgcggttggccctccagagggccacatgaggttgagggagcccatgaggcg

SEQ ID NO: 9486 - DNA, 687 bp, Homo sapiens
aatgctgcaacgactctcttaattatccactctctctacagctatcacagctggggatatgctgggtcacaacttaagccagcactgctctgagtctcacccaagcctttggtccacggctgattattcaagacccaagggctttttagtcagcagatgatgaattctgccaggactgggttcttcccttctctggcccatggcgtgtttagaaaagtcatccagaagttagggcctagaatggtggtctcgcagttctgccccatgtcctaacctatccgagttacaagacatcgccctccttattcttccttcatccctcctcaagcagagaaaaggagtctcccagagctgtgggctgcactgacaacacaaagactcttggccaccctggctggtatctcattagattgtgtgcaccccaagtccactggctccaagctaagcacagcaccgggatctgtggcctaggctgcctttcaagtttattacaaccccacagcattttaggttatggtggagggacttgccaaaactcatattccaactggctgggatggacaattaaatgcttcctctgggaaccccggctgagttctgtcccatgttgaattctgctgagacaaggcagttcttgagttccatccaaagtccaaatcactgtgttctgtctccccaagccaacat

SEQ ID NO: 9487 - DNA, 932 bp, Homo sapiens
gcccacctcccaaatgaacgacaatcgcagataaaactaatcgtcactttaatcatgatccccttcaaaataaaaatgtatttacagaatattgattcatcgactgagcagtgtacggcacatcaagaaatatgtccatccggctagaattttaaagattatgtgctccccatgtccactggcttccaattttttcatgtcccgggatttacccagtaattacagtctgtgtgccctagcataccgctaaaatttaatttagtacacccagagcaatttaggttatggtgtaggcactagccagaaatccaaatccacgcgttgggatggacaatttgcctctgcacaggtatggtttaaatgcttcctatgtaagccctggctgagatctgtcccatgttcaattatgctgtgacgaggcagtactgagttccaatacaaagtccgcaatcactgtgctcttcctcccccaagcacacactcttccactgtcccacacagctgatgctgggggatgtcagtgattcaagactgtcttttcaatcctcttcagtgcctcattccttaatatgttaaaaccagatactgtgattgttcactggatttttggctcttataaaggtgcttttacgtgtggatagttgttcaatttggtcttcctgtagagtggggaactatttctagaggcctctattcagccattttgctctgcttcctctaattatagtttttaattaatatattatgaatatatgtatatatgaacaaatatccagcttataaatcattttaaaatgttgaccaatactttgttgtattctgtactttaaatattcccctattattgaagatttaagttgttctaatatttcactataataaacaatgatgcggccgaaatacaatttgtcatctcttattactaaaaaata

SEQ ID NO: 9488 - DNA, 668 bp, Homo sapiens
  misc_feature (1)...(668): n = A,T,C or G
agtgagtctcaacgagcgggcatggcgctgccttcgaaaatcgctcaacgagctttactaggcttctttagcgtaggccacagaaatcttgacaagtctctatcagacgtcatacttctttacttatggcttactcttgacagagaggtgttgacgaagaccaataggggtggaaagcgctaatgaccttgttttactggaactagaaatctatcaaatacacatagcttgattcaaagttgggaacatctgtgattaataggttgaccatctttaaatcaacgcaactaacctaggcacttatatatacaccgactaaataggtgattatgtagatgacacacctgtgcctgacatgtcgttaactgattattctacctagcaccctaaaacccaaatggctagatcgtctctattgactcagcacagtatacagtgctacagttattatgctgtcgtaactgattccttgccttactaaatgtaagctgcttccaccgaaatcagataactaaaatgcgctcatacgcctctccgcagaagctctggctaacgagagcatctaggtcctgactcgtgaactgnctcgttggtgtgctgttgcatagtctccgcctcctagcagcattacagtatccacgctaaagtgagatggcgcagaaccctgg

SEQ ID NO: 9489 - DNA, 1155 bp, Homo sapiens
  misc_feature (1)...(1155): n = A,T,C or G
aacacgtatagtatatacaagataatcgacacacatacatcagtttagataaaataagtatatggagaaaatatacagacaagngagatcgagtacacgcaagcgagcgtataggcgagcggcagccaggcgtgtacattgtcgtttcgacacggccgacggcgacgttattatctcatcagaatatccaacagtgcccttacgcagaccagaacgagaaagcgcaacaaatagcgtggcaacacagaagattatcactcgagactcgacatacgcggataacaaacagcgcgcagcaattagaatgtgttcaataggcacgtgaatacgggctactatcataantgtgcatatccgcacacacggcacacctaggcgaaatgcgatgatatcaaaacatagcgcgacgagcgacgactgtggtgtgtccatgtgntgcacgcgcactcacagttnagcaattgcgacaatgttcagatacgagccagccagactagtgtcgcccacgtcgcccttagcgctgaggtcatacagcggggaactccaagtgaacgtagcatgagtttatggacctcttgtcatgtatgtccgcgagtatccaccgatgaggcagcatgagcccaccttcaacatagccctgtcccatggaggtgggatgtaacgccgtcggcagcgatgcgattgcggcccgcctgaacaggatgcggaaggtaccgccacaggagaatcacatgcgtgacatatggctcctgatatctcccttatggtcatgtgacagcgatcaggtagcctccgcggcgatatatatccccgctgtcgatgatagaccctcacatggaggcggccgggtatctgtctacccaacacgaattttcagacagtcaatgtgcatccttgaccaaaccacggatataccctggtctttcgccgatatgtaccccccgtatgcccacgcgacaagaccaccacactgncgatcacatcagaacatatagtgagatgcccccgggtgaggttatagcattacgacacgcactatagtgagcacacaggccatcgtcgacgccccatattgcgttacccgtggggacttccctcctcaacaactattatgtccgtgcacccctctggtgttatggtctcattgtcgcatgt

SEQ ID NO: 9490 - DNA, 1699 bp, Homo sapiens
  misc_feature (1)...(1699): n = A,T,C or G
agagatgtgtgactatcgtatacggtcttatagagcgatgcgtatgatatgcgttgtcaatgacctatagacgatagtttctgcggtgattagtattatcatgatcctccacgncgatagcttattatgcatttattgtgtactgtgtnttagacacgcgagtaccgacgatcggccatcgtagcgcgctcgctcaacctccatcacgacactcactacatgtcacatcttagttcaggactcacgtgtccattgtcgccttgacgattgacgctcggtgctcgtggtctccgttattctncncgcntctccacttccacgcggtagttatactgtgaacgacactcccagaagtagagacatacactncggcgtacacgactgatcgagatgaccgccngacgtccagttcacgagagntatatgacntgacagccgattcgagtatacattagctcacccgcgtatctccagcatgttctgcgtcgactggtgtgtacgcggttctgctccgctatcttattcacatatttcttctatatatataatactttcactatatcatcacgatttctctgtggtggtagttcggtgctgntgtactgtcggcactcacntctcagactccgcacttcacgatgcactgcgcgtagacacgccgacgagcgtatctgtgtgttgcatagagagngctacgctctacgcttagcgacacactactctcgcatagcatctcaactctatgatgcatctgtacgaactacgtacgtactatatcgactctntgtcgtgaactcgatcaccctgcgtatgggtactatacctgacaatcatctcgagtgactactacttctctgcgtaattcgtccgatacggctgctgatcacctacagctcgaatctcctcgagactccagcactagactatccagcgtcgcgcgcgcgaactcattcgagatgtgacgatatcacgtatgtcttgcgtgcgttatatcgtgtcaattatgctactcggtntctatagcggcgaggtgtgtacgtgtgcgagtatatatgantgagaacacgtctgatacaatgcagtctatatgtatggtactcctcgtgcgctatcgcctcgcagacgatctatacaagcataananagtgatcatcagtgattcataacgacgcgcgtagacanagtggtcgagagtacgatagaagcgaagtcaacgaggatcacgcgcacgctcgtcgtattacactgtgtcgtacctatcctccgttgtcgcacgagtgatcgaacgatgactagcactcacgcccactctagatntgtcgcgcagcgtgtacgacagcgcagtacgaccgtccctagtgcgtgcaacgcgcacgcagcgacntagacgaggagcacatcgactcacatgtgagagatcgtattacgcgagcgactagtgctgtactaagagtgtatatgacngcctgcgtcgtctttctgacgctagtcncantatatatgagtatatcgggcacggtcacagagtgacccaccatttcgcacccgcacgtgtgagacacgtcatcacatctccatacagatacntgactnccgtacttgtccgactacgtgtgattcgtgcactcgaactctctctgtcangatgtacagctcctctaatgccgacccgtgaccgcaccacgctctgagattgctg

SEQ ID NO: 9491 - DNA, 1780 bp, Homo sapiens
  misc_feature (1)...(1780): n = A,T,C or G
ttatgagctagagattattcgtgatagtcgatacgtgtatgttgcgagaggtaggatgagtatatgagcagagagacgtaatcgagtnattgtatccgtactaagatgtncgagncncatgctatcgtatgcagcacgttatcatgatacatggcttcgctctgtgtgatnangtatcgaagctatgatcnagcgcagntcgccagcgtcgttgtgtcgcgccacgcatggtagcgaagtctcaacttgtctcgtcaagtaggctacacgagcgcgcccgtcgcatcgacgcgggtatgtagtctacctgacgcgcgctggtgctgatgagantagatacgtgactgtaaactagattatcactggtgatacacaagtcagtatatcattctgacgactcacatgtattataccatatgcgatgtgtagtagctgaactcgccaagttgcatagttgtgaatccaagaacgatggatacgaccgcgtgcaaagactgaaaggtattatattagttagtgngcgatncagctcctctcggctatgtgttctatatatacttgatattgattgtgcatgatatacaggacgacgaccgtgtttatatgcacttatatgtcgagagtaacgtatgcgtacgatgcatgttnagtgagtgtcgctcgtgntattgagatcgtagcatcaagcgaggacggagagaccagacagcacgaccngatcaatataatggacggatagtcgatcgtnacgctcgcgacgngagattnatcgtaagataatactgcatgactgtatctactacaagtcaggatatagtgtacctcgtnttgctctctgtatgcatctgcgtactctatgctcgtgtcatgtgatatagacatctgttcagtctttactgacagcgtntgcacgtcgccgcgcagtcatctgcntataggatntagtgtactgtcacgcnacgactgatactcgcctatgcctagcttactagtcatgntgtgnatatcatacactcatcgtangtcatccgtgcctgttatcncctacttgtcgacgtctcgcactagaantagtcatatganctanatcagcgatgatgcgatcgagcgtattaggacacgtatgtctacaaacctatagtgtactcngtcgagctgagttactgtcgtgcgttatgatgtgttatcgtgatctgtcatnactatagtattatgtgccgtagtctgagntccngntnattgtatgtagctgttagcgtcatgtcgtancttactgcgcatacacgatagtgactgactatctatcatgagatcgatcngtgcgtcgataggcggatcntcnngagacgncatatctntgatctgccgtcgcgcactggtagctgagagcgacagacgagcgcaatgntgcngtggatgctggcgngcgatagtgcgctgngtatcgtcactcacgcacgacatagcgagtgactacgacgacgtcgactagaacctacagcgtgtcagngcgacgcgttacgcgcncgctntatacatgctatatncggctaatacacacatatgagcacacgactacgtaccgacagtcacgcgantcacacgcgtancgncgctatgctcgcatagtccgtacacgtcggagttagacnagcacgcacactgatacgcgacatccgactcactgatctgtctccagtatactatcgtcatatcacgngaatngnatactgaattatagccagtatcgtctctctataacgntagagctatccgnctg

SEQ ID NO: 9492 - DNA, 685 bp, Homo sapiens
attgctgcagacgactctcttaattatccaccgatgtgatggaatacgtttactgatttgtgtatgttgaaccagccttgcatcccagggatgaagccaactcgatcatggttgctggcctcataaaatgagtcagggaagagtccctctttttctgattgtttggaatagtttcagaaggaatggtaccagctcggcaattcttgcagccctattttacagctcacagaaattaattaattgaacagtgcttctgatctggaaagtgatggactcaggctgactccacagctcaactattaaacactactctcatcaccccacagggcctgaattttctgctcctgaattcaaacattaaaatgtgtggtatgaggacaatgtggttaatttaaatggcctttggagcaaataggacgtatcttattccaattttttgaagatagagaaagtgcgtggtcctgaactgaagaaatgggtggtgcattcaacaagggaaagattatcttacccccagttggttaaaggcagaactatgaattttggctattggctgggggctccttccttcaaggtggggagaaaatgagagctttgtcatggggatccaattattccaaaaacccttcaccctgttggcctcccccttcttgtgtccaagggctctgtttacctcgcccccacg

SEQ ID NO: 9493 - DNA, 109 bp, Homo sapiens
  misc_feature (1)...(109): n = A,T,C or G
tctatcttgancttgcagctcctgacgctaccagatcactttgggattcttgatagccgatttttaattaaataaatgtaattgcctgtttccaccaaaaaaaaaaaaa

SEQ ID NO: 9494 - DNA, 1811 bp, Homo sapiens
  misc_feature (1)...(1811): n = A,T,C or G
ggggtaggagtgtgaggaaagagaaagaagaaaaaagtattttaaaaaaaagagccccctccactgttagagaaannacaccacacctcttttgggggagngggaggagagaggggcccgacgggggcccaaagggggaggagggcgcacgcaggagagccgcgggagcgggnggcgaggagnggaagaagcgaaggaagagagagaggagaaaccaagcggggccacaccccacaccggaaagaccaggcacntggccccnntccgcgttgaggcgggttcgggcgcggccgccgcagcgggacgaggagcggggaaggacgagagaccaacccacaacctcaacgctctgcagcgcaaaccgagacaatcgccggacaggagacgaacagacgcggcccagaccgggagtggacagcggagggaaaggacggggggtcgggcgacgcccgaggcagagagcgcgccgcgagaggagagcgcgacgcacacacgaggcggagagagggaggtgccgggtcgcacaagaaccaaaacacacacaaacaagagaccgggggcgcgaggcgccgaggggcgagggccgggaggccaacaccacgaggccgcgaagacagggagaccgagcacacgcggaggccagaagaggcggagcgagcgagaggggagaccgaccgagcgagagacggaagagaagcaggggcgagagcgagggaggacaanagccaggagcacacgagcgagcggacggcagcgaagcggcccggcagcaaggaccgaagggcgaggcacagaacgagtcggcgaggtcgcgacggcgccacaaccgacgcacaacgagcacggcgccacaacgcgcgactaggcagagggacagacgcgtgggagaggcggagacacagagaggagggagcgtaggcgagaggaggagagaagacgaggagcggaggagagagagagagtacagaagaccgcagcacggacgcgggggacgatcacagcacgacgaggagcgggacagggcgggcgcgccgaacaaaccgaagcaaggacgagccagcgcgaccagcaggcgcgaagacgcgcggccgaccgagagcgagaggataggagaacgggtagagcggtgagcagaggataggagggatagaaggagagagcgnaacgaaacggaaaggagaagcggcgaacgcagcagcagaacgaggcaatacacagaccgaccgaaaagaggcgacggacacggacggtgcacgcacgacgcggacgcagcggcgacacgcagtgacgacgacgaggagggagcacgcggaaagacgncggcgggatgagaggcgagaggtcgcgctagcgacgcggggataccgcacgagccgaccacgcgcacacanacgcgagaacgacgcgagtgcactgcgcanagcagcaccacgcgngagtatcacgcgcgagcacggcgcgcgcgcagggacgacggagagagcgatcggagcgtacagcgtcnanaccacnanagcagnaggggagacgacatacacngcacacacgcggtgtgacagccnactaccgacgagtcagaggngagtgnggacgacgcncagctgtgagcagcgcagagangcgagcatcacgcaacggaagccgagtcntgcagccgagagcgcagtcgtancgagaggangaanagcggtagtagatcntactgncgacacnnnaggtnacgacgacgcgcgaacgcactganncgcagggcngacgnatganagnagcacggntcaagtatcgacacacgaagcaacgagggcatcagg

SEQ ID NO: 9495 - DNA, 1603 bp, Homo sapiens
  misc_feature (1)...(1603): n = A,T,C or G
cgcagcagccgtagtcaaataataagggggaaagaagcggcgtgtgagtagcaaaacggcggttataaacagacgtggagaggggcgagtttagngggtggcgactcagancgctagagagacatgttacgcggcgcgacgagagcgcaggaccggatacggagtgcacatgcacatcggcctgaacgcagctgttctgcgcgtcgaatacgcgcgacactagcctgaactagcgcatccctactatcgggataacactgagtttatcgagaagggcgcgagctgcgtgggtgcacagatattaatttgattccacaaataacacactagctccaatgactaacaactgcccacagcgacagacagtgagatacacaacgcatcggatacgattgatgtagcacccgctcgtgccnccatatgtatactctaacgtcacaggaccactactcaagtatgattgtcgcgccgacgagcgtcatagcagtctgtgcctcacccacgtagtaacaacgcacgtcaatactccctagttctgactagtacaccaaactgtgtcaccgccagaccgaacgtcgcggcgtcgccgcgcatnccgatgccgcgtnatatacgcgacagtgcgtatagtgcggtgcgtgttagctgatatcantagctgcagcaatactcgtcatctcattattctacagtaatcctatcctacagtgtgcagnaggtggcgcgttgtgagcggaccggccacattagcgcacatagaatgatgtgtaggacgcactcatcgatgtgtgataantacgtgtagcgcggagactcgacnccactacnccggcgtgtggctgttgtntgtcgacacatatagttcaacgtntcgctcgcactctcncgtngtgtcgatcactggcgcgatatcatactgcacatcacagcgtctcagtagtgccgaggttagcgcgaatgctcgcaaggtgtagagcgtcgtctcatantagagcanaacgactatactgctcagtagtcatactgatatcgtacgatggactgagtngtgcgactcggntcgtcagtccgcacacacgntgtcacgcatcgngcgnagagagtcnactgagatccgctacacgctcgcgcgagtnctgcgtcntaggnacgacacntcatnattgcgtgtgatacagcgcgacccagctatgtgangtattcgcgctgagctcaantcgcngcacctgtccgatcttcacgtatgtgtagancgaccatagtgtacggagatagngtcanactcgaacgactgtcgccacgtcgtcgccgcatcactccaccctantntantgtagctgcgactgtcggtncgtagtcagnacacantcgtgagtangcgatcagactcaatctcagtangacacacacgccgcggtgtagtagtgntccagtaatggtatagtaatgagtcgcncagcgctactacggtgtggcncgcgatcatcacaaccngcacctgtatgtatcattcgcgctatangcgtgcgcgtgagtngtagcacacactaatagnattcgcatacgtcatactctacgcgctagagctggctaggagagacna

SEQ ID NO: 9496 - DNA, 1893 bp, Homo sapiens
  misc_feature (1)...(1893): n = A,T,C or G
gggttcccgttccctccggtcnnnnnnngnnnnnnnnnnnnnnccnnnnncncnnnccctccgcnngnnngnnngggncgnnggnnggngnggcgnngnngnnttgccccccnntgtgnnnntntnnnntnntnntnntntnntntntntnntgttttnnnnnnnnttnttttttttttnnntttngtgnntnngnntngtngnnggtgngnnnnnnggtgttttnntttntnnntntgttnntcttggtgttttggtnntngtngtntnnntgntctnntttnnntnttnntgnnngtcnntgcgtntgtgtggcncgnnnngtngngtgncngntgtcgngtgttgcngctctcngtttggcggtgcgtcttcgtcgcggctgctcggngtgtccctngccgctgccnccgncggtcgtgtgggtctgcgtgcntggtgcgtcggncgcgtgcgncggtgctctgtcggnnngccnnncngtcncntccgctctntgtgtcgcgtcgcgcncgcggcgtgtcncgncttgtctgcgcgctcgtcgtngngtgcgcgcccgtgntgcgcgtttcgngctgtgtgtgtggtgtgtcgtctgtgtcttgntngttctctntcgcgtgtgcgttgccgtgcncgngnggtgcggcgtccggcctgcgtgttgtgttgcgttcggtcgtggtggtgccgcggtgggtgntgtgtgtnttgtngctggggtgtgtgtcggtcggtgtgcgtctgtgtgtgtgccgccgcgtggcgtcggtggcggtgtctgtgcgtgttgcccttgtgttgtctgctgtcgggcgcggntgtggcggtggngtcgcgccgcgcgggcgcccgcgcgggtgcgtctcggtctgggcgntcggcgtggtgtgttgtgttgtgcgttccgttctgtgtgctgtgtgtcgctgtttgtgtctcgtcgcgctcgccctcttccgtgggctggttgtcgccgcgctgttggctggtgtgcctggcgggttcttttgcgcgctctgcnctcgttgtttggtggcnctgtggttcctgtcttgtgttccgcgcgcttgcgncggtgcctcggtcggtgntcgcggccgcgcgtccgcgcctcgttgttcgtcgcgggtcggcgtcgcgcgtggtgtccgntgcgtgttgtgtctggtgttgtggcgngngtgtcgcgtgtgtntcgcgtggcgcgcgtgttgtttcgcgctttgcttttggtggctgtgcggtcgtgctcggtccgtggcgtggtgtggggtcgtggtgcgtctcgccgggcgcgtgtgtgtggggggcgtgcggcggctctgtgtgtgcttcgggtgtgggggtgtgtgttggtgcgtgtcgttgtgcgcgtcgttggcgtgttcgtgctntgtgttctctttggtttgggtcgtttgctcctgtgtctgtgcgtgtgcggtgcggtgtgtcggctgtgggtgtggtgcggcgttgtcgtcggtctcgcgttgtctgcgcgcgcggcncgtnggtgcgcgtcctcgcgtgttgtgtgctccgcggcggtttttcgtggcctcgctgggcggtgtctctcgtcctgcggtcgggtgtggtcctcngttgggtgttcgtcgcgtgtgtgtttcgtcgtcgnttgtgttgtgtcntgttctcgctggctttggcgttgcgtcgtgnctcgtcgncgctgcggtntntcgncgctttggtgtgtgtgtgtgcgctcttctccgtgtgcgcgccgtctgtgcctgtcgtcntgnggcccgctgctcgtntgtggtggttgtgtggcgctgcgggtngccngtcttgcttgtgtggtgcgtcgctnctcgggtgttgtgtttcccgncttcgtgcgctgtgtgttgctgt

SEQ ID NO: 9497 - DNA, 516 bp, Homo sapiens
caaaagtgaagtggtggcaaagtgctggaccagatgttagaagtctccaatttgctctcgacaacaacaatccacaagtaaccctgttccccactggtaaataatggtaagaaaaatagtgcctagtgggggcttacgtaaagggactgggaagctaaactgtggaaaaaagattccaagtactactatttttgacccaagtgctttgctcctaaagggagcctatgttcttctatactttggaaatagttgcaaccaaactaataaagatcggatgccggccgattgcatgatccctagataagtgactcagttaacctaggacagttgagtatggaagaacggggtgagagttctttagagggcgtgattgagtttaatgccacaagtgggggggaaagaggggggaagaccgaccagaactcagaaaggcctgttttagtgatttgggcgcatacacacacccccgcgtggagaggatggaggaatagagagcggagaggagaagggacagac

SEQ ID NO: 9498 - DNA, 107 bp, Homo sapiens
gccctggataacttgagctgtccaggagccaggatgaggactcagctccacaaaatccaaatgccttcattatattaaactgcctatatgaatgaaaaaaaaaaaaa

SEQ ID NO: 9499 - DNA, 331 bp, Homo sapiens
  misc_feature (1)...(331): n = A,T,C or G
gggcaggaggcccactttagggtgggaggagattgggtcttaggaaaaagcaccccgtnnannaaaccgacctnnggggnnnnnaaaacccnnnnnnnnnnnnnnanannnnannnnnnnnnnnnnnnnaannnnaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggagnnttttttttannnaaanaaaaanatggggggggggttttttntnttnnttnntttttntnnntttaaaaannnnnttnntnt

SEQ ID NO: 9500 - DNA, 204 bp, Homo sapiens
tgaaacacgtagtgttttcaacattattgaagcattccaagctggagccggtgagcgtgggtttccctgagtgaggaaaatatcagacagagctccctgatgaagtagaatggacatataatttgaacaagaaataaacctttgatatttagagccatgaaaaaaaaaacaatatttaaaaaaaagaggggaaaaaaaaaaaaa

SEQ ID NO: 9501 - DNA, 875 bp, Homo sapiens
caatctggaaacactctcttaacctccaccgctacacgtccccaggagcaggccctggaactgctacccacattctaaaaagagcacgaagctgctcaggaaaaggacccatggctgctgcttctggcggggccaggtcacggggagctttggacaacagaacgagccacttctgccctgggcaaaccacccctgtgccccatctgcggctcatcgccactgggactgacactggcatacagggagctgaggccctggaggacgcgtgagtgagatcctggccctgagggcagcgtcaccctgacacaaacctttacccctacccgggcctcaatgtgtggccccatgcacaagctttagctactggcggattggactcatgggggcccaacgggcgctgtagtagaagaaacctgcatccattctggcgcaggtgatgatttggaatatagttcaatatgcgtggtaacatagagcatagatccattataagtgctgtacgataacagcgacagtctcagaacttggatgaactctgcaagaagcgcccctgggtacatatacggccgaatgaatccacgcttcttagttcccatatatatgtactcaaaacgctatgtactaagaagatctccaacgcacaagtaccatgagatcatagataatattagtaactaactaggcacatagatgtcagccaatgtcgattatgagattaatgcgaccgtcatactttgtcaaatcaacatagagcgatatcaataagcgaagtagagatgacaatggtgtagcgtgtgtaagtgacaagtgaactcacaagaaggatattatatgacagtatacgagaaagacggagtatcactagtgctaatatg

SEQ ID NO: 9502 - DNA, 790 bp, Homo sapiens
cactctctaatttccaccgctacagatgctggcagaagacccaagactcctggatcagatacaaaagatttattactcacagcacagcaaacagttccttccatcatctctctccctctgcttggagaaggaccacgatattgaaatgaggccaaataataactctacaatggccgcagcacatcaaaaggcttatccaccataatcaagtggacttcattcctgggatgcaaggctggttcaacatatgcaaatcaataaacataatccagaatataaacagaaccaaagacaaaaatcacatgattatcccaatagatgcagaaaaggcctttgacaaaattcaacagcccttcatgctaaaaactctcaataaattaggtattgatgggacctatcttaaaataacaagagctatctatgacaaacccacagccaatatgatactgaatggggcaaaactggaagcttcccctttaaaaactggcacaaaacaaggattcccttctctcacccctcctattcaacatagtgtgtggaagctctggccagggcattcaaggaggaaaaaaaaataaaaagtatccatttgagaaaagaagaagacaaatttgctcttctttgaaaagaactgattgtattttaaaaaaccccctattgctaacccaaaacttcttaaagtgaaaacaacttttgcaaatttcacaggaaccaaacaatggacagaatcacagcattctttacaccaattacgaatacggagtacaatgtgagggaccccaattgcaat

SEQ ID NO: 9503 - DNA, 829 bp, Homo sapiens
ttatctgcgagacactctcttaattctcaccgctacaacatttcattggcagtgaggggaaggaagaaaagctttttcttcttgtaggattgaagtgacttttttttcaagctgtctacatctccagacaaaaaccagaagccaggtcaattgatttttgacaagttgcaaagtctatggaaatgatgttaggcaaaaagcaaattcgagcaattttcttattcgagtttgaaatgggtcataaagcaatggagacaactcacgaccatcaacgacacatttggtctaagaactgctaaaaaacgtacagtggagtggtggttcaagaggttttgcaaaggaaacgagagccttgaagataaagagctagtggccacccattggaagttgacaaggaccaattgagagtagtcattgaagctgatcctcttactattacatgaaaagttgctgaaacaatcaacggggaccattctatggtccttttgcattggaagcaaatgggaaaggtgaaaaagcttgaatatgggggtgctctcatgagttagagagaactaaaaatttagaggtatgagagaggagttgtgtttttaagctcacaaaagactcgaaacatttattggattggattaggaacagagaaaaaaaagtggcgttatcaaaatataccacaaaaaacatcttataagttgaaataggaaagaggtttcgagcgtcttgacagaggcaaaatttgtagaaaataaggttataactacctgaaatatgataaataaacacatccaatcagatggagattaaggatgccgaaagacacgagataataaag

SEQ ID NO: 9504 - DNA, 830 bp, Homo sapiens
  misc_feature (1)...(830): n = A,T,C or G
atgttttttataattgagatagggtgttcgcttgcgttatgcgttctggggcgtggactaagaggttctaggtcgtatggaccggagtcatggtactaaaattaaaatcgatgccagcgagacaaaaagtaatcgggcccgtggaccttggcataagnttctataattggatagatatcggaggggtgaggnagaggtgtgagcagaggtgggggaaagatggaagtaactatgttatcatgataatagataacaaagacattggggcagctttgagtggagaaaaaataggcgaggcgacagaggagggggtggaatggcagatctaatacagataaacgttncgaatggtggcgatagccgtcacatgtgaggagtagacttaactagtcactgacatgccccatgactttcatagcggacagtaggccctggtcnacagctacggccccattcttttccatgtcagctcctgtccattcatcncacaaccaatgtctctacacttgaatgaattggggtacgaagttttgcctcatccaccatatctcctgacctctcgccaaccaactaccacttcttcaagcatctcaacaactttgtgcagggaaaatgcttccacaaccagcaggatgcagaaaatgctttccaagagttggtcaaatcccaaagcatagatttttatgctacaggaataaacaaacatacttctctttggcaaaaatgtgttgactgtaatggttcctattttgattaataaaaacagatgaggctgaatataaattattttcaaaanntnnnntttnncttnnnnnnnttttncttttccc

SEQ ID NO: 9505 - DNA, 843 bp, Homo sapiens
ccagctgagacgactctcttaattttcaccgctacagagctggaatcccttccactcctcaccattatgcagatttgctttccgagatgccatcaaaacactggactctttctgtgctcagaggcaaggcttttccaattcttccacacacgtgtttcccagttgccttcctacagtatttacaagcgcataagggaatgactgggtgtgttcactctaagcttcctcagatccgggttgaaactctgactttattaagggcattacccgaacctatgtctcattaaccttttagaaaaagaataaaaggccaaaggctcatatctaccccatggggttgatggggggggttaaaaagagtccatgcacaccaaagaataagcaaacccgggggtgggactcagtaagggttaacaaaagggcctcctcgaggacccaaattttaaggggctgccaaaaagtgaccaacctcttcaagaagggttgaacaaatctggaccagatttgcgggaggcctgaatctttgattgtagaacaagggtgaaagaaactctataagagttctataccaaacaatttttttcaaaccaaagttggcatataagaaaaagaatgaaatcaagagtagtagaaggccacgccgtaaacaattaactaatagagcatgtttgaaaactgtgggtgataagcaagaaagagagttaccctcatgagagtcctgtgttcctccacccccgtgagcgatattaaagaagtagaagattttgtgtggttgagccaaaagagaacacgcgggcattttatgagataaatttggtagggaaatatatgatgagtggtggg

SEQ ID NO: 9506 - DNA, 368 bp, Homo sapiens
cacttccccactgactacagtaaggatgtaagaaacaccccatagagttgatacaatcaagtttccttctgccggaatgtcagcatctggaatggcaccaaaggatttgagaagaatgatgccaggacaccagattttcaaacaagcatctatcagccatgcggttgctctgaagtcacatggtcagcctgccatttggggtatcatagtttctgaataaacccaacctgaaggaaagcagaactgaaagatgcagagagaactgaggactgctgatactgttgaagcacctagaccaagccttctgaaagtcatcactacactagtcttaaaagccttaaattacctttgtttataataaacccgga

SEQ ID NO: 9507 - DNA, 556 bp, Homo sapiens
tctctaattatcaccgctacagagatgacacctctctatgttgtccagactggcctcaaactcctggactcaagagatcctccttactcagcctcctgagtagctaggactacaagcacccaccaccacacacacctgaccttggtacctgtttggtgttggactattgaactggatgaagataccaaagccgtgggaggagaagaatacattacagaatagtttaattcctttcatttctagtgaccgaaatgtaaaaactgtttcccactgcattttatgctaacactccctgatatatttccgctaatataaatatgcctgaaaggatgacatttaattatgttaataactgaatataaaatcaggggtcactacaagtttgttttgtttcatttcaactattttgctttgtatttactatgtagaagtcatcatttgagcagtatctgtatcccccattagattgaaagctccataaggacatatatgatgagtttcatatacatatttaggatctctaaaaatattttttgaataaatgaataaagaacga

SEQ ID NO: 9508 - DNA, 953 bp, Homo sapiens
  misc_feature (1)...(953): n = A,T,C or G
cggaggcctctaatttagagcccctttaataatttcctggtattttcgactagtgaacctgagagacgatcatcatggactgagagaggattcgatcgcgacactctccccgagcattagagaatagcgagctgttctttctctacttttattgggaaaataggaaacgtcgctacactattctgtagtcactttgtacatatccccttcgacatctctagtatctagtgcgtcacctcctctataacactcagacaaaatgatcgtacacgatagtagactgagtagagccggcgtacaactgtatactttcgaatgatatatatatatcacttagcgtacgtctctcagccgtttaacaccaccgtctaacaatggtacatgtgttataagtattgagttacactaaataactactaacactacggacatgatagtgcaatcttagggatgtcgccaccattcattcgattgtccttacttcacacggtcacttatatgtaaatgcgctatccaattcatagtattcacactgtcacaccactctcctaatttgggcaatcactattctgtttgtcttattgctctttatgccgtctattagatactgggatccatccgcgcgtttcgtgacgctgcatccatagtcacgtctactctctaagatctctttcgcgactcgctactgtatcgtgccaatattaatagcatatctgcgactgtaacattaccactcacacacacacttcttcattcatgcgcatcgtcggtagttgtaactctagtcatttatgaccacccgagtcatctgtctgtcctcgcgcgctacgaccgcgattatctgtctngtctctctcccactgtattaattcatataaaccgcgctactctcgcactgcgagacgactactgtaatcgcgataaactacataacctactgtgtcactgccact

SEQ ID NO: 9509 - DNA, 790 bp, Homo sapiens
tgacgctgggctgctgatatgtaacatctgctttcctgatgcagccaccattatcccaagcccttggacacgaggcagagaggaaagtcagcctagcccttgtggtctgttccaccaaatgagcccttgggtggtccctgtttaggctcagatgccccctgctttttgaaagatcattcggtttctctgaaacattatgtatataatctttgctccctaagctgtatgagctaacattatgttaactctaactataatataggagtcttaatagaagcgtaatcactttataaaaaacataagaatgactaacatcactattataatcaatactattacttcgacggaagctacttatacattgtatatgtgaatagtaaatgttgaagatacctatgcttagaaattttattttatagacactagtaaattataaagattatttacctatcatttattagtgtatgagcctatttcgtttattacccgcccatattagtgttatttttttttatgagttcgtaaatatctgatatatttacaatggaaattggatgttattgaaagtattttagatgtaagtgtccaataatcgttgtggtcatattgattatgtgaatgagtataatttaataatatagttagtaattcgtttctgatattcatattaaatacgtgcataatgtttttataattactttcatatcttaatttatcaaattagattgtaatatctttatttctcgataagaaattggtttgttaatcatatctcatgacatgcaccgct

SEQ ID NO: 9510 - DNA, 832 bp, Homo sapiens
  misc_feature (1)...(832): n = A,T,C or G
catagctgcaacgactctcttaatttccaccgctcagaaaaatttaatggtacctgtttctgagaccaaattatgatgtaagaaccaaaaaacagaacaaatcaaccaccaccacaacaaaaaaaaaaactggatcagcccaaggttttctggagagacaagatgctataaatggcattctttaggcaaaaggggaatactgatgggaaaatcactggataagggggctgaagacggctggcattgttttgattcaaaatcctttttcagcatgaaatttacagaaatggaggagaggcaacatgaacacaatatgacactcaattaaccacatgcgtcaatcaggagaaacccaatggattccactttgtcagcagcttggctcgccgtgtgtgggtggaagacaaagccttttcattaccagcactttctggaggcctccagtttccaggcatcacccagttcaattctgtagacctccactaatgtctcaggatgaaaatctaaaagagtacccaggacaaatacagttttttttacatgagaggctntcagccacttgactttaatgatcaggtcaccacttcaactttacttgtgtgaatgaattacaagcacattgacttcgagtcaggatctgggaccangctgcccaagttcatattattcaaccacctttatgtatgcaactatgggccagtttttaaatttaaatcttgtctgtgccctcaatttggcatctatgaaatggataataatactacctacctcacagtgtttatcttgaaaaggngaaaatttgaaagcaatgcatacaaccatccctcaagag

SEQ ID NO: 9511 - DNA, 664 bp, Homo sapiens
ggatgattccagcctatgatctgaagcagatttggaacaggatgcaaggtctatttattcaccgccttagtgtagcacatatggcgggttttttacatttaatttgttctggcctcaggtttgtcatctaataaagtgaaaaataaaccacccaccttcccagtgtttttctggaaaatgtgtaatttgtagccatgcatccaaccatccctcagggaagatgccacatactcccccaacttttgaaatatgggtgaagcctagttgctttctcccagagaatgcaataaagaaagaaaattttcttaactttccagtggagaaaaatgtaacaaacgttacctcagcaatgcgatcaaagttacacacagtgacatgcaatgttgacaatgtgtatccttaatatgatgcggtgagaatagcactttacctttgtagactaattcctaaaaactcataatcccagtctaattgcacacaaaaacaacagacaaatcctgactgagggacactttacagcacaacctgatcagtgctctttaaagatatcaaagtcatcaaaatcaagtcaagtccaagaagttgtcacagagaagccagagacatggtgtataaatgtaatatagtatcctggataggatcctggaaaaaaaaaaaaaaaaaa

SEQ ID NO: 9512 - DNA, 348 bp, Homo sapiens
atgctgtttttcaaaaccaagaacacagaggtagagacaagaactgctgacactcattcccagacatccttcaacttcaggaaaaaggaattgaactaagccagctgatgagtttgagaggaaaaactgcacacagcagttctcaggccttcaaacttggactgaattacagcactggctttcaagtttctccagcttgcagatggtaggtcacggaacttcttggcctccatcatcacaaaagactagagaggcttgcaacacaagctggaagatctaccacatcttgccgctgcccaagaccgcccctttatctttctatgcaagcttttactgaataaaacttga

SEQ ID NO: 9513 - DNA, 902 bp, Homo sapiens
cgaccatttttgacattccccatcatagtggccgacgcggttccccccaagcgggggatacatagccattcatattcagggtttccatttttgcaccaattgtcatatgcgacaccacctggcttcctgcgaatcccaaggccccagcaattgaaaaccttcttcaatgggcctttcacctgacagtggttccatttttaatcaagcctcgctttctatgtatgccaggccccagcccattatttcacgagttccacaaagctcatctctgtattgacactggttatcacccccatcatgaactcctttatataccgcctgaggaataaggaatttaagatgccttgaaaaaagcattcggcttaacgagctgcgccgaacagggaaggcttcctatattctggaattcatctccaaatacacagccagcctctgtgagaaggccatttgcctgtttgcattattgtagtaccgcatttatttaataattacttccaaatctatttttctccttcaggaaaaaaactgaggttgaggttaatagcataggtattgttgttggtgttgtaataccagtactttcttgtttttgtagatgagcacagctgtagttagtaaagcttaatgaattttcctcgcctttaaaattaccatgcacatttcagaaagcagcaaaacatgccagatcatttgagcttttaaagtccccaatcaattgcggtgtgttaaagtactaaatatttaaccatgtggcaaaatgagctccaggtgtccctgaagcaaaatgtgtctgggaaaagtaagggcatgagccttctgttttatacccatcgtaatgttctctgattgtcttgggtggatgccccctctgctttttccaaaataaaccccgatcggccgag

SEQ ID NO: 9514 - DNA, 1079 bp, Homo sapiens
  misc_feature (1)...(1079): n = A,T,C or G
atggtactggtcgttcctgtattttgcccgtttttgttcttacgttggcgttctgatcttttagcgggcgtgggacgatacgctagggcaaccgcgcacacatagcttcgtcactttgcgaggtnagttgagcgtatcgttgtgatttatgtgatttgggcgcgtgacgtacacagattccgcccgttgctaacataacccgcgaccgccgagctattctatttgtggtgggttgcagtttctaatctatgactagtcacatgtcgtatctcacattccccacatatattcgtatttctgttttttaaaataatatatctctacgctctaatatttattgttatgtcgtctcgtactttaatgttagtgtatcagtgattgacttatgcctccctcttacagttgtgtcacccgaccatttacgtgcccatcttcttgctcccccattggctgcgatgtcgcccttctactatttcgtgttatgttgtgcttatcatacacattattacctattgttgcacctcttcgatatattcatcatgctatccagttttcgtcttgttcccctccgtgtcctgggcgtttcgaattggctccggaccagttatttgatcgtgcatgcatctcgccggtgcgtgtacanttgttccgtttgcgatcatttcggcctatgaatgttatcacaatagcatgctanatatactactttcaattcatagctttatttatacgaagtgcgctctatcttgaggctcaatttcgcttcatcctacggatatattctcctacatgttcaaatctccaccatgctacaccttttcgtctgctttatttccaccccataggccaccccgttcttgtgcccccacctataattacatacgaattcacgctcgagtaccgaagaataccctcggtttgtattagtgttccttactagcgctatcactccagatgtttgcatcccgttgtctccatattgagccccatattgtcgttatcacagtgttcgtcctacaccaccgcatgtattttctttacgtcccaccacgtatcgtgtttggccagtatgtgcctat

SEQ ID NO: 9515 - DNA, 1422 bp, Homo sapiens
  misc_feature (1)...(1422): n = A,T,C or G
tctcctctctctaatcttgaagtctattgatttgaaggtatgattctgttactntgtgtgtagctttgtttatttagagaccgaacaccgaactggtcccgagaacgtgatccgacgagcgagtgaacgcggatgacagagagcgtgatacagatataattaaaccgatgacgatgactanatcggaattaatacaagagacagcgttagccgtaacccgctaccacaacaccgagatgcgagaaattatagcggcgggacgtctgacaggntataccgtagacgatacccgttagtaggccgaacaatcaatataggagtcgtcacggatcgccgtcgtgtgtctatatgtacatagtgatgtcggacatcctctatgcacgacgctcaaaccgacaccagcagnaagggagctggcgtggcgggtgactgtcgagacaggtgtcgtcgagcgagtatgtcttgtggttatgttcttggtctctcagacatttgaatagtagtgttagtgaagagagttcagaatcatttgagttaacacgcgcacaaagtggattcggatttgtcgaagcgacacaacctgtgccttacaataacgaacatgcgcacgatatacgtagttcaatctctttcgctcacccangtatcgnatcgtggtgcactctatgatcaatatgtgtctccagtcgccaaacatatgcacgctaatgaatcacccacccgtagacaccgaccgatatggcggtatggcgcgcgcgcaacataggcntatggatatcgtaggatggttgccctctatgtgccagggttgccttcctatgatcagatataacgagtcacaatattcacgtccggcgtgaatgtgtaattcgggtgcctatgctacgtacgtgctatgcctaaattgtagcctagtctctatatcaacgcttctgattatgcatgtgcattacgtcgcatccactaattcctagaagtgcacgtggtaacctcacctggtatgttctcgtgttagtattgtaatgcccgtggccattgtgtgtgantcanactcatacgtcacacancgatgtanccgtatccactatgtgacgacatcccaggttgttgtatccacaccacctattgtccacgccactattgatttgcnccagctcgacagtgttgtcgtatcacctatttatccacttgatatactcggcggtgcgcacatctgggatggtcgtgtgcagtgtattgtcacgccgcctcacnagaccgtgtagtgcacacctggtcctcacaagtttgtcacactacgcaaatattctattntncacatctggtggtcactatgnctntacctacacaccctgcagacgagtgtatgataaccccgcnccccactgtcgagatagaggaattcctgatgtaggcctttat

SEQ ID NO: 9516 - DNA, 1035 bp, Homo sapiens
  misc_feature (1)...(1035): n = A,T,C or G
ttatttataatgaatagttcacacaagaagagagggagatcttccatgtctccgtccaaacagttcttttaactgcagacgtaaattctggatttgccaaacgtgttcgacaggcaattcaagtgagaggcgcttacaagaaaacaaaccaacaagtggaacatgaaaagaaacatactgttaaatgaagttcaatgcatggttagaaaaattttcgaagaaatatttcagaaaggaaatgtgaggatacagtgacttcaataacacaagcacatatgagaattgaatcaagagatgctgtgggaaggggtcactcacatacccgttcaacaaaatatagattaaaaatctcttgaagagaacgaaccatacttaaaagactaaactcttacaccatagcttcttgttcagtagagcagtaagctcatgaagtctcctattattgatgtaacttgtagacagatgatagaacaaacgccttcttctcaataagcacgatatagcacgcgctagtctaatatgatagtaacagacatataggggtagaagagcgacacggtagacattacatcgtattatagatgatacactcaccgccgctcactgcgcgaatcttcttctacgttaagtggagatagctcgtgtcggcgcttaattttgcagagggcgggtcgtacgcacgtacgcgttagctggcctgacacgtcagtgatactgctctaggagtgtgctctccatatgtacgaaccatgttcttcagaacatagagctcgtctttcgtcgttaatagtgccgataacacccgcgtattgcttgatatagtgtanatgtactacaatggtatatactaatatcagactctcgtccatcgcacgcctagaatctcgcgcccgagttcatatatattaattagactgaaacattgtgtgctgatcgatgtatacatatgtgaataacgttcacttaaatattcttcaagacgtcccttggttcacataagtacagctataaattgtaagataaataccgcagcag

SEQ ID NO: 9517 - DNA, 479 bp, Homo sapiens
tgtcagatggtaagcctgaagagtgcagatggtaacagtctctagcgcattgtggggggcctgacaccacagattgtaatagcaggagctgtctccattgctagagaaacgtagccctggccttaaggtatcagaggtggcaagacctagaatagccccagtatgagtcaggctgccttctgcaggcagaaccccttgtgtgttgtatgaacacgatggatcggtttatgcgctggttgagaaatagattcatctgtagagtaagggggggcaagccagaacccagtgtgttgtcaaagttgcatgtatattgtaaactgtgcacttttaaggggagctcatattatccttatatggtgtgaatgacgcatgtagagtgtgcagtgcacagcactgtgcaaccgctagtttgctgccccatttttactgatatgaggtgaaataaaaatgcaaaggttctcaaaaaaaaaaaaaaaaaa

SEQ ID NO: 9518 - DNA, 1388 bp, Homo sapiens
  misc_feature (1)...(1388): n = A,T,C or G
gagcgaagagggggtaaacaatagagtcacgctttttttagtacgtgagaccggtggtgtggtgatgagtagcgttttgcttagaattagtatggaaccaacaatctacgagtgcgtgggtgtcaccgttttcgcagtcatatttgcgttttctgctcacatcgtcggctttctcttcccagtagagattaggcgttcatatggctggtctcccgtgtagcagtaaccacagccgtccctcatacgccgaagctacattggtgtcgtcgtcgatgtcttcgatcacaattgccaactatattagttacaccacctattcatgaacaacatcgacaacacaagacaaacgctgatgcatgtgtcgaatantatttatattgttcngtagtttcaactctgatcgatgtacatgactactaagtcttcatataattgaataataagtagatcatangacgttgagaatactcccatgccgatgttgagacctcccgcgcatccttctcgttgtagctgacacatcgtatagtcgcaccctccgtcgcgatgacgattcttgtgtcctccgcactctattccatctctttcgcagagtacatatccacanccgctatttccaaccatattatacacacatatgtactcaaattgacacagttcccaacagatatcgacacgcatgtgaccctacagatcccgcgcggccaatctcgtcattagtcccgtgccaccacagtcacatggaatcgaaagcataggaagcatctaatgtatcactagcatccgcaancacgagtctaattactacattcgatataacacancnaccactaatagtattactactaacgtataatctgtaactggcaccgtgttattacgtgcntnatctcttatcgtgtcactcgagttcttattctgtaccgtcctagatcacttagcgctgcagcgcctgcagacgccgcgtcaatcatcacctcagtcgtatatgctccantacattgtcacttgtgttactaccattgttatcacccactaaaggantatcatcacctttgtcgatatcctcgcntgtactaattacaccacgccgtcgtaccactcccgccttcgaattcacacctcctacgtatatgtcagatcatgatctcatacctcgtattatccgttgcttccacaccgtgactgtatcttctaagtctnccgtgtagcatcgacatcatgacacgtttgtgacctccttgttactctccatcttgcgctccagcctatattgtacatgtttcgcattctgttttccgcgtgacaacgatctacccaattgagtctgtacgctggtcactctacctantatgcntcgagttttgatcttgtgttgacnccntgtt

SEQ ID NO: 9519 - DNA, 1561 bp, Homo sapiens
  misc_feature (1)...(1561): n = A,T,C or G
gccctcctggccccgctggagtgtggttgttattggcgtcatgtgattgggacggcggagtagagagcggcatngatcggagtgctcgcgagttgtcgctgcggacgcgcgcagtgacgtgatatatggctgacgcgtgcagaaacggcagaataacaacattatacgtnntctcgtntgcgatcaacagccacaacacgacatcagtgacancatattaaattgcactactagacgctntgcgacgatattccgcgaccgcctgtctaacacgcgttacncgaanactattagtgcggcggtgtgaagcccgacggccagtaaccgataggcgacccgcgccgatagtcggatgatacacatacggcagcggcaccggccaantgcccagtgatngaagacatatggatacactgtagcgactgtcantacantcgctctgacatcgatgcgatccatcgacagcacacacgcgtaaaatgtgatagcacgcatgtgcgctgacacactgtccnantaatatatgcgcgccgctctcnatcaatacacgcgtcgctaatgtctgtcgctttagagatcataaatatctatatgcgccatcttgtagcagtagttaatctgtgtaatctcgtcagcgatattgattattgaccactgcgcaggactcatctggagtagtgtgacgataatgacacgtcgacgtggcgccattccacagattgccgattgagtgcactgacgcgaatacntatgagacacataatattgacncgtgcgtcagtcccgcgtacntagtggtcnacgnagcaccatgtattggtcctatgagtgtgttgttctcacntcatagtccttcgatatttccanatgtgcagcctgatgtctgggcacgctcatagtatatcgttacacattcgtcaccagncgcagtatcgcngatatcgccgccccgacacactagatacagtgcgaactgttggcatgtgtaggacgtgagtgagatgagcatgagaatagcgcgaaaatgttggagattataatggcgccccatgattgctgccagctaagcagtacgatagtactagtatctcggcctattctaatccacacatcgaataatcatacaattcacacgtcctatgtcattgagtccagctgatcctagcgaactgtcacactgctatgttgctcacgccagtgcctatgtgaaaccgtttcctcacctccacgttccgtccccaagtctcgtatcctccgatgcattgcagccacaccataatcacctaccgcatgcatttgccctcacacatataatagtcangctcggtatcgtactatcatgcgtatctagtgttctccacagtggagtgacatgtcattatccagtccgcgcacgcgcccgcctacgttcgctcctccgtgccgcaccntgtatgacacccgctcttctgatcttggtccgcagctagtgtgagccgcactcgaccccactctctagttgtgttttatagccgtcactctccctcttattatgaatcgttacttattatgtcgccatctg

SEQ ID NO: 9520 - DNA, 1108 bp, Homo sapiens
  misc_feature (1)...(1108): n = A,T,C or G
aggaaaacggaagtcggacggggtacaaaaggagaaagtcgtcggagatggagtacataacccgagttagagttttgagagaataaaaaagcacgggcaatcgcgatgcagatacagcacgtccagacgcccgatcgaatacagaccgacattacctactatcagcctaactgtcaaaacagagtaaggacatacacggggtgacgccgtagcagatccactcagcgccgcatagctgaaaacatatgagggtgcgtaagaaagagcatagatccctatcgcgccacatttcgatcactgtaacgaagaatgataccgcacggcgtgcgtccttgtatcatgcgcaggcggacgtgcgtgttgtgcgaagatatcttctatgagttgtttgcgcagtgatagcagtcttgtgttctatcctcattggatgggtggacgttggagatactactgtgctgccaatgacgaacttggcacgtatcgtgtgtcgcgagttgtcccacgctatgcaataatgtgtacctaataactgattgtcaatgcgacccagttgcaatcgatgtgactggccgtgggcgtgcgatcgcgaagcgggccgacatgctatatgttgtgggtgtgtccgcaacatcggcgacggatatgagcaccgtttggagcagtgagcgacctattgattcgtcaactctgaattcgtgccttgatcaaagactgaagcgcgcttgatactcatcctcgcggtcactagggcgtaggcaacctttactattagccaccagtcaacctgcgcacacaacctcattattgcacacgcaagagactggtggacattatgtatcccacgtaaggaccgaaagaagtggaatacggcggagttgtcagcgagacattggcgacactcgatacattgtccaaactgaataatgtntgtgcgtgggtgacacgagagaggtcggacggcaggggagacgttggatgtattcgctccgcacacatgggggcaccagagccctctgttccacaccatntagcagtcgttatgggtggcggcagaacacacatattgaagaagtgcacctacattatcgagatggtccgaggttccgat

SEQ ID NO: 9521 - DNA, 1232 bp, Homo sapiens
  misc_feature (1)...(1232): n = A,T,C or G
gtcgcaccgctgctagctgcagcagccgatgatagtatagcagcactcacatacggcgcgaacgaacgtataggcgacaggtacgggcgtctctggagtaccgagtaatgggcggcgtatcgcgatatctgtagagcggtcgtgtccgagtcgcgaccagcggaatcgtctcgaacgaccgaagtagatttagtgtgcagttagacgagaaatggagggcggtacgctgtagtgtggcacgaacggcaaaataattgggcggtccgcgacacacatagtcggcgaccccctgtgccggaagccagatgagaggcgcgcatgcgagtggtccaattgcacattttagtgcagcaatgtaacgagtgataatgacacaaataataatgagtggcagtgcggctttgtccatatgtcgttgacaaacnagatcgtattagtgtgcgccctctccacagttgtggcctctattgcgcacagcgtcgagctagcttggtgtgacaacgcacatcattgattgtccatataatagtcgataaaccatgtgagttagaactgtgactcttctatcacttttgcaactttgaaccctgactgtcacaccctcactagtccatccatgttgacctctcttgcagatatttacacctgccccgtcgatttgtcgcttgattcccaccgtcagcactgtccatatcggatatgccccgccgaaccaggctctttgttcgaggcatggtaccccggattatcgagcacagcaatggacaataataaacgatctatatgctcctaaagaaatatgtcattcctgactaggtatgtacatgcagggaaatagagcctatctaatccagactacgcgtgtcatgattccaccatccataacctgtaggcagctgacatctcaggtccccccgctttattgctcgctgttcatttgtgtcccactgcctccaacaccgtgacattaacccttgtcgttcccgtatttttctccacgacgttgccgcccgcggctatgcccaccccgcaatatgccaaactgtcactcaatgcttatagtcgaggcccctgagttgctatatatgtcatgccatacacgtcgacatgttcgcaccctgtcacactacttccgccacggtttgtatgttcactcgtgtgtccacgaccagctcccccattatgtttgttccgccctcccctcttttgatgttgcgacgtagggccctgtt

SEQ ID NO: 9522 - DNA, 1249 bp, Homo sapiens; identical to SEQ ID NO: 6299
  misc_feature (1)...(1249): n = A,T,C or G

SEQ ID NO: 9523 - DNA, 1271 bp, Homo sapiens
  misc_feature (1)...(1271): n = A,T,C or G
agttgtcgagagagctaagatctgcatatctgacngatagtcngtctcagacagataanactacagtgacgactgttgcagacgacgcaacgagagcggcagtgactcatagagtacgtatgttgagcgctgcggttgctgcgataatgtggaatggaggacagaactgagaaatgtgataagagcgataccagaacgtatccgaacaatgatagatataacagaacacatacagatacgccacaggcagtgtcgctgatagtgatcaatacancaggggatgcgcngacacaagcgcgcgtcgcgtacgtctgtcgtgtatagcgacatgcgtctcggacagacgagcatcataccattcaggtcgactgcgatggtcgagtgtggcaacgtaatgtcgtgagacctacatcaggacacgcacaaaacacttacaaagaaaaagggatgtagggtctgacccgcctccattggcgcgggcggacttgttcgtatgttgtgtcgataacaattatgcaatggtattggtaatgaaatatcatgacatattctgtacgcccactgcgcgtggcctggctgtgggctatagatttggtgcgctgttgagatggctagcattcattgagcaccagcagtaccccccacattgacctcaaaggaacacaatgtctatattcacacagacacctcataggtcagcatgttaccccacagtctgccgtccaatgcggtatgctcccccgcacntgaaattggaatagaagtgaagttgccacgctatagccttcatgcgacagccgcctttataagcgatcactacagatccgtagtatgtttgacgtgtgctagttgtctgtttcgtacactagcgcaatatactttttaccacgtgatggtacgttgagccatccatatccttgcgcgccgcagtaccatgcacacactacaggatgtagtcattacagtgacatgtgttatttaatgattcacgcacacggatatccactcagatctatccgccatgatggtccccatacgtaagcccccctatttattttaacatcaccagaatattaaacgtgtcgatcctggatcatatgtgatgccccatgttagatatgtattctctgccacggcaccctagtcgtgtggcactcacggtacctgttattgcacacgcgagttatcttttcgctattgtgcgttgtacaccacgtctgttggtttgtgagtcaccccatactgtgggtattagtctagtggtgctgatt

SEQ ID NO: 9524 - DNA, 1171 bp, Homo sapiens
  misc_feature (1)...(1171): n = A,T,C or G
cacctgctctcgccagtgatagtccgctgtactcgngcttttctggcgacgatcagngtgagatctctcatcgcttgcactctcagcgactcncgctnctcccgtcattacggagtagctactganacagatctcagacgtatcgttcgacgatcanctcaanatatacagtcctcgtctcntncgatgattactcgcctgcatgcgantatgcgcancangcgcatatagtcgacgtgtgatgtagcggtcgcgacgtcactcgcgtgcgacattctacgcaccatctgtgtcactcgctgtgtcagtcagtggtcattacgtccctagaccgtcgagtcgtcgcgtctggatcgacatgtagctatcgccatantacttgcngtgacgcacgctctgctcgcgtctccgtacntctcgtcctctaccactccttcagtcacttctgctcatcagccctgtcatacgttcccttatactgacgactgcggccggcgagcggtttgtcctatcgtatattcactcctcaatctctctctgcgcgcgatctctctcgggcatacactttgcactcaaccgtgccttgacaactcaccacagttaccacgctgtctctaccttgcacagattattcgccacacccgtaccgggctcgattattactggcgcgatctgctgcgcgttacgcgctcacgtcttcctactctcgcgctaaccaaacaccactcccatattgtttctccatactttttccacctatccttcaacttagtgcttagtatttgtcacttccgcatgtcgcatcacctcctaatctccgctgctctccgtcctaatgcttacgcccctgccttcgtaagcccggatttaacgcgcatgagggtctttgtggactccacgtaagacatgcgattcggcctcggggaaaccgtcgtgaacatctgttggtccccgccgctatagaaaagaattttccacgtagcgcagcgattgtcggtccatgacgcgtgcttcgcgggcaagcacgggctacttctcttgagcttctattgtcacctttggcaatttcgcgtgatgttctctatttcggtacgcataaaaatgtgttggattgacttctaccagcccataaagtcataattctgtatgtattcataaaaaaaaaaaaaaa

SEQ ID NO: 9525 - DNA, 824 bp, Homo sapiens
  misc_feature (1)...(824): n = A,T,C or G
cgttccgtgttcggcgttgttgggcgcgttttgcgtcctgctcttcggcttccctgttctcgctgcggtggtgttttcccttgggcctctgttggtgcctgttcgttgtttgtccgggtcgctgtgcggtcctgttactgtcgccgtgctgggtgggcggggttggcgccgttcgtgtgcgtgtcttgttgctctgctgcggcggttgtgtctcggtcttcgtcggttttcgcttgggcgtggtgggtgtgttctgtttggtttggtgcgtgtgcgtctgtttggggttgtgtgttggtgctcggtgtggctggcggggtgttctgggtgtctgctctgtcttctccgtggtgggtgtgtggtctcccctgttggggttctgcgttctttcttgtcttgggtgttcgggccccttgtgtgtgggtgcgctgcgggcttggtgttgcctggcgtgggggctcggggggccttgctggggtgcgtggccgttggcgtccgcttctgtttggttcttcgcttcttggcgttttgggggttttggtttgtctgggtgccttggcgttgcgtcgttggtgctgtgtcgctgttaaaaaatcctcctgtgcgtcttgtccgccttttcgtgttttcgcgctgggggcgctctcctgggcccgtggtcggcgttctctcgttcttgtttttgctgtgtttgtgtgtctctgtttgttgtttttcttggttttttgccgggttctgtttgctccttcgncatnattntggttcgcggccaggcgggggtgttgccccaactttttttcgtcgtggttgttcgtcggtttctt

SEQ ID NO: 9526 - DNA, 1765 bp, Homo sapiens
  misc_feature (1)...(1765): n = A,T,C or G
ctcgctcaagacacgacagtncacggcgactgatcngtgtgtntgcgagagtcagcagagtctacgantgagatcctnagtatacgcgctagcgtgagcttggcgggtcncggagagctacgacatacggctctgtctgtngaagntgcgacacaacgngcagaccgcgagcngaagacgagcagnacgctagctnacgcgcgtgatcgatgatcgagctcgaccgcgcgatcctactctgacagcctgcggatctagcnncatcacaanctctcagtcgcgcgctgtctcgcgcgtacgantagcacagagatatcacggcganagaccaagcacgcgcgcgncgatccgcgactacgcagnangagngatagccggaactcgcgncnagacgcgatagtagtactaatacaccgacgcgtccgacgacctactagtngngtgntcacttggtgttncttgcaatacgncgcacctctatntactcgcatgagctcactcattatcgcagtananatatagatactgtgacactgtgtgtaacgcggatgacantgcacctagaacacttctcngacgcaatagctacacatatgagtatgattatatgtgtgcganagcatgcactgacgacacttatactgaatagtcggtatcagnctgtcaatcgttcacacaaacgtaatcagtaagataagtgatccactacgcacatcactcatactaactagccactatacgtcgtaagcagtactacnaacgactggcgcacttgtangattactananctacacatgtnatctcttatatcaccacgttagatccgatccgcgcgagtctctactcactcccttcgttgcgcnnttacaatgatgttcgnctatcagatcctatctatattgccgacatggacactcgctgagtgtgtatgcgcatgattacncnannccgtncggcgctcagcgcnatatgtgcagatacgtcgtcgcaccgatagactggatcaatagataccattngggatggtactcacgcacatcatgcctacgcattgcgatacgangcacatattatactagagtcgaataaactggagcatcatcacatatgacaagacagcgcgacgcactagtgtcgtcgagcgcactacgactatactgctgagcnctatactcanactatatcgntanagnatgtagntctagcggagtatngtacgcggtcgcatatgaggctctgtcgccgactgtangactactngcgacgacactcacacacaacaatattatgaccanaacataatgataatcatgtatcnacaccgatctcgctaccctacactcctgtgctagctcagctaatggttcgtattccagactatattcgtcgtctcaccatctaacatgtgcgcncatacaactgttgcgnattagcgacacacctcnacncactgagtacnaatggtctctttcgcgtgatcatangacgagtgctagatggcagtgcgcncgatgcgtgttgcgacatatgtaatgtacancggtgcntagtgacatanagcgacagccaangtagagtcgacccancttgntgcncgcaccgcatanagccacgtgacancntagttggtactacgatcagctcgcttacgatgtgctcgncattgccacggctcacgcccagangatgatgtatatgtgtcgtctcgcntacactcatcgcatacancgttgcaagatntacattgctgtatctccantatct

SEQ ID NO: 9527 - DNA, 1420 bp, Homo sapiens
  misc_feature (1)...(1420): n = A,T,C or G
gataatgagggcggagtgaatgcataggncggtgtggtgaacggttgtttcggtgtgcgggcggcgtccgcgccccgggcctcctatccctcgcggccaccgggtaatggcacgcggtcgaacggagtgatatatgcagatcggaacgttactgtggacggtattagtccaattatcaggaagctgtggtatacggggtcatgagcgagggaacgggcaaaagcggggggtgtggctgtcgcgtatcgctcggcacgcgcgcgatgacgacttacatttcggtggcccgcgttgcgggggagtgaaacgccctcataacgcgttcatcatgtacgctagttacgacttaggcacataaggaaagagcggtgcgtggtgcggaaagaataagtataatgtgtgtggaatagctatgagtgtgtttatgtgtgctcgaggacataatatgtggtgacaatggtgatttgccattcgccaacttctacgataatgggatgcgaaccggcatacatgcggtagcggtgacagactgtgggaatcaggacgagatccaggtgcactctgcgtagctcgccgccagatttgctgacggtagtgctcgatcacatgtcacaccaatctatgattgcacctacgtggatgtactcacactatggccnatcatggatcacacagtgtactacaatgaatagtcacgtcatagaatcgcacaaccagacgccgccagaccnatatggcgatatgaccccgacgactaagacatacgtgttcgtagcagtgggtgcttagttagtgctaagttcgcgatagtgggaatattgacgaagttacttttgatgtcacatcacagtgattcaggcacgttattcatggacaaagcaagaactagaagcagtacagttctctctacaacatnagactatcacttcgtgtgtcgccgcgtgctatatgccatgatgtcgctgcatgttacttaggaacccgcgcctcagtcagagaaagtcacatcacatgtttacttggtgataattcaccacgagtgtcacacccatcgtgtgattcacaaccctagtgnacacttcgccccgtctggtatccaacctgcacgactgtgctagcctccgagtctgtgttgcgccgacacgccgatatgagccgtgtcgcgtgtccgatccatcaactgcaggcattggagtgaccactgtgggatgagtagtagatgtgtacggtggccagcacacacgatttgcacatgtgttggcgtcactgtggccacnccgtgctgtcngcgcgcncccgtttgtttgtgtcttagcacttgaggtgtgcatgcacccacctcacactgattgatgtgttctgtggtgcgcgcactccactacagtggggtagcgtttttcacagtgtgttgtaccgcttg

SEQ ID NO: 9528 - DNA, 1361 bp, Homo sapiens
  misc_feature (1)...(1361): n = A,T,C or G
ttgtttttccgtgtccagccgacctgtttcgcgtacgtagccgttcaccagttggcgcggatggattgggccggagtatcgtgcgcagcgcgcgacgtgagtaatcgctgtgcggtcaaacggcgcagacgatgagcggcgtcggaccggacgcactatgacataatnagcaccatacatacacccctcgcgttcgccgtacccggtctcaatacgaacgtatgcgatataatatggtctgtggacgttgatcgggaatagcactagctacactcncgtaggcaggaagacaatacagaatgttgaccaatccccattgggtgtanttgtnccactttctcagcgcacgtcattcaagcatccgccatcactccccgctcaacncantagtgcagaccngcgcgcgggacacaacanaaccatgtgtacatcagcaacaaacagcgcgctccttttcgcgtcgcatctnacttagtcgtctatgtctttagtgctctcgacatatgcactcgatgtgaagtcaccggccggcatggttgttgctggatgactgactggctcaatcccctgtcactgcacgtatcctgcacccgccccacatatccgacggtagagcgttgcagatcccgcccatgttgttcctataaatgaccacacattccacaatatgcacataaccgccaccgatagtgccgcatgaacaccgatcgatcggcccgcgcgataggccaatcgcgcgcgcgccantgatcactggtcgtgtcangggtgactcatcatcagtctcctgccctttgcctcatttacccgactcatataccggtccactaaaagctttactgtgaatcggcagcgtactgtctaggtaattacggtgatatatatagtccgcgtctctaggcatcctccgatgccgcccatccacttgtccatctagtccagctgaccttagtccgcctctctcacaaggtagatagcgcctgaccagtcagcacgagagtaccatcccgcactcaactccatctgcaccgcagcacaaagtcccgttctcccttagtttgttcctcaccctccatattgcatccacgtntacatgacncgctctcaccatcttatgtgcatatagtcgttctatcctctatatgtcgacgttattcacaccagtgttttcctatgctctatcacttaccgcggctccacgccctcagntgttgcgcccgcggtatcactctcatattgtccgccctctgtgttagcatgtgcgccttgcgtgttcccatcaccgtacactctcagtacntgttatatttgactccgctcgctagcanttccgggtttcgtgtcccattgtttcccacagt

SEQ ID NO: 9529 - DNA, 1184 bp, Homo sapiens
  misc_feature (1)...(1184): n = A,T,C or G
tgcgtctggtgtgtgtgtggtctgtccgctggtgacgtgcgctgttgcacctcgtcttcccttgtcccgctcgtttgccgcttgcctcctgtcttgccgcttgggtccgcgctctncgctcagctccggtgtgctcccggtgtgtcgttgtcttcgctgttggtgtagctcacgttgccgttcttctcgtcccgttgtgctcctcgtgcttcctgtctttcgtctttctgtgcgtggctgttcctccgtggcctatcttgggcgtggtggttccttgtgtgcgcggctgggccgctcctccggtcctttgcgcgtcgctcggtcctgtcgcggtccgggcgtttgtggcgcgcagtctcgtcgcctcgtgcgctggcttcgcctcaccgtgcgctcttcggttctttttttcttctngngtgtgtttacgtggccatgcctgtctcttctgcttcgtcttcttcctctcctcttgcgtggcgctctcgcctggcgtgaccttctgctgttttttctgtcctgctctcgcgttccttcctgttccgctcactgtcgcgttccggtcttccttcnttgtcgccgcgtcgtcggggcgcctcgcgcgttctcgcgttcgtcgctgcgtctctttgtgtctcttcctgcgcggccctggctcgtgcctgtgttcttgggggcgctcggcgtgtgccgtgctcgcccgctgtcgtgtccgcgcgggcgtggcgcgggcttcggtgtgcgtttgtgcgctgctgtgcatcgtgttccccggtccgcgtgtcgtgttgtcggtgccgctgtgtgggctttcgtccgtttatcgctttgcctctgtcgaaacatggtgtggcgtctgcgctgtgttgtgtgtccccgcttctggctcgtcctctcggttgttcccgtcgctcttcctcgccgggcgctctggcgtggtggttggcttcgctggtccgtgcgcctgtgcttcgtcgttgcttctcggtgccttcgcctgcttctgcccgcgctcttcctgctgccttttcgcgggctcgttctgctntctntctgtgggctctgctttgcccttttccgtnttccggctttcgcccggtcttagntcgtgtgtgtcgtttccccccgacggttctctttctttgtgtttgtcgtcggttgtgtcgtgggctgtggcgctccgc

SEQ ID NO: 9530 - DNA, 1643 bp, Homo sapiens
  misc_feature (1)...(1643): n = A,T,C or G
tgctactgtattctatcatcctagtaatctatatctgtatgttatgagcgcatagggtagttgccgtgttatcttgttntntctgtcgtgtcgttagttggtggtgtccccgacgcacccgcgattcgaccatctacactatagcgtnataggacagacgcgggcagctcggcgaagacagatgtgtcatagatgagcatgagtcaggggagagtctgtctacgtcgcgcagagagattacataacgaatcttgtcgcccgtattcgtgtagagagacggcaggtgtagcgaagtacaacacgcgcttcgcgcagtgctgatcgcagtaatgcatcgtgcgacacntcgacatcgacgaggtatacagatatgacagagcgccgaggcatatgagatggagtagtgaaatgtgnattgttatctgtgtctcataattgtacgtaacgncngcaaactacacagacagaactcaacatagtcgagatccgagttgagggtanattgttaagtcaatgagcagatagagtcaataacaaagtagtttaatgtgcttgatcagcagataatgcacatatatggatattantagtaagaagacacaagaggtaacanatcctgaacaaggcaatatacacggcgacatcgtgtggtgtcagtgcgacgcgtactgtgagagcactcaccggaagtccgaatgcgtaacgtcatntgcaatcgcacccttattagccaacgtaggccgcgcgttgcggtcgtccccaccacatgttagccctcacagcggttgcacctcncngcgcactcgatgtgcacacattgcagcagactatatatgcatgacgcatcgtactccgcaccgatgggtcgccggcncatatcgcgatatcgagncagcgcgatattcgatctttgcgnacgagaggcgctggtgcgaatgcgtagagtgcagtcgacaggcattagcatctctagtatacgcctacactatatgagaccttactgagttttgcttgatagtcggtgttagcgctgtcgccatcatgtctatgtcctagcgtgttcgtatttcataacgagcgaatcgatanantatanatcgatagcggtgcgtataccatatactcatgtagccaccgcgattcatacacgcgaggctacgctctcagacgtatatatatgtcaatccatgttcaatatggtggagtatagattacaattcagctaatatatggcatcgttcacacacgtgttatctttcgtgcctgtgctctgattcgcacacacactgtgtatgcgcatccacatcgtgctagtgtctctccacacacagcatatgtatntcctatgtgacagagtgtatatagatgtaaggtgaggagtgtagtgtcacancgtggctgtgtagagattagagtgtcctgtgtcgacnactgcttcgactgtacagtatctntggcagctcgcgttatccttcccgatgctatgtagagactctgcatatatntngtctgttgttcgcgagacgcgtntngctatcgtgcacnacgctagacgcctcactgtcgtgcgtgtgtatatgngtgacacattatctcaacaatggcgataatctntatatcattagtatgtgttagccattgtg

SEQ ID NO: 9531 - DNA, 1845 bp, Homo sapiens
  misc_feature (1)...(1845): n = A,T,C or G
gatctcatcacaccactgcagatatatgaacagaataaganntatncaaccacaacactaacaatagatacatantagagaaggatgagcggatgatgagcgaagagagctcaagtgtggtaagacataangttagagccgatcgtgccttctacatatcgcgctctctctgatgacgttgccgtgcgtatactcagtaaatgcnggagtatcggcactctggaacacgacgccgacgatcagatanaagtatgtatgcaagtatcagaagcgcacaccgcacccgngtccgcacgagatatcacgccgtagacagagtagcgngtcggagtangctgtgaatancaaaagcgcgcgcgtctgtgtncgcngcagtacgcgcnnganatgcctntccggcgcgaccgcgcgcactactacgcgcagagtagtnactaatgantctgcatgcgctccgtcgnactatgcagtgtgatatacgctcatatagcgtctctgatgangatnagtcgcntctcgacatatggtcgcgtatctcgcacatctacaatcacactagcactcagtctanantatgtgcaantcgtcagggtgtgcggtaatatatgtaccaactanatgatgcggtctgcatcacanctatacatcggcgccgacacatgagtcagtcgtctgttactacatcacaagagccagactaattcgtgtctcagtgcactcgctcagacatcacgcgctcgcgtattatgctacgatcgaccgttcgctcacanctctcggtcangtacagagtcgcnagacaggcgcacgtcaacagtcgagngcgcttttgtctanntgaccggctcatagctcaacacgcatttagacagttgtgtagtatactcgtgtatctgatcaacgcacacacantatatgccgcancntgatgtnctcgcacacaagtantccatngcagttaatgcacgatgntgtactcgacaccattcggcnagcgtgcaatgataacncagcnacnagtgaagcaccagntgccgatatcgccngtatntcgcctcgcacgnagtcantcgatctatnatggcgtcgatagtgcgatgtgtacgcccnacgtatgttggtcgtacactcacacaacacgctgcgacncaatatagtgncagatcctatgatcagtcgcttactgagtgtatagcgtctgtcatcgagantgcttgtagactgtatcgcgtctacagctaatccnagtgcgccgcataactatcactatcgccatcaatctatgatattgtgaagacagccgtatcacatgagtgcattgatgtgcactcgctacacatacatatcgaaccgaataccacatggttattatagtatacaccgctcattgacacattgtgttacactacnacanacactaacagcactacatgtgcttngatctacccgtgactacgtatcatgccttagtgtgtgttcacaccacgacccgatatagtctcgctcgcgtatactagcgtcgccacacacacagcactagatgtcngagttcgcagagtcatatnaggctggagttcgcgcgaagtgagtccacacgtgacggtgtgactcatgatatgancatttgancagatgacgaccgccaagttgtcgtagagcgcgcaacacagtatgcacacagcngtatgtgcgnctgctaccctgtatgctctntgctgtcnanctatgtgtnggtcaccgtactcgcctcgctcgcgacactntcgtgctgtnttgtcgcacagacacntccacacacctacgntcgtgagcntnagtgttcacatgntgtatgtacgcatantg

SEQ ID NO: 9532 - DNA, 447 bp, Homo sapiens
ccatgaccacctactatgaagaaagaaaagaaaacaaactattttgtgggacagagaaaagctgtaggagagaaagaaatgtggatattcctcacaaagatggaaaaaaagaaaaagcggattatctatgaggaaccaattggagcaacaggaactgtttttctggttcttgacagtgcaaaaggcagatgaccagacctgggtagtaatgactgtgtgcatcagcaagaatgtaaaatcctcagcctcatgaaaaattcccggagttcaagcttggcaagaaaataggggagagtcccttaagtgtgaggattatgatttatatatgcaacatagaaaaacaccatagtgctctctcatgagtgtgtgtgtgtgagagaaatgacataaaaactatagaatggagagcatactgcctgaaagttttaactactcaataaatcttga

SEQ ID NO: 9533 - DNA, 1473 bp, Homo sapiens
  misc_feature (1)...(1473): n = A,T,C or G
cctcacacgacgcacacgagctcacctcatcaacgagacacangcatacgaccagcangcggacacccgagancncgtgaactggcgtagcncgtgaccgccttcgtgtcttctgtacgttgagtgtgttcgctantatcgaaactattatacgtcatctgtntgcgcctctacagtacgtcacggatacngtctctccnatctacgccgtcgcangngttanaactgcgtgtcatgaacgctactcagctcagcgtgatgctacgcgacgagacgactatgatgcgcacagtatcgtacaccaacgctctntnactgacgcagtcacatgtaggctcacctganctgcctcgcaggctagatgntcaccacctcactcacatcgaacacgtgctcaacacacgccacgcgtcgcggcgcgcgatggcggcgtttcacgcttctgtaccaccttcacaccagctnttaccctacccatgacacactacaccgcaacactctgcacgaccacgatgatagattcgtgggngctctcgcactccacacgtccacgtcttcatctgcgacatcgtgggtcgctctcagcgatacactatacaccataaacgccactatggtgcacattataatgctcgcagcacactctgacacgactatgcgtacgcacctgcggctctatcttgtcgcgatgacatnatttattattactctgattctagcccgcgtctcaagacaacatcatcgcactaggctctgacctctctttctctcgtgctctntctctctgcctggtttgctctcctctcgtctcaccgcggccgcgcgctcgcgcgcacacacgagagtaccgactccgtcgctgtncantgtcagacattattaaatccatcaataatatatttctcactaaatctatatataaaatccactccatttcgacccatcacttattttctttttcttctttactcctatctattttntntcatattctatttactcacacattcaactcatctacacatcgcgactgtctaatctcttaacctctctatatttcttttatatatctatattntacttgcttatttatttgacgttatttataatgatatattaactctctttacatcttcatctccatcacattcactctctcactnttaantttnagttccctcgcgctcgtcatacaacnaagtcacgtctcaacatcgactcgaccacccttgctgatcgttcacatnttnttntatttntattttccgcctcgccccaccccctcgcctatnnntntnncccttctacncnctnnnnncntcncgccncnccccccccacnccccggnccggccgacgcccgccnnncncccnccccccnnnncacacccccccccncccccccgcccnccccnnctcccnnccnaccctcnncgtnntnnnnnnnnannnnaattaaannnnnaattaaaag

SEQ ID NO: 9534 - DNA, 609 bp, Homo sapiens
tgagatgaacccggtacctcagatggaaatgcagaaatcaccgtcttctgcgtcgctcgcgctgggagctgtagaccggagctgttcctattcggccatcttggctcctccacaactgaatatggaggactctgaggcccagcctggtagaacaacaatgtagaaaaagcacagatgccctaaatcatcaagcggatgaaggatgccaatcaagaaccctcacactggggtttttcatgagcaagaaacaaactttcctatttttcagtctctttaattttttccttagaacagctagtattatcctaaataatgctagcagagcaatacaaatctcacataaaaactaccttttgcatacaagtccacatgctacttcctagtctcactgtttgaagtatatttacctaccttatgtggttcgtcggcccattgtgctataaacttgattgatcaacatgctactctcagattgtaattaattaacaaatccacacaaaaagttgtaaaggtgacatggggatgaataccgaagggagaggaggacttgaggcctgcaggtctcaaaaatctttagctaatattcgagaaaaggaaaataaatcgcga

SEQ ID NO: 9535 - DNA, 874 bp, Homo sapiens
ctctcttatttaccaccgctacagacacagtgactcatttgcctaatctatcacttaaccaatctgggagggggggatcacttaatcctatgattttactaccagaccttgacaacatggcataaaccccttttatacaaaaattaaccatgcttggggcgctgcacctataatcacagctactcaggaggcagaggcgcgggactcaattctccccatgatggagggggctccaaagacccatgattgtcccaccacactccagcctagatgacctagtgagaacttgactaaaaaaccgctttccatcctgcaacaacagacatcacactacgctaacatacatttaacatttttccagattataaaaccgtccaactcgatcccggagttcaatctgcctcagaggttatacatagcaggcggaaataccttgtcttttcaggggtcgcggcctgttccgtttcattagagataatcctcctccctgccacactgactgcgtcacccctggctcccggcactttgagacgcttacctttcctataaggggttttacagatttcaaccatccttggtgacatgccgaaaacttatctttctccaaatgcccaaaatggctcagaagcccaaaaaggccggaagtccgtgttttcaaaagcccccccccttgaagtgtttccccagttgacgttgttcataagtgcgagaccctccgctgtcttagtctccacggctggccctgtggttctcctcatgccacacgtttcagccctgtcttacccgttacctgtcctttttctacttggaaagcgtggctgttttacgttcgcggtggatttagaggaggaacgggcgcttctccggctggcgt

SEQ ID NO: 9536 - DNA, 1005 bp, Homo sapiens
  misc_feature (1)...(1005): n = A,T,C or G
gtttttnnaaaaatgggnagnnaatnnagaaaaaaggtgaggaagaatggangagtatnttgtattattataaatttatnananatataaaattatttatattctctgtgatagtagactgcgcgttgataaatgtggagtggtgcatatgttagttttgggagatagaaatgagacatgtagtgattaacatatcaatacaggttaagtcaactgttgctcccgcgtttccgttttatgtctgagccgttatgctccgcttcgtaatattagcatcgtagagatgactggtcatgcgtattgttgaataggtgatattatggcagttgaaagaagnaccacgaactgnacaagtaacgattataagtgtatgcaatcatacagcgaccgtaggcgcgctggcgagccgcttgcgtgcgcacccgcgcgcttcgcgggcgcgcaacacaccttcacggaaggcccttttcctcgtctttcccttcatccctcctcccccctgcccactccccccaccctcctctcttcgcttgctccccgccctccgctcaaccgccccacttgagacgcgttcgccaccgtctctgcatgagtgtggtcggtaatctcttcgcgtcggcagagcacgtgcttaggtgatacacgactgtaccacttagcaggtgagttagtgacgatgctcgttgacggatggggtgacgtgagcgtgatgagtgcttcttgacacgcgcgccacgcgcgggcatgcgtgctggttggccctattccgcaccgccgctgagtgttgtgtcggcttgcacgaccgctcgttcgcgctgatggttgtcccgcgcgttatttcacatgacgttggatcgtatgccgacctctcgcgtagagcgtaacggcgccgaacctaccgtgcgcgtgttgccgcctcatgtctgtgtgaccgatatgggcnaccgatcgtctagtgggcgctgcgctcgggcggtggtcggaggcttgtgcgcgtgcgcaccg

SEQ ID NO: 9537 - DNA, 869 bp, Homo sapiens
atttacttcattgggatcactaggacacgggcggcctcacttgcattctgtgtccacgacattaggaggatagcggcatagggcaacttcaaatggatatcatcttcaactaacatggttaatggcctaaaactcactacaaagagaattgtccagagcggtcaaaatagagtcaaacttgaagacgatggccggtcaaagtcctgtggggataactggtaaggagcagctgctgctcttggataacatgtacttgaacgctcgcacttaacacagatgctgaactataacacgcaccatttgacgattaacaggaacattcttgtgaatatttcatacgaactcgactttcagtataattggacctaaggtgtttataaacagctcatcggagcctctattggtcatagactgttgagttgattgctgggaccacataaccagaccatgtgtttttagactgtaagacagacgctaatctctgtatgcactctgcttctttatcaaacgtactccatggagagtcttgactctctagtgtaggacaaggttcgacactaacagcagcttggacctgctattccttgtgtacgacatgagagcccgatcatccgcctgctgtgaatgaacattaccgggacgattcttcgacaaaaatattctcatcgtttctcaggttaggaagcggagatctaatatcttagtggcgtccgtttatgggtaatagaattaaagatgttactacctcgcaagagtgctggcgcttagaattacgcactgggccatatgccatgtactctactgttacagatataactgggaacagggtttttcatttctttaacaaaaaaaagaatattgcgtgcggc

SEQ ID NO: 9538 - DNA, 1893 bp, Homo sapiens
  misc_feature (1)...(1893): n = A,T,C or G
agagggaaggagnnaagaantagatnggngnanntaaganagngagatanagtaagtnagagtagnaagaagtagatanagataaangtatgagtatgtattagtagaggtagtagaatacagaaatgatggagctnatgcgttntgatatatngannagtaagtccnanatnagtantatttagagacnttttcgnacgancaacataagatatagtgttagatagtagacnagtgctaatnagaagagtgctgtgtagacgatgataatgataatagtcagagtatatngttnggtctttttgtnacanacatagagagacaagtgatagtgcagatntacacactcgagaagacgtcgngtgngncacgagatacagtagacaatcacatcgncgcatcggtatacacttcatcgtcgtgttcaccnacgacagacnacacaacancnanactcgcnacacggcagcgcatnancagacgancagagcgaacacctntcgtcagtcatagacgaacngcgctgacgagaagantgaactcagcacgacgaaccnaganaggagcganagcacatanactatgcaganacgactgnaatagagcgataagagactacacacacaccanagatatcatagnatncgatgnantacaacagnanctatntagactgcanacacncagcncacgagatcngacnacacgactaatataacagtcanactacgcggtctatcggtcncgcagtgacgaagctgcggntatcgacgcgtagcgacagctgacacacagtgnnctncactcatntccgactcgcgctgtggccagcgacagagagtcgcgagcaactcacgaggcaagagacaagacgagagncgcgacgcacgacgccagtnatcacgcatcnnccnatcnagagtgcgacggcatacgcgcancgcacgcagacagagcctagccgcgccagngcgcacgtcagtaccactacatccaatctctacccactctccacncacatcgtagcaggaagncgcatcatcaccatcatctcacacgcgcactcgctcatcgtctcactccggcggagcgagctcacgcacgatcgcacctcgtcngcgacgcagtagcgctgcgcgcggcacgtcgcagcgcgacggtacctctaggacacatatctggcactgacgagtgnntggtcctcgtctcacgacaaactagaactagtactacgagccgccgcaacnacgtgtgacaagatctctnacacacgactgtcgnacgtcgtgtaagtagcgatatatcgtacgcacgacacgcgaagtgnatgagagacgtacggcagtagtccgacagtgcgacagtatgcgcagagatcgatgagtcactgcggcgcagcagccgaacctcgactctacgcacgcgtacgtcagcagctactctgagtcgcacgaaggagatctacacacatncacgctcgcgtcgagaacatgcatcgccacctagacgcgacacggcgccctagagctacgcagagattcgtcacagcagagagccgccgcacggcggcaccagccatgacggagcgatcacacgtanagcatacggaccnaccgcgatcgcacgcgatacagcgaactcgacagacgcgcnacgtactgatacgcacnacggtcatcagcaatgactacatggtcacatcgaggctgagagcgtcacacacgcgacgaagcgcagacgacagctcaatgtacgtaatataagacgtctgttctagcgcgcganagtacactaccatcagcacgcatatagatctgcncacagccgagcgtcccacgccgacgcgacaggccacgtagacacgaatgcagatatcagctcngcaggctccag

SEQ ID NO: 9539 - DNA, 313 bp, Homo sapiens
  misc_feature (1)...(313): n = A,T,C or G
ttctagaggctgagaagtccaagatcaaggcaccaccanagcgagagtggtggtgaacacccactttctcatanatggtaccttcttcctgtgtcttcacatggtggaagagagaaaaaagcttctttgggcatttttctttttaaaggcactaatcccattcacgagggcagagcctcccaaaggcctcatctcttagtggggtggcgttagggattaggatttaacatatgaattttgaaaacattcagaccacagcacggtttttgactgaaaagaagaggtaatgagatgaaagagtaataaatacaga

SEQ ID NO: 9540 - DNA, 413 bp, Homo sapiens
  misc_feature (1)...(413): n = A,T,C or G
tggcggcccatctggcatatccactgtgaagatnccngctggactgggggaagagtggccagcgctgcatcctccatggagtcagtgggagctgggaacagggccagcccatgactgcccatagaacattcagcacatacatcctcccttctgagcccataaagaccacagactcatacgagacttgggcagatgtcggggggggctgcctgccgatagtagctacccactccgggtttcctctctgctgagggctgcagactcgacaggatgacctgcctggggaaaggagctccctacctcaggtcttctctccattgaggactgcagacacgatgggacaacctgcctgtggaaaggagctacccactctggatctcgggaaagctgttctgttgctcaataaagcacga

SEQ ID NO: 9541 - DNA, 662 bp, Homo sapiens
  misc_feature (1)...(662): n = A,T,C or G
tggcgggcatgagccaccgtgcccagccacatttttcatatttttttttagaggaggttactgagtcctatagaagttacagaagtagctcaaggttgtaaacctgagcttgtaagtggcaggccaggattcagacacagctctgtttgactggaagcctaatctcttaacaactctgctgttttacaacaactctgtgttccccgctgaccattattaatattttggtgtttggcctttcagtttattttatgtgtatacgtatgtgtgttttctaaatgtatatgtagttttttgaacaaaattcggatcgtgttgggtataatggtttgtatcctactttttaacctaatggtacagtggaagcattttccgcatcttatataggattcaaaagtatgattttcaatggctacataatagtccatcatatgctntaccatagctgaacaacaaatcctcttgtggtggactccactttgataaaagtctaaaaatgtagtttgtacaccattctgaaggcagttggaatatattggactgacaaactctaccttatatcctggtctaggactatcaagggataacaatttgggcaaggtttgaaaanannaccacagaggagaagcggagacgagatgaagagaaaaaaccgggcgcgg

SEQ ID NO: 9542 - DNA, 497 bp, Homo sapiens
tatttcatttcccaatactgaagacagtggaggcattttggacctaagaaccagtgtttcggaagatggcatttaccctacaatggccgtgcccaaggtaaactctgggctttgggctgcatggccccaatccagagaacagagggactattcctggctccttcctgagctgctctaacatcctgccctattgagcccaggtaggcttcatttacaagaagaggccgcgttagctcctggctcatgtggagttaaatagagatgagatgtaccactttttttctaacagcacaaaactccttcctgaagagtcaccttgaagagagatggtttcttgtgcagaatcgcactctgggcaattaagcccgaaaactctgagtttatatgctgtgcgttttcattgactgactctgtggcttttgggagaattacatttcctctgtgatattgtaaaatcgaagaaggctcacatcttctctagggaatagacccggatg

SEQ ID NO: 9543 - DNA, 857 bp, Homo sapiens
tttcctgccccttcgccacaggtacaggcttctgaaccctcagtgcaggtgactacaagggtcatatcactgctgagcaaaagctcttcaggctccaggaaaaccaggcttatgttgctttagatgttttgatcatcactttgctagaaagattctttaaaatccacaattccagatgcagaattctgctgttttgtagtctgcatcagccagctagaatccttcaaggttctcaaatgtatttagaaatattgaagaacttaccttggcattaccaaaattagcatcctcctgatggttatgaagaaagaatgagataacgtacatcaggaacaacacgagaccctgtgaaagcaaagaatgggaggactcatcagttccagtatcttgtatcagcgagaacttgccagaggaaaacatttaagttggcatgtaaaatttaaggagattctcaccagggatgacataggagaaacagatacccatcaagaaaacaccatgtgtcaaaatatgtaatgggggtaggaacttggaactatgaaattaaatcagaaatattactattagcagaggggaaaggggtaaaagaaacgggaatgtaggatcctgaacgctttcttgttttggctctggttgttggccacttctcttacctctttacactggagcatacaagatagaatcctctaagagtagaatcattattaaatgatggcttttagataggaagatatgaggggggctttttactggggaattcataaccgggatgcggccgttcctttagggggggtaatcgagacctggtcactgctcctggctcggctgcgctgcgggacggatacgttcttcagggg

SEQ ID NO: 9544 - DNA, 918 bp, Homo sapiens
  misc_feature (1)...(918): n = A,T,C or G
tctctatgaaccaccgctacagacaccctttccagtctctggtatccatccattaactttctacgggcatgagatcaacgtttttagctcccatatgcaccagtgaaaggtcacaagaggacatagctagaaggcagccagccatctgcaggccaggaagagaccaaccagaaaacaaccagaccggcaccttgatttcagagttcagattccagaactgtganagagtaaatttctgttgtttaggccaaaaaaaaaacaatataaagaggggggaaggcgggcgggataggacggggggcgggcgcgcgcattcggggcgtggggcgtgtggcggcttggcggtccttagtgtaggggtggggccggggggggtggggggttgcgagcttgtggtggtggggaggcgggttatctcacataatggggtggggagaggacgggatgggccgacagcagacgcacgcaaattatgatgtatggcggggaggggcggctgggattgcagacaaggaggggtgtctgctcgggccgtaagtatgtactgatagaggcagggagatgtgcgcaacgacggaatatgggcgcgggtgggggcgagcgtaagagggggcggagcatgcgtgggatggagatcgggtaggttcggggtgcggtcgggggtggggggccgtgtaggtaggggagtagcgcgccggttgccgcgggtgatggtgcgggagggatgtggtggagagttgagaggtgtgagggggacggcgggtcaggatggggagggggggagggcggagggtaggcgcggtgggcggggggtagtgggggggctgattggaggaggtcggctgggcggcctcggtgggtgacgggcgtggccgttgggtgagtgcaagaggtgggggcaggaccgtagggggagtg

SEQ ID NO: 9545 - DNA, 866 bp, Homo sapiens
  misc_feature (1)...(866): n = A,T,C or G
cttccaggcaggctgcagtagcccggagcgccttatggatattaactccctcaaccctgacggcaagcccagtggggagggtgcacttcccttcaagtcttacaggtggagtctcgctctgtcgcccaggctggagtgcagtggcgcgatctcggctcactgcaagctctgcctcccgggatcacacctatttcctgcctcaggctgggggggganctgggactacaggcgcccgccaccacacccggctattttgtatttttagaagagacaggggttacaccgagttgaccatgacggccttgatctcctgacccggtattcgcaccagtaggtctcacaaagagctaggataacaggcgcgagccacccttgccggccgcatgtttgcttatcttaaccagaaagagccctgttggacacatttactggattaccataacgaaaaaaaagtactcttacaccatgagtgtgcaggcagtggaacaaccacaacccatcccttgtcttggcaaagagcgcatcttgcaccccaatgaccttagtttccctccctgtaccaaccacggcttctccgaggaccgtctttgagctctcgggcccggcgcccagtgtccagtcaaggggagcgcgccggttcggtttcgggtcgtgtacgctggtacactctactctactctgaaaggcatcacgtggctggcaaggggacagcctcatcacctggccgcatgttccgcgtcagtgtttggataagccgaggggaggtttgtgcgtcaggcgttgagcgcgagcactgccccaccgactgttctaaattatctcagcatcgcgccagtcgggttacagctactctaggcgtgtcgagg

SEQ ID NO: 9546 - DNA, 1095 bp, Homo sapiens
  misc_feature (1)...(1095): n = A,T,C or G
aaaaaaaanttatnatagnagttaagaagaagagaaaaggagagagntgaatagaagttgggaaggaattttaaaaataaaaactcgggaatactttaatataaaggaaaagaagagagagagagaggaagacgggatatagacaaatggaccattttactagaacaagacgaagatgtgngcgtcggatcgcaacaacccactatctagacactcctataccgatacccagncacaccacaacganatacccactgctccccggcggacccaggagacagacacagaagagagacggaagccagatacaaagcccgcgcaatgaacatataacatgacanagatatgagccacaataaccacacgaaccaactacacaccgttataaggcctccgacccgccgaaggaggcgtctagctacggcgagctaccaatcccacacggccgacgattgagcatcagtcgaaccagcggtagcgcgaccaccactagaaaatagccacccccataaattatatctaatccttgtaccagacacataaaagagaggagcgaggggaagggaaaggcgggggaggaaaagccaggaacgagaggaacccaacaaagtaccacgtgaccggagccaataacaaacgcgcgaggtacagctcgtaccgctcagccaacgcaaccagggcagatagcgccaaccgcactattcacgaggagatactgcgtaacacccgagagtacaccggtcacggcgaaggagcgctcagaagagaacgaatggaacgcgcggcggaaacagatgcgcgacggagacgcccgctacaacnccacagccatcggaaaaatcgaagacaggcaagcacgtcgagcccgcacagaccggcgccccccctgcagattatcactgaaaagacaccacacaccaccgcgcacacaaagaccgcactgattagcaccacagagagtgtaaataatcgctgtccaacaacagatcggtcagcaaagtgccgtacgacctaccgaccggcggcgaccgccgagggcaaagaaacaaacaagcaccgacactaatagccaaccgtgcaaagacacgcccacct

SEQ ID NO: 9547 - DNA, 802 bp, Homo sapiens
  misc_feature (1)...(802): n = A,T,C or G
aggagaggacattgaagcaaggagacactttctgaacctctgttgccaaccgagaagagttagcctaagattgaagaagtgcatatctgaggtcaaggacaaggcgggcagtgctcaatgtcatcctttagaacagagggcaggaatcccatctggagagtggaggcaactgaaagagaggaacaagcagcaggagctaatggaccataagagggaaatttgttgtttaaacaatgattatcttttatatttggctaacatgaaaaggggaaagtacactttttctgtcacaccgcatgagaagatcctctgggagcctccatgggattcctatgaatatgcacagtgcaattgcatttttctcaacatgaaagaattcaaatagtctggaaacttgccaactttaattctgacacatctcgagattagaatgtcaatgtaaatgaagaagcagagttgcgccttggtgctactgctttgggatcagagactggaagatgtcaagcagacagagctgtaaatgatcaagcacggagtttcgctcttgttacccaggctggaatgcaatggcatgatctcagctcaccgcgacctccacttcccaagttcaagcgattctcctgtctcagcctcccgagtagcngggattacaggtgcccaccaccacgctcggctaatttagtatttttagtagagactgggtttctccatgttggtcaggctggccttgaactcctgacctaaggtgatcttgctgcctcagcctcccaagtgctggtattacaggcgtgagccactggcc

SEQ ID NO: 9548 - DNA, 797 bp, Homo sapiens
cagcagtcaacttttgtctgtggaaaacaactttggcttcattgagaaaaggatatagaaagcaggaggatatacctgtcttcaagcaccagctggtcatcacatgcatgcctgtaccaccaaggagggcactcataggtctcctgccttaccactaaccttttacatgagcacctagtagaggccagtgggaaaaagctgataatcatatccacaaaaaacatttgagatgcctatccaagtcctgatttcttctctgaagtctgcttcccacctagaaagaccggcatgacttgaactaaggaaaaggcagtgctttcctggccaacaagtttgtcattcaattgtctggctaatgagtcagcatgctaaatgaggggtccttcacacacagatacatactttttcaagattttttctcctacttctcggaaatccaagggttccttgtatgtagtgcagcccgctccagacacactagtatccacttcatgattttctggttgctgatcagcacaatacttcgatccccagtaacacatttctccactgtacatcatagccagcagatgaatgtcactaaatattcctgggaaagtcatttaggttgacagattagaattaacagcttaaaaagaaaccgtaattattaactaaactctaattaaagctccttttggcattaagcattttctattctcactttaacagtaacacaaaagccaatatgacatacacaatcttcattaagtagcatttttaatatcgattttactgaaaggaggccatacaaaaga

SEQ ID NO: 9549 - DNA, 974 bp, Homo sapiens
agggggagtgtatggagggtgttgtggagaggggcataatgcgtagatagggggtaaagaaaaactaatgatattagagggggaagatatgtgtgtggcggtgtgggttttgtagagaaatgttgggcggtggagtgattgaatgggatgggagacggggagggtattgtggaggagagcgaagttcgggatttgttgggaggtggtttgggtatgtggtgcgataatacgtttatggagtgctgtgggtgtaagagtaagtaaagatgaaggtgggaggggatgggaagatacataatgagtgttatggagtggggcgtgagaagtatagatagtatgaggagggtgatgattattggcagtagatggatgtaagttggagtgaaagtgtaagtggagatatctgagagggtaggggtaggggtgggttaggagggggtaggagttatggggaggaatagagggggatgtgaagggagaaattaggggggggagagggggggataaatttattaggtaataagagggggggatgtttggaaggaggggttgggtttttcaagaaataaaatagaattttggggaggaatttttaaggagaggggggaatggttttttattagggggtagttttgtcgatttgtgtaaataggggggggaggtatggtaaggccccccccgagaatattaatttggggagaaagatgaaataaagttagaaaagaaagagatgtggggtataaatttagtgggttgggtgtttttggggaaggtgatagaaggtttttgaatgtgaggttttaaatctgaaaaataaggagtttgtttttttgtcccccatttcccaattttgtaaagaaaataaaagaaataaaaatgtaggttttaggagttattgaagaaaaaataaaagaggatgggtgggaggtttttttgttttttgtggtgttgttatttggtgtgagagtggtgga

SEQ ID NO: 9550 - DNA, 626 bp, Homo sapiens
ctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgctgtgtgacttcaggcaagccactttacctctctggaacagttttttcttctggaaaatgaaagttgaaatcatacctacctcataaggttgttctgagaattcactggagatgctctgtggaaataaagcaaga

SEQ ID NO: 9551 - DNA, 281 bp, Homo sapiens
ctttagataataactctttcaaccaattgccaatcagaaaagctttgaatccacctgtgacttgaaagcacctgcttccagttgtcctacctttccagcctgaaccaatgtacatcttacattggttgatgtcttctgtcaccgtaaaatgtataaaaccaagttgtggcccaaccgtgatgggtacatggtctcaggatctcctgaagtctgtgtcacaggacactggtcacttgtatttggttcataataaatcttttcaaatattaaaaaaaaaaaaa

SEQ ID NO: 9552 - DNA, 767 bp, Homo sapiens
  misc_feature (1)...(767): n = A,T,C or G
acaacttagtgccctgaagaagaagaaggataatggtttgcaatcaatgctcatggacaagacacctaatctgaacttaaccaaaaagtcaatatttaactgtaccttatcagtgtggaaatgtcaagcatagcaagagacaacgaacaaatttccaagtgatttctctttttttatgttttggtgttcacagctatgtggaagtgtttcaacatcagataagacaaaatggcctttgggagaaaaaaaaagacagcaaattacaatacttgcacttgccgaaaccacagtttatgagaggaaagcagacactggatatgcattctattctctcctagcacattccctggttcaccttcctgcctgtgtgatgctagcccttgattgtttcccacagctggcagcctttaagagacagatatgttgaaatgtctccttgctgagtaaagtcactatctgttgccacccaacacaattgacacaaattatttgcactctaaatttccatgcctaggagtagatacataaagcatgactaggaggactgtgggtctgcaaaacaggagctccacctgaatttcctggaagttatggccagttaatgtagagaaagaggttttcaaaatttggagaacttcangacctttgtcaaaattccatcttgctccacaggactccagctaacctcacccacataactggtggttgaaaggtttatttttgttaggaaataattgttacaactggaataacctatgctggtactt

SEQ ID NO: 9553 - DNA, 1544 bp, Homo sapiens
  misc_feature (1)...(1544): n = A,T,C or G
cccgccgaactcgtcacctcgtgcgcgcttcgcgcgtgagtnacattctcacacgcgcgttcacatgtgctgtccacagaccatacacacagcatactccgcggggcgtcgtccacgctcactatcaatatgcgacatcagngttacactgtcaccaacatcatctcgtgtcccgtagtcacgttcaccgcactacgccgcgagcggacacgcgacgcanaacgacccgagttactgcgcgcaacttacctgcggtaacattacacacgcaaacatcgcacagcaacgaacacgcacgccgacgcgcacntctccacgctacgccgctctacatcactcgtgacgcgcctctcncctcacagccgcgaatacaccacagcacctccgagtctgagacgccgcacatacctctactgccgtcaatcacacccacacgcacgctcaggctcgtgaacacgcacgcacatacaacanagcagcgcggccacacgcgcgcgcagcactgcgtncgaagagtctgaccgcgcctcgatgcacataacacgcncacacgtacacangcgcgcacgctgccgcgaacgcctctcgacgctcgtcgtgacatcgcctccagagagggtcacgtcgaatagaccgccaccgcattcctttatatagtgcaccagttcgctagacatcttcatgagcgaggtaccccgatgacgacgtctacgacatactccggcnctcgcgncaacatcgcgcgctcaacanaccatatcacacgcgcgcacaccacacgtcttgctcgactgtacgctctctgcacgccccagcattccactaccgcgattccgagcctatcgcgactctctgggtcggtccaatggcatcgacacgcaacacgccgtgctacgtatcgtagacgacaataagcagacgaccaaacaccgattataccntgcgttctgcctccgcgtgttgaatttaatgtcaaccaataataggcgcattgtggtgagatggggtgcgngtcacacacacacgtccgcgatatgtnttgacgcaacacagttaactttgcacaggtatctcataacgataggcgcgccatgattgtcgatatcggtcacgaggcagatcgcttctgctcgtacacacaggactgtgcgtatntcgatgtngtccncctccgaacntatactcngcactgatcgacagtcgttacgttcatgcactcgccgcctcgaaggagctgttnagaccgtgtgactcaacctccccacatagatanataggtgnataatttcatgtcgcctaccgcatcaccaccgcaccctcactcggatgtgttactgatatagtaaggctgtgcacgataagcgcgacaagctctctcccgcactccatcgccccatcggctngtgcgcatcttcccttgagaagagatatcacaaatctccgtagttatggcacgtcgaccgaacgggctngtgctctcctctgcctctcgcctctcggccgcgtcagcaagtcaccatcgagacacacacagtcgctctcta

SEQ ID NO: 9554 - DNA, 781 bp, Homo sapiens
tctctaattaccaccgctacagagtctcgcagtgtcacccaggctggagtgcacaggcccgatctgagctcactgcaacctccacctcccaggttcaagtgattcttgtgcctcagcctcccgagtagctgggattacaggtgtgtggacaaaactgccatctcctcacctcatacgggaaaacagagaggcctgcagttctgtgggaagacttcaaaacagctgtcaaaaagtaaaattgtatcaccagagaaactgggttatgtaatggtgcataccacacttctgttttcctgaggaagttagcacttcttattgagaaggctgcggcctgatcatgctgttattaccactaaaaaacaaaaatctgtgaggcccccagaggctgcccagcactatgtaacagggaaaagagaggcaggcctgggtgcatggtggtcgcatccatgatccagcctggcccccatcaccagccggcagggagacagacttacactgaagataaagcatagctgcttgactggctggacttgaagtgggttaagttggcagctacatcgaaggacttctgaaaaggtcaagtgacagttacaccttttgactctccacattcagcttgcctttttcttcaaacattggataatctgcaaccctcctgacagggggaaatgcgtctttcctttaggccaggtctaattccacaatatcccttcttggctacggatttacgtttgggggcacaaaccactaaaataacctttgggaataatctttattgggg

SEQ ID NO: 9555 - DNA, 763 bp, Homo sapiens
ctgaaaaagatcctgaacagcatcacttaagaacttgtgaggcaaattctgatcagctgggacaaactgacttccaaaataaaagctacaaaatccagtctgacctattgtgttaatatcaaaattataattatgttcaggagataaactatcttcaagtctgatggagatgtacaagacgactaatgttgggggggctgcctgctaacacaacatccgttctgcagcccatgggtcaaagagtaattccaactttcaagtcttattattgaagaattgcatttcataaggctatagctgtcacttgacagtgattccactgatggattctggcaaaatatatctgaaaccttccagaagggattcaccattcaagatgctctaagctgctctggtctcatctttgcattcccaacaaaaaaaaacttggaatcgcctgctttccacctgagaagctacagattgtagacgagatattataattctgcttttaaagggattgactgatgtcaatttccgtgtctattcagttttgttcttagattctacggctctataaataggggaacttttccgatatagcaatttacgccgcagagaggcattaactcagcggtgtttgaagggctcctcaacacacatataataagctataactcgtatcggacctacgaagttgaattcggaccacgtatgatgtgtgtggtaacataatgttttatggcccatttgaattaccgcgtaagcacgaatgcaccctctg

SEQ ID NO: 9556 - DNA, 836 bp, Homo sapiens
ctgtgtgctcaacttcgtgggcacaggcatgcccgaggtgggggagataaagctgcacagactctcttattaaccaccgtcaggaaatatctggaccagagactgaaacacagcttggaggctgctaggaccactgcctccctgcaggactgctgttcttactggagcaactgcagtagcagagggccttgcaggtgacatcagagatatgggcttctccatgggacccttgccctgctatttgtcccctagtgcctgaggaagaaacacgggaggaagaaacagatgtggcattacaaaacaacttgagaagctaaacttctctaaacctctatcaaaaaagacaaaagactgaaatatctttccattctctctatagaaaaaattgttattgtatgaataagggatcaaaaaatgtagtaaaaagattacatagtgcattaagcaataaatattaatattcatgccaatatatgatatctctgtattctgtgttgctgttcttatatagacttctacattctcaaatgttaatgattttgcattctaaattaatgaccacttttataccaaactttgccttcatgttattcaaacagatccaagttatataatacttaaatggccaaccaaacctggatctatcaatggaattattgaccttaatcagagatgcgggcgcttccgtttatagagggttaatctaagagtcactctaactgactcgttggtcttagtcgttcggttgcggagagtcgatgatcttactcaagggttgtattcgagtatacaccaatcccgtggtaacgcacgaactaacttttagcccacgcgcc

SEQ ID NO: 9557 - DNA, 755 bp, Homo sapiens
tctctcggattcctctatctttgcaccttcgtgagtccaggttacatcaatgaaagaatcatcttttaaaacacagaggaattgagccgtgtcaccgcactttacagtgacgtcctgaagatgcaggaaaatcttgggcgcctcacccgtggactctttagcacattccttagatagctcagtgctttctgcaatttgtgaaagggatgcagtatggcacaactgtgtatcttgaacagatgcagctgtgtggatggaactttgagatacactttcaaaaacctgcacttcatattcatatgatgatccttgaaatgacttaatttccttttgagatattttgctctcctcctttgtgaaagaggaatctgccactgcctgggacttggtggactctcttacatctttcccagaactttgcctatctagggcttgcactgtataatacagtgacaagaagaagaaaagaatattaagagctaagctttgtcacttgcccatgttaggtacacataatggcttggtagatgaagatgaaacacatagttgtcacttgaaagctgcttgccttatgcaatttgattctacatgccgcgatcacacatattaaattttttttctggtgatttatgcgctagtggattgttaaaaactcatgccaaagccatggcggattttggttacttttttttggttggcgtggaacgaggcaaggtccccatgtttggttgcttttaagcctgatagcgaatggg

SEQ ID NO: 9558 - DNA, 242 bp, Homo sapiens
  misc_feature (1)...(242): n = A,T,C or G
cgcgataagggccgataatttgatattagtccataggagctcgcccccttggcaggcatacgaagaattggccggtcacgacagaaggtgtgcgaaacccngcaggacgcttaatgaggcctgtgcgtgtacccctgaattgtcgctagagacgctcttcttgctgcagacgtgagggggatccagatacctggtctttcttcctttcctctggaaggcgcgcggcaataccatagaggccg

SEQ ID NO: 9559 - DNA, 651 bp, Homo sapiens
  misc_feature (1)...(651): n = A,T,C or G
gagaaaattcatacctgaatactgtagacggctcccaaatgttagctcagaatttcagagaaagagaggaaccaactctcactctcctttttctgccacaaaggcagtgcggtagggacaggaggcagataaatgctacgtagaaaagagcgggtacctggagaaaccccaccctcaagctaaaaagcctgacaccatggcccaaagtgagaacttctatccatgtttttccagttgaatgtagcctttacctaagccacccatggctttgccctgcctcatcctgtgcctaaaaagaccccagacttgtccggtcagaatgagaatcagttggatgaggggacgaccatgggctgattgtacaacatgaatgatctggctgcacagggaccactaaaggcgtatcttcttggacgaatctagtttggatatacgctggacttcaaaggtagactacatactcggccttatcacacccccctgtttttgaactcaactgccccttgaattcccatttggtgcgccataaaatccacatacacctatgtcctttaataaaggtttattcttgatcctggctttttgcttcgctgtcactgtccctctacttgagtcaccgttttacgaaactaaagatcggnaatccgtacg

SEQ ID NO: 9560 - DNA, 988 bp, Homo sapiens
  misc_feature (1)...(988): n = A,T,C or G
ttaaacagcagctttggacctagtggcagtacagacctctcacagcngtgaccctgggagcaggcttttcctggtatctctccaaggtagcagagagctcgggttgatttcagacgaggatttgtgatccctacagttgaagcgagaacgctcactccccacaaggaaggagcgcttatagatccccgtcatttttgtcgttgccttgtacgaaaaccccgtaggctctttgcttgagagtgcatgcaatcttatttatacgcacgctattgttgacgattgatgtagtaatctgtgtatatattagtccctccataattttgtgttatttactatattgcggtgacgggatatgacgcctctggattgtctgagattacagtatcacgctgtcccgctgagtgacccgattacagtatttatcttacgactaatcctttgttgctaacaagtgatgtgttatacatacgcagcgaccattcttcgactctcatttaggttcagtattatgtaatcctggtatttgtggatttgagctgtgtgaaagatagtgagaacaagccatatgtaggcggtgtcgctgtagttctaacgnccctacgagacattccgccagccaatgaagtcgctaaaccagctctacatgcagtactagacagcaaagctgagaaaaacggtatgcttcgagcgctggcgttggttgagatcactatagtccaattgcatgcgtcgatgaggtcggctacacggttacagagtggagatccgtgtacgctggcggctgtaaaggtcccggacggtggtggtgattccagctagaaacactccccgactagtagcttgtgatgctattccggtctgtatgtattctacaccggagtcgtcgtccatgctatcctaagtgtagtggctgaccggcctgccgactttgaccgcggcccatctacttgcaggtttgttatcgtaagctattattttgcgttgcgcg

SEQ ID NO: 9561 - DNA, 1306 bp, Homo sapiens
  misc_feature (1)...(1306): n = A,T,C or G
aagataaagagaagggnnatagagatagataagggtatgagaaggaggtagaagaaaaaaagaaaggaagggttagaaggagagggcgggagaggggagattttgaaaacgataaaaacacagagaggcgagcgggggatagaggagggggggagggaggggattttggagaagaggtgagaggaaggacggtgcaaaaattactatgtagacaagcaggggagcgcgagcgcgggagcggcgagccggcacggcaacacggcggcgaaagccgacaaggagggggcaaagaagcggacggcggcgtagtaggagcaagagagggggagggtgatcgggcgcggggcagaggaggagaggaaggtaggagagaagaggcgagagagatcgggagacgacgtgaggagaacgaggaatgccaacagcaccgagagcaagacgccaaaacaacaccagccggacggggcgggagcgcagcaggcggaacggaggagaggagggaagaacaganagcgagcagaagacatcacagcccacacacccgcaacccgaacacacaccaaaccancccaccaccagcacaaccgcgcacacagcagcgccgacgcgccttccgaacggcacgcgcacaacccgcgccgccggcggacgatccagctccagcgcgcagtcggccgcacccacgcacacagaacaacacaaccacaagaaagagcacggagaacgaangaaggagacgcgaggcacacaacacacgatcgcgagccgctcgagacgacgccaacttggacagaggcagagcagaggcacggcgcgggagacgcagagtggagcggacgcgacgaggcggncacgagcgcaatgagagcggcancgacaagaacgagtctacgaagacccgagcccagacaaagagagccggaggacgcgcagcacggcggctcgagagacatagacccgcaacgcccgcgcacacgcagaccacacgacgaacaacgacggagcgtaccgcgcgcagcgcagacgcgcgcgagcgggtggacgagggcagcgcgcagcggcggcgcgagaagagctgcggcgatgcaacgaagcgacgagacagacgccgaagagagggaccacggcgcgacggcacggcaccgacgcncagacgcggcagagcacacgaacacagcgcccacatagacggcaggcggcgtgccgaggcgacacgcgggccgcacgcggcacgcagcacaccgagcgccncgcggncaagggcgcgagcgacngagcgcgcgcagtgcgccgaaagcaggcgaca

SEQ ID NO: 9562 - DNA, 851 bp, Homo sapiens
  misc_feature (1)...(851): n = A,T,C or G
tattactttatatgatttataaatctattggaaaagagaaaaaaaacaggtttagagagnacngacccncntctggaacggacgaatcaggcagaaanggcgcacagagctcaccaggcccagcgggcgagcctacagagggccccacagcaccaacaaccccacgagaaagacgcggccgcaccccagaaacccaaaccggaaaagaggcaggaaacccaaacgcgcagagagagaaaccgggggagaaacaccgagaagcagcgggcggccttttttgtaagcatccctgaccttggatggatagctgtgttccccaaacctggaccttatgtcaaggagatgaatgacactgccaccttttacactaacagggttttaaaggactacaatcacagtgttttgcgacatgtggatacgcgtgacgtcataactagaacatttagtagtgacttttcatcttacatcaatggagcttccattcattgggtctgaaatggttgtaataaaggacctgtatcaatcacagtattcatcgtgattctgacctattctttgggactaggccattctatgactcgctatatcctaagactcctgccaggctcattctcatcttttccagattgaaggcctctaatatgtattcatctacctcctcttatagcttttatacgccaactttacccctgactcatctctcaccaacctgtcacttttatgtactctctgaccctttcgttttccttaccccccaccctgcaggcttgcattggcccaacttctttttttttctcatgttccattatcgtatctaattcttcgtatcatctttttccgtgctttctcag

SEQ ID NO: 9563 - DNA, 1015 bp, Homo sapiens
  misc_feature (1)...(1015): n = A,T,C or G
aaaaggaaggagagnnaggaaganagggaaaggtgagnaaaagaatgaaggaaatataaagagnaaagaaggannnnnnaagaaaagaatgataannnagtttntagaaggtaagaagtnaagattgannaaagtgtatggnaaggtntaaaaattgaaaatgnnnaaaagtggaagnaaaaagagaagtaaaaggaaagaagaaaaaagaaaagtgagatgttaaggtattnanaaaggagatcttaatttatcatttgatggagtanaaatattacaaaagataaaaagagaagnaaatagataaggtatagtaagnnnagaggagaaagaattnatgaaatgagattacgaggcatgtctagagtgttctaaattataatagtgatgagagtggcggtgggagttcatttcgtgagaggttntgtgtcaggtgtgtatcatgctaatggtgagtcgccctcatgccccgtttcgttgctccgggccagtgtactcgtatattccacctccctctccggtacagctcaccatgcatcccagcctttcttagtgttttacctcacgtaccncgtacagtgattcctctctatatgctgtcttgtcagacactctttctacatagtctccnatgaatattcctcgtcagatggataattatttcatcaattaattttcatatactgatgaggcncccagatcctcttatgacaccttatcttctggtccgcgcataacacgtaactacattcgccctgagtatgatcaaatgccaaaattcaaatctcaagtgttcctacagttcatgtcaacatagaagtcnaatgacacggagtgtttatctagtgtcttcaaacagatgcatagattacgaganctccgaatggtgtgtccgcgctagtnacatggacaccgctcaagatgatgggcgggtgaagagagttagatncacaattccgnctatttatnccaaggncacttctagtaattagcttaatgttncctgatgtggcag

SEQ ID NO: 9564 - DNA, 887 bp, Homo sapiens
  misc_feature (1)...(887): n = A,T,C or G
aaataatagaataaatttacacctacatcgcaaaacaaaaaaaaaacccttagagtgaactgactctcttnctgaaccaccgatacaggcgctatcttccaattcagccagacggaggtcttggcggaggaaacttcaagacaggaatttggagtgaggacacagttcattccatactcaaagactggatcaggcttcatccagaacccggacggtctgtccgtctacacaaacccagatgtaatcggtgtcgcatcccacaccaggaatttattatttttgatgccataacatagtgagagagcatgactgactcaagtgagccgggagcacaggccggagcacacagcccagctgcctcccgcaccccctccaccctccgcatctacagcttattgcattaacaaatcgacgctagcccctttacccacgccatctgaagcccactggcgtcaagccctaagatatgtaatttggctgcaaaaccaaatcacagatcaaaccaggtcctaaggcctcctgattccttgaaaggccctcttactgggcagaaccccgcaacaagtttactggaacaccggaatcgctacctttcctagagaactgaaaaaggtggttcctactcacccagtttttgcaaatcaagaggtagatctgactttttaatcctacacctaaaggtgattgtcatcttcataacaccatctagatagcaactctataatgcaccacatacctcgaggctccagaactcagtaatcatacgctcacaagcggtacataggtggtgtaacaactggccgcacatcaattgcgacccttcgccggcatataaaatggtggtggcattacacaacacgagcataacgtcacactccgattccttg

SEQ ID NO: 9565 - DNA, 1048 bp, Homo sapiens
  misc_feature (1)...(1048): n = A,T,C or G
tgaatgggannaaaaagatgaaanagtganaaaaggagaagagagaaaggnnaaagaagggagaaaaaaagaagagaaagagnaaagtagattagagagaagagaagaaggaaaagaaaggtattgaaaaanaaannagaaataaanaaaaaagaaggtttanaatatntacagagaggnntagagggtnngaagagagagtcaaagagatgagaaattagagttnnttttaaggaagaaagagataaaaagaggggaagggngatatagtgaataggcnatgagaaagggatgtagcgtggatgcgttatatagatcatctaggtcaacagcgatgtcctactgtaagctcattgttgtagacgaacacaaaggatnaagggagtgaaggaagcgtcgaggtncggggcgtgtcgtgaggtcgggggncacggtggcggaagcaggtgaagtaatagagtaagaaagatcggagcccaggagctggtcgagaggagcgcgatggnccgaagagggggggcgtaggtacacagtggagagacaagtcgaggatacccactgattccccactggctacgccccccgccaagcacaccgagccaagcccggccgcggcgcccccgcgagccacccgataacgttatggccacgcgaattacatcagaaacccatcaaaccgacccgggcaccgcagaccagcccgcacgtattaccgcgctgtcgagtaccccagccggcccgcagtgggtcccggccagacctgtgggcccgatcatatgctcccgcgccgcgcgaggtccccgtcccccacccccgtgcgtccccagagtccccccgccaaggccggcggtcagggttcggcccgcccatcagcaaagctaggaacgcgccgcgaaagggcagagcccacacacgagaaacgtaaaatcccaaagaacacaggaacaagccntcggagggggttcgagggggggggtccgagagagtgagncagtagagtgatgggtgnnaaggtccacggggtctaggtaatgagcctaaggtccct

SEQ ID NO: 9566 - DNA, 1203 bp, Homo sapiens
  misc_feature (1)...(1203): n = A,T,C or G
agagtatacgagaacagactnctttctcctcccatccttctctcaaacatacaaagaagaaaacaaacccgtgagagggggagacactnngaactacanctctcctgananacacacacagaatacgaggcaagcactgggacctcgcccagcgcncgcgcgaggatanaccgtacagcatcacgagcgcagggacgctgcacacactactcggcaccgcagnagcgtagcaaatgattacctgcatagaacacctacgcgtctacctggtctaccaggatatgatccacccatattacaacccacgtccagcccgtgacacagtgcgcctagccgcagctaagtcggtgttcctagctgaactttatatgatcgcactcgcaatgagaggcgattatttatttttggcagacagaggaatgacactcagtcaacgtgagctatcctacagacctaacttaagatcggcacccaaacggtaggtcgcacttctgaactacaacatcataccacgagctgatcacagctctagatagcttacgagtgatcggttttacatctttgcctagccggtttgcgccgcgaatcacagaagggctagtctacgatagattcgacactcttgacatacccacaatcgacacccgtgaagtctcgattcacccgagccacctgaatcgaatggtatagctcagtagcgtttcgaactctacaatctatcatccctctctcgtagtngcctgtcggcacagcacgttggcctacgttcgcagtccccctcgagaatcgcatcgcaaccaacgtcactaccgtatcgctcacagaactcgcgtgagttcaacgcaacatttcgatatctcctctaaccaaccaccaagagatgcgatggacgaaactcatccttgaatgttcctctctctacgatcgtctattacttggtgacttgagatcagtatagtacagtatccccgtccatcctacgtccacatcgcgccnccacctgtactcaataatattcgcattccgacctaccacactctctatttctttcgaccaatctctacgcagtacagcgtatacggaaacggctcgctctgccaccacgcgtcagtcactatcacaaacccgatatgtatgatcgctgcacagatccgcattcactgcacccactctctgatcggtgaagagatanttatgacaatc

SEQ ID NO: 9567 - DNA, 1508 bp, Homo sapiens
  misc_feature (1)...(1508): n = A,T,C or G
agagttggnaaggagggaggnnnnaggagagaggagggnagagtggtgagggagagaagatggnnaagagggaggtgaggataggnnagaatatggtgnnnnnnnnnnagnagaagggaattagaaggnncnagtatgnaaagttgaggnnaagaaggnanaaaggtgaaggnnnaaacagggtaaggnagagagaanagagagagagnnatatatgnnnacgaggagagtagagaaagtaatgagagatatnannacgtacatattttatacaaagatttanacaaatcaaaaatggatgcgtgagatnantagtaggagccttccgatagttnaattncgagcttcagncgggtttngtanntgaaatgggncaagcagcgtcggttgcagactgaggcgaatgtagaagagaagtcatgtaagatgtatagancgaggagnnnananagagagagagtataaagaagatgnnacgatgaatacagtaccaatatccacagttnatagccnctgcgacacgcgattctcntcatatgagatacatgacgtnctgcccncgctcattctctccccacgctccaatacagacatagcactcgtagtaagacgcggancacagtcagtctggtggccaatcatgtatgtatncacctccacgcgacggagcnagnnacagcgcaggtgagctgagagatggcgaaacacacgagcaggagatagaacatattcatctctcttnnctaccactactcaccagaagataaaacctccaatcgataatctcgtaactccctgtctcgtctgtctattgatctcgtccccgcgtgctcccctctagttttcccgctatctgcctccgctncatcgccataataaatcagttttgttatgtgagcnctctgtctcttcgtattcccgctgtatggatanttgtnanacagtgtgntacgcggatgtatagtctagtattnccagactgtgtgtgatgtgtgnncnagcgccatgttcctgtgtgtagatctcactctgtgncatgtattgtgacncngatntaggagatatacagctctcatcaatgtttnttnctcctattcatactactccgagccncacacgcactcgcgccacagcgcacacgtcagagcggtgnngcanatgagagcgcagttgtgctcacgttgtgattagctgtcnnntctcactatcgatctctatagacgatagtctgtcatatatgtccacgctcncagagtganattcgcgatattgactcgcagcagcacnccgcgctgcttctagtagatcagtctctacgtgaggcttnccatnctctctagcgtgncgccccgccgcggtcntgcgttgtctcgtgcnctngtagtcgctctgtgtacngnccacatattccgcgtcctcgatgtggctgtttcntcactcagcaccacgagcagtagatcgtcacgcacgcacacacgatagtattatacagagtattgatcnncgcg

SEQ ID NO: 9568 - DNA, 773 bp, Homo sapiens
ctcttagtcctatacacattaggagctcaaccaatgtgtgtagatgaatgagtgtccgcaaataccgcatttccatatcccgaagatccttctgaaactgtgctacctgctctccctccctccacgccaggcttccaagagcacactctatcctgtaatacaaagattagccgggtgtggtggcgggcacctgtagttccagctactcgggaggctgaggcaggaaaatctcttgaacccaggaggcagaggttgcaatgagccggatcatgccacggcactccagcctgggtgacagagcacgcacacacacacacacacacacacgcgcgcgcgcgctctatcctctccatctcccttccataccacactgggtcccagccctcagctgtcctgaccacgcagtctccagggtctccagggtggtacaccaaggacctcacccccagtcttcactctcctcaggctcgctacgatatgagtactgccagtactccttgaggctcacctctccctcagcattagtgatacccaggcataaaaagcatcttccctgacacctttctttcacctgcccccagatacaagtggcccccaatgtcctggcctaatcctgctcctctcaaagtacacttaactcttaggtgtcctcatcttcttcatgtttgtgaattttgcagccgttttgtgtttgattcataacggacaatatcccatgacttaaaatgcatacaggcctttctctaccagaaaataaagcatgttccgccagg

SEQ ID NO: 9569 - DNA, 842 bp, Homo sapiens
  misc_feature (1)...(842): n = A,T,C or G
acagcccaatatcccaaccccacccttgtaaaaaaaaaaaaagcttagcggcacgacacncncctgaacgccgaacagnggaagcanacngaagccaanaccaaaagcagaggccataaccaggacacccgagcagccagcaaaacagcgcaaagaangacagaaaaagcaaccacaagagcccgaaggagccaaagccgaagacaggcacacccagagcaaacgaacagaccaccaaacnaacaaaaaccaggcagacagctgtttccctaatattatgcaataatgacttaatatatctcttaaattacgaaaaaattaaaacatacaaagatttctaatctgataatgtctgataaaagcggcaattcctatgaaagctatcgggattactgacactcacgatgcgctcattagcaaacgtcacacttgataaacttattatacacttgtataccgcaacaaatatccttcagaatatctactgggcggaaaaacgctccaccacagcaatacaacaacacatccctcaattttttaaacacccactatctctaaccaactcacctacctaatctcctgttataaacctcttcccctataaattataaaagagaaaaatgaactatgcggcactatacacataaatcgacagaaaaactacatacgccacttcacacgagcaccccccctctccggccaactaggatgggcgcacaaggggtgattctggactctaccgagagaaatctcaccacaaccgaacatacggcgcttctactcctacatctatctcctgccagcttcacctaaccgactatgaacacattaaacacatcaac

SEQ ID NO: 9570 - DNA, 1544 bp, Homo sapiens
  misc_feature (1)...(1544): n = A,T,C or G
aaaaagtggnnnnaanagatgnnanggnnnnnaanggagaanaggnaagggnnnaaagagagtaggannnanngagagagtagtgnnnnatnaagangtgtatgagnnnngaggannnangagataggngannnnnnnnnnnnnnnannnnnaatgtgnnagtagngatangtnnnananagggngnnagaataaatatgtnnnaaggtgagtgnnnnagaatataaagaggnnnnanatagaagatgnaatgnnaataattgtnnnnatagaaagaggaagnaaaatagtangnnnanangaaggtagtgaagaannaatagaggaagttaagggtgannannaatagagtaatagtgaatcgtatacaatatttanataaanatgaatagagataagntaatngnatagaatactgtatanaaaacagtnanatnacagtttaatgaaatatacaggnagatagatggtaaaagaatgagagtanaacagtagagaagtatnangagagataggggaagagtagagatgagattgnnnaaagnaagaanagagaagaacagnnnagagntaaatagagtagggggtgaatgagtgcagagtancactgagagatagancacgagagagaggacaaatgatcgcnaanagaacgtgcgtgcacgagaggcagcggcagacgggagcgatgncaggacgtggnnnngagtgnagtgagtagatcagaatgtagatagtgcngccgaagcgaaagtacgagcgnacgaagacacagtgaagcacacgagatccgacaagcaaagcatgcgcatctgctcgtatttctaaatcgacncaccgcgctgaccgtcagaggactgacacgtcgacagtatagaataacctcatactcaggttaggtacaactnntctatctcagcttagtttcttatagatgtcctactcacgtatagtgatagtcgatagagtaatagtatnatatcgatgcacgcaccgtatgatacnnttatatagatatattctcatatcaaatatatgtttagatttcgcgacactacgactctaagtgtcntangtagtgtcatgtatgtncgatctagtgttatagatttatcattcgaggagattcacagactagcatgaggcacgatcagttgcctgactggagtgttccagtagtatgcagtagacgcactaataacntnacatgcaccaacgtacaacccccacctcaggtgcgttgtcatgccgttataagtacccactcaccctccaacaacataaccaaccaacaagctntccccgctgcatagtcccctagtcgcncagtagtctctcaccatggcccgtagagaggatgtggacactacgtgccncacacgtgaagtcgccacncacatacaggatgctancacatagagcccatctgtagcagatagatnnncgcagtccgccgtacggcagatgtgtgatcnnnnacgtatacncacgcagcacgactcncacgcgcncacgcgtccatgttcccgcgtctatctctcacg

SEQ ID NO: 9571 - DNA, 745 bp, Homo sapiens
  misc_feature (1)...(745): n = A,T,C or G
atgtttttcttagctctggtctgctggtggtactccttcttggattccaggagggtgacgttgcacaagggacagatggctgtttccaatgatgatcaacaaacactttctgctcagccccttcttcctgcagctggcttactgaagcaccgtcactggagttctttgaagatgggacaaatggagagaatcaaagattgaaaagcacttaagattatctcagcagattttgtattcttaccaaaacaagagacttgcctagcccaaccttcctcacgctcgctattctcaagacctgggttccagccactttcctactggccccgaggagaatttccaaagagacgcctgcagtgtttccacagctcacccatgctcctgttgctcataccagcgctggggatganttttgccctgagagacgccagagcccagtgcgtgagccagcataaccaccacgtatttctctctgaagcagcctcactgggagtgggatgcaactattcctatggtggacctggtaatcttttcggttaactccgaatgcccctggtcgaagaaggggcccattcaaaggtcgaggcctgaaatttgcctttggattaaataacaaatgccggatctcgttctttttgaagccatgaagctctattcccaacgaatagatgttctcggactggccaaatttattcttactgccccaagagactgagacttcttgcaattatacccactttactctgct

SEQ ID NO: 9572 - DNA, 1175 bp, Homo sapiens
  misc_feature (1)...(1175): n = A,T,C or G
tctacgttcanctcttctcntatcttctaacctcttcacgggananacactcccacnnanaanacaanngnnnanaatccctgagnaaatctccccactatgaactctccttcctttactagtaaccgccacaccccttctccaacgtttttaatttttntttccttgccattaaacttaagaaaatttctttttacaacntttntttnnacacgaannnaagggagggggnancctatcncnaacnaccccnccccccnctttttnnnaacnccanttnnaattttnaaatttaaananaagaacccctttnncttttccccctcnctcccccanaatcntccccccaanncctccttcaanaaannaaaaatgccaacccaaaaaaagttcttcccaagaaccccctgaaagagccccttcccgccccctcaaacttgcaccctttccttcccctctcgcgcggggaatnaacaccaaaanccccccttttccttccttctctatatataaaataacancccaccctttttcttttccccccttaattccaaaccccaccctttcttccaattcccttttcaaccttcaccccccaaattccttacaacttctaaacaacctttctttcanatctttacacactttcctccccttaacttacccttccctttctccctaacttttttttnccaacacccccctttccccccttttctcccctctttacttcaaacctttccccttttnaaaccctttttccttttttcccctctttcccaaattcaacctncccccctttctttttcccctcctatttcttttaaactttccttcttaaccaccctttttccccctcttaaactttttccaaaatctttcttcaattcccctcctctttttttcttnccacttcctcttctcccaatcatatttttccctcccttcaccccctcttcctttacccctccctattttcacttctcccttttccccctctttcccatccccacccctttttcttttttattcttccccccttttcccctcctccttttatctcctctcttcccctctccccccctcccctttctctccccctcctcccttctccttcccttctatattcctttctcttttttcctcctccctccccaccccttttcccttttctt

SEQ ID NO: 9573 - DNA, 761 bp, Homo sapiens
ttaattttccatgataaataaaaatctataaaataataaacgagaggggagagattggaaacagccaggttggagcagtgagtgagtaaggaaacctggctgccctctccagattccccaggctctcagagaagatcagcagaaagtctgcaagaccctaagaaccatcagccctcagctgcacctcctcccctgggggggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataacatgaagatgcagatggaagccttgactatggcctcttccagatcacagccactactggggcagcattataagagttactcgaaaacctttggcacgtagactgtgaaatctcgttgatccccaccttcttgcagggctccattgggcaaaaaggacggtgtccggatccccgggggattaccacctggggcaaattggaggttgcaccggctcagccagccactcttttactgggctggccagtgggccgctttgaattaaccagggtccgggtgcatccgaggaccactccaaaactcctgtgttgcgtgaggagtctcattggagggtgctacgaggctcatgtgtgggggtctcttcctttccctttcc

SEQ ID NO: 9574 - DNA, 1369 bp, Homo sapiens
  misc_feature (1)...(1369): n = A,T,C or G
gagaggagnnnaanaggataangnnnanaggagaggnaagaagnanagtaagtagagnanaanagaaggaggnnagnnagaaatnagaagntagagnnatagaaagganannnnnnnnnaaangaagggttaaattagatatnantaagatttnnaaagtaagggnaaagaaagtgnnagaaagaagagannnatagaagagaaagtgtaatatgaaaaaggaaaataggagaaagagtnnaaagaaagaagagggnnaagaagttntatcgtnntncaagataatgtataatgtaagtttatngtntaagtgttaatacggtgtanatatacaatatacaaggatagtgtagttacactaaatataannnncagatgttnatataagagagtgagaatgttagtaganaggatgaggagaggagatggagaagagnnagagtgagnacagtagatgggnnagattgaagtgtgaataataaaagtacaagccnacaacatatgcatagactacgatactgaataatgtaaacacagcatggagcagccgatgcaagagacacgcggcacggttcacgcgtttnntcagacgccatacgtagntaccatatgtgtgaatctattagtatagtcgtagtcttgaatacctcactccggccactgagtagcaacgatgcgtgcgagataactcatcatcatacactagcgcgcctaacagatggcagtctctctagtatctcgccttccgccgcgaccctccgnatatgcgtcctcattgtactccgctcccatagtactantcgtgacgtctgtgtctgagagtataattaatgctaagcgagggcggagttacgaaggaagtaggacaatatacagccacatgataaaatgaacgtctatagatggagtatcagaacccccgcgtgtgtagatgatgtnacacgtactgaaggagtnncactcatgatagtatgagatgactttatacgactacgatatttcaacaaacctattgacgatactcgcgcaggagtgaccnctcgaccaggcgtcttctcggccgccatacctgtataagntacgtttattactatcatctcacgtcatctcctacctcgtgctcgttgcccatcacctctaaccttagtagcatatattagtagtctaactattagcgactgtgtgcntagactactcnctctacttaatacagatgcatccgctgcgtcctnccacgagtagcacccccagatgtacgccaaagtatcaaccggaggtgagatcntatagatgtcaggtcgtagtaagtcatntagatggagctcacacagatgcagggcaacgagagtgtcacactgatggcgccagt

SEQ ID NO: 9575 - DNA, 443 bp, Homo sapiens
  misc_feature (1)...(443): n = A,T,C or G
ctccctcccttccccctacactcccacgcacccctcaaacccaaccccaactctaaactctccccgaccccccttctttctccctttccccccccctcccccacccccccctttctcctttaccttttcttccccccntnttccntttctccgcccctccctctcccncnctaattaaatccccctctctccccccnnnnccccctctcttcctttctcttttnnncccccctctttnncncttccnccccctctctctnnnntcttcctccttttctcttctcccctctnnccctcnccnccccccnccccttncctcccctctttcctttccctctttctcttttctcccctctcctccttttttttttccttccctttttttttccttgcgcccttctcccctctttcctcccccttccaaaaaaatatctctcctctct

SEQ ID NO: 9576 - DNA, 924 bp, Homo sapiens
gcggggacgcgccgcagcgatgccccgggccgcccaccggccggggggacgcgcaagtggccgggctctcttaaacttgattcctcaactctgaaatcaaggttctcataggttctcacacactcacatgggggcgggggtggaaaaaaaaatccccatacacgggagccttgctatgtgagcacttaaactgccactgctaaattctctggtctgtacctgcgctgcaacacgaatgatcctaaatggcttttatgtcagatgtccttttatcatggaattattttcggggggggggccacactattggatgtcttacaaaatagattctatggcactcggcctcaaattagaaacagggttggtacctacgatgggtgatattaacacacccaccagccgcgagggcagagtgattgcaggaccccggaaccacaagaactagggaaacccttaaaagcgccgtggaggccacttacacggcacccctaatgcggaacaaaatccctcagaacctgggcaccaggtcctgcccaatattttaagagaaaaacccatttcgtaatctaaccaagagaaccgtgtctaatccgccgcagcgacgcggcgagccgtaaatccctagcccttgcctacaaattgtgcactcacgagaaacacgaacccactccggcggccttactttttttctacggacctcacgcggcccaccatgcgcttggcgcgcctcgacagccgacgagacgccggtcgaggcccctttccccttcaccgcggcactaactccaccaagccctgcgctccctagccgatctagcggccaactccctatgggcgcaccggcaccggcgacacatggcctgacgcgcgcgggatgcccgggagccctggaagtgcgggtggccccgccgaacaacccttctg

SEQ ID NO: 9577 - DNA, 1090 bp, Homo sapiens
  misc_feature (1)...(1090): n = A,T,C or G
aagganaaagagangnaaaatatagaagtaaggaagtgagaaaaggaggtaagnagagtgaggagttataagagatannnnnnaaaaaagaggagaaagtttaagaagnaggagagaaagaggaaagaagggtaaaaagagagtaaaggtataagaaggataacggcncaggaggagganntagagttacagcctcaaacacgtacgagatagtcagtaagaatttactatgtaaaagcgagtgcaagagagaataagcatgaagcagantacggagagaggaagaggggtacagggagatggtaacagcagtggagaggtaaggatccagagagggactacttagggaacttgtaagagtcgagtgtaggcagccncaggacggcgcagcccgagcgagagagatcgcccgcgcgagcagccacacgtacgcgttcgccgaacgcgcgctccatccttggaagccggacacacccccncagcccctgccccgacaaggggcggtgagaggaacagggacgagacgcacgggcacccccgagccagccaccccatcaccaaccagacacgacgcccaccacactccaccgccccctccgtcgcttcctcttcgatgcctcagctatctcgctcctactcaaccaccncgcgcgcggcgtctcctccgccacttccgctgtagacccgcactctctcgctcgatagaatatctccacnccccatgctctcgttaaccactgcgagggcgcncgctcgaggatactagccgccactcatccaagagtcactacgcggcgcgcgcggcccatgtaanccctgcagcgccgggcgcgcggagcgagcagctcgaccagtgcgccgctgtcacgcggcgcgcgcaatcgtctccgcaactcaagaagataagctagcggacacaaacgcacacaccgagcacactgtcccccggcacccgcacgagcccagaacgccacacgcagacgcgntaatagtgacaantgtagacacagagagatgcncaaatgcaaagtaagattgttgnnccatcacgtgcgatgtatagggangctgagatgaccgacgggtccct

SEQ ID NO: 9578 - DNA, 1140 bp, Homo sapiens
  misc_feature (1)...(1140): n = A,T,C or G
ccatacccggaggtggtggggggtggggaaccccaatncttccaatncatacccgcggaggacccacggcctcaccgggctccgagagtttatcgagccaattaaacgcatgcccagccctggaaggggcgcgaggccggcacaaagtgggtgcctggcgaactgtttatgccncgcttccatgccaatccttattaaattatctgggcgggggggcgtaacaaccttnttacgacaaccnnncccatagcatactatattacctatttaccacgaacggagggggaggccccgtccgaaccaccaagggcgggcagaggtggcttgggctactaaatcagcgctgacccgggcgcttctggagtagagtcacccacatgtggttcncnggggagttagagaccgctatgggagaggaagtcggccccaagtgctggggctttctggggatttagaaagctttgagaaaatcgaacccctgactttctcaaggcttgacctaaacaaaaagggggcatccatttgggcgctttggacagcgctcattggttccgacaacggaagttgcggcgcttttacttgaagacgcggtagacgcgaactcgcagaggcgngcgacgttncggcgaagaccgatgttgacgcctgaacanttatgtgtttcagacgacaggcaaagagatccgccacagggcttgagtgaggcgcttctgagagtgacaccctgtcgaagatacgcatatcggagcngncnaggaagagggcagantggaggacgtagagcngagtcggagagcgggccgtgtatgttgtatcgctgtgtacggcgngtcggtctacgangcgaacatgcttcggcgctgtcncactctagtgcccgcncgcggtacagtgagtgngcgttcacatgggatgtgccgtcgagagttgcgagcccntgcggcattgagcgcgcgatgtatggagcagcgtgtgcaccgcttcgccgcggcagtcgtgagccncagccgacgcggcgcgcgagggcgaggaggcgacgcacgcacacggatggaccaccgtaggtagggcgcctgacgctcgcgcgtgcgaggaagcgttgttgagggtcgtcacggggtggtncgcctgcgcgacgcg

SEQ ID NO: 9579 - DNA, 1722 bp, Homo sapiens
  misc_feature (1)...(1722): n = A,T,C or G
aaaagggnnnnnnnnaannnnannnnannnnnnnannnnnnnnnantnnananatgatannnanaanannannaaaaagnnnnnantnnnnnantantattannnaanatnagnnnnnaggnaaaatnnnnnnnnnnnnnnnnnnnnnnnnaaatggntnaagttatgagtntnanannaatnagatnnnntannatatgagtaaaaataaattgtgtnnaananatatattatgtnannntaatgtatctgttaagagangtagagntanntatagtaaagagtgatagagataatagtgaannagggtagaaanatgaggagnatgaggattagtgtctatcaatgatccncttagtcagatgctcatnatgtatgtcatgtgtgtttcngtatcaatagggatcntctgtnctcattagttaataatattgtgttnatnacttagacggttngtcgccgtgatgattcgtcgatgntgcacgtcatctactagatggttgcgcnagcgcagcgtgagagtggatgatagaggtgtggctgtgtacgtgtncgcggagagngngatngagtgtgtgttgacggtagtagacagtagagtatgtacgatatangcagagaggtgtcntcgtgatgttanattatnactactatatatatatgcccatcgcanncgactctcagagtgtatagctanaggtgccagaggcgaatntagcgagncannaanancanagtacgtggatgatacgtggcgtgcgcgtccatatgcgcgtagcgcnatcgcagtgcgatccagcgtggcgcctcgcgcaagctcacntgtcagcgcgtcacgacgtctccagccgagcgtcgcncgcncgcggtcgcgtcgcgcgcgccgagtcagcggcnncgagacaggangcagcgccgcgcatgcagcactcagcngcacatatgcgaggtntnagtgattgtgacgatagagcggagagcgacgctcggtcagtacccncggtctggactcgatncatctcatatcacatggtctcgcgttgcnttcgcntatccagtgtcagtgtncgtgagtcagtgcatgcgagtcattattagcgacactatcgtcagcgtgtgctgcntagattgacactgtaantgttgtgtgctgcgtagtatgggcntcgagcatagaaacgtgatctgatagacgattgtcgagtagaatctgagccggcagcgctgggnagtgtgagaggatcgttgagatatgagagtgtnnancagtagtaaacagctgttgtgtgatgtcacacgcttctaccggagtcacgagtcgtgcgttgagnagatgcgagcgtgagatnacacgcacgcgtaatcatatcgatgcgtgagatccgatatcgtaagcactagatgtcgtagagtcatagtgcgaggagaaggagagagcgcgagaggctggtacgggagtgtgtgagggagnactgtggtcacgtgcggcgccactggtgtcaggagtggtacgcgaccctcccncncatgcacttcaatgcaatgtagttacccgtagtgcgacgcgcgtagaatctcagacgtaccgacacacgagtcaatgagtngcncgcgtatagagccagtgatacactactggacgacgcacggagttgtaggcgctcatcagcgccagctgtagcatcaggactaccagaagtatcacaccgttagtgttcattg

SEQ ID NO: 9580 - DNA, 291 bp, Homo sapiens
  misc_feature (1)...(291): n = A,T,C or G
cgccctcctcccccttcactcttatgctctccgcgacccccccccccccaccacacaatcctcaaatctccccttcccccctctcttnctgtcaccccgccccttcccaaccctctgggagtctcctttctttaccccccccacccccatttcccccttctttgtctttttcccccttatnctaaatccccnncccccccgnccccctccccccttcttcctccccttttcccccccggctctccttttttgnctctccccctccccttcctctcttctcccccccttttt

SEQ ID NO: 9581 - DNA, 1038 bp, Homo sapiens
  misc_feature (1)...(1038): n = A,T,C or G
acaatggagatgatgttagacaaaaaccaaattccaattatggtctgggggggaggataaaataacctcctaaancactctgagacaacctcacaacatcaaacaaccgcatttcgggcccatagaactgcgtacatgaatggtacaggggcaggtgggtgggtttcaaacaattgtttcccaaaagggacactccgcatcacttttaanattcacgcagctctgggggggggggggcccctcccaatcttccacaccttaaccacataaaaacacccaatccattcnncaccctttatccctcccttaccaacccaaccattaaaaataattttcccccaaacaaacctccaaccatccnccacccatttcctcatcgccctttttttcacccatcttctaaacccacatcttcgaagagagtgggaaaaaaaccttgactcaagtgggggtgcccctctgttagcccttaactggaagaatgtcgagcaagtattaaccccgtgtgttggaaggtgggtgatgttttgcgtttttaatgtggggctctcaaccagaccatggtgaccctgttcgcgtccccttccggattgtgggcagcggtggggcaacaaaaagatgtgcgagtttcttaattcgcacgcaacgcgcggcgggcgtgagcacgcagctctcgagctgggcgcacgacgcccggatagtgggagggtgtgcccnaaggccagtcttttccataaacgcgccagtgttgggccgccaagagaaaggggcggcgcgggttggtgctcctgtgtggagggtgggcggtggtgtgcgacgcccgcgtcgccatgtgtcacancntntccgaaagtcccggggggaggagcctggtggcgttggcgcggagcgtcgtggcgtcgccggagtcgggtcggatcatcgccttgtgcacccgtctcgcgtgcggcgcgccgggcgggccgtgtgcgccacccagaactgcggcgcctgctgnttctgcaccacacgagcgccttcgcgcgtcgcgtgcggcag

SEQ ID NO: 9582 - DNA, 1599 bp, Homo sapiens
  misc_feature (1)...(1599): n = A,T,C or G
aaaaaggggnnnnnaaaannaagggnnnnnnnnnnnannnnnnnaaggnnnnaaatagatnnnnnnnnnnnnnnnaatagtnnnnnnnnnnananagtatnannnnttatnnnnnnnataggattttnnnnnnnnnnnnnnnangnnnnaattgtnaattgtnaatgtnnnnnnnntataatnnannaggtatatatnnnaangatttnnnnanatagagatatagtttnnanatagaatagtaaatgtnatagatgnnnanatattagagtgtatnntnatagagnnnnaanagatgatgatagtannnnnatagacagtgagttagagtgtgnnatgaggtggtgatattntgcatcaatatagtcctcttagtnatatatattttattgaaggttnntgcgttgcgatgcgcgtgtcagtgtctatatactctatgtagtgatagaagtgatagtaataatatagtangtgtagatacaacattgncnatntaagntatttgtnnanagtagaatgatttaaganagatagacatgagtgttnnatcacataatatgacacagaatatagtcattgatataagtattgtnntntngacgaggtcctcatgtcccaccacaagtacatanntccataatagctcgtcaagatgatcnnancgcacatgttaatatacactagattagcaatacgaagtaagtgtatcagaaatacgcacancagggatatgatgtgtactcacttagatgatctcacaatccgacccactgacacaaccnaaagcagacgaacaccacgagagccagcancgaacgcgactcagtgctacgctcgttactcccgacgacatacatatcacagttcaccgcacacagcgcgacaacgctnagcatcatacgctctcacctnctccttctatgatctgttncactgctattaagatatctccatgagactatatagtgtatatntataagatatcctgtgagaagtacgggngacatagtttagcntcacgagacgacgccacagcacgacatgtcctaataaaactatctattataacggtcctacatcaatgaaatgatagaatncntacagtattagacatttcntatcagtactacgatatatatactacgacacaggtagcgtagtggcctnagtagtcgctatgtaggtgagcaccgtgtcgtgtnntncaaagcaagatcacctcagataccacgcatctcacncactcgacatagtatgtatagcnccgtgaaagtgcgtctgagagcgcatacatcgacacgtctccacgacaccactagtgttacgacgacacctagtacatgccgcacgctcgtgctacattacnctatcctttctattcgatcgcntcgctagatacgcagatcaatgtcatcacaccacatgcgacacgtagacgtagacacgagtccacatgtacagcttctgagacaatgtccncgcataacatatgatagtcnnncactataccacaagagcagattggatagtgccgnctacgcacacgacttacataatacctacacagtactaatgtattcaacatgtttcagactctag

SEQ ID NO: 9583 - DNA, 733 bp, Homo sapiens
  misc_feature (1)...(733): n = A,T,C or G
ctatttcataaattaaaaataaaccacatcattnaatccgggaatggggggcgtaacatcacatctnnaagtaatttctaaaagttttatgtggttctagggggcagggactgtgaaaaaagtgcaaatatagaggaggaaagaacagaattctgaactgcgttaatcatttaagcacatatcctcaataaaagggggggggggaatcaaacaccttggactaaaactatataaggggggctataaagaccaatgggaggatattacaagaatgagaaaatgtaatgggatgggcttacactggtaaaccggggtacaatcagggaaatggatgcttttctagaaatgggacccaaaagggactaaaagtagagactcccctaaggaggaggggggggcacaccaattgtgagcttagcgcaatgagggtggcgcaccctaatacctggaggccgggagtgggagaacgaggaggctgcggggtggtggggccgagaagggcgaacccgccggcgccggggttttcccaagccgccttcgaggggtcgccaagggataggggggacggctgggggcggccgggcttagagaggggcgccttccagagggcgaggcgtcgtaggcgcgttgccggggcggcgcaacactgttggggagttgcggggggcgcgcgagcgcccggacccccccccgcgggacctgagccccgggcgccggcccgagaagcgtgagt

SEQ ID NO: 9584 - DNA, 849 bp, Homo sapiens
  misc_feature (1)...(849): n = A,T,C or G
agaagtaatatggttaagtgaagtggaaagatggagaaagtgagggggaagaagagattaaagaagaagggnaaagtggtgtngggggtgtgtggggcggtttctgtgtttgggattagtgtttgtctttggtgggggtggtggggggatttgtgaagcggaggtaatggcgggggtgtcattgagacgtagggtgtgtaagtggggggggggggttttgtgggtggagtcgagtggggtgggctagcgtcgggctggggcgcgggggtggggatggggctgggaggacgagtggggcggcgctttgcgtctgccgctcgggcgggcgcgtgctcaccctcgcccgcgtgtcccaccaccgccctcaatcccagcaccccccgccgggttccggtctccgtttctcgttcttttgccctctgagcgggccttgtggggtgctacatagtggccagcagcgtgcgaagtcgttgttgcgtagggctgtgtgttggtaccgttgtttgttttctagggtataggcttgttctatggtttatgatctggggtgcgcgggggggcgcgtggtggtcgcgtgggtgtggtagcttacgtgcgtcgcgagttcctgcggtgaacgtctgcgctttccccggcccttcggtgccgctcacatagctcgcccccgtgccgagcacgccggcgtccccgggcgtggcgcgtgcaccgccgctgctagtatatagtgtccggtggcgcgcggcgcatgtgcgtctggtgtcggtgcagttctggggtgacgggcccggggtcgcgccttgttggtccagtccgcgccgtcgtccgcggggtcgtggctaatagaccccg

SEQ ID NO: 9585 - DNA, 380 bp, Homo sapiens
  misc_feature (1)...(380): n = A,T,C or G
aaggcgccgggagcgatttgcctctccctcgctctttttttttcccccccccttccccttcaacaccccttttcccctctttttctcttttnnccctccttccctgaaacggtccctcttaaataaaaaacccctttccctcccccccccccccccccctttcncttncctccccnctctcctctctccccctttttccnncnaacnctcttctcccctccttttcccccttctctcccccattcaccccaccttcttctccactcctcaccccaccctcccccccccacttttctcgggcggggcggcccccccccctctcgngcgccgccccccccaaaaaaaatccctcccccctctcngctcccgtgtttctttgt

SEQ ID NO: 9586 - DNA, 778 bp, Homo sapiens
  misc_feature (1)...(778): n = A,T,C or G
ttacagatcatcactggagctatcccatgggacccactgggggggtggggggctggaaaccacctanaaggaggtcacagcccttatgcacctactgctcactcagccccataatgactgttcttaacccatctggggattgtgaagtttatctagttgtttataactttttttttagctaaatagaatacaaaaccatggggggggggtancttctatcaaacgtggagtctagctctgtgccccaggttggagggcaggggcgcggatctcgggcactgcgagctctggctcccggggtcacagcatctctcctgccttagcctccgggagagctgggactacaggccccgcgcaccgacgcccgggtatttgtgaatttataggagaaacagggggtttcaccggggttgcccaggagggcgttgatctcctggacctaggtaagccccccaactgagcctcccagagtgcgggggatgccacgccgggacgcacgcttcgcgggcggtaggttcggtgatcgttaaccaacactaagggcctggttacactttagctgggtgtcgcctcagggcagatatataaaccgatcccgcacgcgggggggaaggggaggggccgtcgacccagagagccgtggcctgtgcacgaaaggccctgttggtgatctcaggcgcgcttagcttcctgtgtctaggggtcagtccaggagggcgggggcgcgccgccagcgccgttaggggaggaccgtcgtgtcacagagagtggcgacggc

SEQ ID NO: 9587 - DNA, 573 bp, Homo sapiens
  misc_feature (1)...(573): n = A,T,C or G
ttctccggaagcctacaaccaattttcatgtaatcaaggagttatcttcaacatctcaaacccttaacctgtncattcatttttaccccctcacccaacgttcccaaatcttcttctcaaaaagcaaaatccaccttcattacctcttctcaattatatgtctagaacacataccaccccatttccaccttatcgtcatcatcctttctcctttttcacctaaccaaaaattaattacccttcgaatacctttcaattttcacttttctaacaatctcccccctctcttacccttactaatacctcactctcattttttcaaccaattttttaacctaccataaactcaatcattacccttacccttccttccctcctttcatacaacctcccacaaccctaatatttcctttttcttaaaccctcccttcttacaactaaccattaaaattctcctacaattaccctcctccccaccatcctttccttacccctctcccacccacccaccccacttctcttcaacttttctttacaaaaaccaccccctccctcccctccacccccaccccc

SEQ ID NO: 9588 - DNA, 549 bp, Homo sapiens
  misc_feature (1)...(549): n = A,T,C or G
tccatgggaatgatattggagacttgtcataggagtgaagacaaagaagtggcacaaaaatctggctggtggcacggacgtttctcaaaaaatatcccattgtaaggaagagctgatgagattttaataatgggaataactcatattaaatattttttgttgtgctgtgctgggggataaattccttctttactcccagtgtttagggaaaacttgctacatcattgacattgtattgtattttatcattaaattaaagggaaagaagtttgtgttccactttaggctcaaaatggtggtagagatggataactgttaaaggaggtaaaactcacaagggacgtggagaatccgcagaaccagaatctggagaaagatctcctgggatctttacagccttgaagttgaaaaagaaagaccacttggttttcattctaccaaaggaaaagggtgagcttgctttncttaatggcctttttcccttcctttttggttcctttcttgctccttctttccttgcttatgaggggaggggagcagcgcaggaag

SEQ ID NO: 9589 - DNA, 926 bp, Homo sapiens
  misc_feature (1)...(926): n = A,T,C or G
tacttttattcttcgctaacaaccgccggnccggggtaccggggacaacgccctaaatttgctgataacgcttcgagtaccaaacccggggcgcatccagtgatttgtgagggccttataagcccaccccacactaaagggaacccgcgccgcatgggctctttaaccaaaaggccgtgaaattgggcttcggtgacccttttatttaaacccacttctcggtcctggagacttgggagacacaataccgttacgcttatttatgtctcttggagggcaacaaccataaaattatccatgctctaccttagaaggggtctgactttgtcctcgaaacaaggagaaacctgtggttagttctttttgtggatattcccgaaaaggtcattaagggggacttttccttctgcagtgaaaattgtgggcctctttctagtcggaaaattggcttttttcccctctccggttacttcccaccgccatttttttcaacatgcagttaagcgctaactccccaaatttttggtaagctggcacaaggggtgataacaaaagattcctgagtctaactaccaccccttttgtattaaaacagctcgccggcccgtctcgttattggaggaggggctccgcgcccccctaacccacccgccttaacctccgcccgcaatttgtaatgggttgagaaaagaaaacacaagggcggcggacaccacggccccaccccatattaatctgaccggatgctgtgtgaagcggtaccatagttgctccgtgcactcacctgctcgcacgcgtcctttctctagtcgccccgattgatctgagaagccaactaccgcagagaacattgatgcaatacttacgtggccctttctacgatcttaccagaaaattccgccccacatggatctggttttgttgtt

SEQ ID NO: 9590 - DNA, 797 bp, Homo sapiens
ctctccccgaaggtcctctgaggaggagaaacaaagcaaggcgtgcatgagcaacacgggagattatatgacaagctaaatagaatagaaaacatcaaagtgcatacgtgtagcaaaggtggagtctcgctctgtcgcccaggctggagtgcagtggcgcgatctcggctcactgcaagctctgccttttgggttcacaccattctcctgcctcaacctccggagtagctgggactacaggcgcccgccaccacgcccggctattttgtatttttagtagagacaggggtttcaccgtgtttgccaggacggacttgatctcctgacctcgtgatccgcccaactcggcctcccaaagtgctgggattacaagcctgagccaccctgccaggccttatgtttgcttatcttaaccaaaatgagcccttgtttcactttcctggactaccctaaggaagataaaatttcatttacaacctggggttaaaggccggtgccaagtaccccaagacccttgggctggtgaataagggggctactgaaaacccaaaaaccttaaacttccttctcttcgacaaatacagggagacagctttgacccccttcaaccacctttaacgatggcctcgcttaaaattaaaaccagttcgggccgattccctttaagtaagggtcaataacttaacctaacgtacctggctccgttgagctctagaaatatcggatgcagaatagagggaacaactcactccaaggtaggaaataacgagtgcccacaaaatctgtggtaatctcag

SEQ ID NO: 9591 - DNA, 909 bp, Homo sapiens
attaattatattcgcacaatcatctactatataagccaaacacagaaccctcttactgcaactgtctactcttatttatccaccgctacaggcattattggcaagtggaatgagaacaagaagagatccaaggctgaattctgcagttttctggcttcatttccaacttagaatttatatagaatattctcaatctgtggttggtcgaatccacacatgcaaaacccacagacgtgagggctgattctacgtgcaaactggtcacaaaagcactggctgacttcaaagctgcatcctaacgagggcaaagtaccttggacaatgaatctcgattgtatttacaacaaaatcacctttactgacgggaatatgttacctcatacagtaacaaggtgctaatctgtatccttccatcctccaaccctgaaattatgactgcaagccaccaaccgctaccaaattggatgaataagatactacaatcatcgaagggtaaacctatgtaatatataccacaactagctgacctttaccatcaccaccacagtttcacctcgcgtacattgggtaccaatgaccttgacgactcgacatctcaaccaccaaatctatatagattatccttactatgatcttttacatgtacattgttgacctctccacacccaccacctcattgctcgcccctagcctttagatatgaattacccataataaaaaaaaactctgttcaacacattatcacgaatctccagatctaactatgttacttttgctcttcgcgtcctcaattgctagatactccgaaacgcgcatcgatagcagaactagatgttcgatacaccaaagctgcagctcttacatagtacagtaaaatcatgtgcgcgcctcctcgaaagtaccacacat

SEQ ID NO: 9592 - DNA, 1369 bp, Homo sapiens
  misc_feature (1)...(1369): n = A,T,C or G
aggaggggggagggagaaaaaaaaagaagagagaagggaaaaagaagagnaggnnngnnaggaggnaagnnnnaagaggaagaangaanagagggnaggaannannganngaagaggaaggaggagaatgggtttnagagannnngggaacgannngnatgggggagaaggatgaggaagaaggagaaagagaaaaaaacaatttaaagaangagagaaggagaaaaaagggggagggnngagggaggtggcacgaggagcgcagggggcgggcgggacgatgacgcccaaacgcgaacacagggagataaggagagagacgagagggaagaccgagagaagccaacgcgaacaacgagaggaagcgaggcggcaggancagagccgggaagtaaacaaagaggatagatgagaggggagggaggagcggcggcagcgagaaagggggcacagaacgggaggacatagataacgcgtacagcccacacgcgcgagaggcagggagggagagacagcggccgagcacgcgagggcgggcgagagagcagccggggcgcaagagcgaggaggcgcacagcgcagccaggccgaacgagagaggacccccgaccggccggcgccgcccgcgcgcggccaccgccgcgaccggagacaacaccgccgccacgacgccccgacgcagcgcgaccccagacacccacccgcacccacacgcgcccgcacgcgccgcccccgacgcaaccgaccacccgccgcgggccggcccggggaccgaacagacggcagacgacggcgggcgaccaataacacactcaacgagcgacagggagcccgcgacagaaaggcggccaggccggcgggtcgcacgagacncacccgagacgacgcaggtgncacaagaaggagagcgacccccgacgcgtgaacggcggacccaacaccgcgaggacagagcgccgccagcgtagcgcagagaagacgacaccggagagaancagcgcaggcacgaagcggcggcgggctcgcgagagggcggcgcgagagcgagacgccgcagcgaagcgcgagcgaccccgccgccgcagcgcacaccgcaccaccagcgcgagcaggccgtgacaagacgcaccgcacgcagagacagataggcgaggatggacggaccgcaccacaccaagcaacgcagcagagtgnacgaccgacgagcaccgtccgagagaggcgagcgcgcgagccaggcgcagcgggcgcgcgaacgagagaggacacgcgccgacgccgcgacaccacggcgcaacaggacangccagangcacacgacataangcgcgcgcagccgacgacagaagtcgcaaacacgaaacaacag

SEQ ID NO: 9593 - DNA, 750 bp, Homo sapiens
  misc_feature (1)...(750): n = A,T,C or G
aaacagcttttgagacaaatgttccacggaaggtgttttaatgccaaagaattttgcttcttccctgggggttgttttaccttgtcattttcacaatgaagactatttttctttatttctcttctctattttcctcttagagcttcttgaagtttctttaaaactttattttaaaaagcttctatttcagaagttaacaggcctggaggacatgagacttaaggttggtgaggaggctgcaggagagaaatagggaaacagtatgccctatgagttcccacctattgtaccatctctgaatcttcagaatatctacctggaaggagagtcccacggggatgagaactgtacctgtgaagaaggggagaaagagccttgattttagccttatgtccaacggtgttaaaaatgcagaaaataatcatacagagacttcgtcagaataatgcaaagatgcagtccatgaagaagtcaggaaaaggagagcatccccacatacagtataggatatgacaagatgaactgctacaatgaaactataacagaatcatttccactagatgccccgatgtattaatacaatttattaagcaaagatgtaagatgaaagagaaaataattttttaaaatcttccttgcaaagcaaaaagaacgggaaatcctaagtctagttactaaatcatttggtcttttttctctaacagnaatcatttggacgtggaaaaaaacagcaaccgacccnacaacaag

SEQ ID NO: 9594 - DNA, 156 bp, Homo sapiens
tgctaccttatgaaaacactttgtatgcctacatatagcattcttagttaaaaacaaagtctttaaatcatttcaaaatatctctacattaaagttattttgtcaaatgcatattaaaatatatgtttatgtactacactggacaataaagaacga

SEQ ID NO: 9595 - DNA, 449 bp, Homo sapiens
acggagtttcactggccaggctggtctccaactcctaacctcatgattcacccacctcagcctgccaaagtgctgggattacagaagtaagccaccgcacctggccccaatagagttttcgatatgtgcatcttcacctttgataaatactgcgaacatttaaaaacctgacaacgtcaaggactggtgaacgtgtcacatgtgatgggtgtgaaatggcatctctccgcagcaggtgctggagacagtttggccttaaagaggcacttagttatagcaagaatgttttataaatggtatttgatataagccaattaagattaatggggaataaaaaatgctgcttagaaataataattcatagatccaaagtcacaaaatctttttattcaaatgaacactatataagattttacagagagggggaaccacttgaaataaaccaagat

SEQ ID NO: 9596 - DNA, 1236 bp, Homo sapiens
  misc_feature (1)...(1236): n = A,T,C or G
tactcgatctgccgtttgtgattctcgtgacctcgcacacgatactgagtattcgatatcatcgctggaagactggtgctgtctagtcggttctatgttcgtagtctgtgtgagtatagaagcctgaaagtcaatgcgagtaatgcaatgctattatgtgacgcttagactagtaacgagatacagaccgtcatatgatcgctgattagctcgttagcggtctgtgtctaagggggtctgcgatcggtacacaagtggaccatttgtatgagttactcggacaacagacgtgctggtcgttgtgtgtcttattttagatgcattcgcagttgtgatctgtacgtctgaccactgtttcctgcgttacgagcgacagcgagattggnaccagaacgagtgcgtattggtcagatacagttagatgtcgaccgtcggagacgtctatctgtgcgatagattctgctcgtgatgagcgtgagatgtacgttagtcgtggagagtagcagttctatctctttagatcagtgtgatctctatcgcgattatcagcgaagtactgcggacgccactagctatgactagtcacatgtgcagcgtcaggcgacatctgtcgagagctcttacgcntacaccatcacactacgtctctatgtgtaatacttctctctatctgtccagactcgcgtcgtgtgaatcgtgacgntctgtacatctcgctcatctctgcgctagncggtactcgcgagcactacgtcgcgacacgcactatgtccgctagtcaatgtaatcatgatctagtcgatgtcaatcgcngtagagcggagacagtgcgtagaccgcacgtagtgatgactcagccgacantatagctgactgtgctgcgcctcgacggtacacctctgtcgagacgaccaatatatcaatctgtgctttgctatacctgtcgctgtaagctcatagcatagccgcactcgatacacgtcagcgtnccagagttatattctagtacgnatagagtcacntactgctacattgtagctctgccgagatctgatcgatttgtcgactatgactgtctcagctagctgaccgcgtggacagtattactcacaacactatgatatctgaagacgatagtcactaggcgnttcgttttattcgtgtgatanattagtntngagcacgatggtagacagactantgcgaagattntgtcgatgtgcagtatgatgagat

SEQ ID NO: 9597 - DNA, 662 bp, Homo sapiens
  misc_feature (1)...(662): n = A,T,C or G
cctgccaanncggnaaaagcaatgctagtcaattctacaggnacttacctgaacagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaatatatattatattatataattttcctaaaaaaaaaaaaa

SEQ ID NO: 9598 - DNA, 925 bp, Homo sapiens
  misc_feature (1)...(925): n = A,T,C or G
gtgtgtgatggttggggagtgtggttggtgaggagaggagaaagtangagagagagtgagagggtaggagaagagtagggttggtgagtataaagaggagggaagaagagaggtgganggaaagnantagaatggagggaggagaaggaggatgatggagaggggtgtaaagaggaggtgggtgatgtggggatgtgtagaaggaagaaagaggtgggtgtgagagaggagggagagatgtttataggagagagagaagttgtgtaagagtgttggggagatagagagatttttaggggaggaggagagattgttgngtttgttaaagaaagagaaaagggagaagtgagtnttaaagaggagggggggagtgggaaaatattggtagaagagtgtggggaaaagttaattgttgaagagggagagggtggtgggggtttttaagaagagtgttgttgtgggggggaaaaaaagaagggggaggggttggagggggtntaattagggggggaaaagggagggagtgagaaaaaggggtttgttagagaaaaattaaaagttagggggggggggaggggaattaaaaaaagagggggggttttaagggaaaagaagggtatgtttttgggggtttttgggggnggggaagggaaagggaannnaagagaaaanaaggggnaattaagggggatgttttataggggagnaaggttttntttttttttacccccaagggaggggggtggggccaaaaggttgaagggtaaaggtttaagggacctgggaaaggtaagggccaagttttgaaattggttttatttttttaaaaaattaattaataaaaaagttttaagggatggagagagaaattaagtagggggcgaacacatgatgaaaaaagttatttagttaaaaaaaaaaaaaa

SEQ ID NO: 9599 - DNA, 2131 bp, Homo sapiens
  misc_feature (1)...(2131): n = A,T,C or G
cacgccgcactcatacagcacacnccagcgactccacttatgaacagagacgagcggagagaagggaggggggccttaggtacgttcggacnagnactgctgctgtgacctcnaacgcaggcngcgtgaccagnagncgttcacgcactgctgctagaggcgaaggttagnnaacacgctatctatatcatagncgaactagatgccatgtcactcgtctcactggnangatnangcggactagngtcaacgacgaagtctccctcttctgcagacgtccactccgctgtatgaccaattgcggcagcctgctcgcggcatagtgcatngtactatgtggagactctattatcgagtggngntnatatatggagactcataagcatgtgcntctcatgaaagcgagcctgtcagagagtgtcgtcatagtactgcccgtcagagtgatccacagcaaacaacgcgcacagtnctctattattttatgttcattgcgngacaagngnangangncacncagggncggcangngaccagccgttcgnngacangccaacgacgttnaggcancatagnagccagccgttnctcaancacgccgncncacaangagaccacttnncaggcangacgancgacacancagctcgtgcgctactaagttcggcccgtcatcnacgccactgctgttgatattnctgctatgncacacccgtcnttagcgctagagtcgngatgtgactcntagtcntncgctgnaaacgcgccactgtccagcgcaacnttgctngcgttngntgcactgcatgcnacttcanacgcatncaacgatatnaantgnctatacccagccgntctntnatctnaagatgcaggcaaagccncttagctctcgtaccagcaatnagaagagtgcgtgatgtatactcntacntcancgttgngacgcagtgngaaancatnacagctacgcggcgcaggaccanctggtcgacangtcgtagtcgtgcgcaagccgaacacggtcgctaccatctatatactcaccgtcagtaantacnacactncgcgncnagtngcagtactantcantcgacaacaatgatcangacgcacngtgccgcaagtacacgntctacaaagtagantcncatcacagcatgcncactcnacacacgagatcggcgtancgnagncatntccnctatagtntacgatnatngnanagtcnaatcgatcntttnatatcntacntacgtcatcgccgaccncngcatctagtactatnaatatctttaacgcttctatgtacccnngtacatctcctagtatactagtctatatgtccgnacntntntggatcagacgatagcatgcatnactantcaggctgtgactctgngcnactgactggtcntgnagtngtcntcgntagcctgaccaccagtagtatgtcatgttgtcncagctagtgagncatnatncaacgtcacgangtcgcgcnaccactacncgnntcancgactacntagctgagtcatatcgtntctcacnacggacacagtttaaacgtancagtannatcatcgcncagcgncgatgatatgntnnancagtctnattgcgaagtcgtcgagttgctacacngcnagnacngancggaccgtantcgntgccngcanacntnctgantatatntgacgcacgtcatnatcaccgatcacatctgctgcgtcngcgatnatgatnagcgcncacgagntcganngatngtcgacgntangcnantctngnncgcnacagcngttagcaganncgnctntctnnctncgntgncantgcgtcgagccacttcctancnntttgcnnatncgagtnagtccnnatccgactgcccgcannctannganctaatagtagntcactcntaccattgcnncactgaatcgtngcttnncncntccgcncgntnnatttcatgctnagngtagataagnnantactnacagntgatcancangtgactgcntanctgactacgnacgtcnagctacnagntcctatcgactgntgtcgtcaatcnagctaancagcngtnanctgactatacnagatcagtattactaagact

SEQ ID NO: 9600 - DNA, 1889 bp, Homo sapiens
  misc_feature (1)...(1889): n = A,T,C or G
aaaaaaannnnnnnnaaaannaattnnnnnnnnnnnnnnnnnnnnnnnnnaaatnnnnnnnggagaagntnnnntnnnnnnnnnnnnatnngtnnnnnannnnanntataannnnatnnnnannnannnnnnnnnnntnnagtntnnnnnnnnnnnnnnnnnnnannnnannaanntnnnnntgtnataanttntnnnntnaaaantatnnnnatatnattgatntnnnnnaataaagagnnnnaatntagagtatacggnnnnanntagntagaggatnatgnnaanataggatanantgatattatagtgnanganaaaggaggagtnnnananngatantgagtagtnagtnnnnngtgtgtagnagtgtgtatgtgnnnttactcactatccttcgaatcatgncngtctagtacgctatagattctcactgtagtgcncnanntnntnaattgtnntntcatcgcgnagagtacgctgtgctgatgctgtganagtnacganatgntnaggagagtaatagnatnnngtntgtagcagagaganatcagtgctatganatgtagtangnatgngagtagagacatgatgtgcatgattacaaaagatagatngatgtatngttgngnagagatgagnncnananantacagaatnnacaaaaacatagtatgtgttatagacgtagcagtagtgtgtcggatactgtggacacagcgagcaganaacaacgcaaacgcgagttcacgcatacanacatangcacagtaccagactnncntacncaccagcgcacagctcacggagagcagagatacacatgtacacagcagatgacacnagcaaanancacacgtgncgntagcggacgtgagnacgtagcatggagtgtcagctcagatgacacgcgaggcacacnanancacgacccgacagcagacgtatgagcgcagatcacactaagtagagagacaacgagacnagactaacgccgacatngacgcgtctccacaactgtcntgtctgctctcgctcatacnacgcgtacgtcgctcactggctgcgtatcactgctacgctcgcgacgtgagcggntacgaagagcgtnacgcgtcgncacgagacatgtnagaacnagatcatgagtattacggatcaggtcgtctactagagatacagntatgatagctatagtgattgtgtatagttagatctgacgtactatacagctgtaggtcgncatacgtctcagatgagatgaacangtaatcgagaacacngnatgcgaatcggactgaatntnagcgcnantagtaggacgtggcgncctcgagcgacgtagcactagtagatnantgntcgagatatntcaataagtanntgactagtgatcgtgacactacggatgcacggagcgnaaggagtgnngcgatcccagtcatacacnactctgatgcncacgccgntcgtcactancggctccnctagacatacatacgttncgcactcgacgatctcactcgcagtncncnacatcgtngtcgactcnctgatacagtantgtcagagatatactgattcgatctactacgagtnatatagcnacagcatcacnacgatcgcantatgtcgncacagacagctcntacactagcgcgcgagcgagacatgcgtgcacacacgagcagctntcgcgcgttatgtagtgtgtatgtcncantcacgcgacgcatacgacactagcatccgacagagagctgacacgacacnnntctcgactacacgactgagtagcgaatcaatgaganncttcagagtcgcagcgtcatgcatctatgaacacatcacacnagacatatgtacacagagcagagtgagcnctcacg

SEQ ID NO: 9601 - DNA, 754 bp, Homo sapiens
aatacagtcagccctttgtatccatgggttccacatctttggattcaaccaacagcagagagaggaaaaaaaaagaagaaaaatatatctacataaaaatttctgtatatctatctatatataaattgcatacacactgaatatgtgcagactttttttcttattccctaatcaatacaatataactgctatttacataggatttacattgaatgagccatcataagaagtctacagatgatctacaaatactgaacagatgcgcttacattatattagaataccctgcccgttgatatcacggaaccgagccttgtcggattttggcatatgaggaatgttctgaaaaaaataatccatggcaactgaaagatcaccacactatgacataaaaatcctaaaaataaataaccctccacagagtatataaaatcactacgacgaggagataaggtctctttcgacactcaattacctagcacggctacaattttgctaatcgcaatatcactacactgttctccaccactgtgttatcctaccgatgactatctcgatgccaacgacagatattttccgcaaataagaccatagtccacacatcaccaccaagacttcatatcctacatagacatagcgacagatccaaacacgcgcatcaactgtatatcattaactcctacccaagccaagtgtaggagatgttgcattataacctaaatatatacttcgcagacaactaatcctttagatg

SEQ ID NO: 9602 - DNA, 795 bp, Homo sapiens
cccctctgcccaccatcaccccaagcccagcatagtccctgggattcacgagctcacctctgctgagttgaggacattggagctgctgggacaggtctccaggctggtgaactacacctccccgaacgtagagatgccggcattgttaacgaggccccacatccctggacaggatatggatagatgttcatttaccacatgggcttggcccagacattgcccatgaggctgcatgcaatcctcctctcagcctatatcctgggatttactagactctcgcacatttctctaatgactctcgttaagattcaacattgtactataataacgtcttacccagggaatacgtcagatacctatagcaaggccagacgatattgagcgtccccacgagaatgcaatgttcttaaagtctactaatctctgatgctgaaccatacggagtgttgacaaattagggccaatatgggtgtgtttcctcctggccaggcctggcactttgatagcagcgcccaaatatctttagcctttggtcaagtttggggtagtttataatagcacttgttttcgcgctggccgcgactctccctcatcaacgcgatacaatattgagcgctaggaaagtgtgtgatcaaaccaatcacggcttactcaatccttttcttgtcatatgccgcaattcaactaatcttgtcgcttactagtcttatcttttcccctcacttgttcctcaaaacgcccggagtttgaagagattttttagctgtgtattccgtaaacaattgcagatagata

SEQ ID NO: 9603 - DNA, 761 bp, Homo sapiens
agtttcgctgttgttgcccaggctggagtgcaatggcgtgatcttggctcactgcaacctctgcttcccgggttcaagcgattctcctgcctcggcctcctgagtagctgggattacagtatccaaccacgttgatcacttaagaaaaagaagccttgtgctattaaagaagaataaggaggaggaagaggaggagacggaagagaggagaagagaggagcaggggaaaagcatacggacagaagaacacacaaaagactgagagttgattctgatggcattttctttcttaggtagttttttctaagctccagactcattatcatccttgttttctacaagccacactaatatcatcttaataaattattttattttttgctgaaaaacatcttgagtccttttctgtaacttgtgatgaattaattcctaaataacgtaggtcacatgtgctaataactattgttggatttgttgtgcacttcaggcagtttacataaatgatggaatattaggtctgaacatttattccagccaaccatctgggacaatcagtaccctaggtagacatacccacttcaggagtgttcatctattaatggatcacaaaggccactcttggggagataactgcaagctttcagctcttgctaaatccaaaggaaaataaagataatttcaatccctgtggctctaatgttccggatggaaaagtgaacctatctctcctttttaatgtatcttccaagtccttatacccc

SEQ ID NO: 9604 - DNA, 137 bp, Homo sapiens
gctaagcgctactttataatgtcatttataatgtcattccgatatttcatagtactttatcttatacacataagataggtgctatattatagcgtttatttacgtaaataaacaagtcagatataaaaaaaaaaaaa

SEQ ID NO: 9605 - DNA, 666 bp, Homo sapiens
  misc_feature (1)...(666): n = A,T,C or G
agtacctctttgnnatgcatcagggtgatgtggggggggggaggggagaggggtgggtggggctccgggtgaggggggcacgggggatggttgcgggggtggctgggctgggtgtggggggcgcggtggggggggggcggggcgtgggggcgatgggtatgggcggncttgctatgggattcatgctcgtctgtgggcgcgagcactnnncaagattggagcatcgcaaggtaaggcatcccacgncgggcctcgtcctccctatcgcatctggtatctctacttgaccttaccggggcccattcagccacgctgcagggggtnggtggggggtgttaccgtttcgtcgtggggtgggggtgggcggcggggggagggcgtgcggggggggggggccagtggggaggtggggngggggcggggggggggggatgtgtgggccggaaggaggtggagggagaatcgggcttggataatagagcgtggttggaaagcgcctgctttngtcgggtttgccagtttccttttaacagggttcccccaaacactttctggtaatggggggcttgtctttttatttttccacccacctttttttaggttttttatccccaccttaacattttgattaagccgcttttggttccaaaccctttnaaactagac

SEQ ID NO: 9606 - DNA, 895 bp, Homo sapiens
  misc_feature (1)...(895): n = A,T,C or G
ggggggaaccanggggnnnnatacaaaaaaaanacnnncctttctcggaactaaacgcctcaaaatggatctgacaaagccagcgggatacataaaacggggcgcatccagtgatttttcggggcttataggcctaccccaactaaagggaaccggccgcatcgcactttacacaacaatcttaaacataagctgtgccgggattgatcattaaccaccgcgccaggaattgtccgttgagccctcagatcctcggttacaagcaaggtttggacacactccaagggggtggcacaagcccttgtctccaccttgggaatgtggaccaaagactggaccgggccgtgagggcctcttatggccaccccaaacgccatggggttgggtttctactccgccttgaaaacaccagagtgtcaaaggaggccttctcttaagactgcatgttgagaagagtggcaataggccgggggccccactgggcacccatgggggccttttcccgctacaggacccacccacaagatttgattttctagggaagaggggttttccgcccaacataaacacacccagttggggagaaaggcggcccccccctggtcccctacttttgaaaaaggccccccccctccctaaataaagacaaaggccttctttagcaattgaggaccggcgcccgctgtttttaatgatggaagtaaggccggggccttcttgcgaaccaaggtgtgaatagtgtggcagaacccctctcctttaaataaaattttttgcgggtcctgtaaacggaaaaaccctatgttgggcattggcccccccccacacaactccccaaaattcaaactaaaaaaggggggcggcccctcggtcgagacgagagggaagaaatctt

SEQ ID NO: 9607 - DNA, 806 bp, Homo sapiens
  misc_feature (1)...(806): n = A,T,C or G
ctgntctggaagagtaccatataccaagttggcacgcaagaaatactttctgaagaagagaatgaatgaagtaatgagaagtgaaggggagaagaggaaaatggtagaggcaataaaaatagaaatgaaaaggaaacagaaaggaatgaagactcatctgttgaattcttgcactgataaatggtgttcagaaaactgattatacgcaagcaaataaaaattcaataaaattagaaccttaaagcataaacaaaatttaattaaaacttgatcaaagaccttaatataagccctaaaactacaagacaattagtagaaaacatgggaaacattgtcatggcattggatttggcaatgattttttggatatgatatcacaacaacacaagaaaaaataaagaagttagaatttatcaatattattggtttttgtgcactatcaacagaatgaaaaaggaatccacagagtggaaggaaatatttgcaaatcccatatctggcaagggagtagtatccagaatatataagaaactcctacaaatcagcaacaagaacaacaatgagaaccaacacaaaaaatgaacaatccattaagaaataatcaaggacgtgaatagatattttttaaagaagatacaaaaatggcccattaacacatggaaagtccttcattgtcccaatcattagggaaatattaccatgaagagatcccactatacccgctaaatgactgaaaatcttagaaaaaagaaatttttgttggcttttgtaaaatgttnaaacctggcctttgtggtgaaaataaa

SEQ ID NO: 9608 - DNA, 1128 bp, Homo sapiens
  misc_feature (1)...(1128): n = A,T,C or G
aaaagagaagagaaanaaataagaagaaagaagagaaagaggnggtnnggacganagagagagaagagacaggaagaaaagagagaaaaggcctagggaagnaagngaacatggaatgatagaacaagcttataggagactggaagagacgacaggaaacggaaaagagaactaagaagaaagagagggactagaggagtgacagttaaaagtngaaagaaagagagaaaaaagagaaagaccaaaaacaaaannngcaaggaagagaaaccacccaacacggacgcaagagacacaganagacgaagaaacaaagaacataatcagaagcacgcaccaaccccgcacccggcccgccacccgacgaccncaaacaacaaccacaccacaaagaagcnaaaataacacccacacacccgacgacaccaaagaannaaagacaaaaaagaaagacgacacgaggaagcgccacacagaccacacacacccacagcccccacgcaaccccaccaancccacccacacccacccccccacaccccgcccccccccgacccacccccccccccccccccaccccacaaccaccccaaccaccccccccccccccgccccccacacacccccacccccccccacccccgcacccccgcccccccccccccccagcccgcctcgcgcccccacacacccccaccccacccgcccccgacacccaagccacacccacaccgacccgagacagccacaccaacagacacacacccaccacggcgaacacgcacaacggacagacacacaagaggccgaatacagaagaaccgaaggcccgcncgctcgacacaaaccaacacacacccaccgaccacgccgacaacccccacacaccacccacacacacccacacaccacgccgcccaccatcccgcccccaaccaccccgcaccgacccacccacaccacccaccagccccaccaccaccccaacaaacaagctccccgcacaacaaccccacccaacgacgggcacgcaccgacaacgacccccacccaccacacaacgcaacgcacaacacaagaggccagagacccaacaccccacaccgatcacgaagaacagcgcagcag

SEQ ID NO: 9609 - DNA, 1017 bp, Homo sapiens
  misc_feature (1)...(1017): n = A,T,C or G
cagtttataaccacacaaaaaaaaaaagnnnggccggtttttgtcgacaacccgggaaagttcccggtttaagccccgggacacggggccgctaaagatcaatcgtttcagccccggttttattccccttataaaaaagcacccaaaaaagaaagatagcgggcggcggtttttttatattgtctttacaaaaccccacataatacaacaacacaagagggcggggttattaaaatagacctgaagcaccgccttttatagaagcgcgaaactttttttttgggggggcgacacacaccaagaagcccgcaccttacagaacacccccctacggacgcgtgcaataggattcccccccgcacgatccatacaatagtgaaaacagagcgctcctttcttaacatttctgcaatccccacccccacgtacacagtttaaccgccgagcgcaacgtgcttttttcgccccctcaccctcataccgttaatatatctagacccgcttcgcctcacactaaaatacaaaccgcacgctcctagtagtatttgtaataggaccccataccccccactcgcccaccgcctttatctctattattacaaacagcaccgcaatcaagcgcggttgcgactcccgtacaacgtcatgtctaccacgcgagattgtactcacccggccgccacgccctatccgctggtgataaccaactcggatgtacgatgatgaattagcctccaccccgtcactattcctgccctctanctagtatacgccacccgtctcaccctatttctaaatcatatgactctaacgttagcatacgcatacttcaatacttacgcactcgcattcacctatccggaatcttaattattacacaccactaccagtcgaaccagcgacaagatgccaccagagatgtctaatatccgcgtaccatagaaccatatcaacgcggtacatatgagcgtcgctgtaatttaatcaccccactcgcgattatctatatgataatac

SEQ ID NO: 9610 - DNA, 757 bp, Homo sapiens
aatgcctggtatgaaaccaaacatagccaactgtgcagctctcacttgacattgcatgagaaagttcatacacggatagcatcaatcaatgggtcagtgttctacagtggaagttgatggctcgaacctaaatgtgaccaccgcgcggaacctggctccacccttattgactgtcaacgatcgaaggaactcataggactgtccagtgtctttctcgataagcatgtggaaacatgagcattcagttgcttgtgacattgtacaaggtgaatatcttagccagacttgccgaacaattgaacaaattgatgctggaaaaagagactgcagacacaagcagtgcattgcattccccgatgcccggaccggtggtgaccgtctgtgccaagcctggatacgctgacccagagggtctagatgtttgagtaatagaagccatgagaatgcacaataatatgacagctgggaaaactggcacggtgaaatctgtgcactgccaagctgtatacacaggtggagaaagggatctggtctcagagctggaatgaaggatgtataacctttcagacgtaacccactttaactagccattcgcatgatgctatcacacacaattgattcacgctttatactggaagccccctgtgcagatacgtttacgtgatccttcattaacagagtcaggaccacttttctgccacacactgccaatggaaagtctcattcgtagaaaactgcacatatgacctttacttcg

SEQ ID NO: 9611 - DNA, 1700 bp, Homo sapiens
  misc_feature (1)...(1700): n = A,T,C or G
aaaattttaaaaannnnnnnaaaanaannnnnnnnttnnnaanaanattnagtngnnngnnnnatagtnnanatnagnnnnannntnnnnnatnnantnnntnntnnnnnnnnntnnntttanntngtgnnnnnnnnnnnnnnnnnnnnannnnnaatnannnattatatttttgtattnnnntnnatnntnttannnanatatatgatgttnnnnaataagattnnnnangnagtaatatatagattatnantagatattttnatatatnatatgtatatnanantagatagttgtactatnaatagtatgannnanatagaagagtnatagatatnnnntagatgatgagtgatgtgtgtangagcgaggagcagtgaganagatgacaagtgagaagcgcgagagancgagagtgagcgagagagcaggnttagacgtatgtgaaggaggtgtntgagatantatangagatgagatggtagtataggngtaatgcatgagtcatgtagtatgtgcatgagaatnanangataagatagatgaggtatgantactagaatttnacatttgagatgttcgtagtagnacntntataattgtnctaatgtaagtgtcatannnagtaagaatatagtgtgttagtgtanttgtgctgtcgctattcctcgtattattgtacatcaacgcatccgctcctcactgacgntgcngttgcacgntcgactatagtcactcgtgacagtgaatcgtactgctgacgttgctcatgtgcanacgagcagttagacggcagcgtcctagtagtgctctactnacgtctcacacgctaccgctcttacatcgctccgaatccgtgctcgtacgacgctgctgcacnagtcggggcctcgccgtacgtaccaagcgctacgtcagtgccactcgcnccactgtgacgagacagcacgcncactagtntatccatacattagtcgctaacttcgtgntcactcgatgcagtgnntagtagcagcngcatgaatatcatncnagcgaaacatgctgtcattgtatacgttcatcgnatctgtgntgtatgctgtgcgtgtgtatgaccgcggtgagtggagtgcgcgtgtagcagngtgtcgatgtagtgagatgcaagatcgatgttgtgtgtgagtcnnacgatgtagttggtagtgtcnntanagcagtacatgcatagtatgtnactgtctatgacacgagatcggatgtagtcgttgtgcgcacgtgtatgacgatgaatcgtgtggtgatagtagacgagtcgcgcgaccngcagcacggcgtcgactgattgcgtcgcgcaggctctatcgcccatcgctcatagctcagcgtctatgcccngtggcgcgatgtatcncnagcggcgnctcacgcgcatcactctacncgcgagtcattacgttcttcactcacgactcatcgtcgtgccnacgtgtacactcagtagcgtcaccacgtctcagtatgtaacggtacncntctctctcgcgcacngcntccgcgatncgcgtcgccagactctatcgtaggncngcatgtcggcgttctgatggttgaggtagcnanacaggatcatgtagnacgtatgtagtatcagacgcgcgcgcgcgtcgctattnagtacatcgaccgattcgtctgtacaacagaggagcagacat

SEQ ID NO: 9612 - DNA, 731 bp, Homo sapiens
  misc_feature (1)...(731): n = A,T,C or G
ctcctacctggtgatccgccgcctcggcctcccaaagtgctgagattacaggcgtgaaccaccacgtccagcctagactatagaagtgacgttagacaaaaagcaaattcgcgcaattttcttattcgagttcaaaatgggtcgtaaagcacgggagagagcttgcaacatcaacaaccacggtnttggcccatgaactgctaatgaacgaacgtacagtgcagtggtggctcaagaagttttgcaaaggagacgagagccttgaagatgagaagcgtattggccggccatcggaagttgacgacgaccaactgagagcaatgattgaagctgattctactacatgagaagttgacaaataacccaacgtcagccattttatgggcggttcagccattgaagcaaagttggaaagctgaaaagctccatatgtgggtgttatatgagctgagcgaaaatcgaaaaaatcgatccttttataaagtactcttctcttatcctacagcacaacaaccaattattttttagaccggattatgacgttgaaattgattgtttacgataaggtctcatgacctagttattgggtggagcacgaaaaagttttatagcatcttcgcaaggctaacgtggtctacaaaaagggtcttgtcgattgattgcgcgttagtcgttggtcttattcgttccaggttcgtaaatcgacatgcaccttgtttatttgtaaagtc

SEQ ID NO: 9613 - DNA, 1523 bp, Homo sapiens
  misc_feature (1)...(1523): n = A,T,C or G
aaaannnnnaaattnnnnnnnnnnnnnttannnanttaaaannnaattaannnananntnnaatannnnannantntaaanannnnaantnnnntttnaatnnnnnnnnnnnnnnnnannnnnaattaattattttannnncnnnacaatnnaaaattatttcnnaacaaatnnnnacntgaaatattnnnnaaattatataaattnanattannnnagagagtatnagcnatattattnnnatatatatagttaanaagaagtattgaacttggcaccgtaacagtagacagagtcagagaataagcgtatcactgagtgcggccgacgttnnagcgtgtgattagaggatagtgttctctgcgccgtgtattcatatcactccctgaacacattnntatacattcgtgagtanatcatataacatgtncnnntacatnatgaataaacaatgtcatataaacnnncnnnanaaanaagataatccatcnaccatacatacgattntangacagcgagtgtacattccacnacgcgaagttacacttctacaatttatctcatcgtttgatcactcaattctacctcaatctactatctccttaaagctcttgcctgtgcatcccatcggtacaactccaaaacgcttgtcttctccattcatcttccctttctctattctcgctcctcctatgcctctcnttcctctacatccacactttctctcctgtctcnctcgctcgcactctcgctacttccactcatctactctcatctcactcctcactgtgccgttcccacggttcaactctgctacgtttctcacatctcgtggtctgtctcagatcgtgtcacaccgtgttagtagcgcgcatagcgacacgtatgatcgccacgttagtaccgctaanatgagactatcgagtgtcatcgcagtgagacgacggatgtcgtctcgagacagtgtgtaggacactatatcgtcntagatgtatgcgacaatagtatancacacagtattttacgtatccgcngtatactggtacgatatgattttnttntacatttatnatgtagtgttcatgagtcgcacatccattcatgangtagatcgagatatntgtctatgatacgtatcatttctaatataggccgcntcaggcgtgcactagancctcgcagctatgccgcgcncagctctcgtctgcatcatgagcacgtgcagagagtgtgcactantagagcagagtatagtagtgatcgcgcacagctgncgacacnactagacctngtgtatcagtagtgtctacaatgatannttagagattnttgtagatatatctcctagtctatggtcntatcagtacgtgagcgactgtagttattgtgataggcgcgtggctcgctatattgatatgcatcnccgcacactgactcctctactgatctcantctctccgatcgtccacgccctcgagtgcgcaatacgctcagcttagaagcgcgtacatatttgtacgtct

SEQ ID NO: 9614 - DNA, 856 bp, Homo sapiens
  misc_feature (1)...(856): n = A,T,C or G
caaaaggaaaaatagttctacggcagaggtgcccatctcccccggtttggcaaaacagcggggccccacccttcacattggtttatggggccctcttggcccggccttcgtttaggcgaagtttgggtggccccccacccccgggccattctagggaaccccccccatgcaacccgggggggctaattctcaaggtccatggtttctcagctttggtccggggcctggccaaccttgcccccaaccatttgcaaggctggggggcaaggctgctaatgatataatgaatcccttaaaagtaacgcaatccaagctgcccaccctttttaaatatgttcccactcctttccctttgcaaaatatatctttataatcccaaaattgaaaaatatgtttaaactattagtttttgtaaattggaaagtcagtacaatattgacaaatttatttataattatacatctgagtgttctgttgatgggttgatgatatttccatgccatccaatgaatacataattcaatgaattttgttatatatttcattgatttatttctcttgatttcattttagcacaatcattatttacatttttatgatnaagattttcaccccccggttccattcatagtaatgccaaatgagatcacatttcctgaatcattatactttgtatatattttcccttagtttcaatttggagaaattttgntttgcagaatgtttagnaaanagaattgtcaataaaaattttatagtaatacccgccttgccctgaatnnnatganttttttatgcatgttgaaacattgtaatggaattgttgtataatgatataataaagtatgatcggcca

SEQ ID NO: 9615 - DNA, 1658 bp, Homo sapiens
  misc_feature (1)...(1658): n = A,T,C or G
cactcttgctccaaccgcagatgctcactcctcgaggtgcatgagtaagcaacgcaccgcgcacacgccccatctcagagacgtaatacgcgcacattttgtccacggaattataacgcgcgaatgcaaccgtatcactgcaaggacagcgacacgcaagagaacccagagctgatgtccgtgaactctggtgatctcgatcagcacgtccttatgttcgcctcttactactttaatccacgcatgtccaacacctccggcttctggcgctttaacctgtcgacacgacgctcatacttcgacgtcctaattctatataattattccactngcctattgttttcctccatacgctcgtgcgctttacgagcgatacaataccataatgttatccacgacgtcgcgacagcgtatggtagactgcgtacataagagcactgtggcgaggtgagcgcgtagccgcggnactagcgagagcacataccaggcgtcaatagattagtacgtcatatagtagacgtcgcnagacggtcgcacgacgcgccattattangatcagacgantatgagngcgtctagttaattacaccgcagcacggatcagatngcgtcttatcttattcgtatgagctatncgctattcaaccaccccagtttatctgccacgcactacaccccactactcgaccgacaccgcacagttatatccttccatgacgtacttgcccctcactactagccgactcgcaatgtacaccgcntgctgccggcgtccactactgaactantatgaatgatgtacatctgtatagtctcgctggacgatagagctntaatgacctantcatagagtgcgagcncgctgcganacgcgtccatgcggtgatcatgcgagaagagtatacagcgatncgncagtcaatgcgacgaaagnctcgttcgctaacgagcatcgcagtcgacagactgtgactntggttnagctatcagcgcacgctgtcgtcgtactccgacgagtcagtgtcacgcgcacgcgtctcacgcgcagcgcgtctaatggatatacantcatantagatatgccgtgatcgagtatagngcaccgcgcactagacgacaacgcgactctgctcacatcgctgtgtctgctcgacactcgctcctgnaggcacatgcgtcgcgtcgactacgcgtcntcncactgcctcgctctgcgtcgatcatcacattcatctgngtacgctgatacagtactatgaganctctctactcgtaatgtcgcatgcgtgaatcactcgagatgganntagcgacganatcgtgntacagagtanctcgcgcactcagacgtcgcgcgagtnagacgcatcgcatctacngctgcggtgcggcgagtnagatagagcagtacagtgcgactcgtacatncnactgatatacgctacgnancgtcacgctcancacgatgtnatccatcgctacagcacagactctacatgcatacncngagtacgatcggacgatatatgacactcatgcagccncatggacacgtngactcgacatntcacacgcgagccgcactctcgntcgtatctcactacntatctcncgtctatacatctatcgtcatttagtcntcgctcgcgccgtcgcng

SEQ ID NO: 9616 - DNA, 1618 bp, Homo sapiens
  misc_feature (1)...(1618): n = A,T,C or G
ggggggggggnnggnnnnncgggcgcgcggccggttggtggttgttgtgtggtttgtggtgnggggggggcaatatatttttttgtgggtntggggccncgcgttttttgttacggacggcgggggccggcttggtcgcgcccgggtcggagcgagcgtcaacggcggcgagcgcctccgggcgcggggcggcacggtgtgtgggcgtgatctctttcctcccgccccgcgtgcagtgcccccgcgggcgggcagggtcggcgcgcctccgccccccccggcgcgcgcccacgccgagcgccctccccccgcctccgcccggtcggggcgccggcggcaccggcggcgggcggcgcggcccgctgccgccccccgcgcccaaccaaaccgagccgctaggacataaccatggaagtcataaaaaaaagaaaagaaataaaaggaatataacaggaagacagtgtaaacgtatggagggccgcaagaagagagacgtaaagccgagtttcgttattgacacatacacatttccccgccgcaccaacgtaaggccgtaggccgccagggacacgagcaactgccgcaccgaggtggcgacactccgccccgtttgggcgttgcgtacatccgctttttacactttcgcccgcgatcgcatttgttgccgcgagtacggcgcgtgggtctcattggcgtctggcccacctggaggaacagggtagaaganaaagcagagcggcgagggcgggaacgcaccgccgaacagaggacacgactatcgctgcgcctcaactacatattgtatatgtaaagaaggtaaaactcgcaacaaaacaacagcgtggtactagtcggtcactgtgcgtatagcactcgagggcgcgttggtcgagcaggataatacggcggcgacgcggtacactgactcacacactcataatcagattcataactacacgcaaccgtgcgtcagactagtacgcaagagcgagtctaatctaaacgaagtaagcgagntcgctaaaataagagacgtgcagtctcgggtacaaactcacactgacggtacaccagtcgagacatgtncgtgagcagtcgcgaagcgtagtgcggaattaagggacagatcacagtgatctgcgagtanagcctgtgtcgtgggacatagatgtgagacacagcgaagcggcgaggatgtacgcgcgccagtgtatgtcgattatgtgaggacgcgcgcantgtcgtaacgaacgctgacgatacataaacgctgaagcacactgncatacaggcgcggtaanacgccgtatgacacacgagcgcgcaacatcgtctcgacgacagtacgaacagganatgttaggccactgtatcagagntgtacgacgacgcgttcgacgagacgtgtcgaatgagagatntaatacantgcatcgaccgctacactaatatacgantgcaatcagtgtcgcatcatcggacacgaacatctctatgagacacgagtanacacagagtcgagcgtgtagtgaggtctgtcgtatcacacataaactcgnggatatatcaacgacgagtcgctagcagcttatgtatacagagcaangacgcgcgcacg

SEQ ID NO: 9617 - DNA, 726 bp, Homo sapiens
  misc_feature (1)...(726): n = A,T,C or G
gggggaaaaaacanacnaannaaacaanncanaaaacggntttttcggaaaacaaacacctaaaaattaagagccgggtctggttcctggatactttgagccagcccaaagaaaccggttaaacagccggtgggagtttatccggaaaaaggggaaccgcccgaaaccgcttttaacacaccggcctggaacttatccggcatagacaatatatatttgcgcccggtttaattcccagactcccggtaatgtaaataacacacgaaacgggggggcaacccttttccccccatgggcggaaagataccaaaagaccccggctcggcgggtccaaaatattcaccatataaaccccccgccagcaggggcccacccccaagcgggccccaagaattactccctcccatccggaaattaaggctgggcccgaaacttgaaacttggatagaaaaaaaggccctgtttttctttcatggggggggggggaaaaacattatatgacacccaccgcgatgacctaagatatgccctcccgaaggcgagggaaaactagaatccccaacggctcctaagaaaatggtcctttggaaaatattgaaaaagccgcccctcaaaaaattttgggaatgaaaaaaaggaaacacctttataaaaaatgtacctttggggaagagaaaaaaagggttttgaaagggtgacccttccccccaggcaaaaaaaaaaaaa

SEQ ID NO: 9618 - DNA, 120 bp, Homo sapiens
ccataatgaaaggaaagtgacctgcaaacatccagtcacaggacagccatcacaggacaattgtatttttgtagtgaatgaacagactgttgcaaccatgacatctgaaataaagaagga

SEQ ID NO: 9619 - DNA, 332 bp, Homo sapiens
tgtatcccagagttccagaggtcttcagaggagatatattaccatggagagggttacatgtactgcaggtgcaacttcacagacctcttttcataggccgcggttcatcctttgaatattggtccaagatactttggtgtcactgtgttgattaacttgatataagaagaaaagtgtatctgtttggactaaaatagaggttaacctctgtaattttaatctcacggcatcacttgattcttccttcaattttactgggttttactctagtaacttcacactagtaacatcaaaattggaatttgaatatgcacattgataataaatcctga

SEQ ID NO: 9620 - DNA, 1469 bp, Homo sapiens
  misc_feature (1)...(1469): n = A,T,C or G
gcangtntgnagtcgtgcttgtacatntcatctactcncnatctcagtatgcagtactgtatatcacactnattcgtattatatctctcacncgagacacgttgacacgtacgcagtgtctantacttcacgctatgatctctagagctnagtactcntncgacgtgactattcacgactgatatgagcgtgangnatgtacaacacttcgtgcgacgtagcagtagcncgagangtgtcgacgtgcgtagtcgcgtcagcgcgnangtaagaggtagacacgatagtcgcatgacgttgtatgcgcgnctgtcgagactagtctcaactatcgtcttgatgagtncgtatgcgtcgactgccctacaccgacacgtggatgtccgctcgtcactctgcactcagatcgtattacgagaaatattgtcgtgttnatccgcctccggagccgttcgtacgagtcgcagatgactagaagctacgcggcgagagcatgcatcttcatcccagcgtactgttatctggcnagcgttgcgacgtgggtgcgcgtcactgagcgtatgcgtcgcaggcgcacatgcttcngccactgacttattgctgtgtgtcgtgccggtctcgttaatgccctacttacgtngggtgagatcggaccttgtctacgcgcgcagcacgcattcctagantgctctcgaggacgtccangagactggctgatcgtattcgtcgtcgttgtctgtctgtcaagctgggtgcttggtgcgtgatgctnctccgntcgcagctcacctgcgtacgtccacacgtgtgatgtgttagatgcggcctatgctcgtcgatgctatgttgcgcgactgacaaccgtcgcgtctcgcgncncgcgcatgacatgatgacgatctaaacgcgatagtcacttcggtatgcccgctacatcgtgtgtcgacggcgacgcgtcctatancgtcgtgagcaagtaggctagtgagattgtagtacgatacgttccgatacctgccgcctcagtacagtgaataagtgggtgcgaaggaggtctggctgttgaaggtattaacatggtatgctgtttcaacagcatcgtatcctctcattactcttcccctcccgcctccgtgcgacaagaattcgagtcctctcctgttggccgacgtgtactgtctatctagggtgattggtcgcagactaggacagtggagcgaggggccacatgtagggatctatcgcgtcagtcttgagctggagatgtttatgcctctagattatgtcttgcggtaagatttgtgtgctgcctctgcgctccgcccctgcccgtctatgtttaagaagagacgcggcgcttggcggcttacgcttgtagtgttgtggtatatccagactaagattaaaagtccgcagtcgcgcccgcaggccctccttttctctcgtcgtgggtatggcccgactcgtcc

SEQ ID NO: 9621 - DNA, 1683 bp, Homo sapiens
  misc_feature (1)...(1683): n = A,T,C or G
tatgtatgttgatgcacagcgtctcacttgatcatgcccgacggtcntnacgccaagcgccagtagaacgtcgtcgattggnacggtgttgctgtcatatgatctagtgcnnanatggtatcatgttccatatgatgtctattatgtataggttntctaatgtagagtggtctatgtattgacgtctcngatctgtcacagacgatctncanaagtatgtnnccatgctgtgcacttgcacgtccacacacgcactcctcttcatgtctggtagtntaaatgcgttaacatgcgacgcatactggtcgtactccatttgatcncttatgagtcatagtgcgtgcacatctaagctncttgtacgctcacctggcnncatgcagatgagtacacgatacttcatcgctatctctcgcgatctatgacctcgtacatgcccaacttcggtcnnttcaccgtcagcctcctcgtgatcgtaacgatgacacaagacagtcgtctcgnnncctactgcagtccgactctacacacctggcacactgcccacacgatctcctcgtaggtcccncagcaccacncgtaagtaagtatatcnnncacaacacatagcttgtcatcacacatcgcttctatgagcagacgatngtccnctctgacgtctacctcattcgtcganacttctgctggttgcncgccgcctagacatcaagnagctctgngattcggntgatcnancntgctgacgnnccgcacacaccgcntgcgaggccgacgagtggagacatagtgcnntctatgcgcgatctcgactacngacatcgtatcaactagacgtcactgcgtgctactcatgtgtgtcacttcgtgtgccncgntccgctacgtacnccgagcgcagactcaagngcgnnntnatcactcgaaaacgtagngntntcnatcatatcttactgcgtcncncncgntagtgtaccncactataatgatgnatagtantatcatgagtagcnncnnnatctacgatactacgcatcacgcgatcntcctgctcgatgtatngactctgtcacgctcgcgtacnacacgctcatgtctgacatatgcgtgnctctctgttcgtgcgctctacgntctntcnacaagcactcgtntcgcgncgtacgttgtggcnccttcgctcatgctgcgatgncgattatgctcgacttactatcttntctacggcgcncctcacagtctcgctcnatatcgtcgcgcnntctaagagtagtgactagctctcnacatagtngnactaactcgcgcacgcacctcgtctcgccagtcgtcagcgcctactcatctnncactaatcgtaggctcatccgcgcggctgtctgcgncacgtcnacacgacgatgctcgtccnactctgcatctgtgcnttntcgtcgtnntntccngccgtctncnnntgcactattctatgaatgatgtntcctntatatcgctgattagtttgatattgtatgtcttctgtgttgtntntntncacagatgtctctgcacntatgantncacagtctntcgnccagagtgctcgactcagacncanantgctcgacagtgtcatcttgtcgagtctnnnncgtatgctgnctgatgngngnatgctgtatcgntgtgtgtattagcgtgtccnat

SEQ ID NO: 9622 - DNA, 317 bp, Homo sapiens
ggatcccgaaaaatgaagagttggaagattgacctgccaacagtagacacaatgaactgcagtggagaaaagctggagacaagaagagttaagtggctgtttcagtaatcaagaaattatggtttctaaagaaagtgacaatacaatcagaaataggagttcttaaattcttgcaatttcatcatgaagtgatccttggatgatgatactgctcccatacatgctaccttagaggtaaagtgaatagtgggaaattattctacttattcacttatagcgaagacaataaatcaatcattttgataaaaaaaaaaaaa

SEQ ID NO: 9623 - DNA, 1228 bp, Homo sapiens
  misc_feature (1)...(1228): n = A,T,C or G
gtgatcatgtagcactcgtatcgctacaaattctcgtcgctctccagttcccactccgatcggacctcttatgtaacacgtgaccttgttcaagcgagagtaataatgatagcggaccggtcccagcgtcagcgcatatctgagacatcatgagtttcacagcttggacgcgccagcagttgcgcaagtagtgagctactgacttcgaggcaccgcgacgttactncgagccatctgtcggaatccgtgggtatgaaggtgcgtgagatatcacccccccatcagcacagcgagctcgctgacacgcacgccaccgggaccctattcggtacagggtccagtgacagctactcgggcgagatcgagtggtgaggtgcggctacatcgggtgcgtactcctcagcgccccctcatgctatgtagtgtgacttctcgacaacgtgagcgacgtccctacggtaagcgtgacggacgtcctacgttgagctatatgattcacggttaccgcgacatcatcnatgtgaaggtatacttgataatcactatgtagtgagtgtcgcatgcagactcagctccttcgcgcgaacgagcacggcgtggcgcacgctacgtagcagctcagcacacacgcgcgccacatctctggtctatccgactgccagatatgcgtcgcgtagcgcacgtctatgatcattcnatagtgatgcagtattatcgagcgaatcctacgcacgacctaaaggtggagaagcgcaggcgagcacnaacgcgacgtgacagagcgcagctgatatctactctgaggcncgatccgcgcccgcgcgcgctccgcgcgcggtaaacgtattcggcatgcgtgaacatcaagatgtatatctgtgtgcgctaccacatcgctgactctgagcagcgcaacagcaggtcactcgagcgaggccacagcatgcataancatgccccgcagctcaccgaacgttcactgcgtagcgcgcactcgcacagatcacgactgctgagcgaaatgcccggcggacggagtctggtagactctgcaccgcgccctcacagtacgcgaagcaacacgcgaccacagacacgcctacacgctcattgctccaaacgtctcacctctgagccagtctcgtgtcactctaatacgannatcgacgcacaaatacatccgctctctcgaccggagccacaacctaacattcactaggagcntccg

SEQ ID NO: 9624 - DNA, 1214 bp, Homo sapiens
  misc_feature (1)...(1214): n = A,T,C or G
gttacatacccaagtagtcctcatgcttcttgcacaccccccgtctccccaccgggagtgcccactctcaccatcgtttcgctttctctattcctttcccacacccttcagtactatatgccacgactcgctcnctacncactctctcnactctgtgttccatctattcacttccccctcacttnccccagacaagttttcnnaccatgcccacatatcccacacgtgttctctccctcatgctnacaagcatcgctgatctgnccgacttcatcgncgacactcgcacacgaccncatatccacacaccncacacacactcacacgctctcagcgaatagttcaacgagcatanncccgcctacccantgatcatattaccattatacacgcacaacactaatatagagcagtaatccnnnncctgtgctagccctctcgcttctatgtgttactcccaatactgctccatntggagtncaccttataccgagctcatgcatgtctccnncacgttccatgtctatatctcacactctnttcatgatctactctgtcnnnccgcgctcgacagtctcccggctacgtcagatactgcagtgttacaagtactacgatgggtgtgatnnnatgtagactccataacccgatcatagacaaatgatatggtatnntagtacgccaaagcgagactcatatctntaagcagaaaaacgggctccagtaccgaacgatcgctcagcgattactccctccggtggatgatnntacgcaattcncactattgtgacgttagttgagtgaggggnnngcccgcgcctctccatcagatgtctcagcgcccaccgcgccccacacaccaactggccccacgacncacctgatcgttgtcatatcccatctctgcttctcatttccctgcccacgcctcctcatggacctcgagtcnaacgatcggaagtactacttgaagcataccctccagccacctgtctctctactactggctgttacgcacacatgtnacgnaactgctacagcaccactacatgccatatcncacggaccctccactttatccgttgctatacagtaggcaataggctagatatctcggnntcgtatcgcgatggcgtcatctgcctgatggagtttcaagaacacaaacaaatatcctcctcgtgtcgcattctagtcagctaattataggnccg

SEQ ID NO: 9625 - DNA, 1401 bp, Homo sapiens
  misc_feature (1)...(1401): n = A,T,C or G
tctcactgcctcgccccctccctccctctcctctatctccnctcccatactacgaggtctagcgcaagttcgcttgctatttatctatattaatnccattatatagttccgcttgtcttatatattatttccgatattctgtccccactgtgagagcnngagtttatgtctaccctatttaatctcactcctctccaatggccctattcttccctttatggatgtttcnctctacgttcacttcgtccgcctcatcgtctctcncccagcgtacgnaatctgtgtgctatactnccacggtctgcccaatcactctctactctccccaactcctctctccctctctatttccgcccggccctagatattgcttatattagnntagatatgttcccgtacgtctcggcccgttgcttcgcgacgctaatgtgcggagctntacgtctctcgccttttatactcactccaccaccagacgctctatctccgtcctcaatctctgacggcgctgtaantnccagtcactagtcaacctctctccgctcccacaccttgtcgatgctcncctgctccccggccccgacctcctgagatgatggctcacgccgacacccacagtgcgaggttagtagacntcacacgcttccctcgccctcgttctccctaccgatctgtctaccgcgcncctccctccgcacgcatcgtcgcgctctcncatcantctatatatgnactcacgtcttctcctatactccncttctagcttgtgtcaccgcgccctactgctntcctgatgatatgcgttntccactcgactcggnctccgcctctactcagtcactgctcacacggcccgcgcnnngccgccagcgctcctcttctgtactctnctatttatcttacatatcgcctacatatcttctgcccagacgctacgctctcntccncaccgccgactcgcagcactaccgactccttcctcgcatcatcctacagattccacatgaagntcctagcactcctctcacagtagcttgctacgccacnttaccgacccatacactatctctgacactgcagccactcctagcacctgacaccctcgctcgnatacctctaaggtgctcctgcatacacaatacgcgaatncaccaactcacgatcncactagctacattcactatcgtnngntgcacgtcccctctccgtattcgtcatatgcccntcactctcgcacatcgccgacgtccntaacacgcgcgccgctnnnngcagttgacgcgctctgcactacctgcgcgcgnctcacatatcaacggcganncagtagcaatgtagtcacctcaaccncanacgagtcgcaagcagcgcccgctcacactcaccgcccgtcgcgcgcct

SEQ ID NO: 9626 - DNA, 1214 bp, Homo sapiens
  misc_feature (1)...(1214): n = A,T,C or G
tgctgatggtgtcggaccgtcgtgcacgctgctatgctcctgttctctctccgcgccgttctacgtgctaggtncaggtctagnctctactagatcntcattatgatgcatcagattcactgtcgatacagtgccagcccagtgatatgtcccatccctacgtgtccatccaatgcccgtcttctattgctctccccctccacgctaacgttcctattctcagttcgccacctcctcccctacgttntataattcgcgttagatacgttcctcttcctccgccgctctcctggtcctaacgcgtccaccaccacgtggaccctgttatcctcatgtgctgccgcgacaccacgtacgcatagagcgaagagtgagagtgtcnncacagtgcctgcgatacgagagaatcgcnccactttatgcagcgtcactgagacgcgtgcgcgcacnccctcctcacgtcatgcgtccactgccagagcggccgagcgnccgcgacccctgtcacgcttgagctgttgcaacgcacgcgcgagaagagagagcgttgtaacgacgcgtccccgaccgagccgtgcgcaggtgatccgtncactgaggcccgtgcccggctcagtgtccctgggctgcgagccgcatcgctcgtctatgtcgctcgcatacaggcnncacccgtgtgtactgtnaacggatagtgcgtctcatatggtactcgatagctgcggagcatcatggnccncgtacagggctcgcgtacgcctagtaggnctcagtgtcctcgcactctcacgcgaatcgacgcccctacgccgaccacgcnnnncacctttcgcacctgctcagctgtncagctcgccgcgttgcatccaagtcacgctactntccataagcnctgctactgngacatagtcggntntggtntagtgcacgccccgccgcggcgcatcgctgctacttcatcgcgtccgtcactttccagtcgatggcgcttcccgtgngtcacatctgcaggattcatgagacggcacganttcacacacgcccgactatgccgacgattagcgcttcactactcctagacgacctcccgttcgctgnnnnccgcatgcgctcacgtgcgacgcgaccaccctcccacggccgttncactcacgtgcagacgcagagttntccggacagactatgactattctcatcctgtatgcgtctcnnct

SEQ ID NO: 9627 - DNA, 275 bp, Homo sapiens
caatatatcccaaccagcgcccgatattccatccaatatccaagcggtagatgctcctccgggaaacagcagggcatccacatggaagtagcgcaccattcgttggattgaacccgcagggaccgttgcacctatcaggatgtgccactacccccaccataccctggctaccacttaggtgctagaaactgaaaggcactccaaacacccctgattgagcatagatgatcctaaagatccatacctgaggatcaggcctcttgggccccagccac

SEQ ID NO: 9628 - DNA, 996 bp, Homo sapiens
  misc_feature (1)...(996): n = A,T,C or G
aaaannaaattnnnnanaannnnaaaatggataannnnttatnanntntatatantttnttaaatnnnnnnnnnnnntttaattattnnncattnnttaataaatcatacaaataatnnaagtagaaaaaaatgaaataaanaaatagnaaatataaataagactgttttaaagtggatatgtttgtagcccctagcattaaaaacaccaagataaaaagaaataattagcaacagacaaagaaacaacaaaattaacgaatacaaaaacattatattgataatagcaaaatctttagcactcctttaaaaaattacataacacaacaatcccacactactcaagaaatcccatacaagaactcacacaaactcaaaaaaatgaccggaaagacgcgccatatcatcactcccccaactcaaccagagcaccaccctaacctatccccccccaacacccctcctccgtctcactccccccccccccctcctccccccctcccgctcgcccatatccctccaatcaacagcgacaagtctccctattacatcacccacaataaaagctaaactgaatagactcgttacatcacaaaatatcgagtaatgaacatagtaagatggcaggatcggtgagtactatcccatagttataatctcaaatcctagctaatgcgtaataaatgcacgaagtaccaaatacaccacgtcgtaatcatatgtcgcacaacatagataccatcactaccaatcttatcttatatataccacacctaactactcgtcacgctctcttcttccccccaccatctcatcacctctaactcacctcaataactcccatgcgtacatttccctccacttttatttctccacatactcctcctatcccccctctctacattcaaataatccncaacagtcgtcgcccacatctatcccctcatgacacaaccagccccgctcatatccaccatcgatattacaaatttcacct

SEQ ID NO: 9629 - DNA, 1752 bp, Homo sapiens
  misc_feature (1)...(1752): n = A,T,C or G
gagtagatatagtatgtcacagcacggcacatgtatgcgagtcgcaccccngcctcgcaagctgtacgacagagtntnaccacacgctcgcacatacctccgtcctagcacagcatcctcagagctntcacagtgtagtctgactgttgcacacgtcaccgacncgtgcgnncnactagctattcgactgtgacacctctacatgctgncngcgctacatcagctatccgcntctcatcatgatgcagcgtcccaccaagatcggctatacgctggcncncagcgtgcnacagctgtctatgtccgcatctntgtagcgctcgcncnccacgtcattcatgtcagactagactcgncnnctctattgnatgtgctcacactatgtttagtcagatcgacgcgcnctatactagttacgtcngcacactactgcacgccgagatgtgctacttnnccntctatcatctgtcgcactcatagagtatcgcgatcgacgcttggcgctagtcgcatcagatcncntacactgcatnctgtcgtacgctgcgtcnagctgtcgctctatagtgtcctcgcctgcgtctgtcacagtcatgccagcgcgccgactgttcctacgtcgattgacgtcgnncacacgcacatcgcgcncatgtactgcacactacnactcgngcgaggatctcgctagagcgcatgtccgctatcgtcatcgtcgtgnnanncatagcacagtgctagcacatntctccactacgactccgtacattcgccnctagatcgtgnactactatagcgtagtctnctcacactgcttgcacacagtgctgtgcgtttgtatctcnacatacctnccaatatgactgctncctcacacatagctctcacatgagctggtactatatnanacaaggccgtcgtgctgacganagcattcatacggtagcgtggtcnncaagcgcnacgtgacgattgtatgtgtgacactgctactgnnncacgccctgtgtnctcccgacgtcgcggataggactggtcgacctcgtggatcgagcgtnnnnccagatcgactcgcagcnggcactctatctctcttgtnntcgtatcgtcgactngatacgtccctcaggttcgctntagtatgtcacctcgaagtacgatgtatattctcgtcatacgacgaganccacgacgtcgtagacntntcgcatacattactagagatatattagtatgttctgaggccncccactcgtctctctcgccctctctcatgttncactgtagatctattgactataacatgccacttgggatcacgcgacactgtctatatnacaacgagatcatcttctcttacgttgcactttcagtccgctcgtccgcgtgtggtgatcccgcaccctccgtacatcgnaccatgtagaccntgtatgagtctacttacntcggcgctctgtactcgtccccngacttcactcgccctcttntgtatactacctagagaccgcgacatgtgtnacgttactgccctctcgtctcggcatggagctatagtgnnnacgcgtgcctctacaacatctgactgtgcgctagttcgctctacctactctgttctttgcacgccacgtnccncacgtgcntcgctctacctcatcgccgncccgcgtgcagcgcgangtagagtgagccgaacntcgcgcggctctgacactatcatcccttcgcaacagacgacccctctaccantcg

SEQ ID NO: 9630 - DNA, 144 bp, Homo sapiens
gatcccatgaaacctgaggcagccctgcagactaccaccagcaaggccacaggatttcatggcaggtgcttcacaaaccagcttctcactcagctccattctattttaccaaatatattccttctgccttcaaaaaaaaaaaaa

SEQ ID NO: 9631 - DNA, 1430 bp, Homo sapiens
  misc_feature (1)...(1430): n = A,T,C or G
catctattataaatacactctctatcacgacagatgtaatatactctcaacacgtcggctagtcccagtctagtatcctataataccactaatgtccgcgccactctacagccactaacttatccacagccgtcgcgtccacgcgagcccacggtcggtagacccttaccgtcttgctgtggaatgaattgcntatcatttcctaatgagctctctctctcatccatctatatatttctctctatcgcacatatcgcacgaaggtacggtacactgataccggatgataacgcgcatctgactcactgcatcaaattcctacatggncacttcatccgccatacaccacggtctcgagatnaccacgtggaatagcaatgttcgtctatctacgtggtgcgattacgtgtgcgaagctaagttgcttggactacagtagtgtgcgtccctaacattacacacaaatatgatcagaggtatggcgtcacgcatatcatcatggatgtctcacacaacactagaggcgcgngtnctccattcattatcgttggccagcgcactgatccctctctctacacacgtcttgcaacgtaccagtctgtccgaatctncgccttgtgacatcatatatgtaacgctgtnnatgtgcgaggttccgccgcaggtgtgtcttgacggcgtgtacctgtacaatgaacttaggacgctgaccgtntgaagcttgtcctcagtgcgatgtctgccgcagccctattctcatataacgcgcattaantcgtcgtctntntactacttgtaagtcatctntcgtgtagtagttagttttacgtgcgtaatgccgtaagaggttatacgctgcgatcgttggncnntnttagcgtcgatcaactccacagcgtgcgtagtgcatacagatgtacgctcgtgccagcgatcgctcggactctctctcgtcgtatgttgtggcgtccaatcacgaaagtccatccaatcgtactgtatatcgattgtggttgctacagantaatacgatcgtacacacagcgactcgcgtattcactcatgatcagtcatatagtgagtgtggaggttcgcattatactatcagatggctgcactttatgtgaacgtcaccgtgcgtatatcntatcagacgcgaacgctgatatgtngtgtccgtacgcgttacgngcatgcactctttgctgttgtctatccggatcctnctcgagattatcttgtangttctagctgagtagactagcatataagttatcattctcctcgtggcaccntctacttgccaatgactatgcgcncagcgtgtcaatcatatggacgtattgcgtntattatcatgnagatatatgtctcgttgtatactgttccttgtgagtttcgttatgtacagtatacaacacgatactntt

SEQ ID NO: 9632 - DNA, 991 bp, Homo sapiens
ccaaatctcccagtccgcatccgcataaatcaaccataatcccatcaacgcgagcctccgccggaaaccagggggaccagtgttatctacagttttgaccgcacaaccttgattgacctgactgtcacggtatgaagacttgcctcagtttctcacctctccagagtcctaacaagttatcgtgtgacactacccacgatgtacgggtgtccccgctttcgccccctgttttcatcgtttacgctttccccccttggattgccgttcgtggcgcctgtcgccccccccccccgttatgtcccttagtttttgcgccgcgatgcctaggctgttggttgtccccacgtatatctggacggccacccagagcagtgatcaatgggttcacaggcccaccgttctcagccggtcactcacctgtaattttctgggtaccatttccgcatccaccatctccccacgtagaacgaatggtggccgggagttgaattttgaatgagcaatggtgagacatagtgtcccaaccgaggctattacaagcatacagtattgaaattactccgcgtcttagcgtgttagtcatcgggcaccgcgagaattacctcaccatatcgcagcataatgcgctttagtctcgtctttcacactgaaatacgccgcccggggtcagtgagagacgcatcggccccttacgctcgcatcgcccattgacccgtcgaatcgtactcgcctccgccgacgtcgagcgatggactgcgttgactattatatcgtatcattcagattgtaggcgccaagcgacacgtaggatgcgtgttggggatgtttattagattacgcgcgcccacataaattgccgaataccgggcgagtactaaacagaaactatgtcgttgtttttagtgtctcccaatctattgagatctacatgacctctccgagccgcctgtggctctcccccatcactctcgcgttgggtatactcccacac

SEQ ID NO: 9633 - DNA, 1709 bp, Homo sapiens
  misc_feature (1)...(1709): n = A,T,C or G
atcgagcggatctatgaacactagcagacgacgcgantggcngggtctcgtgcgcacgtatcatactaccgccacagcatangcgagcggctgtatccacacctagacnacgactgaacnacaccgtggagtgcgtacgtacagntagatatgctagagtgaaggatgtcttgctctggtgatacgatgacagacgtcataccacctgtcancgtcatcgtgtcgtactattcgcttgacatnactgttcgacgngngcgcgacagtcgccatcgtcnctactcacancagatcgatntgtgttgtacagncatcnctgtcattagatactcgcgtcctacagtagncgtaagtcacgatgtgccagtggtganagatctaactagactgtcnatacgctgtcgtacgacacgtcggtgttgcagaatagtgnatagtgantgcacgcggtangatctgtgtactgctgcgtgatngatgngactgccagtactcatagtcgtcgcgtngactagctgtgactcntggacgactgatcgcgtctatgacatgctgcagcatcatctcacgatcatgcgcgcgcgcgtgcgagcatcgcggagtgactcgcgctcgatcatacgacttgatgcttgcggcagcgatgtcgacgctngctagctctgcgtgtgtctcctcgtggtccttagtcttctgctcgacgatgcntcgcgcagcagtgcaggcgcganggtcangccatacgcgcgagacgcatgtcatgcgagaacaagntgcgctctgctatctcgccgcagtgtggagcgatgatctgagcgcactcaacacgcgggagcgtacacggcgagtatagcgtgtgtgcganatacatatantcagacgcgcactatccngtacgctgcatcgcggnatggcgttactccacggctgcggcgtccggcaagagcactagacagctgatgcntccgtcgataagcagcatagtgcgcgtgatcagctggaaacaccanctattaatcagtagacgcaggatgagtacggcgccgccatcgcctgttactctcgtcactcagccactgctcgccgctcgtacggatgtcgcgagaactatatactggacacantatacgaggactcgcgtgcgtngtgtcagcgagagacanctctcgcgcgcgcactcgtganntctcagtatagagagtatcgatgaggagtgngagtatgtatgncgctgcggcgcatcctacacgtttangtatgtcctcacnggtgttggcggatcatgagtgagatctgtcgcgcngacgcttcacatccttacgangtataacctcctcgaagaggtgccgctncgacggtcgtctgtattctagtgggaggccgcactgcggtcagcgcaatgtaagcgccgagtacntacgcaatctccactatctagagaaganttgtatcgatnatgatgacagntcgcgcaggctacagcgngcacagccttgcctntgcgaagagactttgntgctgtcgtcaaatgtacagttgctctcacgcgtcnccacttgcgtcgtgttcttgggctatacaatttcagcacgctgcacggnctagtgtaacgagccgctgttctcgctcgtagcngcagcgctctgtnttttgtgttgtgcttgtcctcgtggtcgtgctacttcgcgtcactgctacgagctagtctg

SEQ ID NO: 9634 - DNA, 884 bp, Homo sapiens
acacgccttttcagtctctggtatccatccattaactgtctacctccatgagatcaacgtttttagctcccatatgcaccactgaaaggtcacaagaggacatagctagaaggcagccagccatctgcaggccaggaagagaccaaccagaaaacaaccagaccggcaccttgatttcatagttcagattccagaactgtgaggaaataaatttctgttgtttaggccaacactgtaccagcatgtggaacccggaactccgacccttgacatcctggcccagcctcttgaagccagtaacccagcccttgagggcctgacccagcctctgcagggtgggaccccacactgtgagccctgccagctgccctctgagtctccaggggcactctcagaggttctggctcagcctcagggggccttggctccgcccaactgtgagtcagactccaaaactggagtgtgacccaacccgtagacaccccttatctccaactttcaaagtcaggctgtaggatgacaacccgctgataccattttaggtccggtgctagagtccttaattttattctaaacattcccactcagtccccggcaaccgccccgggggagtggggggggactttcaaagtgcatttttgaggacctatggcctattcctagaatggatagatggtgctcttacgattgccagaatccagcttgtgaaggttttaagcccagcttaggatctgcaatggaggctagaggcctagattttgcccccttggtcccagaacctgtggctacttgagctggggtggttctacgcaagcctcgtctttccatatgtgtaataaatgatagaggagtcttttctgtgtgaaggtaataaaaccttctcc

SEQ ID NO: 9635 - DNA, 867 bp, Homo sapiens
  misc_feature (1)...(867): n = A,T,C or G
aaccccaaggagcatgaggacatcctgaacagaggccacctcaggagagctgaaggagcaggagagcagccctggtgcaccctgcccaggctcaactcctcccgcagaactaagccagggctgagaagttccttgaaagaggctgctctttggaagccttgcacatttctgaaggctgccaagagagtgtgtggctgaaaccagagtgaggacccatgcttccttgaggtggagcccaggcacttgggcaaacagctgataggagttcattttgtgaagctgtcacgagttttccagtagaccatgagcttgctgatggcaggagcctgcctgtccttgatccttgtttctgtggggtctatcccagtgcctggcacagtggctttggagatggaaggaatagagggagaagaggaaaccgaggcctcagagaagtgatttgccaaagggtaccaagcaagttcgcggctgagccgggtcttgaaccttaggtcttcatagctgcctcctgcgacaagagcggagcagcgctggtgcagagctctggagcggccggcaagccgagcagcggaggcccttccatgcctcttcctcntccggangcagacggggagccggcgacaaattattcacgctatttttacattatgtataatgcggcatgatttattttgctcatttccgaatctttacaggaataggagcggagaaaatataaaattaatgccatttacacttaatgggataatcccttcctgtctaataataaaactgatgcgggcgtttccttaatgagggtaatcatgacctcgctactgactcgtgcctcgggcgtcggttgggaagcggttagctcatcaaggcggt

SEQ ID NO: 9636 - DNA, 891 bp, Homo sapiens
  misc_feature (1)...(891): n = A,T,C or G
cggttgttgtatttagggagggtggggaataaaagggtattgggggaaaaaacaaattaacagattggtgggaatggagggagatggggaatgattctgggggagcgtgggaggtgttagttatattgtgaggagtataggaggggttggtaggtattgtttaagaggggggggtttttggaaaggttgatattttttttaggatttgaaaaagaaggtggttgtttaaagaaaaggtagggattatagtttttgtaaggtggaggctaggggattgggaaaaaaaggggaagagaagttaaattgtgtgaaagttgttaaggagtttttttagtggggcgatggggtttggtgaggggagggagaatggattggagattggttgtggtttaggtgggggtgtatttaagggtcgggggaaagtgggattggaagatgaaagggatagagggagaagagggaaattgaggggttgagaagaagtgatttggttgaagggtattaaaggaagtttggggttgaggaggggtttgaaagtttaggtgttaatagttgcgtcttgggaaaaggtgggattatttttggtttagaggtttggaggggttgcccccccgagaaggggagggcgtttgatgattatttttattcgggaggaagagggggagcggatggataaattaattcaggntatttttagattatgtataatgagggatgattttattttggttnattggngaaatgttttttagtatttagtaccggagcccaatataaaaattaatggaatataagactttaatggtaataatagagtattgtgtgtaattaataaaacttgatgcgtggggagtgtctttttttattggggttgtatggagggaggggggt

SEQ ID NO: 9637 - DNA, 433 bp, Homo sapiens
gactctcttatttaccaccgctacagcaaaaaacatcattataaaatgtaaaatggagaagaatggtctgaagggccaccatgcagccatacggcacaggatctagattatgcaccacagtggttctgaaatgtggtccctggtccagcagcctcagcatcacctgcaaactggttagagatggaaattcacatgtccttcttcagaccaactacatcagaaactgaggatggggcccagcagtccctgtcctaacaagttctccaggtgaccctgatgcacactcaagtttggtaccactgcactgtgattttttgttctgaatctgaggcctgctattgtgaatctgccatacttaaaaagaaaaaagttggaaagtcattttcaactaaaaaacatttcaaacagaggaaatagaaaaaataaaggatga

SEQ ID NO: 9638 - DNA, 139 bp, Homo sapiens
aatttggcaggagtggttgcttctagaaagaactagatggttgaagaagagagattaaaggaaggcttgctttgtactaacctttttggaatcttctgtgttccagaaagagagagagacagagggaaaaaaaaaaaaa

SEQ ID NO: 9639 - DNA, 1322 bp, Homo sapiens
  misc_feature (1)...(1322): n = A,T,C or G
atatgtggagaatgtaaattgttgagtgtgtacacgnggtgttatatctatgtacgtagattagtgnagagtcgngtgatnagcatatataaatatatagactgtatatattgagagtcgggtgtatgtgtancacgatagtgagggatgtgtgtgcgtggtgaagtatgtgatactactgtgtatggtgtttacagtatgattgatgagtgaggatgctgtgaatgaatatgtggatgattatataatgcgtggttgtatatgagagatatataataaaggtgatcatatataggagangtgtanatntgtgatntagagtatattngngntgtgcatgatattaatataatgataagtgtgtgtatgncatgcgcactatatgagttagtctcaatatgctcatgagtatacaacgtgatgtgatggtacttattactangagagtgtnggtgttagttatataatacgtgtatcggtaatatcatagagatacgtagtatgacgaagaaatgagaaatatatgttattagtgactgngtgggttgatgagatgagtagactctgcatggagattagatatgtgctctttaagaatgacgtgataagtcatatcatgtgatatgattagggagtgtgtaatatgtgttatcatgtgtcgcgggtagtagaggatggtggctgaattaattgtgcggggtctgtagttgaataataatgtataatattgggggtccttatgagagtgtaagttgaggtctttgtggtgagatgagattatatataataatggtggtgaatagttatgatattgtgatagataagtggtaagttgagtagattgcattatttgttaggtacggcaagaattttttatgaattgtttatagatttttagtgaggtgtgtttggttttggtttgcatgcataaataagtgatgagaaaatttcttttctaaaatgaaaagtttggggggggttatacaaccccgctgtaaaggtaagggtgttttatatgtgtgtttcaaaggtgtagtagaaaatgataagaggtttaaaagttgattaatgaagtgaattagatggttatttttagtggttttaataattataataaagatatattagagggtgattgttggagattattttgttctttatgtaatgggttaatatgttggaaacgacaccgatcccccagaatatataaaattgagaagagatatgaagtaaagaaaaaaagtaaggaaaaataaagtattaaagctgttgcggtcaggatttttgtatttgggtaccttataatgtagatataaatatga

SEQ ID NO: 9640 - DNA, 796 bp, Homo sapiens
ttggccgacccacactttatggaatccatctcatatggtggggctgaccttctgcacactgccctatctgtgtgcggcacaccctgtctaacagtgtccaactctctcgaggctccaccatgctcacggattgcccacgcccactgcagagggatctgctgagagcggcggctgctaggctattgctcatcgtttagctcatagacggcaggatcaccccgaagcctgtggaggtccaggtggtcacgcatcacatgcagcagctacgccgagtggttcggaggctccatgctggactcgactgccgagttctttcaagtctgccacacctagaaggactctcaatagtacgggcccagcatctgccgccacaaccccgtctttggagtcatgtactagaggctgcctgaacgcgtcggtcgagggtgtaacgttagcgaactagtgaccttaaaacccagagaagccgccgttccaagatagcctcgctggcgctattgccatcaaaagccttcattagcgggcatgatgaggcagacgagcccttcaatagagcctttatccgggtgccgacccctgggtgtcagccttctttttctccaccgttttaacttggatatcctactctgcttcttgaggtgcgtaatggagattcctttctgaaagattcaatgggaccttgaaattgcttataaaacacctgagaatggcgcaaaacgtaagccccaaattaattgggaggccccacccttttcccccggcaagtttggaagaaatcgttaccttaaaacaagaa

SEQ ID NO: 9641 - DNA, 803 bp, Homo sapiens
  misc_feature (1)...(803): n = A,T,C or G
tggaattgaaattcggattgatggtgtacatctgtgaaacctcctctggatgtcctcagaatattacagaagagaattggtggttttctcgatgccttggtcaggaacagtcaaccagccagattttatatgagatctccaaggtggtacatcaacaaatctgtaagaaccacagtgatactgggattggggcccttgaattcctggaaagccttcccaagaagaatgggcataaacaaggccagactatgaagaccacaataaattcctaactcttcaatgcccggacaatgacaaacatctacaaatatcaagaccagcagaaaagcatggcctcaccaaataaactataataaataaggtaccaaggccaatcctggagaaatagagatatgtaaactgtcagacagaattcaaaattgctgttttgagaaaattcaaagaaattcaagataacgtagacaaggaatttagaattctattggataaatttaacaaatatttcatgaaaaagaagcagaagttgtagagttgaaaaatgaaagtgatatgctggagaatgcgtgagtttcctaagagcagaattgatgaatcagaaaaaagaatttgtgagcttgaagacagcctatttgaaatacacatttggaggagacagaaaggantaattaacaattaagtgcacctgcaggacctagaaaatagcattgaaaggtgaagtctaagagttactggttttaaagaggaagtagaggaagatatgtggttgaaagttaattcaagggataatcccagagaacttccca

SEQ ID NO: 9642 - DNA, 936 bp, Homo sapiens
  misc_feature (1)...(936): n = A,T,C or G
cccgctccgtcacactcctgattgtctgctgctcatcatcgcacctagcccgactccaagacgacgacccgtgtcgcccctgcctgttgttaagtccgggcccgtccccagctgctcttctatctcgctcacgtcaccacccagcgcctctcccacctcgccctacccttgctcaaacctaattcgattcatcgctctcgtctctcgcggtcgaggacttaccctttcctctccctcaccctccggtcttcataagtcaccgccatggggtcgcgtacaatgcagatattctttgcgaccagactgttacctcttctaaccgcagcggcgaacccactcgcaaattgtcacagcgccactcccatcttcctcgcatattcggcctcatcatttctccccttctcattggcgccaaacaggggtctttcgcgtttgccccaaggctctgctaggcggtgcagggatctagtttcgggggttgtgagcgacagacctcctgcaatgttctttgttcaagcactccacccgcgctacgccactgtttagccccttaaacaaaattgggtctggggctcactgggctctgccctgtaatcttccgctcttttcagtcccatgttgtgagggattccttaaggctcgaccgccccccccccgagcttgagcaccatagtgacaccttgtctctacaagatttttatataatgggcctggtgtggtggtgcacacttataatccctagctactcaggaggctgaggcaggagaatcgcttgaactggggaggtggaggttgtagtcacccccgcccccccngagtgcacccccctatgtgacagagcgagactctgtctctaaatcaataaatcaatcaataagccttgctgcggcctacgttctttcctttcctcccgtccccgcccattcccccaccacc

SEQ ID NO: 9643 - DNA, 224 bp, Homo sapiens
acttcagctggcagagcaacacaagcagctgagtggcgagcagagaagcacgtgaaccttggagactgtggatagacaccgctaacctcagatggtgcagcttcagggaaagatcaccttcctgcaccatcccctttccaactcctatcccactgacagccacttccatcgtcaaataaaatactccgcatacactacccttggggaggggaaaaaaaaaaaaa

SEQ ID NO: 9644 - DNA, 612 bp, Homo sapiens
ggaggacgtgtcggaacaaattaccacaaacttggcggtttaggataacagagattcattctctcacagttctggaggccagaagtctgaaatcaagatattacttataaatggaatcctgtagtccaaaaatgaacagtaacaatttttgggaagatatggagcaactggaatccttatacactgctggggactccaactcgggtggctccatccttgactgccattgtggtatgatatatagcatatgtgacacctgactgtcttactaccatatcagggaagggtgggtttcccttgagagttgaagattagaatatgttttattctggccgaattctaagcctcatggaacagtggagagggaaggggaaagcctcatctaaagggattatttgggctttcttaagtaccggggtttctggtctgttttttaaatggtgggaaatgccatactaaaattcctcgtttacttgcagggttcactttttgatgagagagggtgcctatttaattatttaacgaagtaaaaaagagcctaagatttttaaccttaaacaaggtacctcctcttaccgcttttttgggtggttataccccatccggcccaaa

SEQ ID NO: 9645 - DNA, 2004 bp, Homo sapiens
  misc_feature (1)...(2004): n = A,T,C or G
aggggngggnnnnnnnnnnnnnnntnnnnnnnnnnnnnnnnnnnnannnnnnnnnaaaaannnnnnnnataggtagggtnnnannnanannnannagtatgtngnnnnnnntnnnnnnnngaannnnatntgnaantnnnnannnttttnnnnnnnnnnnnnnnnnnnnnnnnnnnnnnnnnnnnnnnntgnnnnnnattgattttntatnnnnnnnnnnnagnaatagnnnanntnnatatatnagttnnnnnnntnnatatnnnnnaantaantnngtagatagnnnnnnnnnnantgtgnanatatatgtgnaanattatttgagnnnnatgagnagacnagatgnnnnaatgagtgntgnnnnnnngananangttagangaggnatnnannagagagcagtgagagtatagcngaagnanagaagcagagcgtagttgagancantanatgaaagcatgatagagtgagnaagcgagcaggaggtaagacaggagtgagncagancaagtgagacgagatgacagtgcagattgnatngagnagnagntgtcagagtgagagcantgtatgnnaatgagagagtgnatcgngagagngacacgagtganaaaacagcgaatatntagaacnannnatnacaactgaagtgnnanacnacnantagtanagcgagtatnananatnnagngagtcnncatnatngataaaattgtncgnnngnnannngncnagtagtagnacnaggtctcctgtatagtaccggcgccgatagagcgacgagacgtgacgcagcatgagcaatatatgctagtctagtacatgagtagntcgngtgcgacgtncgctggtgcgtcgtcanantcgctctcagcgccacgatgtgncggnacgaaggtgcgccagcgccgactcagcgaggtacgcatgtgantagcttngcncgtntcantcgtatccacgtctntctntnttantaccactgtctantcttgtagtcnttcttcactctacctttagtgcnctatctcnctcncantcgctntcatctattcacgctcncntccgtcagtgncacctcgcncactgtcttatctctatgcacgcgctcttagtcntgccttgcacgacaaatcacgatcgcagtgatctgatagctatgactgtaagctgtgtgcggcgatgaggtgagttgtnatgagactatttgtatgngnggcgtgtgcgngtcataatancgatacgagctggacgagnagnagtagagatcgcaccgatgtgtgnaggntagtacntatgtgagcaagacacagcgtccnatagttgtgagatngagatagtcggagtgatgacgagtacgagtcatatgtgtgnagttgatgntgtatatatgatcnnacgacacgagaatgngtattactcgacgcgatgtcacaatgtcgatcaatatagatantntctgaaatgtatacagtaatcgnacgatgcgctcatntatgacgnanncncaggtacgctgtcgctacgtcgtctccacgctatacgcgcggcacgacgcgcgtcccgtctcgncgcgntccncncnccgcatgcatacagacctncgctgcagtagntgatgangttnactgatcgtcgatactgtatctagcgtcgcntacgtccntcgtgacgtcncncngccacacgcgtcaancncgtnagcgacggacncgnacatcgctactcgacntcntacagagcagtcagttcatcntagctgtacacatnagtaacgtactactagcntcngcatcatatgcctacgnacacgacagtacgcgcgcgagactgtcatcgcatcgcnnacagtcgaaatataanncgacgcgntcngnatctcatgctancatcgtcctgtagttnatntntnntcancacgagattcnatcgcgcntgcngataatcgcacgacgacgatgctcagctcacattntcacangcatactagttatnctctcg

SEQ ID NO: 9646 - DNA, 818 bp, Homo sapiens
  misc_feature (1)...(818): n = A,T,C or G
tttgttttgaggtttaataacagtatgagggaggggaggggtttttaaggggaaattgggtntttttaaaattgggggggtgtggtttttttttttagggtttggggatttccaattattagatttgtttggatttacttggagggtatttttctttttggattaaaaagagaagtgcataatgtttatttattttgatcaaaattagaagagagttttgaaagatttggttctattaaaagaaagttaagttcttagataaacccctttcgtgtggtttgtttatagcacaatttggggccgaagagattttttttaatagtttatcatatggggaaaggataatgatacgcagtaaactaattttttttagaggtgggtattgaggaatccggaaacaagttagtaataagttttgggggggggggaaaaagattagaagcctaggtatactgttcacaggagtatgagtctcaagggtctttccatacttaaaagtgtgtaaaatttgcatttgatagttttctttccnttgttttggtgttgtggtgaatnnaagttatttttgtttaccgcactcgtgtgtgataaatctattaagtatttgtaaagaggaattctgtaattgagtttctgtcagtgatcttaacgcaaatatttgagtcagacttttcataagtaagttgggataataattataatantgaantgattgtttttttttagaagcaatacacttagataatatatgtaaattgatttggaagctctgaaattttatatgaagaatatgattcaataaatatagatgcggcgag

SEQ ID NO: 9647 - DNA, 223 bp, Homo sapiens
  misc_feature (1)...(223): n = A,T,C or G
tctaaattaccaccgctacaggtatgaataaacaaatcgtggatacaacaacaancggaatactacgtggggagtgaaccattaatacatanaacaacacagatgacctcaaaaacacgctgagcagaagaagccatacaaaaagaatacttactgtgattttattaatatgcaattctaataaagaaaaactaatctgtagtgacaaanaaaaaaaaaaaaa

SEQ ID NO: 9648 - DNA, 362 bp, Homo sapiens
acggagtctcactctgtctcccaagctggagtgcattggcgcaggctgggctcactgcaacaaacaagaagcagtactcacctacgacactgttacaaaggataagtcatggacaccacctcagacaccctggatcagagagtgtctcagagtaagatccaggagtcaacattctaagaaggctctcagatgatgcttatgtcggggggagcttggactgcactatactaaaagacttatctaaaaccggaccaagtgctttaatatgatgattaaagtgtttaatactggaacacagttccacagatctatatgtatatctattttaagatttcaaacaccaaatatgcgataaacacacg

SEQ ID NO: 9649 - DNA, 813 bp, Homo sapiens
  misc_feature (1)...(813): n = A,T,C or G
ttgggattttgttggttatgggttcagggggaggaaagaggattttgtttgtttagtgaactgtgggtaaaaaggggtaacgctaagtttattgtttaggtggggtttattgcttaacaaggggtatttttgtaaaagggtttttaaaggggggggtgaatgttaataagtggtggaaagaggtggtttttattttattgcaggtttttaaaaaagggggtaatatttcagttgaaaggttggggttataggttgatagaggtaatggtttgggaagggttaaaatgttttgttttaaggtagtgggaaatttaaaagggggggatattaaggagttttttgtggatagaggcgtatgttagtttatttgtaagggagtgcagtgatatttttactgagttgttggagataaaagtaagggaatctttttgttaaatgttgttagaaaagaagtatatgtgtgtagcggagtttggagtgcagtggaggaatgttggttttttggaagaanaaagaagnagtatgacntagtatattgttttattttaaagtgatgganatnacttgacacccccctgtattagagagtgtcttagagtaggatataggagttaggattgtaagaaggtttagagattatgtggatgtagggcagagtttgtgaagtaatataatagaagagttgtttaaaaccagaagaagttgtttaaaattttttaaaacgcataacacagaagaaataggagagatttatagtttgtttgttgtaagttttgaaaagtcaaataaaaaataaaggctgtatggtgtagg

SEQ ID NO: 9650 - DNA, 1080 bp, Homo sapiens
  misc_feature (1)...(1080): n = A,T,C or G
cttggtgtcgagcgtgctaggaggcgcgtgtgacacgcggggttgtacagganctgatcgttgagctgagacgttagttcgcaggtagagtagcataggctcctacatgctatttgnggtagcaactgnggantatccaagataacgcggctccgagngctgcggtgggcatcctcgtcgggtgacactgttgaccgcgagtnngacacggtgcgactcattgnacagagagggagcttgtccatgttggtgcctgcggtggtgcgtgtgannatcgtgccattatcattactagaacacgagtgtcccgtgttttaggtacggacgagtagatatctgttgtcggctctggactattttgtcagatactctcagtgacgtagtgtagcggtgagggnaactccggtacactaaatctgcatcgtgtcgtggcggcgggagtagtngcgggggtctaattctataataatatagatatnaagtttgccctagctgttaactgtccgtccctggtgctttctttctctctctcttaanactgtaaccggtggccatnngaaactaagacatcaggngcggatcttctctgcatatacatattgaactgaagcgaaataaacgttcgcgtcactaggtaacttctcactctatngcgctagcactcggtacgatatacaactttcagtngacggcccgaggtattnaggcganactctatattaatactctcaatatcatantcctgccctctcgtccacggagagggaaagactgccgaggagtgcggacggggtggaaggtgagcggcgaggacggccgtgacgctgggtgttgctcttaggtatggctaatggctggctgcggttggctcgcctgcgaggtcgctgggcagacccatgaatcnggttctcttctcccttactncttcttccttnnctctccttccttcctccctnacctncccctccctccttaattttctcatnnctctnnnaaccctccccccnncaccctncnnccctctnnnnnnctcccatnccncnnnccccccnccttcctnnnncnncctcccccttcccc

SEQ ID NO: 9651 - DNA, 929 bp, Homo sapiens
  misc_feature (1)...(929): n = A,T,C or G
tttgattgtatgaacataacaaagncccacnnaagctagcggcaagactctcttatgtaccaccgctacacagatggggtttaccatgttggccaggctggtctcgaactcctgaccttgaagtgatctacctgcctcagcctcccaaagtgctgggattacaggcgtgagccactgtgcctggccttgaaataatatattctctaccactgtattcctgctaaaaaaccaagaaaatgtggcaacactggggtaagaattttatttttatttcagcctagataacagcatacatagntggaaatggcaacactgctgtgtatgccagctacntccccttagttggcagaaacatgtctgctggtcctgtgctgctgaagaagtgccgagacatgcaccctgcgtcatcctaacatttgaagcattggttgtggtgaccccagataagccatcaactttgcaaagagcagaaaggatccagatggagcccggtatcagcatatgtgggcccttgactttttatctagagtaaattgaaggaccaaactctgacatgctagcctacntgacttcacatttaaaggctttggaaaggactttctaaaagaataagtgcggctcttaaccctataccctgtctcttttctttgtttatgggnccttaatgaacttttgccttgatcctccaatgatggccgtctggattaatctattacactatgggaagtataatatggcaaggccctggcgttctataatgcttcgcaaagtgagtcggggagaaccctataacttctctaacgccccttaaaacaattcagaacttatacacttcgtttcatccacaaaatcaatgtcgaattctaaatttaaaaaaatagaggggatattgtnatctttaagttgctctaagactatcacattgcact

SEQ ID NO: 9652 - DNA, 867 bp, Homo sapiens
atgtttttcttagctctggtctgctggtggtactccttcttggattggagggaaagcacaggttcacttcttgtggggagtctgtatcctcagtcctgaatctggcctccagagggtgacgttgcacaagggacagatggctgtttccaatgatgatcaacaaacactttctgctcagccccttcttcctgcagctggctggggggggcaccgtcactggagttctttgaagatgggacaaatggagagaatcaaagattgaaaagcacttaagattatctcagcagattttgtattcttaccaaaacaagagacttgcctagcccaaccttcctcacgctcgctattctcaagacctgggttccagccactttcctactggccccgaggagaatttcccaagagacgcctgcattgtttccacagcttacccatgctcctgttgctcataccaatgctggggatgattttggcccttgaaaatgcccgaaccccagcttgtaagccaaccataaccaccacgttattcttttctagagcagcctacctggagttgggatggcactattgctatggggggacctgctatttgtttctggttaacttcggaaagcccttggctgaaaaaaggggtccattccatgggtgagagcccgcaaattatgtttgggtttaattcaaatggcgggttttattccttttgaagcgagttgtgtttattcaccgtatcaagatcgcagggatgtccgtatttttttcacatgccccagagattgttggtttattgaattaaaccctcttaagcctggttctatgactgaacaggtctttacttacgttaaagacgagggcattattcttcgcact

SEQ ID NO: 9653 - DNA, 1062 bp, Homo sapiens
  misc_feature (1)...(1062): n = A,T,C or G
cggccgctcgtcggccttcgcgcgctgcgctgtcgttctccgcgtgtcttcgctctcttgctggtgcttgtcgtgtggcgtttcgctcgaccgtgtcggcgtgccgccgtcgtgcggccggttcgttggccctcgcgtgtttgctcgtctcgcgtcgccgctcctactcgccttgtctgcgtgtgcgtcgcgggtggtcgtgggtctgtctcggggggccgcgctgcggcctggcgcggcgaccgtcccgcttggttcctctccgctcgctcgtttaccggctgcctcgttccgtgccccgtcttattttgtggtcgtggtgctgtgccgcgtcgctgcgtcggcggggcgcgtgctgtgcggctgtcgcgcgtcgtgcgggtcgtgtgcgttggtgccgtgttcggtgggcgtcgtggtttgttcttgtgagtcctgcacgtcgcctgttgtctngtggctcgtgtctgtttctgctctgacgcgttgccctccgtctcggtgtgttcgtgcgctcgctcgtccggtcgggtgggggctgttgtctgtgtcttcgcctcgttcctgctctcctcgtcttcttctcctgtcgccacgcgtcgtgctgtcggttgtgtcgctgcgttctcccgtcctcgcggttcgcctctctgccgccgctgtcgccctcgtggtgtgcgctgggtgtgggctggtgtcttcgcggtgccgtctgctccttcgtggtcggcgtgttggcggtgtcgttgtgtgttgctgggtctggcggtggtgtccgcggctagcgttggcgggggggtgctgtcctgtcccgctcccttcccgtgttcaccggcgccgtggcccgtgctcgactcctgcttgttctggtctggcgccctccgtttcttttgctccgtctccgccgtgcttcctcctctgggtcgtcggtgggcgtgtgcgtctgctcgcaagatggctgcggcgtgtgtggtgcgtctctcctttcggtttctccccccaaggttctggcgctgtctacttccaggtcttttccgcttgctgctgtgtgggcgatctctt

SEQ ID NO: 9654 - DNA, 810 bp, Homo sapiens
  misc_feature (1)...(810): n = A,T,C or G
ccctcctccccctccctcgactctttctcgggttccgcccgcgccacctcgttttcaccgccccaaaactcaacgtttctccccccttggcccctccagatcccccgccatgtcccccagctaaacctccccctgtcccctcttcttcgtgcccccctggttttatcgccatctcccgggccacttatttccacgcacggggggtcctctattcactcactcccccccgtctcctcaccttgttccccccatacccttccctaccagaaaagttcggggtatacattagggcggcgtgtgcatacataggcggggggcgggtccgtatttttttaggggtcccacccctttttctttacaaaccccgcctttttagtatttgtgcccccacaaatcctgttgttaaagagagatggtttccctcccaggttcctagagccaggagcccctccattcccccataggcccccatagaaaagcatcaggattattccagtaccagagtaaatgagggaaacccaggtgcagacgcctttattttatcttctctgagaagacatgggttaggcccgccccccagcctagaattgtctagtttgaataattttattgggccctgagcatccctagttgtctaatacctggtcctagaatgattaaggaaggaagatagcagcctagagtgtaagagnngagtaaaagtggtagntgggtttagtttacgcccctggccgtttgatatgaaaaacaccctcatagagtccccaagttataaagttcaaaaatacagaataaagagagatgtggtag

SEQ ID NO: 9655 - DNA, 1114 bp, Homo sapiens
  misc_feature (1)...(1114): n = A,T,C or G
ccgggtgtcctcctgtgcctcgagcgggcgctacgcagctcgtaggcaatnagagcgcgggtgaggtggttgcaagaaattgaacatgaataagctgagataataatagacgnacacgccccggagtgggcactctgtctaagctcctgtgcgccatggggcactaacttggccctgtggatttgtgtggggctcgggcctctgcggnnctctcggacacccggtgtagggagtggcggagggggggagggctcgccaacagatcaggaggtgaggacgattcggaagggggcatggtgtgcgtggggggtcgcacgcaagtggtgcgttgagactctggaggagctgacgagacagtagagtanacatcctatanttactctcagcgcgctggattgggctggactgggaaggctngctctagcaggcgctcgcgcgtctgtggtaaggatgtacggtgnacctggcggagacgggcacggggctggacgcgatgaaagcgtgcggttggancctacgcctgtgtgtcactactgtctgcacatgccttcggngtctcgagcctctcttgnccggactccaactagacgcgcaaacncaccgnaccncctctcttctactaattttgtannagtgtaatatgacgtgtatgatntgtatggtggcattngaggcgactgcctgcaatagctttactactatggaaggtgcgaggtgtagaggggagggcggtctgagtggtaagaggatgtcgcgtttgggtatgtagttggatgtgatggggggaaggcgtcgcggcgaggtgatgttgggggtgggcgtcggtggtgatacattataggaaggcaagtatagtcacgtgccgccagctgtggagacgtacgttgtaaaatgtgtgtgtgctttgttgcctatgtcccctgtgttcttgtgttggacttnccatatccacctcctcccctctcacacgtagtctccctcagctatctaaacgtatccaattnanacaataataacacnantnnaatccnnccaaaactttatnnnnncnctcttccaaannnnnnnnnnncccnnnnccctnntnnnnnnnnnncncccctccttnnccccc

SEQ ID NO: 9656 - DNA, 719 bp, Homo sapiens
  misc_feature (1)...(719): n = A,T,C or G
tggtgtgtggggggggattgggtgtttggggtgttgtggcgatagtgggggggatgggggagttattatgaggttagggttgttaatggatggtgtatgtgggtgtttgattggatatgtgttgtggtggggaatatttgttgtgttgtggttgtgtgttttttatttgagaatattaggggggggtgtgtaagtttatttttgggggttgggtggggtttatataggggggtttttgttgtggggaagggttggtttgttttttagggaatgataagagggtgggggttttttgaggggggaggggagttttttgaagaaaattttagtatttttgtttttttaaaagaggaggggggtgttgttttttagaaaagaaagaaagtttttttttgggttntttttttttgggggttttaaaaaaaaaaagaggggtgtttttggtttttgggggggggaaaaattttttaatttgggggggtagggttttttagannanngggggaaaggaaaaggaaggattttttttttttttgggggggaggnggggggggtccccccccgcgggggggagaggagggcgtttaaagaggtttctcggggtttaaaagaagggaaaaaattggggaaaaatttttggggggtttttaaattaaggggggtttgggggtgtttgggaaaaaaaaaaaaaaaaaaaggtttttttttatgtcccaccc

SEQ ID NO: 9657 - DNA, 924 bp, Homo sapiens
  misc_feature (1)...(924): n = A,T,C or G
ggggggaacctttcgggggtcgggggaagggactatnagtnacngcccccggggactgaaagcaccgatcanagccccancnncanaaagaacggccacccgattataagaagcagcacaaaccggcngcagnancacaacaaggcccaacggcgaagcancccgagcaggaaaaggaaagaaggcgaggacgcaancagccacgtagaggggaagnngggccccaaagcccagagcagccaggcccaaggccaccccctttttttattaaccggggcgccacgagggcaagcagaaagacggaggaagacacacggcagaaagacgacggggaaggagccacaaaagaaagggacacagaacaccgccccagggcgcgcgggggacagaccaacccgacagggagagagcagagaacagcgaagcccaagcccccaaggagagccaacgaggacaagacggccagccgagagagccggaaggaagaaaccccggaaaaccagccgaagaacccaaaaggaaccacaggaggaggcacacgcgagcgaggccaacgaaggcaaaagggcaccaccgaccgcaaggcccggcacgccgaccacacagagcccaaaagaagaaaaaaagggggcaggaaacggcgacaagggccgggaccaaggaagcacagcaggaaacagcaaaaacaggcaggaacggaccccgggaccgcaagggggaagcacaaggggacaaaggacaccaaaacgggaaccgacagcaaaaggcagggaacacaggcgagggcagcccgccgagcaaangagcaacgaagcaagggccgccacgacccaagccggccacaccaggaaaaaaaagcagagagaccgcgaccaagagggagaaacaaaaccagccaaagcccaacaccacgcgagagaagag

SEQ ID NO: 9658 - DNA, 1127 bp, Homo sapiens
  misc_feature (1)...(1127): n = A,T,C or G
gggagagggggnagaaagagggggggaggagaaggagaaagagaggggggtggggggggcggaaagagagacctaaagggggagaccgagagggggaggggaggagacggggagaggggagctagagaaggaggggagagcccggaggagggggagggcgggagcgcacgccacgcagccagcacggcagcgcgcgcggagcgcgacgngccggcggccgcggcggcgaggaggaccgaggagggcccggcgaggcgggggggggcgcagaaggaagaggggggggagcaaacagggcccggcaacgacgaggccggccaggccggccgcgccgcgcggcggggccgagccgcgccggacgccacgagcccagccccgggacgccgggcgcgaggccccccgggcccgaccccgccacccgcggaggccgccgcccggcaccccccggcccgcccccgcccgccccaccccccccccccccgcgcccggccgaccgagccacgccgcgcggccgccaggcacgggagccccaacgggccggccgaggcaccggccagacacacgggcccccggaccagacgcgacgagacaacggaccgagcgacaagaggggacgccgcgcgggagagccgacaagccccgcgcgcacgagccctgccgagcggccgacgcgcggcgcggaagccgcgaggacgngnccngcgagcggaggacgcgcgcgacggagcgagcgcgcgctacggcaggacgagggcggccagcgcgcacgagtccacgcgcaaggaacgcccgcagcgcgtgcgcagcgcgcagagcgtngacgcgcgccgccaccagcgcgcgagcagcacgcacgaagcgccagtcagcgagcgagcaccagcagcgcgcgcnagacagncacgcgcagagagacgcgaaccgcgagtnccgcgcgcgcggcccgcggcgcgcgcgacggacggcgcacgcacacacgncgcagacgcctgtcgacncacgccgagcgcgctcagcnncacgcgagcggcgagacatgaaggcacgcagcngatcangtagccgngcgcacacagacgagncgancgccagccacacagcagagcgcagcgacggcgagcgcacac

SEQ ID NO: 9659 - DNA, 868 bp, Homo sapiens
ctatacaagaagcatgatgccaacatctgcttctggtgaggcctcaggaagcttccacttatgatgcaatgcacagggaaacaggcgtcacatggcaagagaggaagaaagagagaagggaggtgccatgatctttttaacagcatgaaggtcacgatcatttgaggaaagatcaaaggaagaacctttttaactaacttaccgagctttatattgacctcttctaatcagaggctgagatggagaaagtgaacgatctcaccaaacggtagatacagtaataagaatattgatcaggaaagctctatcggggcacaaaagaaacctggaccatggaaaagaatgtgcatctcataatgcaagggccaaggagaggagcccacagatatgacacttgtggaactgcataagatggactaacattctgctggcttataatccggcacataacaaatcattccagacaaattgccaattgttgatcgaaaagtaattgaagacctttagataaatacagattcacgttcccgattactaaattaattcttgcgtatgacgccgcctgccaatacacctctcgccatctatctccgaactagcttgttatggccacgataaaggtgctgattaatagaatagtgtgtcacaaacctgcgctttggtggtagatacggcgctgaccctttatcatgctattttagcctgagatattaaccatagtaatagagattataatcccatcatatgctacaaacatagtatcaaagacgcgagttacactgcacatgccaaccatgccgtcaatagcatttgatatcaatcatgatggttgatttctgatacatgagctaatatacgactatgatat

SEQ ID NO: 9660 - DNA, 1330 bp, Homo sapiens
  misc_feature (1)...(1330): n = A,T,C or G
tcaatatctttttatcacaactaattagacggaaaacaaggaaagaagaacttcngagatggacaactnggactnctacttncctcnagaccgacgcgcataccagcagnaaaccagcaaacacgcaacacgtaagtattatcacattgtattaccatacatcgcttacagacggcagcacagaaaagtcacattggataatatcacctaaaggagtnaccttgatgtaacaacgggtaacgacgcacgactatctatattattatcgtagcgaatccaaggcaatcctatatcttgatagaacttctctactacaatgggtcgcgactatatcacaactaacaatatctattccctatctgtctctaggcagaacgatttttgatttcttgtttcccaatattctaactccaatgatgctcgatcactgcattacatccatgtgaagttctcacgattttctatcgtcatattatatccatacttctcgcttcatacccttctgcattactctctctagatagcagctgaatattttaatttactcctcttctatatcccacataatctacacacacttaccctttgatgtactttggtataactataactctcactatctcttttacgtctctacccttacaattgctccggctctcacttccaatgattctctcgaatccagcttgccctacacctcgcagccatggtgccttataataaattagcgtatccttgacttttcaacacccttcaatccattagagttatactcatacttgttttattccactaaccatatatcgtatgatatacttcttatgtagaattaataatttcnttatccaaataacagccacttttacatcagtctatctacgctctctactncaacgcactcacttgtcgtctcatacccttattgttcttctatatactactctgtatcgtctcttatatattgcatttatgatcatntttcatatagccttctcatcactacgcgnacgtacacaacccgcactcaccgcgaacttctactcattcacttctgctantctcagcaccgctcgtacgcatcttattcatntcctactcacccacctgtccgaccacattagtcactcccacctgacacatctatactatgtctatgttgtctcttgtatatagtattcttagctcacttctctcacattcattccatccactcctatactacaactcacgtgcncatccagtcgcgtcacacgcgtactccactcctccctccatttatgtacatcatatcaattacaacgatcgtcaacaaaatatcatccactacaca

SEQ ID NO: 9661 - DNA, 658 bp, Homo sapiens
taatggtctaaagtaaagatgaaaaggtttgaaggaaggaagccccatacagaaaggagagaccccccttgaagataggttcatcctctgaagatggttccatttcccttgagaaccccactcctccaaacgggggcccttaaactggtctttagagctgtgctgtcgggcagagagacaatgcaagtcacacatccaattttaaattttatagtagccatattaacaaagttaaaaaaaacacaggtacaattaactctatttacttatttatttttgaaatagagtctcactctgttgcccagaatggcgtgcaatgatgtgatcttggctcactgcaacctccgcctcctgggttcaagtgattctcatgcctcagcctcccaagtagctgggattacaggtgtgtgtcaccacgcccggataatttttgtattagccatggtttcaccatgttggccaggctggtctcgaactcctgagctcaagagatccacccaccttggcctcccaaagtgctgggagtacaggcttaagccaccatgcctggccaaattaattttaactctatacctagtttaacacagatatatccaaatatattaaaaaatgtcatcaacgttaaagttatctcatgaaataaaaagcgatcggccag

SEQ ID NO: 9662 - DNA, 111 bp, Homo sapiens
  misc_feature (1)...(111): n = A,T,C or G
ggtggggacgncccacaaaaattcaacactcccactaactcattttgccccgtatttcaaacttaccttattaaaaaaatctgtttgacttggctaataaaaaaaaaaaaa

SEQ ID NO: 9663 - DNA, 636 bp, Homo sapiens
cctatcatctggaacaggaaaggagacataccttcattgaatgagtgatgaaaaatactgttgggcaagttagttggagttgtcgattgggattatgttccacagcccttctgtcaagtgaaagttctagatccctggatcaacaaaactgatagaccactagcaagacaaataaagaagaaaagagagaagaatcaaatagattcaataaaaaatgataaaggggatatcatcattgatcccacagaaatacaaactaccatcagagaatactattaacatctctatgcaaataaactagaaaatctggaagaaatgggataattcctcgacacatacactgtcccaaggctaaaccaggaagaagttgaatctcagaatagatcattacaggctctgaattgaggcataataatagcttactaccaaaaaaagccaggacatatggttcacaacgaatttaccaaaggacaagaggggctggctcattcctttgaaacattcaataataaaaaagaggaattcttctacttatttattaggccgcacatctgatccaagcttgcgaaaccaaccaaaagaaatttaaaccattcctggggaatctggcaaatcccataatactgcaaccaatta

SEQ ID NO: 9664 - DNA, 893 bp, Homo sapiens
  misc_feature (1)...(893): n = A,T,C or G
aggcaagtggacnngnggaaacagacacacaaanggacaactggtgtacgacggcnangtggaatttgnggttttcttgtatctctatatgcaggggggccggtgtgagggatacatggaccggactaaaccaataacacaatgtgtgagaggcngggcgacaacagacttgatgtgcacggagtgtgggtgtgttgggggggttgaatgacatgaatgcatgagggcggggggttgaatgcaattgttggggagggtgtggtggtaactggggaaacaaacttctttggcgggaaccaaatgtgggggaagacacggggttggcggacccgaccgggaatggtgaccatgatgggtgttcatggtgtgcctgatcacatatgatccttatgtatnacctcttgacggtgtgtgatgaacggtgcttcaagngatcttangggaccgggcggctgagatacaaaacaaacatgggatatctgggcaacaggatggatacttacgggggtgatggcggagagccgtttttttctttttattttcttggaatagagggctcttctctgcggtgtgcacgggcaggctgtgttcttgtgtagggggggttggttctgactcactcacttgtcttgtacactgtgggggggaatgggggacacggcagatgggtctttggaagaaatgattatgtaccaggggggcactcgccangacctgggagttggggggtttggggtgcgatacactccacgacgggnggggggcgggtggggtactatctcatgaaacacaggggtgaatggggtatgtggggaccccaacatggggacacacacaacggtgcttatactcaatggtgatcgggtggaacatgggggtttatttttttatta

SEQ ID NO: 9665 - DNA, 503 bp, Homo sapiens
tttttttttaaaaaccatctctggggggcggtgaaagagacaccctttctgggcattttcccccgggcttaaacaaataaaagggcccccctttcgcccaaaaattctttttaaaaattaaaaggcccagtgtcggccatttcccaagttttgtggttaggggatgttttttacggtttttttcccccaaggccaaaaaagggaaacccggctgggcgggttggtgccccttttttccccccccttgggggccccggtggcccatctttaggtcccgggaattaggcccccctgggttcaccgatgtaaccccttctttttttaaaaaaccaaaaaatttagccggtttggtgtggggggcccttttttcccgcctcttttgagggttaggcaaaaaaaaggggttaaccccggaggcaaaggttccaatgaagttaaattcggcccctccccttccgccttagtggcaaagttaaactcccttttcaaaaaaaaaaaaaaaa

SEQ ID NO: 9666 - DNA, 867 bp, Homo sapiens
cttttaactgcaccatcctcacttacatgacttctgactgatgagatacatacataatttgaggggaccccccatgaggatgatctgatcatgtacattctgacagcctgcctatccttatgagacaccaaatgatgcgtgtgatgcgctgcgatggaagataagggcaacgctgagatgaggtaccctagcttacacactgggagagctgactaccttcattctgagatcacacactgcaccctaccatgccattgctcgatgatagaggaccactagagtggtcacagccgacagccagacctgaatgtctacatttacctcacattcggcgcttccatgggtgagggtcaacgatgaccctgagtccctgactgcattcaaattggctggtccggtgccagatacactctaatttacatcgaatgtcgtccacttggcttacgactactcaagcgatgactccagcacctagactgctagcaagtcagcctaccttaggcctgacacccgtgaactggccatggcctgggccttcatcaagacgctcaacccctgtgtccaaatgaaagaattggttgctatattgcaatgctgcaaaaccgtcaatgctgtatagacaccatctcatgcagcggaatatgtcttgagccttggtcgtcccagctgccgttaccagtactgtccaatatatccttggcacgcgaggccttgttattttaaccgggggggtccagataggagaagtgctttccatatgacctagggggacccgcttagctggcgtggagttctgcttatcgttgtccgcgtaccaaagagaaacactgcacctcatgtatccataaaaatgcggaccccccgccg

SEQ ID NO: 9667 - DNA, 1635 bp, Homo sapiens
  misc_feature (1)...(1635): n = A,T,C or G
ggggnnnnnnnnnnnnnnnnnnnnnnnnnttttnnnnaaaaanntttnnnnnnnnnntnttaannnnnnnnnnnnnnnnaatnncntnnntnnnnnnnntttttntngnntnnnnnnnnnnnnnnnnnnnnnangtntnnnntctgtttctttnnnttcnangtttnntntcttacatgttnntnnnnnntatctnnnnannactgctatgttnnnnnacgagntnatnaagnnnatattttnntannntngtaacatnatnnanactgtgtnnnnnacagatgttgactgtantnnnnntnaagatgtatgtatcagangacgatatggtcatgacgaagcgtagtgcacagccacggggcgactgtgctcgatagcaatgtgnacatcnactcatgatgggtccgcgcagatagcatncnactagatcatagncgacgacgacacancacaggtcgacntcncaccgaaccacacgtcnnaanatctgctcacgatcnnacnancnatacgtnntgatttatgtactcatncgnnnnnnaccccacnntnctntnnccactatatctnctancntctcaagagccctcnncncacccnattcgcnagctcgacagaacgagatagtacagcgacacgtcatatcatctctgctagtcgacagagtcacatgatacgacgtatcctagcaagcatcacatacagaatccagcgcattgcncacatcgcaatcatccggcgctgatgtgagactncggagctacngngatgatctgcagtgcgcacgagatgtgtgatgtgtatgagnagntgtgtatcgaggtgagtcgaagtactaatgcataggtagtgtatcgacatcatgtacatactncaacgttgcacactcnccncacacgtagctgaatcgatcgctggacggcctacanatatcgtncatcggtcgcgttatatctatacntagagtanagcacatcaacagatgacatagacacaagtatgaacatatcacatncaancaagtgtcgactgtgtgaactcaaataagctagagtgcacatcacgcgtcatgagtgctagtacgatcgctgcactcgcgaacgagatcgcacacagtaggataagcgtgccncacgacgattgcggaatagtgagcgctgacagtgccatcagcggatatgatcgagtcatcgacgtcagtcagcatacaacactctananngacaggccagatctcgcgactacggctagagtacacagagagtacgtcacgantatgtatcagtnactnctcacgagacacgactccacgtcgtcatgcgacatatgtgagtctcacagntacacgtacgatgctcatagcgcntagatagtcanganacatgcgacctatcaatgncgcatggcgcttcgcatatacncacacntgtacgtgtcgagtgtgacacncgatagtcacncgactgacggctcgcagtgctcgcncacactggntccgctgcctcgattcgcatgcatggagtatagntgncgcgagtggactggatgagagtaggtatgagatctactacggtgtnagccgcggataattacgtcacgctgtcactgatgtgcgctctcgcttcagtgtctcnt

SEQ ID NO: 9668 - DNA, 339 bp, Homo sapiens
  misc_feature (1)...(339): n = A,T,C or G
gagcacctggctccccccgccaaggcccccgcccccgactcccccgcgacgggctatttttttttgggagagggggagggtggttcccccccccccccatgaaatgggataggcttctgggcactgagccccgccccttctccttctcctgcaagctgagggctggccccccattttttcccgggcattagatgccaatgcaagcnaacaatatggtgaaagaagttattagtcccccccccagccccatgaggagatgtgaaataaccccgcccggagtgtcttccccgacccaacatagttccccaactctccctccccccgcccccccgtccctga

SEQ ID NO: 9669 - DNA, 782 bp, Homo sapiens
atggaaggcaaaggttgttgaagttatgaatgtctgtttcacagaactaaatatgaacagctgtattaaggagaggggtcatcccaggataaagacatccccagatgatatagagaagattacaccaaacaaatctgctgtaaactgcatttacccttaggagatgattaactaaagatcaagggatgggataatgaatgaatgtttacatctataaactattataactcttagaagaaaatatagcaggtatatcaccaaaccttggattaggcagccagtttttaaatatcggatcaaaagcgcaagccacaaaatttaaagatagagaaatttggacttcatcaaagtgaaacttttgcgtttcacagaatacccccagaaaggcacaggacaaccacgcgatggagaaaaaattgcaacactttttattaaaaaaatggccccataattaaactttccactcaacaataaataaacattatttgtttttgaagtggaccatgggacgactccaactggtgatacacactaaaagatatccttttttagcgtccgggaaggccgtcaaaacccctgttccggttttccccccctgaatgggtgagaagaaattctataattggagattggagaaataatcctttacctgtgagaaaagtaaggtcccgttttggagaactacgggtttgacaataaaaaatcttgtaccatgtcacttaagaaatataaaatatactaaatttcttatggttttattttatttggcaaaagactcccca

SEQ ID NO: 9670 - DNA, 1653 bp, Homo sapiens
  misc_feature (1)...(1653): n = A,T,C or G
agagaataganaagaatatagtagaaaagngaggtgntgggggtaatagagtggagcgatggatgatgattgggtgtgtgttaagagagtaaagaatagtttgtatgggtggtacgaccngttagtgaataagagatgttatacacaacagcatttagataannatatacaagtagtaaaagatgaggtagagaaagagtgtggttggtgctgtttggtgacgtagaatagagaaaaacacatcacaaatgttaatacagtcctgtttgtggcagagcgacacacgagcgcagcatgctagcggcagagaggccacaatgcggacaggacaggcgactgactcacacatanaacaagataagtaactccaagtgtgactctcatgatatatggtagtagcgagctgcgctcgtagaacatcgncgaggtacatagctaattcatccacgtgacgcgttgcgcgcancgagcntgcagtgtgagagagaacgctactctacgagcgtgcacgacagtaagtcactgaacgagtatacgagctgagagtagatataggcacacgcggcgcaagccacagtatcgcggagtngacaagacagtgggtcgaatgactgtgcnggacgacactcgcagcgccgaatcgtcgactcgtgcgcgtcgtctattgtacgagccggctcagcgctctgagcggacgtccagccgatcatgcacgcgcacacgntgtagaagagtacaggcgcacgatgcagagccacgagagatgtgcacacgtcgagcgnagtcggcgacgaacagaagtangacgangntagaaagntcatcacgcgnacggagtgaggcgacagacgngacacacagatcatacccacgcgagtcatcnagcgantctctcatctanctctatcaccactctcaaccagacgtcagaanacagagcgnacgacagtactatagtacaacganangtggagcaccgacaatgtcggacactgcgtatcagcagcagcgagcaggtagctcgagcgagcgtacgtatcgctgcgctctccgtccagtatctcgcgcgcatgtcttaacatcatgtgttaggcgtgcaccagcaagtacgctcctataggatanacagccagtgaccctcgtaagcacacgcgccaacacaccaactntgccacancaagagnanaagcagatgccactcacagatgncgcgagcagccacggcgacagatcaganntcacacaactggacgtantagtccacaaacattgtcactcaacgctacgaatagcgagcntcncnagacactgaagaagtcgtagcagatatacgatgacattcacagtcctgacaacgcactcgagcgananacacgagacataacgagcactcagcacacgcatgccaactagtaatcatacacacatcantcgcacgaacgtcgtatacagtcagatanancctatatacgtacacncgtctcacatatctcagttaacgngtcagatggtcgcatacgagatgcnagacacttgntaacgntgtgttcggcatctagtcaggtaggttgagatatagnagcacaggaaatctaacagcattatcataataaacatcgaaagattgattacacatcgtagcgagacacacag

SEQ ID NO: 9671 - DNA, 593 bp, Homo sapiens
  misc_feature (1)...(593): n = A,T,C or G
gggggggggacannctttggcttcttaaatacactatgcaaggcagcagccgtcctgggaaacttaatatttggctctctggtcagcatcaccaaatcaatccccatcctgctggcttctactgggctcgtgtgtggaggactcgttgggctatgcctgcctgacacaccaacccaggttctgatgtaatgggaaaaaaagccatccttcctgcgtttcttcctcctgccctgggtcaattctccttcctgactcaaggcttcagagttttcctatatcgaaaggggatcaagtataaaaacataaacacgtgctgtgacttaaaattaaaaagcatatcatcttggccctttttggatttgtcacaagggggtggtctggtgggtccgcttaatggacgcggaagtttgccaacgcggaggctgctggctccgcgagaaattgaaacctttcctaaagcgcctangcagcacgcgttgcttggggtttgcggtcggagaggagaagctcgaaaactgggcgggggtaaaactcgcccacgtccaaggaacagtaacagaaatatagcggggcattatggcaggggagggaag

SEQ ID NO: 9672 - DNA, 793 bp, Homo sapiens
tacctggctggcgccatgttacctgcttgtttacggcacgcgatgatgacaaagaaaagctagtggacatctgaaaccctaaaacatctcatctgtgcaaaaaagaggaatgagccaggtcgggagagtgagaagctcgcaccacttcgaaagcgtctgcctggatgctgaagttcgggttgttcttgtagctggagaggacgcaggacttcacaccttgtcctccgcactcaatgagagcctgaggccgatccacagagaggagctgcaccttcttcatttcccgaactccccagaagagaacctgaggaaaagaccagcagagccatcaccacagatccacggaggagccccacacctgccctggctctgtgtggaaaagtcagacctgctccctgagaaccacgctgtgttcctccaggaaagaactgcacagctttttgagggctcattctttttctctaggtctcccgcccattccatattacctctcctacaattcaggtgggggcactgcccttgagtgccaaagacaactcagctccttccgtgacccggacctgcatcgggatttggtcaaccccggcgaatgtggcaggaccgggtaaattgggtgatggctgtggctcacgggggggaggcttggcgcccaaagggggaccttacccaaaggcaggttggagttaaggcggaaagaccagggaaggaccgggccccaacccccttttagtagaatgtcctgtttggcaacaaagaatgttccaagtaaaaaccagggcctgcgttttccatt

SEQ ID NO: 9673 - DNA, 794 bp, Homo sapiens
ctggtgtatgaggaaagacaagccatggcaacatgccggcggctggatcgcaccaccaacatcttcagatactcatcataccacaccctgcaggagatatatacctggattgacaactctctactggagcattccgatattgtctcagagattcccatcggcaacacgctctgaaacaccaccccattctttgttctgtaatgcagcactgggggctctcgccacccacccatccggatccacactgtaattcactccctggagcgcatcacccatgccaccgtgatgtggactgccaataccatagccagcgattctggctgagaccgtgtgctgacagacacactcgttgccatggacattttcataaagctcgccacagaccctgatgggtttacttttacccacagcatgaaccagtgatggcggaagaacactctcatcatacctggaatcttctgcatcagcgtggatctcaacacgagctggaggttggcattttacaggaaatggttataacagcaaccactgctcagagactgatcacgggccctcccctaactaccagccggatgtgggtgccctaacgaacttcatcacagcccatggcaacttacatgctctgatctccatacacagctactcttagaggcttatgtgcccttacggccgatagctggaacccgttgaaatcaaacgggaggtgacgacttgccaagatgccgaggaggccttgctgaggtcctcgcattagcccatttggaaccataggacacctcttctggccgcggata

SEQ ID NO: 9674 - DNA, 2445 bp, Homo sapiens
  misc_feature (1)...(2445): n = A,T,C or G
ttaaagtttgttnnnaannntnatgntatnntntatnantnnnaannnnntatntatattannnatatattatnnnanagatggatgatgggatnatanannnnatntngatattagagttatnataagatnnnnnntanatnntanananngtatntnnnnttaannatattatatgtatnnnttanannnnganannnnnnnnnannnnnnnnnnntngtttnnataatatnttatttatatntnanntaannattaatatnntatatanantccntagtatatatnatatataaaatnanntanntnantnagtantgatgnacngatatnatataagtaagtttagtgtangatnntagtannnangatatatttgttnananntnatgtnagcaagnagatnatanacagagttgatgnnnnnnatacgggtgatgtgatagagnganngntantgaacaaggagcacgcatgtagtataangnanntancnnntataatcacttgcagcatcctntactgnatcganntatnagtatatagantctctgnaccantatcgnancggaatgnatnctntatgtgtagaangatgagntgatgtcaggatgatgatagggnagcagtgctgctcgggatgngatgtgatngntagtgatggtgaatgtnaggnctagnagtnanctngnngnntcgantcgtgaggtatgtnntgntgatgtanatatcgagaatngagtagacattatagatagtntagtatggatnannntnanantanatcgatggtacgntnnatangnatnatnagngtagntagagtagagngacgtnntangatacatnntatanannnatnantanatntaatatngatnganantnagtanatgtatgtagttngaataatgatnatgntggnntatgaggntatgtcntggctgngtgtgcnngagcagcgntggtangncagtgncagantatgcagncgganacagacgatgngacgagncggtgnatagnnngtatcgtcgggccgcntgtgcaggncgacgactgtngagcnagtacagtaacgactangcagangacgatgagngtcgacgagtgagtaagcagngcatagtagcgagcgagngctgcatacgctgctcgcgagcatcgctgcagacgagcagcagcgacacncaagtagncgnagcancagctacancnanagtccagccagcgcgnaacngctgagcacgtcatactgcacnnactgacacancatnanancnactgacgcgacnacgnncgcgcgaccncagganncagcgnncannacgtagacgaagncgcgagtgcntgctactantcatgacggantcgangtcgcacgatcgtgtaacagcgataaacacgcggcntgntcgcgngtcctgacgcacgcctgtgcangncgcgngcacggatcagcacgaggtagggcnctatgncgctnagtcgtgtagtggnntgtgtgcgacgncgatnatgatggtagatgcngatngcngnganacggagtcgagcgnnagnnattagctgagagtagtacgancggactgtagtcgtacgggtgcatngnangtgtcagtgtggcgcagagtagtgntgtcagacgtcgtgagngannnatacgacagaggaggactntcgtcgagagtggagtnatgatagtcgatcgtgnacnacgacgtgngntangcgntgagancgtgnagtnatgnatgtgntcncgncgtnntgcagtangtacgggngacnagtctgcancagatggtgtgangngncgtgcagtgcagngngngatgatgacgtgacgaggcatgangatgatcgcgcatgtagatagtngctcgcgcgagcgagcgacgtgatgtagatagtngacacgcgagtcagacgcgtcgactgtcgcgcgancgcgagcggngcgtgagtcaggtgcancagcgcatctagctgcncngcagacgcagtcatgcacgcactcaccgtacacaactgactacggcncgacntganagatacgtncactctgcgtgtgcgagacgatcacgtantcagacagacacgatcncgncnctgacgtcgcgaaggcgagccggcgtagcatgcgcagccgtacatcggcgacgncgcacgcncgactctacggaanagacgtagannannantcgcggtctngcntntacatgcgagcgngaggcgtgcgacancnagacgtgcagtgangantantagcgcgactacnancggcgacacgagcagcgctcagcgcnnntcncgagttagnagtcgcatgantcgaattgggatgcgagctangnacngctgncgcatgtccgcacgtgcgaggtatagagaggacgtcatgcgacgcatgagtacancgcgcgagtagatagatncncnag

SEQ ID NO: 9675 - DNA, 395 bp, Homo sapiens
tgaattacagccacctgctgaggaagccaaacagcttcaagaaaggctaaaatttcttctttgtttttaatagactttcctgctgaggtaggagactctgtgaagacaaagctgggcctttttggctgagactcgaaacccgagttcctgaaggaggctggtagtcatttgttccgggtttttggaccagcaacaatggagtgttccaggtggactgacatggtaaaaggcaggactgggacggccagcccaaatgactgatgaggtatttgacctcctgtggtagaaaatcagcactgaggaccttgaagaatttctttcctagttgccttggacagcactggcgacctgactatgaaacttagactgacactaaacaagacaataaacaccga

SEQ ID NO: 9676 - DNA, 795 bp, Homo sapiens
  misc_feature (1)...(795): n = A,T,C or G
ggaggtcaacctgagtaaagtccttggcactcttaaggaggtagcccaagggcagaagtctgtcttcactacatgcttagaatgcagtattacactttcattcaccaattcctactgacacactgttttctaagtcaaccttttcttcagaaatatactgaatgtcaaggacaagaatctattttgcgagaaacaaacactcgataaaatatgtacttgagaggcatgaagaagtgggaaaaaagtgggaattaagaaaaaaacgagcttacgtatggactttggaagatgtgaaactaaagcactgaaagagccattaattaaatgctaatgaggccgggcgcagcagcttacacctgtaatcacagcactttgggaggccaaggcaggtggatcacttgagttcaagagttcaagaccagcctagccaacatggtgaaaccccatctctaccaaaaatggaaatacaaaaaatagccaggcacggtggtgcacgcctgtaatcccaggcactcaagaggctgaggcaggagaatggcttgaacccatcaggcanangttgcatcgagcccagatcgaagtcttgagttcatctttgggacaaaggagaatgctgctaaaaaaacaaaaaacactagtacttttcgggtatttggcaactttgattacccggactatgcgaagatgagaagaaacaaacggtctccggttttaaaaaccagtataacattgtgatactcggggcctaaatggtgatggacttcgttccaataaggacctagcaatatccaagtg

SEQ ID NO: 9677 - DNA, 889 bp, Homo sapiens
  misc_feature (1)...(889): n = A,T,C or G
aaagtaaagtaagataagnaaaaagaaaccaggatttagctgcaacgatctcttattttacccgctacgggcagagaaattgagaaaaacgactcttgagaaattgagaataaggaggaagttctggagagaagacatatgtaaaaagctaccaatcatctttcatgtggaccttcataagtcctgtcccaaccatgatctaagcatacgtgggacaaactgaaagtatcaaagcaaaggctttgagaactgaactaaatttatgccaccactgaagtttcagactaatctctgaatgtcacattgcatatgatggatgaaagcagcattaaaaagactcacactctattaaatcaccatttccaagaagattgagagaaaacttgcagtctgaaattgtttttgactgccttctaaaaccaaaccaaaccaatagaaaccagattagaagcattcttcaaaggatcctaaacaacactttatgggaaactttcagtgcaaaatagagttacttatcgaataagaaaccaagaatacatgaccaattttgaagaggaaagacaatacacaaatccccatccaggatgaaagaaacaacggaaattgctagaactttacagcacaactttacaccatgctgggggaaaaactntcggaattatntgggagactatcatgctagaaaaacataaaacctgtttcaacaatttcttcgaaacagctcaacataaataacgatgtatctatgatagaaatcgtgtccgtcgtggctcaagaagaaaatgggcaagcgcgatatccgcatcccctgtaacaaaggaatactatgtcattatagtcactcataaggaacagaaatgccgagaatcgtctttgtctaattgagagg

SEQ ID NO: 9678 - DNA, 917 bp, Homo sapiens
  misc_feature (1)...(917): n = A,T,C or G
cggaattttgattccaggtatgaggtgaacgccttaaagctcaaaaatttaatcccctttcagaagatgaagaaacctccatgtgaaatggtttggggccttctagacccagcccaaccaatggaaccagaaagagagcattttcagaggttcctaaaccaccgccaaattaagaaccttcagtaccaaatttaggttacttatgtattaagaaagcaagaagaccatggcccatttccaagagggaaaggcanttctcaggatccccattccagaggacaaagagaatggaaatttggaagatttacagcagtgcttacaactatgcttgataaagtaagtttggaaataaattgagagacaaaagttcttagcagaaacatanaacctgtagcaaataatcatatggaaattttagaactgaaaaacacagcattcataaaacaaaaaacttaactgcctgggctcaaaaagagaatggagatgacagagaaagtcagtgaccttgaagaaaagtaaattgagcttatttattctaaaacacatagagaaatgagaccatcacaaaagatctaatattcatgttatttgagtacaaaagagtagaaattgtttcagaataaatactgggaaaaatggctgaaaatttctcaaatttggtgggggacattgccagaatccaggaagtcagcagacctcaaacaggatcagagcaaagaaaaccttgcccagacatgcatcataatcaaactgctaaaaaacaaagatacacacacagacacacacacacagatatggaaacctgctagagaacaatgccacatctataaagaggcatggtaatttaaatgactgaagatttctcatcaaatgccatgaggaccagaagacagaaaataatcttgagtcggcctgag

SEQ ID NO: 9679 - DNA, 876 bp, Homo sapiens
ttgaagctgcattgactgctctttttataaccaccgctcacaggcagtagccccctgggaaaactcacatatgtgttaacaatagtcctgggtgggcgtggacaaaacttgagcaaggcctggtgatgaagagatacaagattgtcacccaaggatttgattatacctctgttgaaagttaatgcgcactcaaccggatatgggaattactcttaattctatattctcaacaattacatgtgaagaggggggggggaatacaatcactggcacattttttaaaaattgtgggtaaactgtaatattctggcaacatttaatgacatttgaagtgggcctggaaaacaattggagttactttatttataaaacatattaaatagggctcgtccaacttggattgtttattaagctaattttcatatttttgcctaggggtggacttaggaggaatgcgggtgcgttattcaaaatttttggctggacgatgtccgataattggggaaattttggtattttagtatgttgcttattgcgccccttgtgggtaggttgtggtttatttctaattaacgaagtattggctgttactgggacttggaatgtgctgggtttgattgggaccctactcagtatttccaaaagggttttaggggccggggggacttggtgttgggttgtacggatgagcttctattttggggactaacaagcgcattgaaaggagactttagtaagggggagaggcgaggattttttgagatcgcggccagctcgtagcgtagtcacattgggggatatgggttgtttcttcacgtgggggggcttcgttgatgtgaatttgtaggttttaatggtctgagccgtgacgaaagt

SEQ ID NO: 9680 - DNA, 217 bp, Homo sapiens
acgtgatgtaagaaggaaggtacattataaattaaagctagtcctgaggatggcaaagcagaaagatagaaagagcttggacctggtatgatgctgttgagctgtgactctaccaaccctgagatcccacctacttctagacttttaatgcagaagttttcaattatagcttaacactgggaatttcctgaactggtaaaaaataaaaacggatgcg

SEQ ID NO: 9681 - DNA, 899 bp, Homo sapiens
  misc_feature (1)...(899): n = A,T,C or G
caccgcagcaaataagtcatcggcgggtggggttatttgtatccagcattggaggccactggaggatgcttagttaggagttaagacctttgggcaactggtaaaccctgtctttttccaaacaaaaagttaccagggccggtggtcaagcaatagtcccagctcttggggggttaagtagagaattgctggacctggcaggcagggttacagtggttgagatcaggccaccaccctccagcctggggacaaagcaagactcttttcaaagaaaaaanaaagaaagtcaaatctgtgaagtcatcanacagaacttctagagattaaaaatacagttttgttgaaatacaaagtgaatgaatatgcagtgataaaaggaaaggagtaatcaagccacgaaaagacattgaagaaccttaaacatatactaagtggaaagagcaatttgaaaaggctatatactacataattccaattacatgacattggaaaaagcaaaattatggagatagtaacagatcagtggttaacagggattctgggggagagagatgaataagtggagctcaggatatttttgtaacagtgaaactattctatatgaaactgtaatggtggatacatactgttaatggcctcaattgtgtcccccaccccactccaaagttcatatcttaaagtctttaaagaggtagctgaggtaaaatgaggtcattgcggtgggcccttatccttatgagaagaggagattaggacacagacaaacttaaagggaagatcatgtgaagacatagaagacagccatccacaagaagaaaccaaccctaccaagaccttcatattggacttctagcctccagaactgtaagaacnataaactnctgatgttgccctgaaaa

SEQ ID NO: 9682 - DNA, 1319 bp, Homo sapiens
  misc_feature (1)...(1319): n = A,T,C or G
ttttaaaaaaagatannnnnnnnnncnnnnttttnnnnnnnnncnnccccgccacaaaaaannnnnctagggtatttacgcccaggaagcctgcccgtcagtaggggttcaagtagatgaaagttgctctaactgcagctacatcaaggcatgtttccccaagcaatgaagaatctgaaactggcttttgatattatgagagtgacacatggccagataacacagcctgattgaagatttgattctacttttagaagaatgcgacgccaacatcagagcatcctaagggaacgcagtcagagggaaatacggcgtgtgtctttgttgaatgccttattgaggtcacacactctatgccttgttagctgagtgaacctctcctattggaaattctgttccgtgtttgtgtaggtaaataaaggcagacatggttttgcaaaccaccaagaaatcattagtttgtaagagaaacccctattattaataaaattccaaaaacatttttggtttgaaggcaaataaaaacgaccttacacctctggggcccctcgtgtggggcccccttcaacagggtggaaaccctacttgccggggtcccgacttttccccccctttttaacctggaaggggggtttaaaattttcccaatggatatccctttcggatttacaaccttggaacctttccccctttgaccccccttctcgggggaaccgtttttcccagggccttttgactccggcccgtataagccccccgctttttttttcaaaccccctttccaaaccttttaaaaaaagaggggccccccgggctataaattaacccgggggtctctttatttccccccaaccaataaaaaattctccctagggggggggcgcattaaaatcccgcctaaagcggcaaaatcagctaaaacccctctttgctgtgcgaaaacccccaaaacaaaggcgggctccaaagactccataaaaaaatgggctcccctacgggcgaaaaacccccgctcttaaaacaaaaaagggggcccccctccctcttattttggtttttagtgcccccagccttctttttttccccccttctaaggggggctgtttccccagacaccccctcccctctttggaaacccgaaaaggccattttttcaccacccaaaaaaaattatcccctaccccccccttcctaaacaattctttttaaacacagtttcggctgcacccccaaaaacccccccggcaaccagtggggatacctcctttctttaccgggtatattaccaccctcctggagccgatcactatgtaccaccg

SEQ ID NO: 9683 - DNA, 912 bp, Homo sapiens
  misc_feature (1)...(912): n = A,T,C or G
accatccatggagaccatactacatgtagctgccgtgtctccttaggctcctctagactgtgtcagcttctcagacttcgttctcaatgaccttgacagttttgaggagtactgcttaggcagcttgcataatgtcctgaatttggggtgtctggcgttattctcattatgagactggggttatgggtttctgggatgaaaaccttcccatcatattatatcaaagatgcttactgtccacatgacgcataactgatgctgaccttgatcatcgtgactgaggtccgtctttgtcttttcccccgctgcctctagagtgctctggacgaatctccctctgctctgcccactttatgagtggggagttatgttccacttccgctaaggttgggagtatgtacataacctaccttggaccttttcacttcgggcgatactcctatgctatttatttatagatttatatctattcagagactcatggatttgtagttaattcctttgtatcacatttcgatgacctgggattattttggctcgcaggacttggttccagtgttggggcactgggaggattatccatttgcgccccctactgccaagatcacactccgccccttactgttgtgtcgtttgcgtccgttatttttcctatacagcgctctatagcccgtattgctctccttctgttttcttttgtcccagccttagaattatacctttattatctagtagccttgcttttcctgtatccgtatatcagggataacactacctttccgggtgtttttgttctccctgttgcctgcacttctcaactgctatatagaatcctgaccaccgtgatcngttattgcatacgcattcnaccccgatctcggattggatttctatgtctatacattcgtcttt

SEQ ID NO: 9684 - DNA, 1778 bp, Homo sapiens
  misc_feature (1)...(1778): n = A,T,C or G
ttttattttttnnnnnaaannnnnattnttttnnnnnnnnnnnnntnnttanntnnatatntnnnatngggttatntgatnagantnnnnnnnttnnnagnataatgtnnnntnnnntnnttaatatnnntntnnanntgtnntnngntatttatantatnnnnnnnnntannnnnnnnnnnnannnnatatatnattttttattatgntnntnnnnnatatatntaanattngaagtntgtnngtnnaaatngattnnnnnnnatgatgatatatgtanagnnaatgtttagatgatagttaacttttgttgtnnacatgtgtaaatgtatatttaagtatcatggnncnnatgtagaagttgatngnnnatacgagtgggagtgtgtagaggcaganacgagcaggatgnagaggatgcgcgagacagngagcggacgtangcagagagaggtgatcctacagtgcagagtcagtgtcagtagtgtattnatgtgtacatagagctatagtatgangcatancngttngcagcatgagtattgataggatgatagacgttactacaagtctcgattactatncantntaccancntgttgtagtacaattnatctatgtctagttanntatcngtngnatatttcanagttaggtcacgatatncttactatgtacantatgtctatgagatgcgactacgcagcgacatcactcagtagacgaacgcagcgacgtgtctacgtcaacaacatgncgcagctccagnagtacaacgtaggcatgttcacggatcagttgcaagtgntcgcgcgcgtcgtatcatncactagcagcntccacgcttncagtcgccgtatnccnctgtcgcatcgtncggcgcgctcagtcaccgccagcaatcacgctcaaccgtcacgccacggcaactcacgacgtccttcctctctctactactcctcctcttccgtgcctcgcgccgtccgcgcgtcgatcgcngtgcatgtcgtcgtgcgcgactnacgctcgcggcgacgtccncgcatgatgattggtgcacgtgattacgtcnttatatgtataggcttgctcgcgtgtngatgtatagtacgtgcgcntacactatggtgctcngtgcgtgtgtacgcatacgtgtgagacactcggttangagtccgacgagagatgtgctgtagttgactgccgccgagcgactgatgtttncgaagtgtatgtacgtatgccacacgagcctgtgttagtacgactcgccancagacgtctgtagacgaaggtcggcacttatagtacgtccacanagcgcaacgtgancgcgacgagtgcgcgcgccctcgcgacgcactatgcgcgacncgcgcgtatcctctagtgcatagtcgccgtggcacgtgctcatcgntgcgtgcagacgatgacagangaggagagcgcgtatgacgctcgaggtcgacagtcagctacgccncgcgtcgcgcgcacgntcgtngcgtcgtcaccagtatgagagctgtcctgctantacacacgatactctacatgcgtaatcacncactgtcggacgcatcactcatgtagtcatcgccgancgcgncgtctcaacagacacgcgagtnctctgntctcgtgangttagattcgcacgctcgctcgccgcgcgcaacgagagccgacgcgtncgcgcgcgcantcttcgatcacccgntgacatactcacngcgcgctgttgtggtntcngcncgcatcttttggtncgtgcg

SEQ ID NO: 9685 - DNA, 814 bp, Homo sapiens
  misc_feature (1)...(814): n = A,T,C or G
gtgtggaaaataaggttctaagaagttaaagtaaaacaggtcatccagctagaaaataacatggatgacactcaaatgcaggctacatttgctctgagaagccatgagctggagctttctggagcacaagtcagatgacaagattattaatgggagcagggcaatgtcatatctgatttcatgcatattcatgtagggagccacacagctgggaccatgcgctgtggagaggacaaataaagagtgctctaccccccacccccagcatgaagaatgtcattgtggagatgaggagcctgattggaaaagtttaagtaattgtagcctttattttgaaaaaaagggatagaatttgcagaaacaacaacaaaacaaggtttgctaccctggccaaactaagtcaatactaagttatacagaaccttgtatctaagggtcacccacctagaagctctctggattgaagtatgcagagagacaacttttgcacttggtgtcaacaaaagaagtaaatgtttagaagcaaaagagaaagaaggaaggaaggaaggaaagaaggaaggatggaaggaaggaaccaaggaaggaagatgaatgaaagaatgaaaaagaangaaagagaaaagaangaaaggatcagcttttaatgacagttaaacatggactggctctccaatgaaagattaagtatagttagtttatggattaacattgtaaatcctaagagggattaaacttatttagtactaagaccggatccaatatccttcagtcccaccaaatattgccaggaattcttgcatcttattccgag

SEQ ID NO: 9686 - DNA, 1127 bp, Homo sapiens
  misc_feature (1)...(1127): n = A,T,C or G
ccgcgccccccaaaaaaaaaaaaaaaaaacccgcacacgcgacggccgggggaaggcgcgggagcaacttaaaaaaaaaagaaaaaaaaaaaagttaggcgcgcggggggggcagaggccgcccagcagaacgaagaggggaagagggtttggcgggagaaagcaacaagaaaggacggcacgatcgagagccggcgcggcgggcggggagagagcgaagccatnaagcgagaggagggggagggaggagacggagggcaacaggagaggcaaagaggaaaaaaagaaaggaaaaaaaccacaacagcaaacacgcaaaaacaagaaataaaatagggagggaaagggaagaggagagggggggaagaggggggaagggacgaggggacggagcccagantgcgcacgncccccgagcacgacaactcaggaagcaaccagcgccaggccacagaaggcnaatagggaggtgaacagaagaagcnccgcccgcgcggcgcggaggggaaggagcgcccggcgcgaccgcaggccacgacacgaagaacacaagcaccaggccggagcgaacaccaacaccaaccacacacgacggagganagagaaggaaagacaaacgcgcgcaaagaggccgccgacagggccacccacgcacacacaggaagcgcaggaaccgnacggcgtgagaggaggcagagcaacaaggagcgacaaagaaacaagacgaggggagcagagagaggagaggaggaacagagagcacaagaaggcaaaagggcggcgggagggagtgggaggggaagcacaagaggaggggagggagggaggaacagcgcacacgaggcgagaccgcgcacaagagccacaagacaatgggagcgcagcgaaccccgacacacacacgaccgcacacggcgacacacgcgaggaccacaaagccaggcgacaataatccaaccccaccacatagaagagagaaagagaaacagagagaaagtagccgagagcgaggaggagaaaagtgagaggagcgacgaacacaggacgagtcgggaagaaaggagcgacgggagcaacagacaaacacaaagaaggaagaagcacaggtcaggaacgaacggaaacag

SEQ ID NO: 9687 - DNA, 918 bp, Homo sapiens
  misc_feature (1)...(918): n = A,T,C or G
tgaaaacaacattgtcgcttggtgtccaccagagagtatgatttgttgaagccaacagaacacgaggaatgtaggaacggtaataaggaaggatggaaggaaggccccaagcaggtatatgtaggaaggaagcacaagaaggaaccggaaggaaggaaggttcagctctaagtacaggttaaacaggactgctttcccagggaaaggataagtataagttagttatgcattaaacaatgtaaaatcctaaaagggataaaacttgttagttattagcccaggatccatatcctttcagtcccaacaaaataaatgccaggaattccttgcaatcttaattcngtagccagacaagcaacaaagcagttgtctgtaccctaggactattttggaagttctacatggtattacagaccctgccaatcatagctaagagactgaccaggaaagaaagttactcacaaaagtgtattgtgcaactaactagaacgaaaataaggttctcaagaggcaccagtatgagaagaactgttgggaagaatcttcttggccatccacctgggcccaagcaaccacagggaacagggaccaatgagaggaggccaaatagctgtcttcaaacaagaaaggtggacacgtctaatgttcccctctttcttatttatgtattcactcattcgtacataaggtagtgcatgcattcattttactgtgaaaatcattctattctaggactgtttcttggaattatgtaagtgattattatttcagaaattttcagttaaatattagctattagcataatggaattcatgctgtatattcattatatttaattatttaataaggagatcaaataaatatgtttctacccacgtaatgtctcnctatcagnattgcgcctcagttacaaaccac

SEQ ID NO: 9688 - DNA, 806 bp, Homo sapiens
aataaatttaccagcacaacagtacgccattgacctgggagtggaggagtgacaatgaacacagcttttgtttccagttgcatgatcaaagcagagagaagaaactgtgcctcttcaaagctgagaaacatttcaaatgttatggaccacttgaaattgagaggtgaagccagctggacttcctgggtccagtggggaattggagaacttttctgtctagctaaaggattgtaaagacaccagccagcgctctgtctagctaaagtattgtaaatgcagcaatcagcacactgtaaaaaagcaccaatcagctctctgtgtctagctaaaggactgtaaatggaccaatcagaactctgtaaaatggaccaattggcactctgtaaaatggaccaatcagtgctctgtaaaatggaccaatcagcaggatgtgggcagggccaaataagggaataaaaggtggccaccggagccagcagcagcaacctggtgggaccccctttcatggagtgggggctttgttctttcactcttcacaataactcttactgctgctcactctttgggtccacactgcctttatgagctgtaacactcacggagagggtctgtggcttcattcctgaagtcaaggagaccatgaactcaccaggaggaacaaacaactctggacgtgccgcctttagagctgtacactcactgcggaggtctgtggcttctctcctgaagtcagcgagaccacgaacccaccggaagaagaaacttcagacacatcttaacatctgaggcacaaacttcgaaacacc

SEQ ID NO: 9689 - DNA, 1561 bp, Homo sapiens
  misc_feature (1)...(1561): n = A,T,C or G
gggggnnnnaggggnnnnnnngttnnttnnnnnnagtatgngtnnggggtgttgnntantgggangtngttnnnnagtagtnnnntnnnnnnnnnnnagttnttatttctnctagagttnacgtagggttgtttgtgagcagtgtcggngatatggagttgnatagttttactgtgtatatggttagnnnaacacagtgtgtggngnagggagtcatcgttcacactgcatatatagagcatactatatcgcatctagagtaaggtacgatgtgtatcggcgcagagggccgcgagtgctggctacgcgtgtagttggtacaacggttgttaagagcgcgagctgaagagacggtatgtcgactgtgattgnganatatgcgcaatttaccggcatatctagcgagnnnngancagtagnaccnttgcccgataccgatgcaaattatctgcgataagtgaggtcctgtctccatacacagtgtgcctcctgtgtcctcctcgccaacccaaatagattagttgactaccagtcctcgatntcacaacaactacatctttacagcttcngatgtcacagtggtccaccgggtggagaccacaacacaccgtccccacgccttgtgcttctctctctgtcntgtcctgctctctctacctcncgccgctcaccgtgcaatcagtgtggcagtcagacacgtcagacgttcgtatcagtctcatccatacactgctatacccagtaatctgcgcctgtcgcgaagcaccgtcacgcgttacgtggtatcagtgctgcgtagtgcgcagcagtatgtcgtagtagcatcatactataatcagcgacgantaatacactgtcagagtcgatctcagaatagcgtacaccacgttnatntctnacatacgcatatacgtatcacacactataggagattcagagcatgctcngntacaaggacgcagtcgatgacgngngtgatgtgtagcagactacacgctgaagtcgtgttgttatcgagttgagcgtctaatgtattatcgatgactcgccacaccngtgtcccgtcgtgacagcgaccagacagtatcgntcancgagcgcacgtcgtcctgtgcngcgccangacgcagcgagtgangtggcgtgtctgcgactctcgtaccgcacgtgtctcacgtatgcagagatcgagagtngatacgnttatacgctcctcgagnctgcacgcatgcgngtgtcgacatcgtgctcgagagtntcactctctcgtagtacgtgtagcgcngtcgaatcgtcacnatcgngacgatcctgacatcacctcgtagctgagattcagatntntgactncactcatcgtggtagtacgtcgtcgccgctctgcgtgtgacgctctgtgctacttanctacctcacagttgttgatgacgcgctcgtccacgctgaacgctacncatcctngatgtatgtactcgctgcgaactctgcancgagcagcntcgcgcanctatcgcgcgtgcgcgacgtatcatagacgtcgtactcgtgacacgnccgtcct

SEQ ID NO: 9690 - DNA, 791 bp, Homo sapiens
  misc_feature (1)...(791): n = A,T,C or G
gggggtgaagccccnnnaaanaannnaaaagttttcggcaaaaagccgaaaattacgggcagcctcgggaataaaccacggggcctatccagtgattttgtgggcgctataggcctaccctaactaaagggcggccgccgcctgtgcctttaacacaacagtcttgaacataaattgcagggacactgttaatataccacagtttcaggagcctgactcgccgaggcgaacaaaaaggatgtaggggggggcctatgtttgggcccgggctgtactgaaacccgaggaccaactgcccgggttaaaaaatcaactttaacccccaccccggtaagggcgagcgcacaaacgggactcttactttaagccgcccgctacccgcctttattaatggaagggcggaccacccagaatccttgtgttttgctttcggaggagttccttgaaataggggggtttgtttcagaactcgctgcccccagggtgtttactaaatgaaggaatcccttcccttttccgtgactctctttgacaggtggagaggcagtagcaacccttggtgattggccttggtaccacgaaagagaaagcgctttcattttgccagagaattggatattctgtcgaagaaggaagaaacaagaaaaaataccctgcgggcgggcgccgcacggaaaagaaaccccgcctcaaatttcctcttggagaaaagcttcgaacgccgcttcctttttttaatgggtgggggggagaagtttttttaaaaaaaaaaatccttaaaaaaaaaaaaa

SEQ ID NO: 9691 - DNA, 866 bp, Homo sapiens
  misc_feature (1)...(866): n = A,T,C or G
gcccttgatgcccctgaccggctttcttctccccgaccaaaaaagaaccccgttctctcaggcttcctatgggcctgaggatgaaataaacccaaccaggcatcgcttgcaaaaccatgtttttntgctttaggatccacgcctcccggagcaaacccattagtggaggttaaagacatcaaaggagggtacaaacccaggcaaagaaaacctatgttgtgtcccccccataaagtgataccaatatgacagcctgagttgcccagcctgaaccacaatccaatggaactctactattatgaatggaaaaagagtgccctaccaatgaaagtgagatacatagttcaatgccttaaattatgcaaattacacaggtcaaaagagagataagcacagatactgaacttttcccactacccaatcacagctctgcaatggatctactgccccaggtgcaggcaataagaaggtgcattgttcgcaccttctaaaatggactaaaagactgtatgcttttttcattatcaacatgctccagcagttctaaacaatgccagtgatgaaatactcgtttgcagaaaagtatcttgttggtctcatttctaaattactgagattactgctgacttttaataatattccagtatgtgaccttcaaattagcattgttctttaataaaatctatgttctttaaaaaatgccatattctacatgaaatttgaagtactaccagttcataagacatttgtaatgactcaacatcctttgagtttgcctctccccatgctgttctacatattcctgaatttaaacactagacatacaatgactgcacatgattgtaaaaataaagctagatcggcag

SEQ ID NO: 9692 - DNA, 1974 bp, Homo sapiens
  misc_feature (1)...(1974): n = A,T,C or G
cgtcatgcctttaatgatgatatgagcgncgatgcagtcgcncgacntgtactcgcnagcgagacgatngntactagtntggaagtanntnatcgngaactagtagctagtcntgtagcagcagagacgncnncagcgactctgcnacactacttntagctntcaagtctagtnntagcnagcgatatgcgggtntcnataganatgtgagnctagtctggatncgtgcagatcagtcacgagangcatcgnctgtgctgatgacaggangcagccgagtatctgatatacgatagctnacgtacntacagacgaacgttnagangancggcaggntcgacgagtatnctgtctgngctactctgtatgcagtagcntgngtangcgcagactggtagagatgnagnagagnttgcatgtcagncgngtgtgatgcgactntagtcgnacgtgcagcacgtnagatgtctcngacgagcgctcgactgcagcnatgagacagttgatncttagcgctgacacntgntagntagctacgtgtgcacgtancgncggtatgntgtatcancatgcatcaacgtantgtgatcangtagcacgtntgtcattatcactctgtancagtgatgtcnattatgantgagagancgtantgntgnatgntngtnatgatttgaagagagtctnacnagcantntntatgatcacanagtctggatnatatcgantggtcgtatcgatgtnctctcatgntgcgctgacagacgactcgnactgtantcgacgcngactgtatgactgcgacgctantntgcatgtatcggcgngntagtcatcagctgctgatacgcnagtcatgnacgctnctgaccgaagtcacntcatgtngntcacgnatcncnatcnagatctgatagtacgngacagcntgcgtagtgntgttgtgatgngacngangngccgctcgtcgtnagtgacgnantanctcntggnnantgtatantgagnantgcagctactagctgatcctcgcatgagtngngtacaggngaaanctgtcgacgcaacntgntcnactatgaactgagattantgcanantantgtactgtagagcnngtctgantgatatttcaggcattncantgatgatatcgcnattgtagcntagcgacgatagtagtagtatgtagtnnatattancatgttnagnatnagacgtatatcnntggactnantngtgatcgcntctgacggagaagcatgcagtgangcnactgcactgcangagacganngnnagtgctactcctccntngatctactagtgncgcntacgcactcgatgancaacatgatcagtatcgaantgcgcantancactntccatntacagcactcnantgtgacgaantgcgtnacnatgantantcatngtcgtgcangncacacactgntagtncagtcagttgtagacgtcgtacgctcatgatcgacgatgacatacggcatgactgatgntgcgagtgntgatgagtgctgncatcaggagcatagctgctgctagcgncgttcncgntancgtcgactatntgngntgatcatcgagncgctgngncagctatgncgacgaggcgtcagcgctgcgcntcctgcnacntcgatgctcntacgtactctgatcgcactcgagngactgtacccgacgnctgcacttatgatgagatacnctagatatactatncgttctnantangaagtagtnacgtncgagcacgagtgtgctananagntatcgtacgatcagtacagtcagcgtantagctacgtgtactatncgatncgttntcatnanngcagnagtcgagactagntagntgtngactagatgagtagtcgatgccgatgcgatgacgantgantgcntgagngtagntncagatcacnacgtngtnantgcantanngntgacgant

SEQ ID NO: 9693 - DNA, 1171 bp, Homo sapiens
  misc_feature (1)...(1171): n = A,T,C or G
cccgacacaggccccccgccgcccccccggcccggaccgcaaaaaccagaaggagctaaaaaaaagacaaaaaaagaaaggttagacagaccacaaaagcggacggcccacagaaaaaaacccaggcgacgattaaaaacgggacggggcgaacagcaaagagacccgcagcacgcagcaaggcgccgcgagcaaccagcgcgaccgagagagcggagagggcgaaagaagggagcagagaacggaagggagagggggagaaggaagggaggagaccgcgaacagacggagggaagggacccgagacggaccaaggcgaacagacagagcgcacggagggaagacagatcggagaggaagaaacgacagggacggcggaggcaaacggtggagacaagaacccaagcaaccctacaggaagtcaggagaccacgagacgcgcgggcgcacgagggacacagcaggcggatgagagaaagcacagagtgcgaggcacacgaacaagagcgcgcggcagaaggcaaagcgcacaaacacgcaggccgggcgcacgcgcgcaaagggaggcgcaacgaggcgcaaacaggggaaacagcacccgcgcagcggacggaccaggcggaggagtagcagcggccgcacagttagcggcgccgaacgagtgagagagnatcacgtagcagtacactcagcacagagntatcatcacacgngtgatggcctgcgcggcgagacactcgcgagncacgagggagacacagacgcgccacanagcgcgacgggacagagncggacctcacncancgacgcacgtgtacactcacagagagggcgcaggagccacacaacgcagagtaggacacgaacgcagacgcacccacgacaacacggagcgaccaggccgacggaagcgacgcgaggcgggcgagcccgcaggcgacggcggcacaggtcatagaacgagagaacgcagcacgaggtggccgcaagaccagatgcggacgccacaccaaggcgcacaggaggcactacggagactcagcagacgggagaaggcgggaacccagcagagagtagacgactggaagcaacacagaacacgaccatgagagtcacgatcacgcccgccagtgtcagtcgagtcgcacgaccgcgtgcgagcacgacgagg

SEQ ID NO: 9694 - DNA, 1384 bp, Homo sapiens
  misc_feature (1)...(1384): n = A,T,C or G
gtacacacacggtctcagacccgccttcnctatggcggtaacccattacgatgctnctccctatgctcacactcnnccgtctgcaatccgtcnancactggncaacgctatgangncaatatagtatgtctcagatacgtgtcncagctcacgagtactgctactgtgcgagtgtcaccctgactacgtagnctctcaccgctnacgcgtgtcgcacgngcacgtgctcacgaatccgcgcgcagacaggatgcctntcgacnnctnagtgtcacggcnccagtctcgacgctctacgtgtgctcattcacggcctgtngtntctactctactgtcctcacacgcgctctcgcctnagactcacagtgnagagttgntncgacagtaagtanctgatagcngccactagctgtagttctgtcngtactctgnantccacgtcagtgagtctntnnnnattcagctgatcaccacccgtacatggacaggncactgcnncanangctgctcatatgtntnacctacagtctgnnctnctgctacctgcatatctcgtgagtgattgtgatcnctgcantagtcatgnntnagntcgtacgtatctcatacnnaccagtatcgttnnncatgntgcaccacgcgtgtgagtanatnacatcacatgcgtcnagtcctcgacgcatacgatctctcgaccgatctcatacgtatngaagntcagctatcantcacgtcgcagncatatattncncnnccngacgatgcatctcacatgtgtaagcgancatggcgncntcatncagncagtctntcagtatagtcgctaatgtgtcatgagcatgacagcgtncatatgcgtntnncatcagcgtatcgctgtcatacgtgnctntatcctcagcatgtgtgctgctgcactcgacagtnctcgagtgctctcacgtctcgnnctcancacacnactcacagtatcatgagagttntcctctgcgtggcacgatgtctctngctctctcgtctactagtctccatacggaatgcctctcngtcggttatctatcactggcnactncggtcntctcgagtcnccnttcgtgtctgcagtgcgatgtgctccgctatcgcgctgctggtacgcccccagcgacgtcctnatcgttccatcgtcatgtcgtcacgtagagtcncgatcaccacncaccacatcgcagtgagtaacancntgggtcgcctctctatntaactctagcgctacagacgccagacagctagcatcactagcacgagatcgtgctntacatcnnnacgtgtatacgncnctcctactcatggtgtgtgcatgatggtgcacntagtgatagagtcagtcgancanncnctactg

SEQ ID NO: 9695 - DNA, 1128 bp, Homo sapiens
  misc_feature (1)...(1128): n = A,T,C or G
gcctggaggggccccgctanagccgacgagacgaaaaaggtttttagagaaaaggggggggacgtagncangaaaaccccgaatcttgaggacgcccccnnaacagcagacaggaaccagagcaccaaggacggaacgccgcccaaggagaggcccgcccgagcacggccacccgccccgcccacggcancgccgccggaccccgcccgggccgcgcccgggccgcggccgccggcggggggcagcggcggcaaccccaacagccccgccggggcggccgccggggcccaccccccgccgccgcaccggacggaaagacagcgcggccccaccggggggacacgcccacgggccgcggggccggccgcccgccgagcggggcgcgcgcgccgcgccccccgcccccccggacccaaaggccccccccccgcgccaccccccccccgaaggcgccgcggccgagccgccccgccccgccccccaccgcccgggangacacgccgcaggcgaccggccacccccgcccccaacaaaaagaggcgcaggcgcagagccggccccacacaggcccccggcaccgncccccgacgcccgacccacacagacacccgcccaccacagggcaacgcgccaccgaccgcacggagggggcaacgcgcaagccacaagacaccacaagccaacacacggaccccgccccgcgcgagagcacgcaccggcccaccgcccacccccagaacaccacacacaacccgcagcgaaccagagacacagagggcgacgcggcgggccggccacaaacgacggcgaaacacgaagacaggngcccgcagccgcccgcacgcgcgcaagcccagcgcaagcaagaccgccgccaagaaacacaagccgagggcgcctcgcggcccgccccacccgcaccaanaccccgagaagagaggcagaagcccgaccgacgccgaccgccaacccccagaaccgacgaccgcaccgtccgagccgcacacaaacccacaaaaggagatcagaagagacgaagcaagcgcgacgcgcacggaggcgaagacccggccgaagacagccacgagctcgaagcaggagcgaccnacatacaacgtacaggcagag

SEQ ID NO: 9696 - DNA, 1099 bp, Homo sapiens
  misc_feature (1)...(1099): n = A,T,C or G
tgtacgttatgatctcacatatcctacatcatctcgcataatattatacgtcaacctacacacaacagagacacagacgtaaaacnacatcataagtaacggacagagncatagctacgccacgtacagagtcactccaatctaaagacgacgtcgcagtgtcacagtctcgaagctcggcgtacaacacataatcactactcacnnactactaactgacaacgagaaggtcgagtacacaagatagtnctaggatcatntcatccagttcacgagactcagcantcaatgcttagctactctatacgctagcgtagaaatataggcggatcataacttcgatgctccatagttcggttaggatttnacatgtgatgaccttctctacacttcgcgtagatcgtagagatagttgtgagactttgtcgtgctccaatatgccagtacaacgcaccacactaatgaatatctaatcatactgcaccaatgccctnagtgtcaatagtatagtctgtgtaagactcttcgatatgtaacgtggacggtgtgcgtgggagcattcgtcagtatgttctctctcccacgtgtactgcctagtagaaagtcgagacanaccatctggctcccatattggtcaagttgcagacccgtgtgtcaacatgttccgcgagctccactacatagtcgataaccactccactacgacccactaggattaccatcacgtcctgcgctacgtgagancccatcgactccttatcctctgatgtctagtgctgcatctccgatccatagatatctatcgtagctcctctggcgacacagtcccactcgccgtcgcacgtcacatcagccggtcgagactcgntcgtacgctcatgtatcatcttnttcatgcgtgtctgtagacgcgctctctactagtagcgctacntgtctgagacgtaccaactcgatcgtacaatatctcctgaacacgcgtggctactgcactgacgaacgtccacgganagatacagacgatccnnntctcagagactgcatcactctactgagtttacatgagagtcttagatacagagatatgnaaccnnataat

SEQ ID NO: 9697 - DNA, 809 bp, Homo sapiens
agatgggatctctcttctgtcactcaggctggagcatagtggtgtaatcaatgatagttcactgcagccttgaactcctgggctcaagggatcctcctatctcagcttcctgagtagtcgggactaaagaacatttggataccacttacctctgaggcagttcttttggaaattataaatatatttctttccgggtatcaaaagaatccacatcaacatgaaagatgaagtgttgaatctgaattcacagctgctttatgcaatctggaaaaaggtcaagctggagtgcagtggcccaatcctggctcactgcaacctctgcctcctgggctcaaggcatccttccacctcagcctcccaagtagctgggactacaggagagaagacaatgaggtcagctagaatgatggattgtcatcactggggcacgggaaaggggttgagcaagtcaatgtatgttttccagagcctacagaatgtgtctgattctctgaagtatattttttctaaatgccagattcaagcattaagcactgtgccgttttgagagaagaaggtattaagcaaaactgacttgagtaaccaccagcccacattcgggactttgtggggatgctatggctcttccggacttacagccatagtgatgcaaacctgccttagcatgtgtaatgcttgtaaaaataattcccagaaatgtttaattttactggcagtgcataccatacagtttgggttggcggtaaaaattacaacttggttcgattaaaccgagcgccgttcctttatgaggttattattgatccgct

SEQ ID NO: 9698 - DNA, 1412 bp, Homo sapiens
  misc_feature (1)...(1412): n = A,T,C or G
catacaactcgatagcaccacacctaattacaaacgcaacgtacncctatcnctaccgacggacggtggtctcatctctcgttccgcgattgcacactgcaacttcgtgtgcatatcaaatattataacattcttgtgatatatcttacanaaatgcgatgtctgagagtacgctatctcagctggagcaccataattaaaccacaatataataaatgactatgatgtacacatatacaagacctattagagacatcgcagaggaagccaatgaatcgatanaagacacgtcgagaggacgcgacatacacaatggacagcatacgtcatgattgtgcacgntagngaacaaggaagtgaagtatgagctgggatcatataattataacgataatcacagaaaacgcatagtcaanaatttcatataagactcagcacatacatgcagatgtgcgccggcctctatagatatgagagcaattaatgacaagtgacaatactgatcacctagtatcattgtaggagncaccatcacaagaatcttcnttctgactgtncacgctacacgcagtctgcacgcagttcgcgttattcatgcacggaccacatccctatgcctatgtatcattatagttaacagtaacatgtgtctcgtatcgcctgctatacacaaacgagagacatcngtaaaaatagaacaagagaaacacgacgtccccgcgtgttcatcatctatcacaatccatgtcccgcgatagtctgtattatatatatgttggtgtagccacggctttgaatcatccgtaatctttgctatattctcccacctcggacatcacaatcagcacaaaatataatatctaaccgactaacagcacgaacatctaacataacacatcnataacacaaacaaacannnncnatctcactccnnaacaaatcaccacnccctccaacacttcccgaacttntaaactctcacctctctcccactatcattatatctcttccataattctcgtgcccctcttttgcccctactcttaataaatctattattcttatattatttattattattaaattcattcacaattatattcattgncgttatacggggacgccttntgtcgtgcattagtagaggtttcacgattgganntatttgtatattttntgntngttttctccctccctgtnctctttnnttcgcccctcctcgcncctcctccgtctcctcctantannntntntcttggccccgcacntattnnntcgcgcgcgagcaatgaaaaatnnnnaccnnnncnntnnnnnaannnncaaaancnnnncntnnnaacancnnannaggnnnanaatannttattgtnngtttnanntatntnnttatatatttttgtatatttata

SEQ ID NO: 9699 - DNA, 867 bp, Homo sapiens
  misc_feature (1)...(867): n = A,T,C or G
tggaaacaagcatttcacacactaggaaccaaatataccaggagcacggtactactttaagatgttgggtggtgacttccctggccagagaggataccaatatgcacaagccgatgagagttggagcttcaccaagttcctgaggctggtcttgaactcctgaggccaagcagtctgccngccttagcctgccaaagtgctaggattacagatgtgaaccaccacacgctggcctttnattttgttaaacaaatcanatatggaagtaaaaaatgccacccgtatgccatctgatgattctgcacatgcacagattaattaatggctgaaatccttttacatatattgaaaggtatagtgggacggtacatgttgagtaagaattaacnngctatttgtggttatggtcttacgatagccacctaaaaacattaatatttaaattcatattcttcagattcctaggattctttattccatggtaatatgcaaatgagttcgccatttagtcatgttacggttcccgtcatttaaaaggtcaattacacttatttggcatattccataggatgactaacataatatatcatcggattatatagaatctcggncaaataaaaggtcctcagagggtagcgtaccgagtcgaacgcatatttggaggttatgggttaaatcgttccgatttnccttcgtcaattaatttaatatagaaatgtcntattgcaagaatatgtacatagtcctccttagtaagttgatgcgattctgtggcatcaatacatgtgcacttgtcagtttgcnccctagtggggctgtaactatcatctccctgtaagccttccacatctatcaattatactataa

SEQ ID NO: 9700 - DNA, 288 bp, Homo sapiens
atggagtcttactctattgctcaggctggagtgcaatggtgagatcttggctcactgcaacctctacctcccgggttcaagcaattctcctgcctcatcctcctgagtagctgcgattacaggcgagatgacattatggcaactgaagactgaagattggtgttggctacacttcgcaggcacctggcagctaataatattgttgaggttgctgatccactttattccttcatgtccattatttttatgacattacattaaaaataccagattacaaaaaaaaaaaaa

SEQ ID NO: 9701 - DNA, 252 bp, Homo sapiens
agcgagcccggcacccagctgtcgtccacttgcatttagtgtagctgccacccagcaattaacgcgcctgggctctcctttggaaacctagcagagaagaacaataccacagcgagttcgcctggacccgaaagcaggtccttgaaaaggatgcaagacaaaaggaaaaataaaaatccacagcagcctgcagtgattgaagttcaatggcgtactctattatcttctcctgtatgtttaaataaaccccga

SEQ ID NO: 9702 - DNA, 1434 bp, Homo sapiens
  misc_feature (1)...(1434): n = A,T,C or G
ctgtcggatatcgcgcacgngctctcgtctgtgcgttgttgtgtttgtgtgttagtcttatctgagatagagtgcctcgcgagtccgagacgtcgngctccgcgcatgtcgcgcgcgcgatcnacggtgcagccggccagtgcacgctccgcctnggcantggcgagctccgtcgcgtncatcgcncgcctcttccgcactccatgttggtaacgcagtatgtgtgattatagagccgcgtgtcgctcctctccgtgcgctcgcttcacgactccgccactgcgctccgctccacancgtctccgccactntctctcgcgccttncgcctcgnccttgcgttcatctcctcacagtggcgcgtactgtgccgtcatctgtcgtactactaggtgcgatgcatgcggctgtgtcgcgtccgtcttctantctcggntgcgtcgcgccgtcgtgccggccgtcgtcctgccgggtcgcggcgcccgacgctcggcgcctcgcttcacgtncgtcntgtctcgtgcgttggcgcggncgcgccgcgcgcggcgcgtctcggtgctggtgcgcgttgcctcttcgtgcgctcgcggtcccgcgctncccgttcctctgcgcttcctcttcttctcgcgcgcgtcggcggccctgcgcctgcgcgccgtnttttggttcttcggttgtttgcgctcgctcctgcgacgttgcgcgtgcgcggttcgtctcgcgcctcgtcngtctgcgtcgctcgtctcgttctcgtcttcgggccgcgctccgtcgcctctccgcgcgtgcgtgcggggcctcgtcttgtccgctgcgttccccttccttcgctgcggtcctccgctcgtcctcgtccctctctgtcgtcgcgtgcgctttgctccctctctctcggtctctctcctctttcgttcgccctcttctcctgctccgctcttcctctttgcgcgtgccgcgtgtgggtcttggcctcggcccgcggccgcgtcgtgcgtttccgcgcccgcctccgcataaaaaaaacatcgcgcccctttccccctcctccgccccctccccgttgtcgtcgcccttcgttcccttcttctccccgtccggttgcccccgcttctcccgttcctcgcgtgcctgctctgttccgcgtgccctgtcctcttccgctctcttcctccctcgtgttccnccccnccccccctcccctcgcctncnncnccnncgggtgtcttctccccncncncnccnccacccacaaccccccccnnccnncccccnnccnnnccnccnccnncncccncnnncnnnnnggttttttcnnncnnnncccgagcncnncncncggcnggcncnggtanaaacanaataaccgaacttccttttttcctnctgtagttcggctgaataggaagctgcgtcgtctcctcctctc

SEQ ID NO: 9703 - DNA, 149 bp, Homo sapiens
aacgtcaagcgtggatcggccttaggttctctgcctcctgcctcagaagaacagaggtgcgtcagggacccaaaatacccctgtggctgccctcatgctggcccttagcaatcaaagaaatacagatttaaatactaaaaaaaaaaaaa

SEQ ID NO: 9704 - DNA, 850 bp, Homo sapiens
  misc_feature (1)...(850): n = A,T,C or G
tctatagacatttaccaaaaaaaaaagaagaaaaagaagaagaagaaaaagaagaagaagaagaagaagaagaagaagaagaagaagaagaagaagaagaagaagaagaagaagaagaagaaggagaagaaggagaagaaggagaagaaggagaaaatatgaaaagaaatgtctaggctttaaggtgaagatgggagaatggacagcaaacctagtacatatttgttaaagtggaggtccctatggccactacagaagactgggattttagcctgcttctgtgctttggagagaactagcacatctttctagtcatttgcatccctctaccagagttagtaaatcaggctaggaccaggaaggcactgtcgctaaaggacccttggtaaaagtttctactggagtctacacttttcctgctccaaaccttctggccaaaatgtgtcttatctcaaaatgtcaagctntgtgcaatatcgttattagtttatatatattttcctgcagaaatcatgacatttctatacaattattttagtctttcttataatttctggtttttcgcgaaagaaatcttatatttatatagttatatttgatgtagttgaagattcagtggttaagtctcatccacattgactgtctgagatttttttttttttcgagacaagccttttcctgcacctggctggagtgagtgagatcttgctaatttttgtttcttagaaagacaggtttcccatattggcagctggcttgactccgccctagtgactgcctcttgcctccaggtgcgggatacggcgtgacctgcccacctgttgattttgaaatgggccatgggtcccct

SEQ ID NO: 9705 - DNA, 1745 bp, Homo sapiens
  misc_feature (1)...(1745): n = A,T,C or G
gcgtagtacgtagagtagagaggacgtgcgccttatcagctattgtgtgtcacggtcacgtcgcactcgcatctatcgcgataaacgcggtatnagagtagcatgcgagtagtggtcatagcactgccgtatgtatatctatactctantgacacacatctgctggcgacatcggngtacgcagtctgtgtcgggccgacagtgatactgtncacgctctncctcgnatggagcntgtgcagcgatgnctgtnagtgcgcgtgtgcgtcagtctcgctcatcgcgctgnccgtcagctcgcagcaatctggagcaganatggatatcgntgatctgtcgcacgcacgncgccagagagtctcgagatcgcagtatagacaccctcatcgtctatatctnttctctgccgttctgctncgtccnacgntacacgatcagacataacagtagtctgcgtattgtgtgtgagccagagacagaantgataagtgagaccgctaatacacggcgcgcgtacacctcgcatcgtacgtcattacctgttatatctatatgtcatacgagatagagtcccttatncgtggacacaggactctcagcgcgatcgtgcagcacaagacgacaanatgagagtaaaagagaagtatagagtatatctttatgacgtatacatacatanacttgcatcagnaatnacacatacagtatcacgacctacagctcatgcgctctctgcgcgcatagagataggtctactgtcgcatatcatcacactagatgcgacagcgcagtcgcgactcaacgagcacatcttganacacagatgagtgagcgcgcagagatactgatgattgatataagtgagtctgtgcgcgtgcataacttaatccntagtatacagactatgatctatcagtcttntatactgttatctcagatcatctacacatagataccgtgcagagctcgcgctcggatgctagtagcacttacccagcgttctttctanatgagtaatagccttgtgtcactctcgccgcccgccgcaccgtaccccttgtgatgcctcatagtgcgatctgctactcaatgtgcacagtctgtcaatcacccggaacggtgtagtggtgttgtagtcctacgcaccagactcgtcacctcgccngctncatgaccagtgagtcgcgtcgtcgcccacctgctcgcgtctngcgatagtgagagatgtatgtgcgtgtgtntgcntcaccgtcccgcatcgctctgcatctctccacttcctcactactcttcagacccgcatcgtaacttacatgcgcatatctctcctcaacgatctgaacatatgcagtcagatcctcaatcgctcgcgcgcanctctctccacgctntgtacctccgatncatggtgtacattacgatatctnagctaagttnacgtatacgactanactanccgctactccgcgcgctactcgtatctctattcatcgtcgtactcncncttgctactactcgggcgcttcgagtcgagtctcgtctatcgacgatgcgagaaaatacgcgccgctccgctacagttgtccatgtgcgagctcataccgcacgcatccagagttcgggttctttacgaccgccctgccagggatttagttnngtnctctntgtcttctcctgcagtcagggtgttgtgctctgntcttcggctgctttgtgcgaaggatgaggagtaagaagttcgttat

SEQ ID NO: 9706 - DNA, 1367 bp, Homo sapiens
  misc_feature (1)...(1367): n = A,T,C or G
ggagagnaggagtggaggcgaggtggaagaagagggaggngggagggagttagtcggcgagctgtcgagaggtgtcatcncnctgtctcataaactgatgtgtgtttatctctatntnncgangtctagacatcatcattattagatagctagagtactctagangagatattggtagtgaggggagngcggtatatngcagaggagctgtgcttctgatgtgnnatcctcgagatcaacacgtgtgtcgtgtgtncacatctgtatagagccatcgaactttcagagaagatatagagtntcgtattatgntaagtatgcgtgtnnacacactgagtgctatgatcnacgaatgaatattagtaantcgcgtgcgatataagttctnaactatgtaagtacagtnggtagatgtgtgggtggaatataagaggtagcatggcaggagacgtaaaatgtatagtagaagaggcagaatgtaggatgaatangcatcgacgtaganttcgcgtcaggcagtgcgatngttnngctcgtacattgtatgagtnagttcgatatagagcgttncgagtatatgaaggcgaagtgaaagtgtgagtgagaggtggtgtgtgtgaggagaagcgcgacgtatactgagatagtacgaggacgtctgttcgtganagnacgaaatangggtcattgattaagtatgcaggacgggctggatgaagttgnactgagagggaatgtatactgtagtcctatgntacaagcactgcgtgnagctatacacgtgttcgtgnngctcagtgatagcgacatggngacgaganatagctagtntcatttgtaagaggccgagtatgangaaccatgggncgctctacgaaggacaggcgcgagtgagatgacggtagacatccgttgggtcagatatgtaaattttaattgnggtacatgttgagtagggtgtgagagaacatagaacaaaaaacacaaganacggggatacagcatatgagagnnatatactatactatcgtggcatggttgtctcgagagtaagagaaaatgttgtagttantnggacagtagatagtgatgagtgngtcgatatgagactagaaattcatggacatggaaaggtggcttatgtcgtcagcgttnnncactctctcgtntgaacctcgctaggcgtngacacgtaatacgagacgaagaccagacgtgtagtagagataagcgaacgacgcataactacgcggtagtgattaagactagagcgtgaaaagtagcgacgtcaaagaaagggtggccgatatggtagctagcgaagagcggctcgtggtggaggtggaggcgactggagactgaaagca

SEQ ID NO: 9707 - DNA, 710 bp, Homo sapiens
  misc_feature (1)...(710): n = A,T,C or G
aagctttaaagacttgagttttcacatcaaaagaacttacagaatgccagaaaagattaatgacaagatacacacctaaacatactggtaaaatttctgaaatccaaagataaaaaaaattctttgtaagcttacagaaagagaccaagttcccaataaagaaaattatctggaattaaatttcccatccacaactctatacatgtgtcctttctgaagtaatttcttacacgtcattttctaccaaaagaaaattataacaggcacatcaagacaaagaatcagacaaacagaagaaacagtaacaagtcatgatcaaaggcaattttaaagatattaaatatcagaagcaaaaatgtctagtatcccaacaaaacatacanattgattntagaaaggagaggtcgggcgcagtggctcacacctataatcccagaacttttggaggccgaggtaggcagatcgcctgaggtcatgagttcgagaccagcctgactaatgtggagaaaccctgtctctactaanaataccaataataaaatatgacaaattagccgggcatggtgggatgcctggaactcccgctattggggaagctgaggcaagagaattgttggacctgggaggcgaagttgtgtgagccactttggccctgacttagcttggcacaaaacaaactttgtttaaataaaaaaagaaatagagggatc

SEQ ID NO: 9708 - DNA, 632 bp, Homo sapiens
acaagatctgcttttgttggccaggctggtcttgaactcctgggactcaagctatcctccaccttggccttccaaagtgctggaattacaggcatgagccatggcgcccagcccacagaagaaattttattggcttcatttcctctccaaatactaatatcattcaagatattttaagaagtcatttgccatgactccattctgtctactctgtttaaacacatcaacatgaaaatggaaaccatgaaaagtgaaaaggactacagtagtgcctgaaaccttttcaaacttgctgcaagacacaagcagatgaatccaataagctgagtgaacctcaagagatatccatgccatgtcatgaaataactgtgaaaattatagataaagaaataacttgaaacatccagaaaagggaacattggctataaaaaatccattttgatgactatacttgctcatctgaaccatagaggcagaagaagtttacacatgtttaagtgtgaaagactggactgaatttggactggatgacagcctcaagatgaaagaaattaacttttggaccagatttaaaaatttgtagcgaacaataaacatttgacaaaaaataaaaaaccgatgcgcgtccttat

SEQ ID NO: 9709 - DNA, 1160 bp, Homo sapiens
  misc_feature (1)...(1160): n = A,T,C or G
gcttgatcgcctgttgtgaggttcgctgtacgcggtgggcggtgcgcgtatagtgtggngagggcgcgtgctggggtggcggtgcgtggtcggtcgtcgttgcgtggcgggnngggtgcgctgtgggcgggtttggcgttggtgtgtggtggtgcgctgtgtgtgtgtcttgtgcgtgctctantcgctgtggtgttgctggtgcgctactatggcggcttgcacatgtcccggctnangctctcggtcaaaacactccaaccatctctcctcgtcttcactctctgttcccctctcgggnactttgcggtccttctgtcttgttatggtaagcatctctacactcgcgtgttctgactaggtcgtgattgtgttactggtgcgctggcgccgtggagaggctcttgtcgctctcatgcactccgctcctttgtgctctggccttcgcaccgctctcgttngcgctccttctttcgtgctcctggcctggggtcctctggtttggcgtgcgtggggttggtcggtggtggcgtgaggttggtcatgtgtcgtcggtttgtgggttagacgtgngcctttcttgtgctctcgtgacgaggcgttgccgtggtgtcgtctcttgcgtcctttacccgctatgaggggtgggccgtggtcgggccgcggcgtctgctgtgcgtgcgtagtgtgnngcgctttgtgccctgtagtgacgcgtgcgcgggtcgtcgggcgtccgtgggtgtgatggtggctgttgggtgcgcttgctgtatgcggccgaggcgaccgcgggtggagtgtggctcgttggtggccgaggtcttgtgcacgacagctgcgttgcngccgcctattggcgcgctgtgcgggtcgtcggaccgctttcatttgggactccgggctcttcgggcttgataggagtctctggtgtgtgatcggtgtcgttgggatgtagtgtgcctcctgttgtgacccttctcgtggcctggtcgccgtgnccctggccgtggncgggtgcactcctgtgccgtgttaggcgctctactctttcgtggtgtcttngngcttgggcgggggtttgttctctctgaacctggtttgttgctgtttctccttgcacngtgtttttgttggttgtgtgtctttcgtcttggtgg

SEQ ID NO: 9710 - DNA, 837 bp, Homo sapiens
tttgcttcagcttgttatacacgaagactctaaaaatcaaaaaagggtcctagagctgttaagagcactacccttctgcctctggtgatgatatctgtctgatctcacaggagctctgtaccagagtgaaggatacaccaaaacatctatttctatcacaggtgagaccactgaccacatgacttactcatgctctttggtacgctgggggaacatgggttatagacgatctatatgatggagcccattgaacagtactgtgatcgaccactgaaggaattagaggggaacactctaggatcaagacaccaatgaacgtctgtaacttgcagactgtgaagatgagaatctgaagaccgaagatcaagatctctgcttgggatccttttgtgattcatgagggacatatgggagagaaaagatgttagagtggaagagtcaaaacaagtggtgacatccacatacctgctggactcaagtacacacagctgtgcactgaacatggatagaatgatcagacctcaaatcctaccagaatctgatcgtgggctccttggctttctcaaaacgctggacatacacctgaccatccctctttgtgaccttacggtgcacgccaggctcaaaggacgacaggatccaggtgaaccgctgctcttgtttaaaaactggcccctggttgtggatgagactggaaacccccgcccagctgctgatttaaagacaagacttggggggaatgactacatacctctgtggaaaaccggaactgaagaagaccccccctccaggaatgcaccactccatgaaaccactggctccgtgcgtgggttcttg

SEQ ID NO: 9711 - DNA, 1007 bp, Homo sapiens
  misc_feature (1)...(1007): n = A,T,C or G
gagggaaggagagagnnnnaagaaaaaagaaaaaaagggaaggaaagangaaggaganagnntaaggggagtagagagttagaagaaagaaannaaaaggaagaaagttgagagnaggaggggaaagagaagagagggagggagaaggaagagagagggagaacaaggtttttggnacggaagagagaaagagnnaaaagaaagagangagcaaagcacaaccagaagacgtacgccagaacacgaagaagacagaaggcaaaaagagaacccggcgggcgggagcggcgcatagcgggaaccgagcagggagcgagggacgagggggggggcagaggagaaggaaaaacggaaagacaaaacgagaccaggaagcccgagaccggggaccacaagaagagcagcgagacgaggaggcccacaaccacccagggagaaagcgaacgggagaagacggcggggacgcacaccgccgccggcggcgaacacccgccggagcggccagccgagccccccgcctcgccggccgccgccacgagcacgccgccagaccgccccccgggcgcccccaggggcngacaggggactcgcgcagagcagccgagccccatccgaatacaaaacacataagcacacagaccgagagagggaatggcccccgagggcgggnggaggaagaaggacagcagagagggacggaccgcgacgcagaaggcgcgggacggggcggaggacggagggcccggccgccgcaccccgccgaggccgccgagtgaacaaagcacgagcgcggggcgcacgcaagggagacgcagccgggagagcgccaacggaaggcccgcagaacgagcacgcagcgacgacccgacgagcgggcaagcgcgcgaggcgagccgacccgcgacaaccctgaccgccgacacgagcacacggacggggtccccgcaacagcacgcaacggcgccgcgccgacccggagcagagccgcaagatgcgggtgcggggtc

SEQ ID NO: 9712 - DNA, 804 bp, Homo sapiens
  misc_feature (1)...(804): n = A,T,C or G
ccacagtttctaccattacatggtgagagggacttnctaagagggggggggtgaattatnataacncaacaaacaccttgnaagctgtttacaggatggatcctttttctgacacacacagtaagacttttacaccagaacaactccatcttgaaaaggagctgggtgaaatgaggctgaaacctactgtgctggggggggggacngatcaccaagggttcaaaccaataccaatgatgcaataaagacatcatttttcctccaggaaaaaaagagaaatatggggtttagtcacccaaggaagaagggggtaaatagctttgaacactcacatttacactctaatatatctgtggtaaggatattaaggatataaataatttaaaaaattggggggggaagtacggatctctaatattggataaaaagagaataaaatgaccccaaccaaatacctttgttgactttctattaacacactggaaagatgtgcctcaaatggttttaactataggggttgagatgaggtaaaaacaaaccttttaacgtttaagagaggggtttgcgcaattgggaaatgccngaaggaaatgaaaatccttaactgggtggcataaaacaaagagcacaaaaaaacgttaggaagggaaatgtggggacaagaccttacctggggggaattgggacaaccgggagtttttctaatgcgcctatacccatactggggccttccttgggaactggantccccttaacttttgggtgatgggaacctttcttcccctggtaagaagggtggtgtgt

SEQ ID NO: 9713 - DNA, 1311 bp, Homo sapiens
  misc_feature (1)...(1311): n = A,T,C or G
aggagggaagaagggggggaagagggaggggagggcagtgggagaggggaaatgaagaggggaagggaggagagggggatttagaanaaaagaaaaaggagagaagagagagttggnaggggaaggaacaaggagaaaaagaaaagcaagaaaaagaaagaaaaaagaatttagagacgggaggagagaaaaacgaaaagagagaggggaggcgccccgtagacgcgccgctgtattagcgcgcaaacacacaaagacagaaaatcaagcaacggctacgcgcnacggcataacgacgtatcgcgacctgagtccgaggcaaccgcagcgacagcaaggcggacgcgtgcgagaggagcgccggtcgcgcgtagagcagagtgggggggctagaggagggaaagcggcggggagcggggaggcgagtggagagatgggcnnagcaaagatactgacgcgacgggacggcgcgcggcgcgaggacggaggagaccagagctaggatcgcagaaggacagcgagcacgcaacaggagcgacactagaagccnaccacagggnacataggaaggataggactggacgctacagtactgtgacgcccgcgcggacctcacgcctgcctcgcccgggtgctgctctccgcacacgccagcgccgacataggccttgtcagtgcctcacccaccgcagccgcggccgacgctcgtggcagtcgcctgcgcgcgtcgagacgcaggcgcatcacagactaactctagcacagatgcacaggggttctacgaagcgcggcggagacgagacacgtagcaagcgatgacatcagcgtagagcagcgatagacgagacagagcacgcagcggtcggcggaacgcacggcagagaccatgaagtccgccgggatagcagcgaccacgcggacgggagtggacataccgacacgtagctagcgcccgcagcctagcggcaccgctgagacgancacgcccgccgccgccgccgcctaggcgagagagtgtgagagagacagactagcgtcccagctctactgctgtccatagtgtgagaaaagagcacgtcgatgccgaatagtagtcctggctgacacctctacgacggcctaggcgaagacacaggtcgtgcagagataagcgatgantgcggngcgagcaacacgacggccgcagcgaagcccaggggagacacaggcgatagagcgtgcgcacgtgctgcgaagcagagaaggagtcactaaggcgccgacagacacgatacaatgaggagaatgactgatccacacgccgagctccct

SEQ ID NO: 9714 - DNA, 1138 bp, Homo sapiens
  misc_feature (1)...(1138): n = A,T,C or G
ctctgctcggccggacggccggtcctcgacccgctcctctcgcacacatcgcgtctccgcgcgtcgccgtgtgtggacgtgtctcgcgacacgatgcctcatcatgcttcggacgtcgtccgttgtcgcggtcntgtgccgctctcgccctgccacgctgccgcgcaccacccactcgccgaccgccgccgcgcctcgatccccgcgcggcgaccgcggctcgcgcggacggagcgtgtgtctgtctgacgtcgtgacgcgccggtgcgcgggcccgcccgcgccgcgcggcgccgtctntgccggttgcgcggcggccggtgcgtctccgctcggcgggcgcgggtcgtgggctaccgccggtgctcggggcggggtcgccgcgggggtagcgagcgatcctcggcgctccgcggcggcggcggtgatgcccgagcgcgggctgccgtgcctgctgtcgccgcccgtgccggcccggcgtcgcacgcttcagcgcggcgtgcattggatgccgcgtcgagcgggcggcatgctcgcgcggccgcgcgcgcgccggcgccatggtagggagcgacgaccgtcgcagggttaccgcgtgtggttcgtgtgttgtggcgtcgagcggttcaggcttggatgcgggccgcgctctggccgcgtggcgtcgtggcgtcgccgcgagccgcgcgcgggtggcccggctaccgctcgcgcgcccgcgccgccctccccccctctcgtccgccagcgggtcaccgacttcttgctcctaatttttagttgtccctcctcctccctcccctctctgcctcccccgatccttacatatcctgccgcgccctcacacgcgggcctgtccgtcttctcttntaggttatctcccgccccctgcacgctcctgcctgtagacccgttgtcacgctggaagttgcggccccggcgctctggcgcgaccccgggtttatannaccccgcgcgtncaggcgacgctntnggggcnccgcggtcgcgggcacccaccccccccggcggcaggaatagcccgcgcgcggagcgggananannnnaaaccnnaccgcagaanacacgacccccccccacnaaaacccgcccgccnnacaaaaataaaanaaaaaaa

SEQ ID NO: 9715 - DNA, 547 bp, Homo sapiens
aagcttgcccttgacatcagtaggaaaagcatctcctgaacattgtcagagtcattggtgactctgagtttgatgctgacttggacaactaggttcttgtctgcagtgctccagggagtgggaccacaaggaataaagagcttcaacacagagagatggatttccagcctcaaaagctggaaagatggcagtgtttctgagattaaatggctcctggaaagtaaacctcactggggacaggagcagaatgtggaggctgcccacccgcctgtcatctgatccagtggcagctcagagggaataaaaccatcaggtctcctaaagacacttaggaggataggaggcccttgaataactccacccatccatccactgggactgcagaaaaggcaattaactctcatacacacctgggaagccaggcattttcccccacttaaaatgagtaagggactttctccagggcactcagtcaggttaagtcaattctggaaatagatctgaggcagaccatacacataacccaaccccaacctctggtccaacc

SEQ ID NO: 9716 - DNA, 2023 bp, Homo sapiens
  misc_feature (1)...(2023): n = A,T,C or G
atacgtgctgagtatgagacacgtttcnatacttcgtagcatcgagacacgtgggtgcgatagcatagcatagatatgagttctcgtcgattagagagtggatatcgtanatatgataggcagcgtactagtgagattacactgttattngttcgctgtcgcgtgngacgtgcggtatagcncacggaaggtgtcancnatgntgctntcacagcaccaggtcgacgagacgcatccgcgcagcgcgagacgacangacganggtgngcactgactngcgtggatacntatgtcgntgcgtaccagtgatgttgtcgcatattcagagtcgtacagatcatntgcgatacatngtatancatatagantgagtcgatnaatcggantacctnganagacgactaacacgcgctctaacgctgacgtgagcacgcncgatcgagtatattgtagtatcatctgcgctacgtnagngtcgtcgcgcgtgcgtggctgctgcgactgagacngngangntacgtctcgatgtgtagctattgtcgagngangatatcattactgtcgctaacgatgncgagaggangngtgcgnggcagcgtgtagatctagnccgtcgatagcgacgcgtacgcagtcatangtatatacgangantgntgacagcacgtatcgtcgtgtgcagctcgcgcgtagncgantntactactatatntcgtaggcatgntgntatanaagcgtgatacgacaggncggnacgcgagggagcagtgacgacacacgactangaatnancgngactgcacacgagcncagctatagatagctgtngtgtngagtattgtgntgnctattaactagaatcgtagcatgctgatatacnagtgagctcgcgtatgtgnntatcgtagagaatagagcatgtctcggacacgtacngtnantacgctngatatgtantatgagtnatntgatgangctgtangtcgtggtttcnagnatcgagcagtgctagttgtcacactgtgntcggtcggtagtncgtgntntactgcagatgaggctngccgagatactnggagagnactgatgtantagtcaacgtgtatcatgatcttgtnaacacnttctgctnctgcttgtctagagtagcatacgtagtagatcactagtgtcantgatgacagtagtcaacanaattcgctgcngtagcgtcgntattactcacctagtgttgtatatgttctgtcatatatatactnttangagtaatgtnattatatacgatcatgcanactacntcntctactantnacnactacnacntatctcacatattctcacatcatcntattgtctnggatctcactctntnatctacatctgaatnttatgctgtatntcattctngctnntatgangtactatatntactcngtgctatgtcgtcttagtactgcncttgatctngtcacagtgtanatctcgtctgcgatctcgctcattatnctatacantnatcggtactatcagcaaaccatctgctagagctgatcgtgncatactacgcgtggtgtnagatggagangtgatgtagnatcgtcgcttctctagcgcgatcctgtngtgangnggnagatctgcgtgatgatttnatatnntgtgngtgntcgtactcgtctgcgcgggagcgttttnnntgccctgcctcgngcgntctctcngggctctngtgtgcngtgnngantnnnntgantannntgnanncncgctggnntnnncnacnangtnnnnanngnnnnacccgtcgctcgcgcaggcgcgacgggnaacnaanacncnnnncntannnnnanacanttnnnnacaaacncaaccacaaaacccccnnncncnacnnncnnnncnccccacangcnntccgcngacngcgcnnntnnnnananngcnagtgnnnaaatggtanntannnnnntnnnantnnntngaaaagatntanntaannttagnaatanatattaagata

SEQ ID NO: 9717 - DNA, 740 bp, Homo sapiens
caatgaactctctatctgcttgaagaggatgaagggcaaagaagtacaggacagaaaaaccttcatacttcaaaatgttatcttacttaaaatggatatgaatcatttcacatactctaaaaccaaaaatcaaagaagaaaagatgtaagactgaaaaatccagatgtcataacagataggttttggattgtttttgtcatgaagaagtgactaacattgtcaaaagctttttgtgaatctactgagataatcacgtgaattttgccctttattccattgaaggtattacattcaatctgatatgctttggctgtgtccccacccaaatctcatcttgaattcccatgtattgtgggagggacctggtaagaggtcattgaatcataggggcagttctttcttgtgctgttcttgtaatagtgaataagtctcatgagaactgatggttttaaaaagggaagtttccccacacaagctctctctttgcctgctggcatccatgtaggacgtgactttgtcctccttgccttccaccacgactgtgaggcctcccctagccaacttggactggaagtccattaaaccttctttcttttgggcaaaacaaaataaatacaaacggcgtaaagatagataaaaggagatgttagtacggagcgaaagacaccccattgtgtaagctgtgggccgcgacccctccaggggggttactatttaatcctcgtacctgattttgtgt

SEQ ID NO: 9718 - DNA, 878 bp, Homo sapiens
  misc_feature (1)...(878): n = A,T,C or G
gttatgcggactgactctctaattaaccccgctacgggtggacacgaaaatgactggccatttgccactatgacattagccttggtgaagtagcatgaagtgatccatacagcacagaaaaaggtatccttctgtagctagagctactcctggtgagctcatcttgtcaactttggacacagtgacacgaactagatccccacaggctcattatggagagtagggttttttttttctagagcggtttgtgcaggacatacgcccacaaccaatgagcaactgcccaccagcaccaacgctagtaccacagtttaccacaggctaagccagcggatgaaacatatgcatctcgcacagatacccatacgaggatatgacggaacgcgctcaaacatggtgccaattaggatgaacaactggccgttgtatagtgagccagacactcatatatgctccatcgagtggtcgctcggtgttccggcgctactgtccgtctaaacgcactgggcccacctctcaagctgcataaatagagcgatacactgccgaacantctaaaatgagactgcgataggaccttcagtacctccccctacagagacacacgaccatcgggtagtcggaaggacttcgaggtgagacgaatcatccggactccttctaccaagcgaagggattccgtccacgagatagctctcggtagacataatgtgcgtcgcgaattagcgtcgctaacaaagaactatcaacaaatgcgagagaccctaacgcgacccgcccgcaagctaacccacgcgctagtgatacattcaacaaccactcaatgcaacaccaatgcattactccgccttataacaccccccaccttaatgtatcct

SEQ ID NO: 9719 - DNA, 1691 bp, Homo sapiens
  misc_feature (1)...(1691): n = A,T,C or G
aggagggaagagaggaaaaagaaggaagnngaaagaggnnaaaaagaanaggaaaaggagaaagaggaagtagggagaaggaggagagaaaaaaagttaagnagagagggaggaataaaggggagaggggaggggggagaggagagggaggaagtggagagaggagagttcatgaaagaaggaagggaggagggaggaggaggaaaggaangnannnnaaanagaagaaagaaagaggacgagaggaggagaggcgaggaagaaaagacnagcaaataacaaacaagaggagtagcaacgcaaagcacaaagagcaggaggaaataaagcaagagagagacaaagaagaagacaaagagagacaaaacgtgagagaaggcgagagtanacaacaaaggagataagaggagagancgagagggaagaagngaagnaanagaggacagaggaggtngaangagaagagtaagananaaaatagagaacaaaccagatcactggncacagaaacacgcgcacagcgcgcacagagagcaggagagacgggagcaaacgaacaggcagaacaggagacgaacaggagaaggaggagcggagggagcaggggagacaaacggagagaccacacctacaacgccgcgagcgaacgacgcggaacacgacggcggcgcgagcgngagcgcagacgagagagagagagcgccagnccanacagcgcaagcacgnacaccccaccgcgccgcaggcgaaccacgacagcgcgaacgatcacggcaggngcgcgacgcggaggcggcaagagacgcagcggagagacgagaggggagaggacgaaaggcgaggagaagagaggtggagcggaggatgaggacgacggagagaggtgaggaggatgaggagcgagagagagggagagacgatgcgaagagcgggatggtagngntagtacncggagagcgatgtatgcaagagacanacagacagagatgagagaganagcggagnacgngagaagtgaagcgagggacgacgagaagagacaagtacgatgacagcgatacgtagcgagtggacggnagnacgagacagacagcgagntgggcaagagaggagncagctaggacacangagtcggagagataggacgcacagcgcagcggacacgcgcccaanacgcaacgaacgcananacgacganaccaccgctctaancgcacaccgacacnncagcgnacacagagaccaaccgagcgcagagcacagngaacgctgnagcacgacgcgaggcacgcnccacgactcgcacgacacacagcnacgcgctgaacagacaancagacgcgacacgcacggcagagcagcacacgcagacgcgngagacagcagcgtangagactgcgcacacncagacagagncgagacacntgngaggacgacgcatnacgcgagagancacncgcaaagacgacacagcgacgcgngcngctagacagcacgcgcatcgagcngtacgcagcgtgggcnggatgagacgcgacgagcgcgacgacntagcggcagaaaacncacctgccgaatncgtagcagcgagagctgcangaccacatcaanaggccgcncacgcgtagaagacagcacancggangcgcggcacgtacagcgaatacnacagagagcacgcatgcgcngcg

SEQ ID NO: 9720 - DNA, 1466 bp, Homo sapiens
  misc_feature (1)...(1466): n = A,T,C or G
aggaaaggggtnagggaatgaggagggaaagagaaanaganananaangganannnaagnagggagaaggagagaganaagaattatggnaagannataggnnnnnagaggnngngagaagttggnnnngaggaggganaacaagagnnagaaagaangngagaaggggnnnnnagatgagngaagtaagnnnaaaagagaatagaagtgggnnnaagatgtaagtagtaaacaagaaaaaatnnaaatnatatatgtgtaagtaagaagatatgtatgaagacatgttaacatgtacccgcgncncactagattgagtacttagaatatcatatatataantnnaattaatatatttatgttatattaacatttaacttgttncacacacagactgaatcaaggcgnncnggcagcagaagcagtatacatccacatccacataatntactcatctaatacacatcantactctcactcaatacacantagtatatnctctaacgncagagtaacagaangactgcgcagagaganaaagatatatgtatntntnnnatactatttatactatgtantctatattgttaatattatagttcacgtnntntagcataatgntnnaataggaagagtactgaagacacgncagagacagagatcagcactacaaatagnnnaatgattatataagaagcagatgannnnagagagaggacataggnnccactacgaagtatctcgcacattcnctctcccaccacccacagacgttatactagtcctctcactcaatagtgtcgtnaagtgagtnncnttagtgaagacncnccagcaagtgcggccaagagatcncgaattgcccagatgcctacttactcacatnnncaaatcagacctcatcaagctatgctccactaaactctaccggcaaactgggttnctatagagggaatgtgatgtgaggtatggggtagaaccgacgtgcagcagctcatagtgcccccaagtcgcgacgaggcacgcgcaagtcnntaaggcgcaaaacgagacgatctcaatacaagcatccagaatgcncccgaggaggacgccncgccagtaaacgagtgctgagtagctgaatgtaataagaggttagtctagaattgtgctcatattccgatcatatgatgcataaaagtaatagaacccatactcctcatcagattacttcctacatggaggtctcctagcaaaaaagttcataacgagatnnccaactaataaggtntctnttaattcattatatgttggaagatggtncacataaatggcacgtggcacagattcgtatagatgctcgagagccnctatataagtagtgaccactaaagagaggnnaagaggttctgaagcgaagatgatcgcagggcnacgagaaaggnacaggagagagtagaccacgaggaggntcacnaagagat

SEQ ID NO: 9721 - DNA, 1163 bp, Homo sapiens
  misc_feature (1)...(1163): n = A,T,C or G
gcagcgcagaacgcccactcatcgatcagagagaagaaaaaagaaaaaaaggagagcttcctatgtatgacnaaccacaccngagaggcctttggggcgggacaaaaccaaagcgccacacgatgcggccaaggaagcgccaatccagagggtataaactgcaaccggaagccccgccgcttctcgcgaacataagagcccccgtgtaacatagggctacgaaccgtgacctcctcattcagataacacgtacccgtctacggcagatgctcctcgcagcgcgtacatacacacgaacgcgtataggatcgcgcggctcacatcactacacgataaacaaccacgcagagacaccagaggcacggctttttctaaagcgacatccgctaacaacacgcgaccccctccccatagaacgggaccaacgtaccgcgtatgctcaggtcgcacgtacgagcaccgcaccaggtgaaacatacaatagtagtactcctgccacacgatggcctagaaaattgccagacggcgctcccgcctcgcattgcagaataagaccttctgaagtatcgtatatttccgcgccatacggctagcaacaaccctacgcgcacaacctacgatcgcactcncccctacgccgtccaactgcatcactagtgaactagcgcggcaccggcacaaccacggcgtgcacgctaccacgtaaccctcaacgacagcgctaaactcactccgacccaacgctccaggcaccggccaaccacgctcgcacgtcgcgcgcacactccgccctagcgcgccgtgcctcgtcagcgaaaaagtatataacagcataaaatatcaaatactccagcagggcggtgtctgcgataagtactgcagtaacgttctactccgttagatattcgtggcctagattgtgtcgagcagtcgaccgcgcacctcacgcgcggagaccatcagacaccacaccgcccgctacctatcacccagagtccgcggcaagccccagcacgcaccatcagatcacaccatcagcacaccgttgctgccctactcaagccaccatgagacaacgcaggcgcacgccgctcacacgatgttactaacgcaccgttccactgaaatagagcaactcaaccgacacgcacataaccactaat

SEQ ID NO: 9722 - DNA, 529 bp, Homo sapiens
  misc_feature (1)...(529): n = A,T,C or G
gcagatgctcctggctgtactctaggaaaacctggaacttggctggaaatggagaacacaagcaattggaaaccagttcagtttcacccagtttaaatttccctgcagtgagtagggcaccagctctcccctcggaagccaaacgtgaaaacttactattttcatggcaatatccagcctcggtcttcctttaataggctggcctctcatccttgagnnccntganncctntntngntccctgggggattantcatggcgatagattgtgatcaacacaaaaaaatattttgggggcgggggggggggnnnnngnnnncggggcnggngccgtcccngcccttgccagaattggcctcccccctgagtctcctacaatttcctaccttgttctgtgggttgattacctcagaaccccatccacagttttttcttgcctgccaagcaatataaataatggtatttgggtcatgtttgtacaggaggagaatttaacggtgccgtcaggcgcaggcctctggagtaattga

SEQ ID NO: 9723 - DNA, 709 bp, Homo sapiens
  misc_feature (1)...(709): n = A,T,C or G
cggccaagaaaaaacgcagccagccaccancagaggaccaaggaggcggccaaaggggcaggcnccaaagaaagccacaccggcagccacgggccaccgcggaggacgggggaccacagcgttttttttccgacaccagaccagaaagcacaccgccaagacaccaacagcggacccccanggctgccaggccgaccgccccactgaagccaacagaggatggaaagccccacgacccgggccagaaacaccccagggcacagagggacgccgacaacccgcgagcggcgccaagcaacaagagaacaagaggcgggacaacgaagggcaccccaggggaccggaacccaaaaggacgggaggagggcaccgagccgacagcaaagggaagaaagaacacgggacaggaggggaagagagcggccaaacaacacgcagcgccccgcacagcggagcagagagagacagacaaccaacgcccacaagganggccagaacggaggaagcaaagagaaggaagacggcacccgccaagggggcgggcggacaaaggaaggaacaggaaagaccagaagggaccaccgggcgcgataacccaggcgggaaggacccgggagaggagaaacgcaacgcagacctacggaccagcggacgcggcacgcgggcggcggaggtcgccattgtgagcgcgcggccgtttatcgttact

SEQ ID NO: 9724 - DNA, 813 bp, Homo sapiens
  misc_feature (1)...(813): n = A,T,C or G
gcttagctgcaatgactctcttactaaccacgcgctacggcaccctcttacgcacagtcggatggtctatggagactcacaatcatgtgcaatctggaagcaaagaatgagtggggagatctgagaatcgatactgaacagcttcagtactacgatgtcataatggggctgtgagctcagccgaaagccccccgcccagttttttttggaagtggtcatagaatctcnctctgagaaacaacatggaaatggagaccaaaagagggaaggagggatgccaccagatgacactgggatcccggaagacggaacactgtgtgcaacgggcaaagaacttttcaaaagggatttcaacctctgaccacctggagacaggcgactggcgctcattgtaaatgcaccgacatgacagggaacagctgctggggaggtggagacgggtgccgggagagacaggaaaccccagaggcttggaaatccaggagccacaggaagcagtgcgctttctgcggagccggatccggtggagccaattcaccagcaggtcccggcagcaactcttctacaacagattcctgcccgtccctgtgccccatccgccccctgccgtcaatctccacctcaagggagccagaccaagcctttctgtgtgtagcgcacatctctcctgcgtagagctcacctagtggcttccatagctttttttttttttttttggagacggggtcttgccctgtcacccaaggttgggggaccggaggcatgacatggttaactgcagttccctcctgggctcaggggaccctctcgcct

SEQ ID NO: 9725 - DNA, 772 bp, Homo sapiens
aaagaaagccataaatggattcaggaaatctgtttgtcgcatgtcgtgggaagaatggtgaagtaaaggcagtccactaagagtttcagctttcccctttaacattgtaggaaggatcatctatgcagcttgaaaattgttttgtcgaggggtatgacattttcatctcccatcatgtgaaatcgcctgcttctgcttggcggtttgccatgattgtaagttccctgattcctccccagaagctgatactgctatgcctcttggacggcctgtggaaccatgagccaattaagcatcttttccttaaaaattaaaacaccaaaagattacataagagacgagctccgccgaatgacagcggtgtgagtggcagtgttccattgttgcggcgcgtaagaccgctcgcggtttgaatgttttcctagtgttttagtccagtagcgtgccccggcgcctggctggcgcgggataactagagagcggtcccggccctgcggggtagccagagggtgggacgctttgcccgcgggtttaaatcagacagtaatgagcgaaagaggggtgcgccggcggatgggcgacgcgtggccaaatcgccttccctcacaagcagggtagcggtaagatttttggccgtgtgtcgtggcggggagtgatttgttcctaaaatgcccgcgccccctatacatgctatagggttggccgttgacatgtgtgcgacagtgacatgcctccactactactctcccgttcgaccccagcggaggagtcc

SEQ ID NO: 9726 - DNA, 799 bp, Homo sapiens
ttattcgttactgactctcttactaacagcgctacggtggagtctcgctctgtcgcccaggctggggtgcagtggcgcgatctctgctcactgcaagctctgcctcccgggttcacaccattctcctgcctcagcctccggagtagctgggactacaggcgcccgccaccacgcccggctattttgtatttttagtagagacaggggtttcaccgaggatgcccctacggtcttgggctcctgacctcgagatccgcccaactcggcctaccaaagtgctgggattacaggtgtgagccaccctgccaggcctcatgtttgcttatcttaaccaaaatgagccctcgtttcactttcctgttctaccctaaggaagataaaatagtcttccaacttggggtataggcaggtgccaatacccaagacccttggctgtgcagcaggggctactgttaacccaagaccctatacttccttcctttggcagagcccaggagcagctttgacgccctctagccccttttccgttagccttgatttcaaataaagacacatgcggcctgtttccttgaaggaaggataaatacttgattccccctcacttactcgctgctattggtcgttcatttgctggcaacgagatagtctatttcaagtgagcgaataccggatccccggatttctgtggttactcatggaagaaccttggattacataggtcggataaggggccgaaatctttaaaaggccgcgttaatcggtgtttttataaggcgcgggcccttaagagaaatataaa

SEQ ID NO: 9727 - DNA, 1025 bp, Homo sapiens
  misc_feature (1)...(1025): n = A,T,C or G
gcgattattgtaaaagcatagnnatttaatgaagagtaagtaggtagtaagaaagtttaaaaatgtattagataagaggaattgatnaaaacatgagatgggatagagatatattcgcttcgctctcttgatttattcaacattctgggccactccaggagatgagagagtaccgaggaagcgagggatagcaagagaaacaagagagaaagatttggtttacacatcaatgaagataggatagtgaaaagacagncaggattaggagatagctaatcaaganaatcaaccatcccagaaggacaactgaatatacatattagtaacgaaagagcaggtcaagtagcagacggccgaagcagtagatcactccacgaggttctccctatcggggcctcgcgctctcgctttacattcactccccaccaagctactttcaccagcatctcttccataccttatctctcacaccctttccctttcctaatatcgcacgcgtcgacgtcgacacgtcctgtgggggcacagggcgcgtttgggcggccgcgctgcggcgtagcagagggatggtcgcatgagctgaaccatatacagtcactaatgcatggtgcagtgagtctaagatgnacgtaggtatgtaggcgcggggtgacgattgagcatacgtgacgtattctcacgtcgtcatagatacgatgcgtgtgaaacccgcaccncgcgtatccgagtccgaggcacgtcctgctacagcgaccagtagcggtgtatagccgcagtctgtgacgtccggtcgacttcttctatacagtatcgatcacacgcattctggtgcgcgagtctntggtcatcncnacgtctctattcgtcgctcntctcgctacgatccgcatcgctcgatgccgagagtcatagggcgcagncgaagcacgtgcgggatgtgaatccggctttacaatatcagatcaggcggccgctacgatgtagtggctgtggacgatntgcgtggtcccttactgcattactct

SEQ ID NO: 9728 - DNA, 1161 bp, Homo sapiens
  misc_feature (1)...(1161): n = A,T,C or G
ataacgaagttgagacgacgaatgcgtctggaccgccgactatagaacatccaccgcgacgaggaggcacgagtagtgaggagaatgagatgacataaatattgctataattagtatcattatatatgtatcgtccgcagtatagagtctattgagaggcaccgtctcactgagatgagtcgcacagtaactaggtacgatgctgcaaggtgtagagcacacgacgnacgtaggtgctatgcgcgagagagngggaagatgggtgcgtgaagaaaggagaagtgaacgggtaggaagccactaatagaggagatgagcgangtagcgggagaagtgggaagcgcgggggtgcagatagaactgagatatagggactatgagagtcggtaagaangacatatactgcagaacggcgcgtcggtgggctcatacgcgaacagaaacatgaagtctcacacgttgcgccgcatatactgcgatgtaatgagtcgctattancggnaggtgtagacgagaagtcacagatacagtggaaacaagaaagagagacgccgcggnaccaatacgatcgtaagggcgcctcacaacaccaaacgtgtaaccaaaggcgtcttcatcgagtgaatgataaaaaaaaaaaagagaagaataaaagaagaaaaaacaaaaagcgtggagcgaagaagtaaatatgtggtnatagtggacacatttcagagaataatcattgagcatatttggtaagatatacgaccggaagagggtagagacaacaaataaaagtaataactaaaacatcaattcatacaacctaactcactctccctctccacaaacacttcctcgtcattattttgattattaatgtgtctggtgtcctaatgtatttgtattacaattaataacaaccacatactaatncaattagtgccatatgaataagtaccggaagactgtcggctgcgtgggttgtaggttctcctgttctctttatcccccctgccccggcgnngctggccttcccnncttttntntccctggcccgctcctnntcnccgcggggggggatccttctannnnngnnnnnccctcacccctnncntnnnctcggnngntntccccctctcccccccttccnnnnnnnnnttnntttnntaattt

SEQ ID NO: 9729 - DNA, 245 bp, Homo sapiens
cattcagcaactagttcctgaatataaggaaaaacagacacctgaaagtcttcctcaaaataacaatccagaatacagacatttaaaaatactgttggggccagcacagtggtgtatgcctgtaatctcaccactttgggaggctgagatgggaggatcacttgagcccagaagttcgagaccagccttttttacatgacaggacctcatctctactaaattttttaaaaaacaataaaactcga

SEQ ID NO: 9730 - DNA, 772 bp, Homo sapiens
ctgagtacggataagagtactatcactaccatacccgctgggcttgccatctgaacgctttgctacaatggtacctaaagatctacgctcgactgttacagattcattagtagttacccaaacagccgaaaaggacctgcgcttaagaggggatcacactttattctgattcattcacactattcttttttgacgggaagctaaatatgaggatgtgctgtttgtaaaaggcgcagctcttgtcactgtgcttctggtattcattcgttactcgtggacatccggatctatgaattcacctgcagagtccactgcataacgcaagtgccatgattccatatgaggggcattatagcggacctttacttgatttctgatatttgtgacgctcttatcaccaactgtatgttattgctcgaggataacgcagcactgggttggactctgactatggtagcctgcgtaccatgctcttctggcactggcgaaccctgggggctgtaagtcagagagtccttttctctgcatccgggtgtctctgtcccggggaattttctggggatgaccgagcccaaaaccttaacctcctatagtcgctaaagtggaagaacggacttcttcctggatgcctgcatgaattttacctctggtaacaacaattcacttagaccccttgggggtcctatggatttacaactttttaatttgtccggaggtccttgggaaattacaaccggaacgccattgggcctaaacaggtatatccggtaca

SEQ ID NO: 9731 - DNA, 1178 bp, Homo sapiens
  misc_feature (1)...(1178): n = A,T,C or G
ggaggggggggaaantnaaaaaaaaaaagaataggagggactgggacaaagaagtaaagggaggaagaggaagtagggggggggaaaaagaaagaaagctaggcggagaaaaccacgcacagaaggcaggaaagaacaaaaaaagttgggggggggggggcggaacccggggcacnaaccccccccccccgccccccccnagacgcccccccncgcgagccccgcgcgccccacccaccccacaacgccccacacccccccacccaccgcaggccgacgcaccgaggcggggacccacgagagaccaacacgccaggggcaccgcagccacggaagacgagcaccaaccgaagnacacccgagggcgcggcccgccgcgggggcgcgcagcgcggcgcccgcggccgggccgcgccgcgacgcccaaggcgaacacacccgcgccgcccgcgcaccacaccccacccacgcgcccccagcgccgccccgcgccgcggcgcgcggcggaccacacggccaacgaaaacacgcacgcgcagaagagcagcgcccccgacggcgcggcccgccgcccgccgccgcccgcccccgacccacgcgccgcccgcgccggccgccgcgcacccgccccgacccgcacgccacagcgcccgagaccgacgccacgcggcgcccgcggcacaggagaccccccgcgacncgcgcaccacgccccacgcagcggcgcgcagggccgcgccacgaccgaagcgcacccnacacccgagcgccgcgccgcaccgcgcccgccgccccgaccggccagcccggcggcacaggcactcgtctaccccgagacgaagaccgcacgccgcgggcgccaccgacaccgacgccgacccggaacacgccaccgccgcacgcaccaacgcaccgcgcgcagcggacgcgccgcgccccgccccgccgcaccgcgcccacgcacccaccacgccggcggcacagagccacgcacgcgccgcagcagcgaacgcgacgcgacagcagcccaagacgagcagccccgagcgggcggcgccgagaggacgccgcgatggccgcgaggcgcncagagaccgcagactcgagacgagagcgccccggcaccacacccgacgggaccgcgcggaccccgcacgacgccgcacgaccaagcgccg

SEQ ID NO: 9732 - DNA, 898 bp, Homo sapiens
  misc_feature (1)...(898): n = A,T,C or G
tcgtatcggaatggactctctncttaaccgccgtactacatcaactagcttgataataactcttccagttaaacatcagctgcatgacagcactagtcttctctgccttattccctactgtattcccagggtctagaagagttcctgccaatactaggagttcattttatacatgttaaataaataaataaataaatggatgagtgaatttcgcaagcatcccgtccagatagggatatagaccgaggactccgcagtaaagagaagcatggcaccattcggacagcactaactccacccctattcaggagtaaacacagatcacagtgcattgcacacttgccacaggtcagatcatgcaggaacaaggcccatacaggcgcacctagagccactgcccttgcctcccccattcgaccccacggccacccaccgccctcccctccagcatctgcacacctcgcccacccccaccacgctgaccacaacccccccccccgctacccccacaacgcccactggctttatgtcacccttactcgccgatccaccaaaccgccaagccgacagcccacccccgcgatggacctaccgatatcatcttcgccccccatcctgtgaccaccgaccagcggacccaaaccaccgcctccgcccctcaccaccccgctctgccacccccccacccgctccgcaccacacccgcgacccgtcgcacccacgcaccccactcgatccacctcgctacatcctctctgtatgccagcctagctctcctgcagccgcacgctctcaccncgcgatccccgcgctcacccgacctgctccccactccctcgacatggaccccangcacccgttcctcctcacccatataatgtaccaccaaccgccccag

SEQ ID NO: 9733 - DNA, 611 bp, Homo sapiens
ccagagcgccggcaaccagcacactttgtgtaaacggggggcgacaccaagcagacgaccacgcaaaagaaaacccaaccgcagcgggcgggcgaccggcacccggagaaaaaccacgcaaacaggagagggaaacaccaagggagggggaccaaggaacaaggccacgcaaccagaaaccccacccacaacgacacccagggcacgcccgacaaccaaaacaccgcagcacacagaacgaagagaaaaaagacaacgaaaagagaggaaaacccgacaccaaacacaaaagacaaggaaaaggaaagacagcaaccagaaacagaacaaacgaccccccaccaaaaaaccacacaccaccaaagaccaaaacccggacaaagaccagaccgccacgaacggcgcaacaaacccaaacacccccgcacgcggcaagacgagaagacccgcgagaaagcagaagaggggcagcacacaaacagggagagaagaaccccaaacgacgacacgaaacgagcacacaccaaaaaagaacacacacccgcaacccgacaaaagagaggaagagcagacgaaaacggaaaagcaggacagagacgcacaaaccacca

SEQ ID NO: 9734 - DNA, 1812 bp, Homo sapiens
  misc_feature (1)...(1812): n = A,T,C or G
aaagaagagaagaggagaagaaggagggagaggtgaagagagagaggagggagagggaagagggaggagatgagagaatgagaagagttgagggagaaaagaaggaggagagagaagaaacctgaggagagggagagngacagagagggaggcgcaagggaggagagaggagggagagagagagaagagagaaggtttaagagaagaggagagagaggaaagaagaccgaaggagggaggggcagataccaaagccgaacgcgcagcgcaaccccgcgcngaccaggacaagccacacgacagacagacacgaagtacgcgacagagagaggcagcacgcaaggacgcgcganagaagagaggacgagagagacgacacaacagcacacacaagacagagacatatgagtggccaggtntcgctgaatagaggaagaagctgagagaagaaggaagnagcgcagngggcgcgggagcagggagatgcgaggagcgaangaggacgaaggtagaaacatacgggagcgcgacgacggacacggccgccgccggagagcanagaagacgcgccgacacgaagagacaagcagcgcacgcgcagagcgagcgcacacanaacttcgcagccgaggacaagcacgcgaggcacgaacagacngacgcngnagcgacctacgcgcgcancgcancggacacacagcgccgcaccaccacgagacacgcacagccgcaacgcaccacgacgagtaccactcggaccgacccagcgcacgacaacacgcacgtcgcgaccgcgccgcgtcgacgcgacacagnacggagtagcgacgcgcgcgcacgcacgagccggacacgagaacgcgcgcacagacagcgtgagcacgcgctccaccacgacagatgncgcagacagatcacacgcacagtcaccgccgtcanagnatagcgcagcacagcacacgcatcagaagcgnagacatcacnagcgtncagcggagnacncgacccgaagacgcagcagcgcgtcaggnacagctgtagtagagaagancgacacgatagatgaagcagcatgcacgactgtcgagtgcacgactgcgcnaggataagagcacgagcagccagntagnagagangagngncgagagcacgcgacgagcagacgccctagacaggcagacatacacacgnacncagngacngatggncgtacgacaggcacgagtgacangnagcgagagcagcacgaccggcactgccgcccgagcgcgnacgagacgacagcgcgataggacancncacgcagacaagngcgtcacgctcgcncccgnagtcacacagcnacgacgcgcaacgnctatgagcgagcnnagcgagcacatagcncgagcnangcgnacgagagagtacgncacgnacgcnatangcacgaccagatacggaggacgatcgcgcantatacacagacacgactgcgagcngacngnacggccgtcagcgtacacangacgcgnacggacgagagnancanagnagncgtagctgatacnacggcngtcgacggcagagcacagctacgcgcangacacaacggacgacagctgcgcngcggccggcaganagcgcagcagcgcagacgatcgagagtgcagntcagccccngtacagaccacgcacgcnanacagagnagcaagnaccancagcagacgacncgacatactcacacanangcnagtacgancaggnacgtcgactgcganggnngaagcagcgacagcagagnganaggtacgaaagcacacnannncgag

SEQ ID NO: 9735 - DNA, 283 bp, Homo sapiens
  misc_feature (1)...(283): n = A,T,C or G
tcgttaggcatcgancntcanncttaaccgccgctatcagagctccatgntagagagcctggagatacagngattaacaagatattcaaagccacctgcctacctggagtttacagtctaattgagggacacaggaaggaagctgtactgaccatttatctttcactgctgctcttcaatttaaaaaattcctgtctgtgagactctgtctcaaaaaatgaacaaaccccgtccgaataaacagtacaacgaaaangcccagcacacaacaaacacggacgcc

SEQ ID NO: 9736 - DNA, 494 bp, Homo sapiens
actgggactcaagacagcttctatgtgtaaaagccccaagtggatacgacagcatgagctggttcatgagagatgatccgacacgctgttacaaccattcagaagagcacagctagtgtcctccatcttttcaccctatgtaactatacatgcacagggttcatgtggcacatatacagctgcttacattcaatctgaccaaccacatggaagaaaaaaagactgcatgtttaggctacaaatctctacggtatatactgtatccatcacattacttatgaaaggagtgcggcccatgatacacgctttgccatatgcggtaataaagctaatggcgaactcaacatggtgacctgggatcgcgcttaaacacaaacacacatagtgatcatgccattactagaccttagaaactgattgaccacaccgaagctatgtaaaaaaataccagcactaaggtaaacttcatccatgaatatataaataaatgcaga

SEQ ID NO: 9737 - DNA, 1253 bp, Homo sapiens
  misc_feature (1)...(1253): n = A,T,C or G
agggggaggggagggggggaanannannntgnggcgagggaagagaaaggaagaggagaagagaggggggggggggggggggaggggctgagagnaaaaacaaaaaaagagcaggaaaagaacagaaaaaaaaaagctagggggggggggggggagcggagaaaanagcagggcgccccacccaaccacgcccaaccacgcgaccgggcgacggccaacagccccgcgcgcgggaaaggacagacaacagagaaaggagagacaggagacacaggccgccgaccggaaaaaagagcagaggcaaggggcgaccgcgagcgaagagacgaggggggacgagcggcgccccaccgcgcgtcgaccggcccccgcggagggccccgggcggagccgccgggcggagcggcggcgcccgccccggcgcgagccgggcgcccgcccgcgccgcggcgccggcgcccacccacccgccacgcccgccccccgccgcccccccgcgcgcccggccccagcccccgcgcgggccggccgcgcgcccccgcgggcgcgcgcgcggccgggagggccagggagccgcgcggcgcgagcgcccgcgcgcgcgcagcggcgcgcggggccgcgctgcgcgccccggccggcacgcgcacgcacgcccccaccccacgccaagagacgcagagcagccaggactacagcggccgcgcgcaggcgcacgcgcacggcggcgcgcggcaggagccacaacgacggcacgagacaccaaaccgcgcgcgctgcagacagacagcagcgtgagaanncgacggacggaccggacgccgagcgcngcgcgcgcgctcgaagccagatagcgcggcacaggacgcacgcgaccacagcaccagccacgagcgcgaggcgcgagcgacatgcgcgacgccnagcactcaccgncnacgacgnacgccagatcgcacgacaagnccgacagccgagaacgcgtacacggcacgcgacgaccgcgacagacacanaagcgagcggcccgacgacgacaaacgacgcgagagtagcacacgcagcgccgcgcggccgacggcgcgcgcgcgcgcacggcgcgacgcgcgcacgcgtcacgcgccgcgacgcggtcgggcanncaggcgnacggtctcacgcgcacccagcagcgcgcggcgngagcgacggaccgcacacgcgacgccgcgcgccncgacgacgcagagaacggcgcgcgcngccggcaccgcgcg

SEQ ID NO: 9738 - DNA, 179 bp, Homo sapiens
ctttattgtgtgttaccggcttgtttgattccccaaggaaagacttcacgtgttagaacctgaacaggttcaaatccctataacagccgcggtatccatgcattggagccggagggcattcccagggggcaaaacctgaaaaggcctgataaaccgggctaattttattccggtcttat

SEQ ID NO: 9739 - DNA, 753 bp, Homo sapiens
  misc_feature (1)...(753): n = A,T,C or G
ggacctgaaccaaaacaaaagcaaaaggattatttgaaaataaattatgcggggtcgcttataaggtggccgaataggaacagctccggtcttcagctcccagtgagattgacacagaagatgagtgatttctgcatttccaactggggtacctggttcatctcactgggactggttggacagtgggtgccacccatggagggcaagctgaagcagggcagggcattgcctcacctaggaagcacaaggggttgggggatttcccttttctagccaagggaagccatgacagactgtacctggagaaatggtacactcctgaccaaatactgtgcttttcccacagtcttagtgactggcggaccaggagatacagtcccatgcctggctcggcgggtcccatgcacatggaggcttgctcactgctagcgcagcagtctgaggtcaacctgcaatgctgcagcttgacagggggaggggtgtctgccattgctgaggcttgaatagctcacagtgtaaacaaagcagccgggaagcttgaactgggcagagcccaccacagctcagcaaggactactgtctctctagattccacctctgggggcagggcatagcagaacaaaaggcagcagaaatttctgcagacttaaatgtccctgtctgacagctctgaagagagcaatggttctcccagcatggcgttcaagcaccaagattggacagactgcctcctcaagcggntccctggcccct

SEQ ID NO: 9740 - DNA, 544 bp, Homo sapiens
agatgattgcagacttttcattagagacagcggaagtcaggagaaactagaccataaagagtgggtttctagaaaagatccatggaaaagacacgtgtctaatggagtaaatttgtgtgacatatattggagatccatgcattggtcttgaaaactttatatcagcagaaacactgccagtttgaattaaaaagtacagaaagaatacaaaataaaggaatgctgtttgtctcccaaaattctgtaggtaagatacaagatggtaaaactactcagcttcagacactgtattatctttcacaatagggaaggattgttcatgagggttcactgatcccagaaggtggattgttaaattatagacaactgttttcagctgttaaaaacaaatgaagttacttgggtggatttcaaaatggttgagattggtaacttatcaccaagaattctttatccattggaaatgttccttaagagggaagggaaattaaggccttttcaggtaaatgaaacccgtacctttggactttagaaaaatgccaag

SEQ ID NO: 9741 - DNA, 535 bp, Homo sapiens
gctgggactacattccttgcccagaaacctcagttgctgtaacccctggaacctccagtatctcagaagaggctgggaaaagtctaaagctcttggtttctgggcagacatttggatgtcctaaaaacacctgatatataactgaagtctgggcctgctctaaggttaccctctggccaatctgtcaggggtgggcttgcccagagccatgtcagaagttccgtgcttgctgcaattatctcctccccagatcaccatctggccatgctctccttttgcactgccccatgttgagatcttatggacattttcctccttcatttcaattcaacatttgtcatcccaaatagtctagatcctaggttcttgcctcctagaaaaacaacccatgggcctaagggaaaacttgagaaagcaggaaccttgggggagttgacaccgactcatagggagactctttgtgcatcctctggaagtcaaggctcctttttgacctttgggttctatgaaagagtttagactttaaaggagattg

SEQ ID NO: 9742 - DNA, 271 bp, Homo sapiens
cttagagatgcataactagtaagtaaaaaattagagagcatactgggctagacacatgctaggggcggggctgtatacacagggtgacgtaacaagagaagtgggacacaatcccacccagacggcaatcaaaagaggtaggacgagagggggaacaggcggtggcagaaagataattcggggaggggtctacataagggggaggggagcacgggagaattttctacccgtcgcaccacccggaaaaggtttttttggggggggggggggg

SEQ ID NO: 9743 - DNA, 914 bp, Homo sapiens
ggtactcacaagagtcgcaatagaaggacgaggagcgcgggcggagggcttctcggaaaaaacgccccaaaacttacctgcgaagcccgcgggatcctcaacgggggcgcatccagcgatttttcggggcagagggggccaccaccactaaaaggggaggcgccgcccgtgttgttgacccaccacgacgcgaacacaagatgaggacagactctgcagttaacaaccgcaaaacggggcggacttacccggccgtggaaaatcaagatacagggaggggcaaacacttaggccccgggggtcgtatgatactaagagagacacatgcgcggcggagaaaacgtatcatagataacagcgtgcaaccagagggggacgtcacagaatgtctgtttatcaccaccacggcgcaccaagtagtgtagtaaaacggaggcgggagagaggataataacatcaaataagcctgatacgaacacaggcgaaaatgaggcgggcgtggagcaattggtaccaaaaaacaaggccatatgaacaaactgaaagccaccattgtgacagagagaagagaggcactatcaggaaaccgatgggtaggccctggttgccccagcggcacgtgtggccacgtagacagcagggccaacagctgatgggaataacagagaaacaacatatgggaaacaacaatgatagaaacaaaacactgccgcaaggcgcgaagacaaagtcacgagacgacgcgcgagggtcattggacagtcatcgggtgagtcagggcacacggcacaaaattaaaaacacgagtctcacatgcacgcatcgcgcaccgcggcctagcattttagagcggcccacccgcggtgcgcgctcaaatcataccgacaattcgacgctatatgcgagacccgcac

SEQ ID NO: 9744 - DNA, 925 bp, Homo sapiens
  misc_feature (1)...(925): n = A,T,C or G
cgccgcccgcatgcagcgttgggccgtnnncgcgagggatttctttggcctcgcagcctatacactgaaccgctaacgcatccggctactgacacccactatcaacttacgctgaggtgacttatccattatcaccggatacggacgcttctgtgtggtcctggctgatctctctgaccttatcagagagggatacatcctccacctatggtgttaaagccataatcctgcccaagcctcttaattaaaaagcaagtgctagtgtcaccctcggcgcgccggaattcattctatattaaacctaccagtgcattcaacatgtttggggtgggggtcattatccacatgccggggcatccagggtggtgttaaacccgtgaactttttggattggagagggaaaaagaacaccctctggcgcaaggacaaaacttgggttttatcaaactatgcagaaccccgactgattaaacaatgcactcacggcccagaaattaaaatccactggagccttgggcgggcttttttaacacaacgtatgacgggagggaaaaccaaagataggccgcagaccctttttttttatgggggcgcctatccgtaaccgctggcagtatccttcaaaaacatggtgtgggggatttcttgggttccacctccgcgtgtttgggttgctctaaaaaaagagcccggtggcgtgtggctattgatgttgcgggggacccgtgatactcttaaccattaaccgctttgagtacggtcgtagagaagcaagctgttgcctgagccaaaggagtgtggttctccctgcctgccacatcttcgacagccctagattccttaatccttctctctctatagtcctgcccccccgacgactggagacacgcaatattttaatatgtaatagtacggagcgacgggc

SEQ ID NO: 9745 - DNA, 393 bp, Homo sapiens
ctcagatgctcgagttggagaagtaaacttgaacgtgaacttgaggatgatgcacgagttattgcttgccggttccctttcccacattggactccagaccacgacacggaggggggatagacacagtgtgggcatatgatgcaagcacttttagaggccgtgaaaagaggccctgtacatcgatgcatttccagctgcccattcaagcataaactttactgggagtgcttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaaaaaaaaaaa

SEQ ID NO: 9746 - DNA, 683 bp, Homo sapiens
  misc_feature (1)...(683): n = A,T,C or G
gctaaggtaactgactctcttctttaaccaccgctcacaggtctctcctgatgccatgtaagatgtggcttgcttccccttcaccttccaccatgactgacaagaattcaaatgctctttctttgtggatgacattatctgatacctagaaaacctgaaagactgccaaaaggcttctggaaccaataaacctcagtgaagtttcaggatataaaatgaatgttcttttatctagtagcatttctatacaccaataacactcaagctgagagcanaatcaataatgcagtcacatttacaacacaaacacacacacacacacacacacacacacacacacaaaacctaggaatacatctaatcaaggggatgaacgatctctacaagaaaactacaaaaatgctgaaagaatttacagatgacattccttgtaccgattggaaaaacaaaggccttaaagggccaaccattattaaattagnnnnngaggnnnnnnnnnnnnnnnnnnnnnnnnnnnnnnnnnnattaaaaaaactcgtttttatttatttgggcccaaaaaaaaaccccaatccccaactatttttaccaaaaaaaaaaacccggggaaattgttccccctttttaaattttttgggggccaaaacaacaagggggggggggggagnttaaaaaaaaaaaaa

SEQ ID NO: 9747 - DNA, 1061 bp, Homo sapiens
  misc_feature (1)...(1061): n = A,T,C or G
atcttatcaagagataattgatatagctctgcaaatcacgatgacctcgcatcttaggaagtgcgcgtagacggggacatgagcgaggcgcttccgagcgcaagactgctacggacgcatcggtccgtacgcgcgcagcctctgagtgacgaggggcgacgcgattgctggaagacgctgaagtgggagcggagaggatgcatcggcgtgtggcgcgcggcatgcgcggggtgcgagagacgacatgtctattcgcccttcgtacgtaatagcgctgggctgcgagtgataggcggaatagtggggctcgtgtgatatgggatgaagctaagacactaacggctnattataataaagaagcaaaatatgactccatgtgaactttgttaatatgcgggatatataagattgtaggagcataccgatacggcgccgcacgttgcagtcgacttatgtgctatagtagcgtgaatataccaggcctatgggcgaaacgatgagtgcaacaaacgaacacgcgcanagaccgcacgtacaccctcgaccctctgcgttcgcgatctcactcgattctgcgcgctccgtcctcgagtcgttccgtctgggtggcgagatacagcacctagggtatcggcgggtatcatactagtgttaatcaattttgtagtgctgtagactaatgtggactgtctaattgtaatacagactaaataaaaccactaactattaataactaattatttacactctaccatatttattcccatanaattacaagcttgtaaattaaatgggtatgcgcaggataacaaagttattaaatatgatacttcctactaacacaatcttcgccaacagcgggatttaaaaggacgtatgtatacacagcccgataggatcatgtataagttttcccctcctcaaatgggcgagagtcgacgacacccaaactgcgcgggcctgtggttgttttggccaagaccgccccccggtttctttctagttctttctttttcttcttgctatttaaattgcccatcttatatntaaataatatttat

SEQ ID NO: 9748 - DNA, 447 bp, Homo sapiens
tagaacacttgacctacaaggctgccagtaggcgagggagaagacagatattccaaagatgattttatggcttgtgcatggaaaagggctgaggatggtagtcccatcttcaaccattttctctgcttgtcttcagtgatacaactctcttcaggcactcacactgcttcctgtggattaaggcagacatagatatcctacaagggaactgaacatgatggggaagctggttgttcaccttcatctaaccttttacggtgtagaaacagtgagttggtgggaaattttctgcactcttggtgctgggcagaatgagggcacaagcatcatggatgtgcaagtccaattcgcttaccatctgctcagagattttcacttctctgtgaccccacaaactaccctttcttcatatttgagcccttggctatttctggtaataaacccaga

SEQ ID NO: 9749 - DNA, 857 bp, Homo sapiens
ctattactcctccctctcccctccccatacctcctccccccccctccccccccaatgttggcggccatggcacactatttgtaaaatgaactcgatgctctactgaaggatctgtgcgagaagaatacacaggatctggatatccataatattacaacatacaagaagaacacaacgcctttgtcggatggagggaagctgtaccgaacggacctcgctcttattatctgagctggggataactagagttggccggccgcaaccacttgctagtgatacactgttttctacaaaattactgcgcactataaggcactccgctgcatcccattttatatctgcaaacctacctgcatatacacaactatcccaccacccgtcgctcatttcttctacgctgcttctacactcgtccccatcctccactcttcgccccatcccccccgccactactactgtttattctttacgtccctcacaactccaacatctaccacactccatctttctcgctcccactactccccctccaacaccgatccccccacaacatcccacacgcctcacccacccattaatctccatcatcaaccccgacattcccctatcttcttttgcaacattcccctcctcccctactcccccttctattcttatcctttaacccaaccctcctcgccccccaccacattttctacatttatcattctcttccccccccacaccccccttctatacctcattcactccatcctccctccccccacccctccatcccgttcccctccctcctccctccttcatcccttcaccatttctcctctcgtcatctctttcctccccacctccttcccctc

SEQ ID NO: 9750 - DNA, 210 bp, Homo sapiens
ctagacatgctgagccactgaatatcacacaagaacttaaatgaagctgcataggcaactgtcggggcttatagtaatcacaatgtcaaaatggttccaatctgttgactagattatgaagacctttaattgttgaaaagacttctgtatcgtggcaatctgtagcacattcatattaaaaaatgcatactgcaattaaaaaaaaaaaaa

SEQ ID NO: 9751 - DNA, 220 bp, Homo sapiens
cctagggaactttctcggcttgattttccaaatcccttctcttgttgcttattgtcacaggagtgcatacctcgctcatcattttggaatgtccgcgagccagtcttctctgcctaatctttgcattttaatactttatagataaaatattttattaaaaatgtaaatatgtaattagtgttattaaaatatttagactttgaacttaaaaaaaaaaaaa

SEQ ID NO: 9752 - DNA, 823 bp, Homo sapiens
  misc_feature (1)...(823): n = A,T,C or G
cctagaaggnacgttttctggagtttgatcgaggtgccacatcagagatacttattaagaccaataaaccataatccggttcttcaaataccagctcctggaagaaaaataaaaaaaaaaataaaaaaaaaaataaaaaataaaaaaaatataaaaaaaaaaaagaaacacaaattcaaaaatatataaagtgcagtgagtggggggtgcttacagtgatatatcgattttttttttttgctttcctcgggggggtttttgggcttttttttttttgggggggtttttttttgctttttttcttcttttgcgtggggtctgggttttttctggggggggctgggttttttttttttttgggggggggtgttctttttcccccgtgggggggggttggccgggggtggtctttgttgttttttggcgccttttgggccctgcccctctagcggtgtttggtgtggggttttttttttgtgcttcccccccctgggggtgttttccatttttctgcttatttctggggggggggtttccccgcggaggtttttttggtgtccgggttttccctcgggtgggtggttcctgttgttctcttttggttgtctgcctttctgtctattggtgttgttgtgccgtgcttttggtttttgggggagggggggcttgctttgttgttagtgtcgcgtggctgtgttatcttttgttgtgtgtgcggttttgtgccttaatggtgtgggtggtggggcgccgccctcccgctgttgttccgtgctttgttgggttttcgtcggatgtcatggtttatgtggtgttcgcgctg

SEQ ID NO: 9753 - DNA, 1013 bp, Homo sapiens
  misc_feature (1)...(1013): n = A,T,C or G
gggggggggtttcgcgaagggcgggggtaggggnaaaaaaattttagtaggaaaccactcccccctttctgaggttcctcccacaagagggcttttntgggtagaggagcttaaaaatctcaggcccggagggcaggggggggggaattacactccctccctcccncctnnnnnnnaagttnnnntccccccccaccattcacccttnaaccaagggtaaaaaaatggggagtcttcctttcagttggggccctgtctgggtgagacccaatgcccccaccccacagggtttgaccctcaaccctccanggggggggggggggaanaaccccnnnttnnnntnccnnntcnaccataaaaaacataaaaanttccctnnnncccccccnnnnnncctttnnnnannattnnttntttttcctttttctttaaacccttttatttttcaaattaatttctttttccaccatttttataacctcctaccccacccttttttttcctttattttttccactcatttcccccaaccaaaaataattttcttttaaaaattttaactttttcccccttctccaaactttacccctacctttaattccctcttaaacaactttcccctccttattaaaaataaacttctttcttctttacctaatttaaaaaattattaacctttttaccccttcccttaaaaactcccttttancaaccctcaaaaaaaaaaaacataattccccttctttttcccttcaacaataaaaactttttcaaccccttttctttttaataaaanattaatttcctctacccctccnccttacttcaccctccctcacctcctcaancttttcaatcttacaaacaaacctttcttcccctccctcttaacacccacctaatttctcctttctccccccaactccttantcattcccctcccatacataaaccttcntacccacaattctcaccccacaatccccttaaccacctaaactatctaccttttc

SEQ ID NO: 9754 - DNA, 1694 bp, Homo sapiens
  misc_feature (1)...(1694): n = A,T,C or G
agaagaaggcgagacggagggagaggaatggagctgtacgacgtgtcgctaacgagttacaggaacaccgagtctttagataggagatagaagacgtgatgcgacgaagtttatggagtcgcgctgatggtgactgtnttttacgtgaggagtctacgcgccgcatcgtagtgatctcggtcgtagtatccgacgcgggcgccgcacctacggtgatactccagtgtgcatcgtgatgtccacaagaatgatacgctacacgctganccgacagtattcaaacagtctagtattanatgccgtgagtagctgnatatataagctaagagacacatgacgtgaggagcacgcacatgagcttgctgctcgatcatttgtcacgtatgcgtcggcttgatgcctcgccgcatagtcatacgctagtacgcaaactatctgatcgcacagcttatgacgacacactgataactgcatagtaggcnccgcgactacaaatagtagangcgcgagcgcagtgtgcgcagacnagtaggtcgaggtcgtgtggccgcaacgagatcgtgtacgcgancactgccgacagcgatcctctacatatgtactcacaagtatatgattgttgtataagtgagatgtgtacgcgcacaacgtnacgcggtatacgcagacgaggtcgtancgaggaganagaggagtgcatatacagactcgtgatgcgtcaggagtgagagtgacgcgcggtgcatgtattgtgtagtattcgagtcatcgcctgaccgaacatgtattactgtatcaacgctagcgaccgacgtgcatagtgcagctgatatcattcatcccttcgtcgctacacacacaccagcgcgacttgtagaggcgtctntggtgcgcgaattatcattgataatgagtgcgtacgcgacgctatgacctcgcgcgcacatctagctgacgtgtcatcagatgtgatgtggatgcgcagactagtataaccactagtagtaggtatacgngtgcgcgagagcgagcagngcttgctagtcgatgntatgtcgacggatgagacaacgacgagtgcgagcatcgagtgagacatgtatcgnatagcagtgcatcggcgtgnctgacgtgagggtacagatactgcgagagtctgatcgctgagcgcgctnagnagcggcatatagagtgtcggatggatactagantgatgtgtcaccgcagctggcgcttcgcgagtgagagcacctgacgctgagatgaatagcgacgtggtgcgcgtatggtcgagtgggtgttgaataacgcggnactgatcgccatgtatctcatgtagtgtantctcgcgcnagatcgacagcgctaaagtaacactntgatcagtcgattatacatcatagacgtacgagtcgacattgtcaacataacacaagtgtagatgcatatctcagacatagcgcgtncagacgatgcgangccgatntattatatataatcgagaaactatcgtagactggtcgttnttagccggtagcacancgcgataactcgagtgtacagtacagtatgcgtcgactatatatacggatcgtctacgacgtatgcactctcagcnacacgcctatgcagcgacggacngatagncaggcgactgcgatagctgagngcgagtatgtcgaacgtttctacga

SEQ ID NO: 9755 - DNA, 1037 bp, Homo sapiens
  misc_feature (1)...(1037): n = A,T,C or G
ccctctccccacctccctcctccactccaagaagaaaaaaaaaaaaccttcnattttaactcccctagctcgtttcacactttatcttcccctcctcccctcttgaatctacaatttattttatttctcttccccggccccgggggtcccaataaaacctcaattcttcccccttaattttcttttttcttccccccccaacctccttctcttanacatatcttcaacaaaaaacccccccccttcccttcacaccctttaattaaacccctcccccccttttttttcctttttcccccatctttatagggaggggttcccnaccccttctacccctcccaaaaaacacaaaatatttcctctttcttcttccccgctatacccttctttcaccttattttctttttctctctcttccacccttctattctcttctacttcccttcccttcctaacccccctttcttctaccccccctcccccccggtttctcttcctttcatctttcacctttcctcctcacaacacaaatatcttctttttttccaatccttatatatttttctactttctcttctgtcctctttttctctcacccttcgatttcctctttttccccttcctttcccttccccatcacttaatttatctcttttccctttttcctcttttccacccactatttaccccctctctctctttctctccaccaaacactaccttttctcctcctcttccaaatatctacataaacttcttcttctccccttctcctctctcccncttctcccttttttcttcctcttttttctctttttccatcccctccctatttctcccctcttcctttctctctccctttctcacccttcctccttcttccctcttctcttctctccctcccctcttcctctttttcttttccctccctttcccctctcttttctagcacctccttctcacccntcctcctctctacctnatatcttcctttctcctcctcctttctcttttttctctctttctcccttttgttg

SEQ ID NO: 9756 - DNA, 944 bp, Homo sapiens
  misc_feature (1)...(944): n = A,T,C or G
acgaacgagacgagaggnagagggagagaaacagttagggcaccaccaggaagggcctagtagtnaaccggggcgggggccttggaaggngggaccaaggggggnggngggggggggggagagngnngngttaangaggagggggaaacgcnagggaaaacaagaaaanaaaagaaacagggaagagagaagngggggaaggaggaagggaaaggagaagaggagaggggagaggagaagagaagagagagaaagagaagagggaggaagaaagaaagaaanaaagaaagaagaaaaaaaaggagatttttttttacgagggaggggggaggggaccagggcgccacaccaagcccccccgagacaaaaaaacacccacaacacaaggagaaaaaacccacgcgagccggcgaggaagcgcggagcacgggagggaaggaaaccaccagcacacaaaggccagcgacgggcaaacccggagagaaaagaacccaaggcagcagcccacacacagccaaaagaagagacgcccaagacagcaggaaaggaggggcgacgagacacagcaagagagcgcgccgcgcgcccgagcgcagcgagaaccgccccacaacgaggcagaaagcggagaaaagcgaagccggcgccaagacagagcacgccaaccggagagcgaccggccaggcaaccagaacggcgcgacgcgggaaaacggcagaacacccaaacgccgagcgagaagaggaccagggagaaaaggcggcggcgcgagccaggacgaggaaccacaggaccaaaacagcaaacaagaaaaagcaggagaacgacgccaacaacccncagcggagccaccacgaaaggaggagcagaccaacggcaagcggcgacagcagcgaaaggcaacgacccacgaggacagcgagccgaagaacagagaggagccg

SEQ ID NO: 9757 - DNA, 2011 bp, Homo sapiens
  misc_feature (1)...(2011): n = A,T,C or G
ctcatgtcggacgagcagagcggcagacgatagtcgcagatgagcagncggccagtaagtctcactacatctatcgtcatatanaacgcacgctaaccacgcatctatctgtatacgctatattatatnagcacgagtacaagantngttacacacgaatctgntgcatacgcgactaggtgttgatggaggcatctttatgacagtacgacggcgaggcgccacgcgccgtgtcactnctgcgagtctctgcgcgatcgatccttagccgtcaacnacggcagcgtcagagcaggatgacgatggcggcagaaggactgtgacgagatgacgactgctctagtcatgcgctgcacagtacgatactcgagaagtacagcatatatgcttgagatgcgacgcagcgtgcgagcgcgacagtatgagagtggcaacgatacgagcccgacaaganatgacatagtgacgtgtagcagacctcaacatatccncagatcantgagacccgccgctctcgtcccgaaagagatacgacatcnancactatcagcgatagaganagacgncgagtactatggcagtcgacatgatctcggngagtgcatanagtgatnacgtcgacacagnagnacanantgagtagcaatganacatnatctagaagacagcgagacgactagtcctctagatgagtacgcggacggacggatgcagtantgatgacaccgacgcgtcatnagcntacgctgcctgancgaggcttgcgcgacgcgatacgctacgcgcgntgatgcgcattatctaacncgcgctgtgacgtcagccacgactgcacacgtacagtatggtacgagtgngatatgcgatattgatgagcatcgatcgacgaagtctacgctctcgacgcgaggagggcgtgcctccgtatagcattatgtgtaagaaggacaaagttatantgctcacaaccnatagattatancncatatgtcaacaggtcgctcagactctgcagcactctncgcgattgctcgatagtgangatatcagcattacactgtgagagcgacgcagacgactcgacagacatagagtgtagctcgattcncagtagacgtcagcgcnancgncntgacgatgagtgtcgagcatacgtcgtatntggtatagcataacaancnccgacgtgcagagtagcgcacgtatcgaatngtgtcgcgcggcggtagtanancgagcacngacgctcgcgagcgtctncantgagagcatgagcgctacagactagncganacgtcangcacntgantcagntagatantgtagatatncgtcgcatagtgcgagagcgcgtagctgagacgtngtggtgtcangcagacatcgntggacgcgagtgtncncgagntggntgcacgcgcagcgcgatactagttgcgcgcnctacgacgagactggctacgacatggcaggagcgtgcagactcagcatagctacanacgcatcaacgtctagtacatcgacgccnagtgcgcagcatatgcagatagtagtacgagtagtcgtatacagacgcatatacgcgtcacactcgagtgagttgctacgatatgcggcgagtcgagcgcgctagtntcgaactatgaatagaaagaaccatcgctgcgcggcagacaagagcacggcgtatgctgactgtagatcgcnacgacgatggtaagagcagacacggaacgagcaacacngcagtagacattgatgcagataacgcactacgctctgacgcatcgctgctgctgactagacgcgacgatcagtagacctacggacatgatagagccggctcgctgtcacacgtatcgatcatcagctaggtacgtntagtgacgcgtgtgagacgcgtgcgcgaatacgccgcgttacgctcactcgcgcaccatcgcgtgaanacatctctaggacgtantgtatagatcgcgaagtatgcagcatgctcaagcacgacgtgacg

SEQ ID NO: 9758 - DNA, 1315 bp, Homo sapiens
  misc_feature (1)...(1315): n = A,T,C or G
accacagcgaaagcaacacgcagcgcgcacaacctacaacaacagaccaagacaacgagacagagagcacgancgggcactcttgacacgggagcggaaaccgcgaacagnagaggaggtttttagacaaagaaagcaagacacacagaaccacaacgaaccgacagcaacgaagcacaagagaacgaagcagccacaggacgacaccagcgaacgacaagcacgggagagagaggacggaggntgacgagagagagacaaaaagcaagaagagaaggacgcaggagacacaggcgcaacgcgcagagaacacaggggcagagaggcggcgcgcggcacgcacagcacgcaaaccactacgcacgacgagagggggcgccgctagacgcataacagagcggagagccaagggacgacgctacgcgacgaagcgcggaagacacccggagccaacacagtcgacgaaaccaaacggagacggagtgcacagccacgagagcaagggacacaaagcagcgcgcgaaactgccagaagagacgacatcgggcagagagcaaggacgcggagaaggagaataggtacacgagaaacatagcggcggngaagcgcgagcgaggaccgcacacaccagaacgcccgaaccgtaacgcaggggaancacacagcacgagaagaaaccacgagagcgcaagaggcgagaggacagacgcgtggaaggcagaggcaggcccgcacaaagacgagccggaggaagaggaagngctagaacgaagaaccaaaagagaaggcggcagaggcaccggaggaacacgcggaccagacagaacaagagaacaacagtccagagatgacgaaaagaaagaatagcgggagagacggagcgagccagtcggaagaaggcagcgaggctaacaacgaacgacgtaagggcaagccgacaacgaacgacaacggacaaacgacgccgcgacgcgatagaagcgtcaagcgcagaggagagggcgccagacgcgagaacgcgcaccgcaaaactagagacaagacagagaagcaggaggaggcacgggccggaagaggcaacagcagaaacccgccgcacaggtgcggcgaacgcaagcagacacgcacgcaagcacaggtgatgagagagcggagaggcngcgaacaccacatacacgaacaaacacaaaaaacgcaagcccgagaaaataagaaagcagaaccaaaacgacaatcaagggtggagaacaaacaacgcagaacgaagaccgccacagtaacacgcgcgagacgcgaccagccacaacagcgctg

SEQ ID NO: 9759 - DNA, 399 bp, Homo sapiens
  misc_feature (1)...(399): n = A,T,C or G
tcccttcctcctctcccnnnannnnnnnncccccnnnnnnnattttcccccaacctttcctttttttttcccttttaccccccctttcccccccccccttnncctcttcccccccnccnctcctccttcccnaagactctcccccctntttattnaatcccccccctttccccccttttcttnncccttttcccccccgggnnctcttttttttgcnttttcncctttttctttttccgcccncncncccccttcnccccccttcctcctcccgttcttccccctttcccctttttcctcctcccctcccccccctctccccccccccgggggtgtngctcctcccctcccccccccccccccccccccaaaaatataatntnnntntntttcttttct

SEQ ID NO: 9760 - DNA, 887 bp, Homo sapiens
tacttactgtacaccaatcttgcttcgcccatatacctaaaaccaccaccacctaataacctacactggcatggtcttttggcaccacccagccggacaaactggctcataagctcttgcggccccgacccaggaactgactcaccgcaagaagacagcctttaactttccctatgatattgctcctccggccccacctatcaacactatcgtactggccttcccccaccccccacattattctcaacaactcttgatccctgaatgtttggagagactgattttgataataatgaaactcttgttctatgggcgcaatagaactaagacaaaagaaacacaaaaaccacatgaacaacaataataaaagaacacaaaaaaacgaccaaaaaaaaaaaacacacccaacaataacacaaaaacaattatcttctgttgtatttccttcctcttgcccaaagtctcactctttctccccacatctaatataacttctccccatctatcacccactcgtcccgttctcccctcccccggcggacgacgtacccaagtaactttaatgcagttcaatatcaacgatcgttagataatattctttccaactaaaaataccacagtatatcatgagagtccatggaaagccccgcgaaaacatataaaccatcaatgcccctcccatatccccactcactcccgcacactcatgtaacgcgtcccaaagaggccatcacctcgcgccgccaccatgtagatccactccctctctgccccctcaacaattgcctatcccctaagcaagttccaccaattacactcccctcgccctccactgtcatctcttcctaccgacgtacacctcctcacacaatacttacacttccaat

SEQ ID NO: 9761 - DNA, 845 bp, Homo sapiens
agcatcacctcgtgattgacaatgctctgaaaatggctcattgctattttgctaaaagactttccgtaaaaagagggttgtacttttcaggacgtagaagtggtcatacatacataaacgctatctagaacattatgcggatatagctcatgctgttgtctagcctattgcccaccagcgagtattaaaatatgtcatagttatggcgaactagaacacttaatagacatataacacactcattaggtctaagcatttatttgattggactgcactcatccactaggaccacatatctttgtgctcaaggactaccaatatccaagtaagtatcgttacttatagtgctactatcgctcttcgatatcagcattgattaacgcaaatagcggtcactagagtgctaaggactaggtctctaaaatacggactcgtgttacaagatcactagccctagtctttcatttaattaacccgcgattgcagcaacggtccctccgctgcatcgcggactatgagtttctacctagtcagtatcgaccttgagagacaataaacaattgctcacctcctgctcgggatataagccagccatacttttccgaatactgtaagaagtatagatcaacagacctgcgctcttccaaagatgcacctaaacgcactccttcctatcaatatcgacgcttttctagtcaacaacgttcgatgagagccattaagcggacgcttgggctgtgccccaagccattccgacatgtctctagtctccttctcgttaactttcgaatataggtatagtgtaatgataacacccccccggaatacccaccacgcacgacacg

SEQ ID NO: 9762 - DNA, 741 bp, Homo sapiens
aggagcataaaaaggcatatgacctcctttcctaaataaaagttaaagaaaaaaataaagggtctttagtcaggaacataaaacactattttcattaagagtagacagggagatatcgcccaggaaatagaaataagaaaagaactctaagacattctaatttttaacctgaacttaatgtctaccagccatgtaggtccggagaggtgaggcagcttgctcaatgttacacatctagtcgttagtagaaatgggattagaatccacttagtctaagttcttttctctgcaccatgtccttgagttagggtgaggattcattataacactgaaaatgaattgttcattgaataggataactatcatatgaaatatagatgcaaacaccatactctgaagtctgacgtacatgaatgatttgggggttattcagtgttacacaatgtgcctatcattgcttcttggaattagaatggataaggtatagttcactgggacacttttccaatatgcatcttggaagttgaacagtcactgtgtaagaataaagcccttgtgtcttgaatgcaatagctcattgcaggcagagacccaggcagcaccaacagtttaggctttagagttaaaagttgtttcaagcattagatgaactagttcattaaagatttattgattcagaatattcgggaggaatggagtatgaagtaaggacaagtgaattggcaaaaaaaaaaaaaaaaa

SEQ ID NO: 9763 - DNA, 1501 bp, Homo sapiens
  misc_feature (1)...(1501): n = A,T,C or G
atcggtgtgttatctagactcagagtagccgtctcaactgcgcagctgtcacagcagctcacacacagtcgagtgccngtgtcgctctaactaacgaattcacacacagacacntcgacantcatctcactctatgtagtatacgtttcttatnttntctactcgccgcgctgctccaataacgagatctactacccatgctagttatctanctagtattggctcataacacgaccgcgctgagtgtctaagacgcgattctaccgttgtatacatctctcatatcgccatacgatcacgcggnatgcattctcatacgtatacgttcaccttaactataatatagtcattcctcatcctcgtacactatatgttggtgtatgtacacatgactgaacacgtggatataaagatgtacttcttcgacccctctgtcagtgacagagtgtatatgatgtatactgtatttgtctacgtctacatccaagccaacagttgtcggacgtatcactgcgagtaacgggcggtggagaaggagctattttaatctcgatgacgtactattccccagttcgctagcgtcaaacagatggcgcagacttattgagtactacttataaattggtcatcaaataagtcatagactatcaatgttacttctattctcttcctcatctacatgtgtcaccactacgcaccttctcatttccgacctcctctccgttcgatctgtcttatancaatcgactcataacagtgacgtatattatcatgaccattcgcgcgatttcatcggtgctcatatgcgctcgaacgatggagcataataatcttgctcccgtcatgtttcgtataatcaccccttncacctctatgtcatcttctactctctagaccaatatagtatatantacacatcgcgacgtcgacgtcagagtctcgcttcgntacaccgctccagcgcactgtatatgatccattacgatcctagacgcgcactgcagatcagcacaatnagagcgtcatcatacttnagtatcatattccactgacatacctcatctcacagccgcaccgtctgtgtatgttacatgacgtagtctctcactcgcctacgatgaatatgatcgcacatgtattatatacttccncgtcgaattgcttccttcaatcacccatcttctatacatatcgtaatcaatgtgaatgtattggtacgcggtatctcnattattgcgctgcccgtgcgaatagttgctgtatgctccgcttatcattattcagtgtgtgantgtatctncaaccataccgatgcacatctgctatatgctagacgacttacacgaatatatactacaacattcacatcacacgtatctcatatcatctgtctcatactactattcacaaanaaacatagcgtatagnacgctaatcttcacgaagatcttaagaacaaagatanactcacatactcatcgcaatacncgatacagcgagg

SEQ ID NO: 9764 - DNA, 1187 bp, Homo sapiens
  misc_feature (1)...(1187): n = A,T,C or G
tactctatcctattctcaactccttattttcttcgcattactgcccttagcagcccatcccctcttnatcaataccaccacacaccctccatctttttacaattcttttccactatactctagtctattccctataacccgccacactcgtctttgtcctacttcttaacctcgtttccctccaatccttcagtgacccgttctcctctcatctttgtatatcaaatcctccttatttacccgccacccgtattgtaatttcgttagtgtcccacgctccgctacattgtcttcacataagttttctacaccgtatcatgcgatcacgcgctcgctcttcctgttctngacacacacttttctccctccgatcttctataataccacacgcgttcctcatctcaactcatccctccccagcgtcctttttgactcactcctcagccttatttaacctcgaactggggtgtgcctctccaatgctgtgatagccacataccgcttgcgtgagcaacactctgattcctcatcaggctggattgcccagccgcntctatatcaccctcgctctttcattgctattacttttttatatttacagaagtcactttctcttacttcattcagacaccacgatttagaccttacttgatgcagtcatgtattgcgttatggcctttacttttcgcacctttcacaagtaatttgttaaagtcttcttaccgcagcacgacacggtgctttcttcaaagtctctttttacgtgttattaccttgaacatcaaccctctccaatggccacacataacataatgctcctatgttacactantattggtttcgacattggattctattaatatccaaaaatcctactcatttatatccttataataaaaacataatatatatacttgtgctcttttttcggccccttagtccggttgtgagcttattgcgactccgctctccctattaagatgaggcgttaaatatcattgattcctctggctcaacttgcacctcccttgctgcttcttaattattttcgagattgttgtattttgctggttattacgcttcatctctacacggcctcgcnaatgacctctataattccactaagaattctacgcgctaattacctatttgagtaatagtaacatatgtgcgatcctacactcggg

SEQ ID NO: 9765 - DNA, 1452 bp, Homo sapiens
  misc_feature (1)...(1452): n = A,T,C or G
cccgtgtgtcctcctcctctcgtcatcgtcctgctgctcatcacctcctcgcgataccgctgggttgctgcctcttaccctctctcttcggctcgcgctcgcgctgtgcctcgcgcttctctcgctctcgtctcttcatgtggtctctctngattctgttcctnttgtcgtgtggcgtagtgtcggctgcagcgcgtgncttctcgtgcggcagagctctgctcgcgcgcgtcgctcgcgcctcttccgcgtacattctcgcgtcgcgcgccgtctcgcgcgcgtcctgcgtgctgccccgngcgccgtcgcgctcgcccgtccgcgccccgcgctactcctcagcgcgtgcgcctcacctcgcgcgcgcgcctccgtcgactgcggcgcgtgtcgcngatcgtgctnggngtcgcgtgcgacgngcgcctcgctgtcctctgcncgcgccgtgcgccgtcgtcgcctcgcgctgtggcactctcgcttctctgcgcgccngcgcttgctgcttctctcctcccgcgcgtcctctcttcgctccgccgctgccgcgtcgtgcgctcccgctctgtggcgtgtcctgtggccgcgcgcgcgtgtancggctcggcgctctctgtgtgcgtcgccctctcgtccctcccggtcgccgtgtctcctgtctcctgtctcgtgcgctggctgctcggtgcgcgcgcgctgctgcgcctcgtcgcgctcgccctcgtctcttattgagtcttcgtcgcgccacgctccgctcgctcgcgctgccgtcgcggcgttngtgcggcgtggctggtgcggcgcgcgtgggcgctgcgtgcgcgctcgcgnnggtgtgtgtgtctagtccgccttctggcgtggtccgcctccggcgnggtcgctctgtgcgctgccggcgctntctctcgttcggggatcggctctgctccgtcggcggggcgtgttccgtactgcttcgctctgggtctccgctggctgtgtgattgctgccgtatccnttgggttgctctcttattttgcgtacgtacttngtcttctccgttctttgctcgccgtctggcgctgcgcggccttcctcttctctgcgctccgtgccgccttgttggtctgttccctctctgtcctgtcgggggctcctctcttgcgttgcggctccgtgnctcgtctccgttcgctgcgctcctgtcttctgcgcctcccctctctntccctcgccggtggtgctttttccctntcccctcttctcttccctctcttcctctcctcccttctttccaaaaacccctttttctctctnttttttttttcttctcntccctctctncntgtttttttcccctttngaggctctnctttnntnnggttncccccangaagtttctttttttttttttttttttctctcttccccctcttttttnttaanaccatttttcttct

SEQ ID NO: 9766 - DNA, 2498 bp, Homo sapiens
  misc_feature (1)...(2498): n = A,T,C or G
cttgctacattacgtagcagcntagcgatanacatcgaaantatgnancggatctcatagcgagctnannatcgcattgctctantagtcgacatgatgagtantcgcgaccgctaccgacncgccgatcttcgtcatagttgacgtgagatcattactgacggaatactgtacgtgtgactctacgacgtcgtttcnatnctcgtagtgctgcgacgacgncgctgnactnctgttcgngtgagantngctgacntacnaacagatnataatcactgntccgcatcgactagcgctgacacgctgaagtatanctgtactcgttctatcgatgantacgtcatctnatacncactgagctaccgtgctatncngtgcnagatgctcngcaggtcgatgcgacacncngtcaatggtatgtacnnatngcagcgatcgngctagcctncagcgctgacgatctgctcatnangtcaantagatnngctncatactgctgactgcngtcagngcncgacntcgncntntgcacntgtagacttcatgagncatcngatgaccgtcgangacngtcancagctgactatcgactgcgntntantngatgttagnacagtgctntactcagtcgatacngaccgcagnatcantcntcnagctntctncggatcnncnattgncgcntcacatnacgacgncngtcangatactgatagcgtgnancancgntcggcnatctatngnactgctgantagcgtnanantgacgtagcgacgctgnctgagtcttacgangcaancgatgatcangctccgtnacgtcacgacgtnctntacntatganttaagacttantgtgatggntagtcgctacacgtgaganctgatcatactnctntganatcctgtcatcgacgcntctcctcgtctngacgngcaccngctgnctgctacatcnagngtgattgatgcagcagtctgtgtcgacnatcacgattgatgatntgaccagcgagantgctagatnggaagctgacntgcgtgtgcagcagtnancaactatcgagtagcatctgcagtatatnagtgtcgtngcagngatgattctgcacgnangtactgctagtagcgccggctgcgagtatcgacnacnntanacgtattcgacgataatctncgagtagtcgatacagtatcgcngtcgatacgcgnatcngcccgcatgatagatatnatcacntactcngtcgacngcanacnngacaccagcntcaccagcaactgactacgacggcagncgacngagtatcgncagatgcaacgatagtagtcntnagaccngcngnacntcatcacggctggtatcgatgacgttatgccatgtcgcgcntactgnctacgactgcnacgtgtcgtcgtacagtagctactatcacactantacgcgatcgtcgtcttgcgtacgagtgagacgtngagtctaaacacacgnacgctacgacatagnagtagcnngcgacgtgcncgcngcncagcatcagcatcacgacgatcncgnannantcgancgccanactgtactgagtcncnagntaacgctncgctgctacgtatcagcaggagnagcgatgatgactcngtgtacgacatgacgatgatattntgtatcgatacatgntcgactgangatgnccgtcgtacgtagnacgccgcatgacgncnncagatcatcttcgncgatctgcgatnacacntggtcagtcagaatnnctantacgatcatatcnattatcagtagtatgtcacatcgactagtntaatanagcgcgcgcgatcggatgtgaactgctgtgacatcatatcntncnattagatcgcntggatcaatacgctnatacgactcgcagntacgcagtgctcgccggagtngtngtctactagtgctgcatacggcgcagtgngatgatgcagtagtctgatantatnctctcgcacagtcngactgtgtcncacagtactntctacacggcgtatagtcgganacnatgctcatactaccagtagtgcangtnctgtactactactgcactgccgagtcgtgacgtaccgaantanttagtatgcgacttagnagatcntncntatcatcttgcatatatgctntantagtctgntcgctatnaatngtatagntatatnntngtgctactatgccgcagctcngtgcgtcgatcgatantaaaagnancntcgtncgntcagcatcagcngtnganncgctncagtatgctacattactacttagcactactgcacgtngacgttagctgtncatnatnctncatcncgtctgctcnncancgatcactgactagctgngcgccatnatctntcgtaagnntcnnatcatcgancantcntaccntacgatgtctagtactgcgncatgaagtcnnnangacgnagctangncgatgatancaagntgatcgncancg

SEQ ID NO: 9767 - DNA, 1309 bp, Homo sapiens
  misc_feature (1)...(1309): n = A,T,C or G
gtcaggacgatttagttagtacaacatagatttaanagaaagatgtgcggagtagactgaatacaaaatcataaagtcgcgggctttttacgaaagcgaaacctagcgcacgggagtggagatagagaggatagatatgcgatgcagagcgtcaccgagatatagttggcagatnacaanatatcattttatcgtcagatgtatgaagtgtcggactagcagcgagcgatatcaggcccttgagccaacgttacacaatcgacagtcccacgagacggcagtacggagtgttggcctacgagagtgtgcaaaacatatccacttagcgcagcatgcgatacataatgacatcgcgagtacgtttcatggatcgaggatccacgcctgatagtataatgttcagacgttattgttctacgcatccgnccagctcgctaagccgcccttattacgcgcgtcctcagcatagacgtcctacagatcccaaattagctacactaatcattcgactcatgatctgatatttctgagaccccgcgtaagcaggagcgcagtacacgtcacgatatagttattgattggtgtgcgggagtgtcccctctatgcgtatagacgcagtctatccggtaggttgagatatatntcggtcgtgctggtaaggcgtatcggataggatggcggtatttaccattgcgtgtccgcgacacagtgcgcagggtggaaatcagatagcgatatgactanaccggagatgcggcggaggtgatcggangacgcaggcgagtatcggnctgagaggttcgctcaccgcctatcaccacactgtttcatcgtgcagcgagtatagaagacaacggcgtgtcanattatgccctcgccacatttgacancaataatatatgatgtgtacagcagaataaacaggacaccagcaagatattgcnatgatgtaatgtcgcgtcagcatgactantgtaatctatcatctcgttcccacgacaacagcgagcgcgaagcgntaataatatccgcatatagtacaggcgaacaatagctcattgactcagagagtgtagaagtcatatataagagatagatgatcggcgctgtcggcctaacgaattgagacaagtatgtcataagtgataatgagattacaggncgccgcagcatgacgtcctgctacgtgaccgccgtcgattcgagcgcatgtacatatagtataatgacnagtatgtctacnancgttcgcnctcgcatatcatgagatacgatacagcgtagcgacatcttgatgaaactgtaagtg

SEQ ID NO: 9768 - DNA, 2080 bp, Homo sapiens
  misc_feature (1)...(2080): n = A,T,C or G
catcantanganacatcgctacttatagtgtgtgntctnatgtctagtcntcgtcgatactcgctgtgagtagagcagacgactcatgcacgcgatgatgtgcgacgatgctcttcgatgagcngagcgtctacgnctnantntggacacatgacttcttggaggtggtcgancgcattgtcatcgctgcgacnnccatgcacagtttgacgtacgtactncacgtactctcgattcgtcgntanactaaattgntggntgcntcatttcntcactgaacatcnactatagtcgtcgcttatcgatgtncatcactctcgctatgatngagtgcgtactngcatggacaganntgctcatagcgtcagcntntntgtacactgntcatagtgtgcgtantganattcgatgctatgtantgatctctantttaactcttcgtgcntctcatatctatgntgttctantctcgcgtacagtactacgctcactatgctgatatcgcttagtctctgcattcctcgacgagtgnggangnctcatctctactnagtngcacatgtactcgacggagagtcgtcatagctgtgatgntatacttagcagacgcnagcgacagagtgtgttngnntcagtcgtttactctntatactgtacgtgctgngctgtctcgnagtcagtgagngtctctgttgtagctcgtacgctgtcancgtgcgtagacactgatnantacgcgagtggagtagtgtaggagtaagtangagtgtcactctatatgtacantgcnctctctcgtgcgntagctnggtagctgctctcgtcactcgcagctcttctctcgntctggatgtgcgtgcgtgagtntncttgtcgcgcggtagcgtagtgtctcgtatcgcagagttacgacgtgatagtgtatatgtgatgngtctgttcgtactagttagtcgtgacatctagtagacggtaggctatgtatagcgtcactaggagagatgngagtaggcngcgtngctgcacgctgacggagcacggngtgctctcgcgntgtcgtctcttacgtcgtcgaggagcncgcgcctgactgtgcntgtgaggcatatacgcagctattgcttggtctagtccgtggtcgctgcgcttgtcgatacttcgctctgcgtntctcgtatctctcattctaggcagagagatagtgcgagctntnagtnggtagtgtgacagtgatgtgcactngagtatgatgtgtgtgtgatgatgatgtgntgcgagtggggtggttcgctgtcacgttggtggtcagtggtnatgactgagcttatgtgnttatagtggatgtctagnctaatggtgcgtgttagtgttnacacgttcgtcgtcgtacatatcacgatacgaacagctgctatgattgatatcattgtatctctgtctccgcgtgcttatatatctacgtcagtacttatctctcgttgatctagctntacgtnagntctatctcatgcagaagtnagaggtgagactgngtgagntagaagtctgctacgatgttagatggagtcntgctcgtgctgacgcgtgcgggctgcatctgacgcacgcgcgctcgctgagatcntgtanaagtagacagtagttagagacgtacgacgtatcngatgntatcagggacttgttangtagcgttgcgcgtatgtgtagtgctcgtcggtgcgttcttctctgtcgtcgtccgttcntgctcgcgngtgtctgngctgctagtacgttancgtaggatctcttatcttcgagtgtgtggagagtctgtgnctgtcgcgatgtatacatctctgttgatcttatctgctangatatanacatgttagcatatgtgtcagagttatctcgtatgnattacaactactctctcagtntctcngtactatatctcatctatagcgtcncactagtgctcgngcggctatgtctgctcgacatcacgttgtctnggagagtactctgtctagtatgacgatncgtagtatcgtgagcatcgtantatgctatatactatagtngtcagccgtgctgt

SEQ ID NO: 9769 - DNA, 988 bp, Homo sapiens
  misc_feature (1)...(988): n = A,T,C or G
tgagagaaggtccgcacccaaacagananaaaaaaccaaaaaaaaaattaactttacaattacctcgtttcatctcataattaaaaaattttttccttacctccccttttcncccctaagttaagggggtgaaattaaantcctnntnnnttccttctnccttttcctctgncctccctctttgntgttttcttggggggtttcngtccctctnttctntngggtggtggggggctgtgnntgtgctttccttctcgccccctttccttnngttgggggggggggcctaaaccctccccttcttnaaaaataataaaaatntaaaaaannnnnnnnnnnntnntttccctctttttatccctacaaaccaataaaacccttcttccacacctcctttaccttttaanaaaaaaattaaatataaaaaaccctccactcaataaactccactcacctctaaaaatttaaaactttcaaaaaacctttttaacttctattacacaacccctaaatcacctttattccacaaaaaatcaaanacatataccccacaaaaaaaaaaccttttanaaccacaaaaccccacacaaaaacccacctccaaccccccaaaaaaaaccctccttctttcttcttccnctcttttattcatataacccctcccaccctccctcaaaacaaaacataaacaaaantatcaaatccatcctacataaaaaaaantcaaccacaccccctccccacaaatatttataaaatacccctcccctctccaccccctaaaacaatttctcctattaactctctcttcctatacacacacctctataacataacaccaaaaaacacaactcccacctttctcttaattttacaaaacaaaccaacctccattttattcaattctacacacccaccaacaattcacacacacactaataataatccaccccccaccccaacactaatcttaaccaccaacaacacc

SEQ ID NO: 9770 - DNA, 450 bp, Homo sapiens
  misc_feature (1)...(450): n = A,T,C or G
atccacctcctccctcacacccaacacccacaacaaanaaaaaaaaaaaaaaaaaaaannncctccncngggagnanacgaacncacccccacccttaagaaangnaagaaaacacnggccccccgccacacaaacgcccccccacttaacacaaaaaataaaaaaaaccnggggcgccatgtgggcccccaacaaaaaaaacccnaaaacaacacacaaaaaancaccttctctttcttaaaacatcctatttttcccttttttttaaatttttgcctttttattcccccccccctttttttttttgttggaaaaaaaaatttccaaccccccttttatatccccccctttttttttncaaagggtgtgggtcccttccatttttaaaccccctttaaaaaaaatttcttctaaaaaaaaaaaatccctttttctcaaaaaaaaaaaaa

SEQ ID NO: 9771 - DNA, 236 bp, Homo sapiens
gttctgatgtacagaaggtggtagtttggcagatgacacccgccatcacacaagaagaatggaagagatggtggcacactgagactagttggagacccctaggaaattacccttcagtttcctgtggctcccaagtgatggaggaaggctgaaagttcttgcgggcaaggagagagggaaggagcagaaactggttatggtacataaatctatacaaggagaaaaattttataaaa

SEQ ID NO: 9772 - DNA, 196 bp, Homo sapiens
ggctagaagttatcgccgcccccctctgagatgcaacggcgcactctcggctcactgcagcctcgacctctcgggctcaagtgatctaccaccttggcctctcgaagtgctgcaattacagacatgaaccacacgtctggcccaaagggaattttaaaacaataataaaacctatcaaaagtcaaaaaaaaaaaaa

SEQ ID NO: 9773 - DNA, 211 bp, Homo sapiens
gcctaggagagactctttcatttgcctcaataggctagaccatggagtacacagattgttctacaaaccatatggtgactaagcctcattattgaatgcagttgacatggaaacaactagtcaacatcaaataaatagattattttgtgcaaatagctgcctctttgtgacaataataaatactttatttgtatcaggaaaaaaaaaaaaa

SEQ ID NO: 9774 - DNA, 298 bp, Homo sapiens
  misc_feature (1)...(298): n = A,T,C or G
ctgnngacgcatccgtgcactgttgagatgagtgatggcactaatataagacctgaaactgaccagcatattgtctatgctagaatatacagcgttactactatcttccacattaagaatgaaaaaccatgaatacactccaaaaatgtgtaaatcacatgaacaggctattcatatgaacttttctaggagtttcacataagccctatattttccaaaatgcaaatatatgcctaaagcaagttattcactgaataaattcttgatcctaaatatttatcattagcagataatacac

SEQ ID NO: 9775 - DNA, 289 bp, Homo sapiens
tgaggccaacgaggccattttttttttttttgcagcagagaaagcctttaatgattgtagggtggctgagcaaggagatggaaggagaccctcgaatccatctctgaggggttctgggctggggtttttaagagaattatgaagggcaaggggctagaaaattgtggttgttgattgatcgaggaaggggtatgaaaatcagaacttggaaactttgttctttgagtcaactgcttgtggggtcctttagaccagccgatgtcaatagtttcactggtagcaaaaccag

SEQ ID NO: 9776 - DNA, 395 bp, Homo sapiens
cttaggagctacgcagttgacatgtacacacctgcacatgcccacacctgcgcccagggcctcacatgcaggaggacttcgtaaactctggtacacaggaagaaaattattgcagggtcgttggacccagaaaagcatcacgggcggaggatgttgaagcttctgaccaggacagagttcttcagttgatagctgtccagaagtttcggcaagacgtttgaaggaaccacaacccagtctaaccaaaggggtggttggtggaaggtgaaggagtcacacacaagtggaaactccagcagagatccaagaaagcaggagtgatgcattttcccccattacgttttttttttttggtttttgtattaaatatccaccctccctcaaaaaaaaaaaaa

SEQ ID NO: 9777 - DNA, 273 bp, Homo sapiens
gcctaggagacactcctcctgcgcatgtaactcaccatcttcctgtgcccagctatcaccagacacctgcaggtgagctcactgcaagcttggcgtcgtggtgctgcgcacagacctcttgagcacacagtgttagcaccgtcctatgaaatctgcagacggtctttgatgatttggagcaggtatcggtcatgcaggctgagctgtctactatgcagctagttttctactttatacaataaatgagtctttaagtgcctaaaaaaaaaaaaa

SEQ ID NO: 9778 - DNA, 542 bp, Homo sapiens
ctagtttaaccagaacgaagaaggtagctgttcggcttaagccagaacatcgcatgttgtgggagcagcggctcaaggaggagcagatgcagaagcccaggtagcagagtgcagctgccacccacagccagccctgcctctgacaggggatacagcctgctggcgtgaatggtccatgccaccatgccatgtgagggacaaggagactcctcctcaactgtgaaaaactcgacacaccacattcacatatgcgacacacattttatttttgcctctataattttcctgtcattttactttatttttatttgaattgtttaattttgtcacacaaaatgtgaaattatgtcacccaaaaggaagaagcagtgtctgtcaacagataaatggataaacaaaatctgtttgtacatatacattcaatgttatattattcagccttaagaaggaaggaaattctaacacatgatacaacgtggatgaactttgaggatattatgctaagtgaataaaacagtcacaaaagggcaaaaaaaaaaaaa

SEQ ID NO: 9779 - DNA, 1701 bp, Homo sapiens
  misc_feature (1)...(1701): n = A,T,C or G
cgcacggagcagacggacacgacacgaccgagaggcagacatagacaagagacagcaaacgacagagcgacagagagcgagngnagacagacttacgagcgnggaggaggagaacaagcgagacggcgcacgagcgagcgatttatgccagccgagcgcgccacanaccccccgggcgnaggcggacanagaacgacgcgcgcacnagagacagatganacacgangngagcagacacgntggcatagcagtcatgcagaaggctgcgancggactgcnacgacatatcgacgcagccgcagctgaagagcgcgtgaganagcagacgcacgcagatcgcgacncagagncgtcncgcagcgacagacaacggcgnanagatagaaggactacgnctcaccgacatgacacgantggaacgccggcgcgacgagcagagagcaccacgacgaagacaggacggaccccgcaggtagcgacgcgcgaanggacgaccagagtgtcacgagatgcgcgcacctcnctgcagaagagaggagtgcacgangcagcaacgcagcgtacgcgcgcgatacgctgtacacgaccacacncgacgagacgagctctgtgtgcacgacgcgcngagaggacggtcgancggcacgagaancaggagatcagacagacgactgagagtgcagtgctgcgactanaagagcnatccccgtggaacaggagcagcacgcacgtatagagagagtcatccgcgagcgaggtaacagaaacacaggcggcgacgacgacgcgcgcgagcgcgagcgaggctggtagcacgcanagacagatagacgggagncgacagacgcgaacagagagaggaagcggnccgncacgctcacgctacgtgagcgcagcgancngctaacacaatacaacgcacacggcgtcacgccgacgacagngacgagngacggcacagcagagagagccgacaaggagacggagagaggcacaacgccacgacgtacagacgacgacacagaccgagacagcgaccgcagtgggatccaccccgttcggcgcatcaggcgacgcgcgcagaagggagcagcgcgcgcacagtgagaccgcgcgcgcgacgaccgagctcgcgcgaaagaagaacgacgcgcgagggtgcgacacgcgagatgagaatagtaggcgacgcgcagacgaagggatagccggacgcgagagacgcggaagccgaacgtgacagagaagaccgcggacgcgaaagagaggagaagagaaagaacgaaagagagcacgcaacacacanacgccgagaagacaacagccgcgactcgcgatcacagcacgcgcctggtagctacagacagagcncgcgcagcgacaggcgagccgcgagcaaacgaacacacgtgagacagatgggacacggnccgttagcacctaacctcgacatagccgcacacgncacacactgaaanaatagagaagccagangcaggacgctcgtgtgacgccccctcgccangcacacagaatgatatattagcatacagcgaccgngcgccaactcgctacaacaacaaggaggtcgcgaacagcggacgagagagacatcgtagacacgccccacgacgcgcgcagcaccccacacgaaggagaatatggcggacgcgcgaccacggacacagcgatggagaacga

SEQ ID NO: 9780 - DNA, 1318 bp, Homo sapiens
  misc_feature (1)...(1318): n = A,T,C or G
gcaccgagaggagacgcaccaaaggcccagcggggggaccggaagctagagggggacaggcggcaggactccgaaggcgaaaccacaacgggagcaaaagaagcaagccgcacgcacccgaccgcaccaccaacagccgcgcgcccgcagcagcgacaggcgcgcggcacgaccgcaggccgcgacaacgaaccgagaaaaaaggagaaacagagacagagggcgagcgcgccgaggagaccgcgcgaagcagagaagcgcgacgcncggcagagccgngaccggcgcccgcgcacgccgcagcgaccacaacaaagaacagaccagccaaccgaggaacgcgcgcgcgggagcgggccgcacggagacgagagaganacancgcccgccgagcacgcacgccacggcgcgcgccgcggatagagacgcaccgcagaacacacacgaccgcgccgagacgcgcggcggcacggcggcgcccagagacgacacccccacgcaggcgcccgcgacagcagccaagaacacacgcagcgcgacggagagagtgcgacacgcaacgaacgcccggcgacgcaagacgggcagatcacagatcggcgcgcgcggcgacgcgtgggnagactagcggcgcgcgaaccagaccggagggcgaacgaggggcgatcggcggcaggagccgaccagaagcccagggccgcagccggcaagggcagaggcccgcagaggacggacgtcccaccagaccggacgacaacacgcgccgaagaaatgccagaagaaagagaaagaaggaacaacaggcagcagcaggacggccggaaaggagaacgccccagagcatagagcgccgccgggcggcacaaacgcacaagaacaaggggacgcgcgcaacgaacgcgccagcgagcgggagcgcgcgcgacgcgacagagcgcgtgagcaagcaacacgtagtatcnatcacaccgagcacagcagccaccgcacgcgcgacgcgcgcagagatagcagacagacgagagagcgcgcgcggatgacgacacgacagcgatcgcacgagcgtcgaccccgcacagaatgaacagagcgtagatnagaccgacgcgccgcacgcacgggcacacgccgaagcacgacaagcaagtatatgagaaggtacagagcgcgtcgcgcgcgcagcgcaccagtccgagacggccgaggcagaacgacagcgcgacacncaatcgatgagacgcgccanagacngaagctcgaancncaccagcgacggcagagagcacgcgaccaccgagaccaccagaggagaacagag

SEQ ID NO: 9781 - DNA, 1344 bp, Homo sapiens
  misc_feature (1)...(1344): n = A,T,C or G
agcatattcatcgttcctcattatgcagcgttatgactagcctctttctaccctacagaaccgcgctccttctacgactgcacacagccacccccaccccgttttcgcgaactacacaaccaaccgctttcaactagctaacaaaacatatgcatcccgtcagtcatattgaacaagcgctacctatagtgtgttgttccatactcacacactattacttttatctacacgctattaagcataaggatccccgtgtacaacgaatgtcgactcatccagccgtgtgaagagacctccttcccctctactgccactgtcggctgctacgaagatatgacacgccccagtagtcaacgctatcgtcctggcactgcccccacacggcggcactatcacatcatattcacatactagtcgacccgaattgacggcgcgcataaataaaacgcctactgcagatcgaactctgaattaccacatctacatgcaccacctaaatattcgacgtcgccctagatggattcgcgttggtagcgatagatagctcgcgcacataatgcatcccgcaatagtcatcaattccatccgcgcgagatccgcaatgcggcacggccgcgtggatcgggcatggacgcagtcgctgccgcgattcgntgccaatatcgaggaccgccatagacatcattcgagtgctcttgtagagcaatgcttcgcgcgatgacactgtacgtaaggacactacgcgacgttgggtagatagcgacgcgcgttaccgaactaataatcccgaaacaaacctatgatagagcgcactcacataacaggagcaagtggctatatatgtataccgcaagcaagaatctgtaagcggtactgatatgacgatcgcgcatgagagtataacacgacgcgcgcgagactgaaacttatgaatcgagctgtgagtatcaatatctacgtccctggcattcgacactgcacatctagcatccgctatcanactatttatactcacgcatattagtcatctgcccgtcgcgcgcggcgcatgacgcatatatgtctcacacatatcacgcaatgcagtagcgtactcatcactcgtttccatccctatcgtcacgtatctgcatatgtgtccgcgctacccgctccncattctctgacgagcagacacagacccaaatatattctatcactccgacgtcaccgcgcgctaccagcacgacgagagtantcaatacacatgtgggtcgatnatatagagatgagcgtatgtatactgggacatcacgtcgagtaaaagatagntcgagtccgcgtctagctctgatttattattag

SEQ ID NO: 9782 - DNA, 1895 bp, Homo sapiens
  misc_feature (1)...(1895): n = A,T,C or G
ctgcagagctgcagatgacacacgcncacagcacagtggtagccgtcatgtnagagangacatgagctcgcactngtcagttctngntcgcactacacgaacatactcttaacaagnctgngagaagaacgcacccncgccgcngtccggaagcagttctttatacaagcnagcggccngcgggccacccgncacacatcgacgcgtcataattatggtttaattatatacncacgacctgatgtagntcgnctcctatatatcagtgtgcagcgtcagagacgagtcgctgtgacgagcagtgggcgtagtgacatacatatcgtactcgatacgaggtcagctcgcacatcacagccatgaggaccgcgtagacgtaccttgtgagagtagatggcagacnacgcggcataggaacgagatagnctgacgatgaggctangcggtactcgaccgtcttgacagcatcgagatgagcacgcgagtgccgangcatgatagatcgcataggtgcgcntccagntcatagctnatcagatcgtcagtctcgcgcgacgcaggcgtcgcactggctgctgacgccgaccagnacgcatacgcagcgacngaactgctgtcggcagtccgcncgaaggatgtnagacgcgatctgtctatatgatagagatgctgagctgacatgcgacgcagcggcancacgntaactcgagcacctgcgcccncacgcatccgtcgtcatgatngtgcngcagacaatctatatgtcgtcgtacacgcatcgncggtaagtagcatgagncgtgtcacgagcgagcgtcagacggtgacacacgcgcgtatatgacacgctctcagtcggcatgcgcatgctcgcatgcaataatangtactatcttatcgcatagatgcgcggcagtctgtgaggcacattncgcatgcgcgccgagaagcgtacgagtgcaccttacatgctctgagccgtgcgctctctatcgcacgaggactgggtattgaggagctcacatatgatctaacaatgaagggagtggagcagagctgcgaacgtgcgaatatcagcacgtacgatacgcgcacccgtgctagacggtggatgtgatcgtagatatgtgtactgtagcgcgaccacagaagagtgctgatacgcgacgcgcgcgcangtgacgacatatagtnggacgaagccgcacncancatngctcgtctccncgtcgtagtatccaagctctgatcgcangacatccgtcanactgactagtgctaagctacgacacagacacatagatgantgacatccacataagtagcgagcatgattataacacctgcccgctagattagagatagcgtcataccgcgtagagatatagactatggcataatacgnagcatngcgaactagatgcgctagtctttattacgagtgaacacctaacggatctcgcgatatncngtccaatgntctcgcgacncacgantcagccgacggcgatcgcgacgaccaatcatcatggtcagatntagtaacgatgcacgtgatgcacggtgctgtgactcgcatacgtacacacncatagcgcgcgatgtacttntgtgtgcatcatgtatgtgctggcgagcgcgtcacgacgacgagtgcacngccngacgcntggtggntgtgtgtgcagagtaagtagatnaagtcgtaccgtacgccgtcgcnagtacgacacgtgccgncgtgagctatgcgccacgtatgactcgttncgctcgctanaggnatatnatagcacgtacgcacgagcgctccgancgatgtgncacnancgcgtctgcagctagcacgantgatacacacgacccagatgagtcctagagtagatgagtgagat

SEQ ID NO: 9783 - DNA, 1340 bp, Homo sapiens
  misc_feature (1)...(1340): n = A,T,C or G
cgcgcgacagcgcgttcccggtcgacaattgctcagctcggagacgcgaatggaggcattagaaggtggacgagggcggagagttttaactctcctgtacacaatccatccataacatgcaggctcgactattaatctatatgacttcattccccgatactcctaatctcatgctcacgcgtatggatgagatcgatagatctacaatcgattcgaagagagaggtgtgcgcgcctgccaaaagcaaaaacaaagagttcgacgcctataacatcgacctgcgccccgggcgcagtaagcacactacccgagatcgatagtgacgctgttggcggtggagatatagcaagggatggcatgcgaccgcctcccctcattagncccccataattccgctcacctctagatcacgtgacgcaaaccatcaacctaaacgtcgtagctccgatagccatatattactcgcttctcgtatcctctacgctcgcctacttcacgacgacgtcgtctggtgtctntcgcttactacacccancgacagatgcgatgagcgggaaagagagagtgtgatatggaacgcaccgctggagttgctcgggccgggtggaccggcatgtgcatcgcatccacgatggtaacacgagtaaagctattcacattgcgacgcagactaagctcacgacgatgtacttagtgacgattagtgcgcnccagtatcgtcgtctattactcacacancattacgttgactgctattatcacgtgatgcgacagcgcgatccgcgagcctcgcgctccatgcaccgatcagacgcgctcagcgctggtgagttctattatagacgtgagagntggagctngcatcgtaacgcgtgacngnactgagagcgaccacncgtctacgatntcagcgactagtaatgtattcgcaacaacactccgacatncgacgaccacgcngtgcgagcacactagcngaagtccatcgctcgctatgtctctctcgctctcngatacgcatatgcantcatagtgtgctctcgacacngatatacgtcttatcagtcatgtacttacgtacccgncgcactcgtactgtcatccgcgcacacactacntgagcgtactcagtgagagagtatgntatcacgatccgcacgcatactcgactgaacgcactgccgtactcaacgatcatctnactatcncttaanctgantctagatnatgatatcgtctgncgtacgcactgctcntaatgatccatcagagcggnacgtagnngatcacatatnctcgacgacagtagtctacacgagatcatagtatgtgatntgtat

SEQ ID NO: 9784 - DNA, 1483 bp, Homo sapiens
  misc_feature (1)...(1483): n = A,T,C or G
ttcagatactcttccacttcttatcatatatattgatgtactccgtattcccggtctattgcgtcatntccccattatatctagatgaccctcgcataaatccaacacatttcccaccccatcatccgaagctctccacagccggcgacgcgagctaacccacaggttcgtagagtacgcaatcttagcagtgaaaatactgcgtaagaacgcagctcgttactatcaccgttgcgcgcatgacgagtctccatcaaagccactcgatcctcaagccatatacattctagatatatctttgcacgacatacgtatcgttattcatgtagtgcatttatcatgtatcatgactatatcctcgttaagnctactatcgtcgttacanaatcaacacagagcaaacgtaacaactcattgtaatgtgagcacgcacagtacccagcctctgatagcataataatgacttagagcgacgtcacagaatttgattctgtgctatttttcatcactctatccacgtataaggaataacgcgtttgtatcgtcgcttcaccctcaggcgttatatcgtctagtctctacatgtctcataagcatatgcgccttgtgatcacgagtgcgcatgtatacgcacgtcagtgaattcgcgtctctcgtctactcactcacgagacacatgcgtcgatgacacgagtatgtacgtccacatctgcaagtttcgcgatcacgtcagagcgacgcgccgtcaatatattacgtaacacgtgtcgacgtctccnactatcgtaacctgtagaccacgactctggtncagacactcgcatctgttcatagtcgccacgaggcctacagtgcctcaccgcgtacacatgtatctactcagacgtnacaccgcgctgacgccgttttacgtgggcgcgcctagctatcacactatatatctctatctgcaacgtggcctcccttaccgcatcgcgcagctgcgtctagacgtacacgaactcacttgatacaccctacgtgtagtctctgcatgtcgtccatctntgactcacctcacgcatgtctctcacgagactgcggactgagacangcacgccagataccactcttccatcatctatcctactagattctcacacgcagttctcgctacgctgacaacntcgcatctgaacactaatatttcgcagcacacatatctngacgattactctatgtcacgcctcgagattgtgcatacaacaccgctcgcncacgcngatatagacttgactctcntcngcgaacagctctatcccgcgtgcgactatctcactccgttgctcgtgacagcantcgcatgtgtgacgcgccagtatctaacttctcagtcctcatctgnccgcgctctccgatntgcacgcacgacattccccgtatacacagtatgataggtctagtgtgtatcnacgcggctctaattgatccaccgtagacgttc

SEQ ID NO: 9785 - DNA, 281 bp, Homo sapiens
ctagtagcatctattcctcatgtagagccacccgtcatttgaaagaggaggaaacactgtatcgcggaagattctggagcacaatgaaaccaaattgagaacgaggagaatagaagatgctgttgccgcagactaaagaggccttgagtgtcacagctctttttgaattagtctagcatgctttctgctttttactggaaagtgcccccccccaaaaaaatcaaaacgattaaataaacaaagaaaaataaaaagaagaatggcctatctggcctcctgca

SEQ ID NO: 9786 - DNA, 1258 bp, Homo sapiens
  misc_feature (1)...(1258): n = A,T,C or G
ccgccgctggctggcgctcccctgttcgtgcctgctccgcggcgcgtgtcgcgctgtgcgtacgcccgcctctttcgcgccggtgccctccttgctcctcgctttcttcgctctgccgctggccttcgccgttcttctcgagtccgcgaagttgcgttgtgttctcggttgtggttgttgtggtgcttcgttggctgtgcgtgtcanccctggctccgcgcgcgcggggcgtctgcggtgttggcgggccgtgcgcgtgtgtgtgcgcggctggcgccgtcccggcgcgctggccgcctcgggcgcgccaccgccgcgccggtgtcggcggcgcggttgnggcttctcgccgcgcggggtgtggcgcgtctgtgctgccgctcgtgtggctgctgttcgtttgtggtgtnggtccgntggttgtagtttccgcggcaccgcgcgcggcgggggtggtgtctctcgcgtcgggcgcggggttgcccggcgcgggcgggttgtgttggtgggggggcggggggttcgggggggggcgtggtgggcgcgtggttggtggtggtgtgtgcgcgggtggggtgggcggcgggggcggcgtgctctgcccgcgccgggctgcgcgccgggtgggcgcgtgtgcgtgggcgtgcggcgcgggtcgcccgccggcgnctgcggcgtgtgtcgaggccctctctcgtctcgcgccgtggcgcgcgcgcggcgcggcgcgtgaggctgcgcctgcgtcttcccgctgtcgctcgccgcggcgccgcgccctctcgctcgttggtctgggtactaagtggatcgctntntttctngttttctgtgcttctcctcgcgtctcgtgtctcctgtcctcgcggctgtgtctcgtcgtgggtcgcttcgtcgccgcctggcgctcccgcgtcgcgccgcgcctcctgggtgtgcttctttccgcgtgcttcttggttctgtctctctcgccgtgttgtcttcttcgttcggttcgcggtcgctcctgtctcccncggncctctcttcttcttctctcagagctctttccttctgctngtcctttctttctctccttgtctttcctncnctcgcgctctctctncctnnctcntaaggcgcttctnctnttcntccnttgtttntccttctcntaaggggtgtctcttctctcttatattttctcttctcttttctcttcttctccttcctctctancttcntccnnncccacacctctcttctctctctcttt

SEQ ID NO: 9787 - DNA, 1413 bp, Homo sapiens
  misc_feature (1)...(1413): n = A,T,C or G
gtgcagacccataagagagaggaatatagatatttatcgtgtatatagaccggctgtcagctaattttgttgatagaccgcgcgagcatttcgaatttttgaaagcaaacgtaccctcagtacgatactggtgtgtagcgcaccgngattaacatagatcgtcgctattaggtacaaatagaagtttctcgatcaacaggaatctagaatcatctccacgcagcggttgacgaagtcagcactattcgcataaatgacatgcatacttagtatagtgcgtattgctacgtcttactggtctgtgattcgttaatctcgagcacatgaacagtcccgtcatagcgtcggggtgtccgcacgagtggcgtacaccttgttgttcgcgagcatcccacgcgatctctcctatctatatcctagtatcacactaacgactatcgattacatcacaatcaaagattcgtagagtgtcgccgtcacacgatgtctactatcacgtgtgcgtgtgcaggatcagagtatcaatacatggtcacacagcgtagagcgtgataattgagattgtatggatacgaggatcacgaggagtatttccgtgtatctgcagtagatacccatgactatacnacagtacagacacagagtgcgagattgacagatattgcgcgcagaatgtaggcggagcgacgcagcacagggangagcagggagttggcttgtcgagagaccgcgtcgttgcactgatcaatgctgtggacgagatagtgacgttacgagtcttgtagtaatcgctctctcgactgtaccagcgacttcgtgatactaacaggtccgcgtaatgctatcgacctatctgcacttcgcnttctcgaccgcatgagggccgtgacatgttgatatgtatgacggtcaccatagacacgagtcaatccgagtcacgtgtatccgctgatcgacaatgcgaggaccaggctcctcatgttgcgtagtgaacctatactaacaacaaggacctcagtcgactgtcgcaataacgcgccgagtgactacaccccatatgctgcacggtgtgtcgtgtgcatgtagcggaccaagttcacgacgtcttcactgatctgacctaacaggtatcgttagctcaatatcctctataattatacgagtttcagttatacatctagaagagcgatcatcatatcagtgttataactctcatatcgctctttacgtatgagagcgcgagccgtgattacgaggcggtcgcgacaattacggtcacttcatcgattctcgcgtgttgcatgctctacatctcgtacgattataaacacgagcacaaccatcagtgcagatatctttattatttatcattacaattctgattccgtcggcgataatttgtcggtcgagccg

SEQ ID NO: 9788 - DNA, 496 bp, Homo sapiens
cctagtcagacggggtttcaccgttttagccagggtggtctcgatctcctgacctcatgatccactcacctcggcctcccgaagtgctgggattacaggcgtgagccaccgtgcccggccttgctttcatcattaaagaagacatacatcttcccttttgtggacacaagcctgatcattggagcttcagcagctatctggtaataatgagagaaaggccaagcccagggaattacagagacattggctctgccattactgagtaactgaaccaactccagcaactacccaagaaacttcctgttgtgagagaataagcaaacttatatctattctaactcttgtatttagcttctctgttacttgcagctgaataaatatagcatttaaaaaaattaccttacgtaattataagtgcttcatcccaaagagacgacgtgtaggtctgacaatagcgggaataaatactgataatattttaataaaaaaaaaaaaa

SEQ ID NO: 9789 - DNA, 2103 bp, Homo sapiens
  misc_feature (1)...(2103): n = A,T,C or G
cacttgcgctctgcgcattcgtagcatagcacgntcgtctcnctcgttacgatgncgcagtctagaccantctactngacagctacngtatacgcatactgtcatactacctgagctctgcgcgtnancgcnagtcgtatnctgcatcggactcngccgatgcgctgcgtcatgactagcgcgcgacgcatcntagtactatctcgtcgcgcagntcacngatgagccgtcacgcctngcacagcgancgtcagctcagcgcaccgctncnaggcgtnancgttagacgtacacacgagtgcgccgtgncggccatacgcactcgcgcgcgcctcgctttcatattgcatgatcnactatctctatgccagctcacgaccgcgtcgcatgcatagtaccgtctngtctctctctcctatagccantcagcgagcagcacacgcngtgcgangcgtgcgcgntgccgctagaatntcgatnctgctcngntactgcgtctgtgctcgacnacaagtgtanncngtgcagcgctgtgctgggtnagnttaggcattgtcagacnagagcgctcgnctgtcctgngtctcttcgtcacgtgtcgacactnanccgagtgtacgcctgtgcgntgcagcctgctgntgtgtacgcctcanccagcagtcgcagtgctgcatgctaccactacgtgcacantcgctcgtcangtgtcggctactgacgtcgactggctcgtgatacgtngnctccgtgancggcagcgtgactgcgcgcgtgcgtagtagcgcgcgcgtgcgtctctcacacancntggataggagactactagcgcgtggtanntctcgcactacactcactacgtccgatcagntcgcgctnctgcccgncgtcantngcatacgntcgatcgacgacacggancatacgagctctacgaggtntcagtagtgactagtactcgtgcgngcgtatgangcagaatcantgtacgcgagatggangngncgcagttcgacgatgtagaggcagagtcgcgcngcgngcgacacgagcccgagnggcgacgancgcgcgagcgcnctgtgcgacgtggccancngncgtgtcgctgataccgtgcgcgtgagcgtgtgactcgtacagtgcagactgcgcgatagtagntcgcgggtcgcgcgcgcggtgctnatcgntagcgtcctgcgccctcgctcccnggagcatctgtgcaggtcacgctntcgacncgngacgntgtctctcgttgtctgtgttctgnttcactaanntgctcngngctagcgntgtttacatgtgtcatgctcncgtgtgcgtnctgtctcctctcgncnanccanctcgtcctgacgtgtagttgcagagagatatagaatgctcggattgtancagttcatctnacgncgtacntgncacaactcnancgcgtatctatnaatctattancctacncacantctaccgnctgactagacactcanngctgctgcacgaggagagangntanaanaggcgtgagtacgangcacgtatgacgtgtnggtntatcgctagcgacctatagatgtagtngcgtgcaatgcagttgtcntgtgttgtgctncacacgtctnctcagactntcgnatcaccgcaccgatactcacgcagtccgcttcgatanctcncgatngttntgtntctccatcgtcntngcggcntatnntntnttcanntaccactccgtcctatatnattcctntattatncncatntnacctatactactnanacacacatacataccaannacgnaatctctacgncccctatcnntntnnnncnactcctactctctctctctgtccctncgcacntcttgggggtcatctnnnnctctcnnccnacagngaagagacncntntnntntntcttcnntnntatgttttntntncncntaatntngaggggttactttctctntttactactacntataccttcccatatatattacatcctactactctcacttactctcacacatctttntatatctattcttcttctctnnactatatcttacatccatncttaaattatatc

SEQ ID NO: 9790 - DNA, 869 bp, Homo sapiens
  misc_feature (1)...(869): n = A,T,C or G
tcttgtataaaatcaccagcctctttgcaaaacgcaacaaaggtttgttagtgactggcccggggctttgagggaannacnaaagccaaangnggcangaccangccanggatacnaccccggcagaaacaagaacgaagcaccgacacacgccacaacaggaaggaacccggacaacaggcnagagagaaanaagccagacacgaaaagacaaacacagcgagaccggacacaagcgaaacaaccagagcaggcaaacacacagatttttttttgagaacgggagaccaccacaggccgcggggcgacagggcaacccgagctaatagctcaacgggaatcagaggccacagattgctatccattaaaaagatttgcgaaacagtgttcatcggttgcatactacctgaaaatgtccttaatgccagcccaatttgtatgttcataacaatggttaacactgggcacatattatgttctttcacactttatttttaactcgatatattcgccaacaataagtctataataaacttttagtttcctcacgcttatataccggagctacctatacctgactacaattcttacgaggaatcgtatgattccgcgcattgcaatatacagccgcccccctcattcctaagatttccgccatcaagcttccccctcatctcataagcagttatcgaaataattataacaacatagcatcaatgctagtgctaaacatttacgtcctccgatatttaaatacccctccaacctcataaacagctcatattatccctattattttaaattgtattctctctttcagtctttcacactattatccttaatactcacgcaccacaatactatctatg

SEQ ID NO: 9791 - DNA, 1191 bp, Homo sapiens
  misc_feature (1)...(1191): n = A,T,C or G
tgaagtggcgcaatacctgcgaaataggttccacaaaaacaacaagtttttaaaggggaaacaacaaaacacacctggggagagagcaaaccacgacgaaaaatcgcagaccgcgggacacccgacaacactcagcccaggcagggtggggtgggtgatcacaccccacgacgaagtggtgcttgtgttgctacaaaatgcaacgtgtatcgcatcgtgtgccacacatagccgccgcccaccagaatgtggacccctcgcattcgcgctctggtaggctctccggagagctagtggggtgcccgaaccatatgggaatgtgagaagcgactacgagcacattattatcttaaaggcgtgtgcgcgtccgtccgactcatggacatatggcgtatatcaactgcagcgtgcttctcgaagtcacaatgggcagactagaacctatatagaatcagtcggcacacctacgcaccagccgcgacaccaagttgtcgnagtgtgcgcgacgtcgggctgacatgcacatcggtatgagcgtttttcgctactctcacggatccgaatagcattctctactgaggggtaggtcgatcagcagtggacgcctcgcggctccgcccacatccgcgccttcttcaactacacgagtacagtacggcgagtgagtcttacgaaacgtgagcaattaactcggaagtatcgtcgtgcgagagcggtggaccggcggctcgagaggagcgtctcgcccgagatgctgctgtcctactcgtccgtttattccgtgtagagatggagtatgtacgaancaatagcagagtaataagnagagagataaatcaatgaggagagcagaagaggagagcagcacggagtataaacatcatcaatagagactaagactggacggagagtatgcaatgagaatagggccagatccattctcatcttaaggcattatatagtgcgatggcgccgcagcatctatcaatgagagctgtttccaaggctgcgcacgcctcgagagagggatagcgatggataggagcagacgcctcacgcggctatacgcactgagtaagcgatagatgcaagacactgagcggcaggcgcgatgcaaccgccgcagagaccaatgcccgcacacacctccgccacctgcacatctgctagctcttgaattaatacagcaag

SEQ ID NO: 9792 - DNA, 1667 bp, Homo sapiens
  misc_feature (1)...(1667): n = A,T,C or G
cccgtatcccggactaccangaccgaatactccacacaccanaccacnacccaancncnganannagnngnnnttcgggttgttccgtnnngnaactnggcgcacgcacnncngannnngcggtggannagngcgngnggaggntaaccgacnagngntgcgagagagaanagacggcgacagaggatcgagacgcccgcnacgcagcgagacagatttataganacgacggaagcgagcgagacgagacagcagccagcgatgagaagaacgatcaccacacgaacgcggcaagagtagcgagagagtgtccgccgcgcgtgcngataagtgacagcggcacatcgacagagagacacatgangcaaccgcngcgacaggagacagatgcacggccgcgtgcgagcagcgngtacggatgaccgagtgtaacacggagngacgcgaagaacgcacgtaacccgcgcgacgcggcgcagcgnagcgacaagaagcgaggaaacaagccacggaagagcacgcgaggacattctctctttgtctgagagggccggccgcgaagcgagagagaaggacagagcgacggcaagngcgcgtacgcgacaggaaacagcacaccggcgcacggagtacctaatgagagcgaggagatacaagcggatccgcgcgancgngagatagagacgatcgtcacgangcaagagcaagtgtaagagagaagggcggcaaccgacacgaagcgacgcgcgacgtcagcatatagaagcgangcaccgccgagcgatgaagtcagcgaaagtatgagcacgcacgagacggcagacggagagagaacgacgaggccgacggaggacacgacagagancgngcgagatacacgagagcaccaggcgctagagagggactacgtacacgcgagacacatacgcgagcgagggcggacgcgatcaacacgacagatgagaagacagtagggcagaatacaacagagcgataaagcagcgcgagctganagagacacgacgcgacacagcgacgaggtgnacgtcgcagtaacgagcagtgagtaganagacgcacacgacgacggcgagantgccgcgacgcgcgcagnacacgncaaagacggagagaanagacagagtacagagcgacagagagaccacncgggcgagagatacgngnacgacacncagcgcgcacggagactaacgacaacgagcgagcacgcccgcacagaacgacacgancgacgacgaagaggcgaagtggcgctgacagagacgcgtgcagcgggcgagacggacgacacgnactgagacagggtacgcgagagtcagacagcggcgagatgcaggaaanactaggcagagcagggacgagacgacgactcgacgcggagcgcgcaagagtacgagacncacacgcgngtgncgcacgacacgtcacaacgacncacggagagagaangatgaaacaagagngnggtgtcgagagacgagaaangacgagagaagncagacgacaccggagagagaagagtgtgtatagacaggnacacggagacgaccacggccnaggtgggaccgatgcgcacagatacggagcggtcnaggtgcagcancgtgcgcgagagacaggcggtgaagcgagaggcacggcgaagg

SEQ ID NO: 9793 - DNA, 1404 bp, Homo sapiens
  misc_feature (1)...(1404): n = A,T,C or G
gagggcgaggcgccgcgacgcacaccagccacgtcccgancaagacaagagcaggcaagcggtcncccatatactaccaacgcaggaccctngatacttatnnctgaacgtgaaacctcacataatcgncgagcaaggagacggctgacgaacggaagaagagagcaacaccggcagactggggcctagcggcggacagcaaggacggacggaaaacacagggaagcacgcccgcgcccgcggagggaaagcagaggagcggcgcacccggcggcagcgccacacagggggccagacacagcgtaggcgaggcacagcaaaaggcgccccccgcgccgcgcgcaaccagagcgaggcgcccgaggcgcggcggcccgaccggcccacctcggagcgcagcgcgcgcgcccgagccacgcacggggcgcccgacgggacaaccacgcccagaancgcgcgcccgcccgcatcgagcccacggtgcagccacaccagcggcgacatcgagaggggcgcgccatgccagccagagaacacgacgccgaccggccaagagcccccatcgcccacgacccgancagtcgtagcccggcgagcaccagccacggcacggacgcggccgacgcgccaggcgggcggcagcgcgaccggcgcgagccacagtgcgagccacagcaccacacccacgcanacgcgctcgacgcacagcccgcagcctcgccagggcgcagcgtgcagccgggcgcgccgcgcgtcncatcancgnccggagccgacgcccnatcagaacgacaacncgagaccncgcgcacgcgcacgatgcgcgcgtgcgcgacgcgcgcnagagctgcgccgacaagggcgacagatgcatcggtaaccgcaggcacgcgatgcacgcacgcacncnacgaagccncagacgncgcacgcgcgacgacgacntcccgctctcagaggagtacgcgaagataacgcagacgacatcngcgcgacagcacacgacgcgcgtgcagcgcgcnacgaggacgncacacagcgccgaacaacacgcgcacgcgngcacgcacnagcgcgcgccgccgcctccgacngcgagcgcgcntaagcgagacgccacgcaggccgtcgcgccgcagcgcgagtaccagacgcgctccgcagcccgcacgcgcccgacgtgagcggaacgcgatacggcgcagnccggcgaccgcgcgcgagccgcctcgagcgcagacgcgcacaagagagggagacgtgcgcgcccgcgcgcgagcgagccctccgcctcgcgactcgcagcagcacgcgaaagagcacacagtgcacacagcgcccgaccgccacagccgccgcggagacagtaaccgcgacgccacgnaagcgacagatcagagaccg

SEQ ID NO: 9794 - DNA, 1693 bp, Homo sapiens
  misc_feature (1)...(1693): n = A,T,C or G
gcaaacaggaagtagtaactagacacaagctggtcgagtgcatgacgctgcgagacgagtgactagtatacacgttnctagtaggcttgagaggagagagaaccaagaagcttacaacgtaggttttggtaggncgcgcggcgcaccgaggagggctgtcgatcaagttcatatatgagcgattgagttcatatcgatagactcataagcatatgtatgatgcgcctcagttatcgacaactcaattacatgcgctagatgcaatcgatagatgcaataggcacctcgttgcggcgtccagaccgcttgcacgcggagtggagacgatctgcaccccaccgtattcgaggtcgaggagtattatgagaattgctggtgttgctttcgtgtgcgatactaaatctctccctcgnacaagcgctgctagtaagtctgaagagagtcaagcatgtcatgacattctaatagtcctctcctacgagatcagttggcacgacggcagtgttactagtgtccgctgtatatatgaccgcactgttataggtgcttcgtacgataaattttctacgcaggtagangcatatgtatccctgcatactctacatatcagtctcagatatgatgtgatatgatcactgatctgtgctggcngagatgtgcagcgcatcgcgcagcnagacctacacacagttcactaacagacgcagcagtatanatatgtcngcgtcgatgcgtgcgcgcatgcgcgcgtgcgcatgntgtagtacgtagtangcagtntagatagaatatatactnatgtacggcgnacagtcgcgcgttatgtcgtactcacacacagccagcagatcgtggccgcgacgtcgtcgcgcntcgcatgagcnatcgangnancagcgatnactacatngtgtatagtatacgagaggctagtgaagaaacgtaacgttctcggcgtcactagcgtcagtagtagcacgtgcgtttcgtggacgttgatcatctgactgtcgtgcctattacatgtagcatatgattacgtatagtgaantgcgagctatatancatatggtcgtagacgcgcatggagcgctcgacncacgcactcacgttcagctgatatatatcgccnacgacgctgcatttgatgcatgtgaatgactcgtgtcagactagtgcttatgcgctagtagatgatangcgacngccatgtgtcgacctactaagagtgtgcgatacatcgagtggttacgtacgctcgacagtctaatcagcngattgagcgacgatgtgtatccgatgagagtatgtagctanattattataganagcacagtaagnaccatgacgtatagttgtctacgatccatccctacacttcaccctacacggnctcagtatagtgatgtaacatgagtatagcgctccgtgcgctgttcactgcgcagagcgncttcacncgccacgtatagatgtccgatcggttngttatagatatgtaatgaaangcttangcgcgtgtatcgtatctcatnantcacncaactgcacangagtgatgtatatatgngtatcgtgagtatattttntgaagagcgagtcatataccgagagtgacaggtgntcagcacatgtcgtgtatgatnatatactggtgaatgtcgctctagagtcggtgagtatattctnatcg

SEQ ID NO: 9795 - DNA, 2315 bp, Homo sapiens
  misc_feature (1)...(2315): n = A,T,C or G
gtacgagtaacacgtcgcacgcatcagagcggataccgacgcgcatgatcctccacgacgagagcagagcacacccaggncccccctcaantagaagagacgactgnggcgcgcgacnagaggcccctcagangnanggngcgggagaaacagagaggacgcgagagcggagtgggaaatagnggtagagtatgantgcagaagcatagtacacgccngtctctgaangacgacctagcagacncgcgatgagagatcagcacgaggagatcanancaatgtcantagttnagtagtcggatgcgctgnctagcnatctgcaagacgatccgagtangctcaccaccaacgcacnacgnctcagtcgacgaaagcagtatatagtgactgcatctgagtacgcagncagagagactgtctcacagcngtcgaagngtnntgcanagtatgctcgcgtcacncgtcgtaatcagcngnnatgntgngcnagntancatgccncgtnagaggancngattanacntanantcacatcatgagaccnatcnacgccagcccggcctgctacacggtcatgntaanagcgtactagtcatgcaatcaagttaggactgccgtatgacgctacatccagcgctccgctatcgtgtcgtatatcncgactgcgagcagagatggntgtagtcgcactaanacgcatgctgcgtatcnacgtcaacanntctgcatcctgtgccgcngnagcggccgacgcgtgtactcgtnatcngaccgtcnacgaataatantagtgtcagctctgctagacacgcgacgcatagacgcagtncgncatcgacgatcagcgacgancgantnncnnatctgacgntcacnctcgcagcncatgacacatcgcaangcatcacgtcnntagtcagtgnacgatncatgatantggcgagaagactnctagnctgncgcgttcggtntantgcccngatnacatgangtngcgatcctgatgcgctcnagnattctntatgacnactacgtctgtgngcgncgtctgcagtggtgcgcnacnnactactgttcacctgcantcnacgtcgaatgagtgcnatgttgnncntcntcgnancangcgatgncgncgatgatcangtacgtgtgaacgatntcntagatantcgtagtntcngtcgactntgnatcagagtccatgnacnntcgntgacagcgnctcgagcagtacnagcatgtncagatagccaccggacagacnacnngnctcgnccacaatgcnangcgatgactgagcactgtncgatgcagatagacncagtctgtacacgntcgagacatcatcngtacgctctcgtagcttcgtancantactgatgtcgatgagntgctgtcctgctgncacntcntgcacatcagtctactgctnccgtagccngagcngagtagtccatcagcacgntcgnagcagantatacagtcngcngcagtagaactaacntcatgagatntcngcggcgcgcagcagcttcaatgagtcgnncgtcgancancacngcaacantcagctagataannatcgacnactacagcgtcacnncgcaactgctctanggnncaaagtacgatgntagatgacgntcgtagnacgctgnagncgcagancatcagnctgcgtcagccngagtccaagcagangcntgctncncancgnacatcnacggatcgtgtagctcgacgacgtnagnatcatcagcatagtancgtatgacttacgntgatgcgctagtcgtngnatgcagcnctgcnacnatgaccgngngcactgaagntcnntcgactagtacactacacagcccgattagtatngatcccgaccgacatctatcagatacgtcgatcagcgnantaaattcatgttccnagcgtagctcgtngagcatangcaanntnngnatgatcatgcgaanttactnagcaagtcagacgcgaccgatcacnacncagcngaactcgtctcgtcgtaacngtcatcaacgactgcgtcgtgntgactggtanatatcatcataagctgtactagttgcacacgcgacngnagtcatgangtcncgagatcgctntgagcngctancagntcgactantagtntagtactgncgntgntcnactcacncancactatatgccnttccnctactngactancgacgaaaggacgtcnacgngcagtgactagtgatancaaggtaggcatcatcgnagtccgcagcagcagccagatcacatgatgatgtgatgagangatg

SEQ ID NO: 9796 - DNA, 1650 bp, Homo sapiens
  misc_feature (1)...(1650): n = A,T,C or G
gcgaacaggcgaggcgancgggcgagcagcgagcacggggaaagggacgaaaggaaaagaagaaaaagaccgcctttangaaggancnaatgngagcgccgccanncgggcttagacnaggaggcgaacaacacacgaagcgncagcagncacgcagncaagcgagagcgcagacaagcaacgacngaacgacggaccacagccagagcgcaggaccgggagaggagacggcacagcgcggggccgggcccgcgagccccacccaggacgaccacgaagcaggcacacggccgacggaccgccgcaagcggccggaacgcccgacgccgcgcacgccggcgcgcgggccgaacgacnacgcagagagagaagacaaaggagacgaagagaaggcaggggcggaagaggcagcgcagggcgcgcancncgcgacgcacgacgcagcctcttttctttctcaccgcagcgagcggaggagacgaggcgcgcgaagagggaggaaagngacagagaggaaagagcgacacgacagcagacgggagcgagagcaacagaagaggcgaggcgcagagcgaggagcagcgccgcggccaaacgacacgagcagcgacgcaccgagcacacgaccagcgcaacacgaccggcgagaacagcggaacagaggccagacacggcacaaaaggaggcagagcggcgagagggagccgcacagagagcgancgcgacgagagacgcggccgcagcgaaggcgagagacagcccgcgaggaagaccagccagncgccggaagctgcgacaagaagcaaaagcgcgaggagaagcggggcgccagcggcagagagcggcgctccacgcggcggccgctaccgctgagcgccgcgccacccgcagcgcagagcgaccgacgccggagaagatgagcgacgacgcggacanctgcgcgagcgcaagggacanggcagaggagngagcagcacacaagggcgcacggcagccagagcgaagcncagagcgcaggcacaacggaagaaacgaaaggaagnaacgcgcgccggcacaggancgacgaacagacgcaggacgagcgagcgagcgcacgaggacgngccagcacgacgcacancgcngacgacacngacgcagccgcgcagcgatcgacagagcgaacacgcagcgcangcgcgcagagccacgcgacgcgcgcgagcncgcgcgtgtctcagccgcanggcgagtagcgcaggatgacgaggacgnagcgaagaaggcggacgaangagcantagacagagcgtganacgcgctaccgcgcggactangaganacngncagcgnagcagaaagtgcgcgcgacnagtcgcgcgacgagagcgaagcggagagcagctagcgagangcagcagcgagcgcgcncagagcggcngcgtagcgagacgacgtagcgcgcgacgacncgggcagaagacacagcaggatgagcgcacgcagcaggagcganantaatgtgctgcgcgcaggnagcagcanacaacangacgccacgacacacatcgagngagacggcgccggacgcgcancgcncgacgcagcgcaacgggtagcganagcgcacgaagcgagaagtagcagcagcacgctcagagacgctac

SEQ ID NO: 9797 - DNA, 1131 bp, Homo sapiens
  misc_feature (1)...(1131): n = A,T,C or G
gaccggcgcagcacagcacggcagaacaccgcgcacgagagatgcgcnagccagagggagagggnaggggccttgggaaaggtnngaccngcggcgccgggagngccttccgnagagagggagaaaccancgcncacaccggaaggaagagggaggaggcgagcacggcaggagccaccggagcgcgggcgaaggggacgcgccgagagaanagggaggaggaggcgcagcgagaaccaggcccgagccccgagccacgcggcaagcgcggcggcgaagggagcggaggncggcggcgcgccagcgccgcagagcggaccggacagcgcacaggcggacaaagggacagcccacccccacggcaaaacacgcacgagacgagcgagacgaacctctctttaaccacacaccacggcaaagaaagcgcccacgcccagcagacacaaccaccgccgccgccaaagagcgccgcgaaggaagcaccaccgccaggaagagacggagcagagacacggaagcacagagcacgcggagaccgcgagagcagaagacgaagaggcaagcgaagcgcggcgacgcgagagcagcgacgcacggccggcagcacaacagccacccggcggcaagcaggcggaagaacggaaacaaaacacacgcgagcaagcggaagaccgcaggccgaggaccgcgcagagacaggaccccccgcgcggaggcagacccccccagaagcacaccccacccaacgagaaccgcccgggacgcgccaggacacgccacacgacccccacgagcgcgacgacgccccccgcgcaggcaacgccccccggagccaagcaacgccgcggagacgcgacgaggcggcgagaagcgagggacgaagcggagccgagccggaccgcgggagccgaagacaaaagacgcgcaggagggacggacgcacgcggcgaggaagacagcaggaagcccgcgcgacgacaagcggcgcgaggaggcgcgcagaagaacagcacggcgccacgccgagcccacccgcgaggagancacaaagaacgagaaagaagaanaccgccgcacaccgcgcaacgcccgcgaccccgcacccgaccacaccccgcccacagaaacacg

SEQ ID NO: 9798 - DNA, 1433 bp, Homo sapiens
  misc_feature (1)...(1433): n = A,T,C or G
acagcacaacctcttctacacctttcgcaacaatacactntcctcattcaggacgaagcgtgacccttacgngagggtgacaatggcgcaccacagaacttaacgnagaacgaagaaacccagagngtagagtattcgatgtatattataggaggattaatgcttctctatacgtacctcgcatttctcacgcgtgtccttaattagtagtgccatagtcaaactatctacgagatgacgatcacagaagggactacgccgactatgagctaccgccaccaagccgcaccacgcgatggcgtcttagttgtcgctaatatatgtgcaagaactacgcctcgcccatgtgtatttatgactgtaactaaccccctactaaagtccacgatatgttgtcgggtcgtgtaagtttcttgtgacagtctnagcgcgcgaattcgtgatgtgcgcgctgagatnacgtgcccaccgtctcgatagcaccatcagaccggcgttgagccgatacagagcatccatcagtgacgcatacaccagttctatatcacacccatcagcgaatctgatactaatgtgcactgcgactatgcgctctactacactaagtgcgcgtaggctcggaggcatacgtcataagtacacctctcatgacgtgcttatcgattgctatggcgctccacctatggttaatagtcgatacttagagtgagcagagagtgcgaacatcgcattcacgacacacgcgagtcttgtcgttgccactgcactcgtgatcgcatggaggatgaggcgtgtgagctaacagaacgtaagatagatagatgagncgtaacatatatacgagagactnagcatgccgcacacgtctgacgcagctagtagtagncacgtaatggatanatccgcatcgcattactcgtctcgtcttatcgtggtagtatatctcgctcgagtacatgactattacgcgccgccgccgattattatgacgacatcatagattagcgctccgccgatgctcgcgtcgccgactagtcacgcgcgtcagtcgtccgtgctcgncagcagtagtgagaacgtcacatcttatacatcacancgcgtccgtccgcctcaactgcatataatctctcacgaagangtagtcgcaaggcgcgtcgcgtagtagtagtcataaacacacaccactgttatgtatgatgtatganagatcatcggtctgagctagcacaatacacccctccnatgctatgtcacatagtattgtaagtatattatgtcctaagcacctatgtgtgctacctcgcntgtctaactgctcatgntgtttgattcgctttatgtatgagatcgttcgctacacgcgagaagatgcngcgctctggatatgctctctgcgtcacgacgtcgtgtactctgacatagaagtgcta

SEQ ID NO: 9799 - DNA, 1509 bp, Homo sapiens
  misc_feature (1)...(1509): n = A,T,C or G
cacagacacacacaactctactccagggacatatatagatcaccacacaccattaaattatcaactatcatcacttacactttacttggtaaccctgantaccactgcncggcatttacaagactgcgactagcgccctgtagaatatcgttgagcaagagtcgtgttgtatgcagcggaagctatcagtagatctgcntatcattactatcccccaggatgtcccaggatatacagtacgctcgggccgaaggaagttgaaggactnagagtaccgtcaggaaatagtattccatctgatgaatcggcgtgtgcgcgtctgacgaacgggngcgcatgcgncatctcgctagtgtgtgcatctcgatttacgcgtcatgtagaaatgcgtcctcgcnaccgcggcctaggtatgtgctcgtcattagcacgcgttggttcgtatgagagtcacagtttcatccgccattaagaggctgaacgactactcacatactgctgtctctcttatctagcctccgcacttatggctgcgcgggagatcaagtcttcgcgtcgtgccctcatcttatgcctcgcagctatatgatgtcagtgcctctcccacgctaactccacctgcggcatgcacgcagtttgtgacgatgtcgtaagccatatgtgcagcgaccgcagacatgcgaccgaagtgatgcgaagtacagacagatggttccgagagcgtgatcacccgcgtacatccagtatcaacaccgatcgcacgatatgaattagtaatagcgtgacgccttgcagcatcatctgcggacgtgcagacactccacganctctattcacagcctactactcctctcacgatgtctgcatcgatacgtcgtctcatcaactagatcgcatagtggacgtctcgatacgttactagtcgcactcgcgacgctatctaactcancataagtatatcgacgcaagacacgatacttcaatcatgaagcacgtcgcgtgcgtacgattatgtgcactcgcctcgagcgcatatnactattacgccncgaccatatatatatgaactaagagaataatatcgacancgcgaagcctcagcacgtaatcatatntatcacgacgacagcactgngngcgctgcatactnagtccattgcacagtacaatcgacaatcactcaatcctctcntactagtacacggactcatagataaatcacagatgcagtcnactagagcataccgtacaagcatctagtcaatgccaccatactgtcgtatagcagtcaatatnattctcgctacaccgcgagcccagcgagtgtagtatatgtcgnagtagagtaaatagaacagtacgcagcgcaagacatcaatcnaccacgcgcaacactgcgactcgtacgataactatcagtcttaatagatgcgcagcgtctatgcatgtatgcgcgccacgataacgagtagacagntggagttctnctctggcatanatacttattat

SEQ ID NO: 9800 - DNA, 1663 bp, Homo sapiens
  misc_feature (1)...(1663): n = A,T,C or G
gtgctgactcagacccgacacgttctaccactggatactaagatgctaatgccaaacgttcgaactccgatctgattcccactcacaacgacacgcgtggagtggacgaccacacatctatcaagtaacacncgctcgcctcccctcgacgcctcgatgcgcacgcgtatatctcttgtcgctatcgatacattttaagcacgaatctatcgncgtaggagtaaatatcgccctgtgagacctgatatagtaacaggtctccagcatgcaacaatctagcttgcagtacgcccaagtccacgcgtcataatccgcatgcgccagctccattctctctcactcagtcagcccgagacaatctatactgattgatgagagatatgccttcgatcgatctccctctccgtaacgacctcaccttccgctgcgccgccgcacatattccatcgcgcctcatcgcgctactccaggctgcgtccgacccgttactcacgaccgctctatgaattggtccaactcacgtttcggattcgatgttctcgagtagtgcccgcgcccttatctgcgcgcccgtacagcacgctctcgcccgccgatcatatgacagcggtcctctgtgatgttctagacgttatggctactctataacattctctgcgtataccagtgtatcgctagttgccgcctcatgacaccnacgagacaccgctcttcctattgggtatccgtcaataagacgagttatacgacggaatacactgacgcgaccgtatgcgacatcacgtcagatatgcagtgatagttaatgtgtactattcctctgacgtataccctatcggacatctcacgcaccactccgtacgcttatccacgctctggagtcagactgacggaagagcgccgcaatcgtatccgcctacatctactcgcagctcgcactagtacatattnatctgtggcgggctccgacgcgctgctataatactgtcagtatagacagctgcgatcaaggctgagcgacacacaccacgtcgtgtgctctgcgaccagagtgacatcgagcagcacggagnatcatataatgattagcgacgcgctcctgagtanattgcgagagtatatgatagtcatantnatgcgtctatnaccgatactgtcgtcacatcgtacgtagcgcgtcctntatatgtatcgnctgatctcagactgatgatcctacacgtatcaatagctgcgcgacatgccactgcgtcgcgnagcctaccatacaccgatactatctgcgcactgatctgtagagcgcgcatagcgagttcacgtacgtncgcctcgatattatcnancaccncactagcgcagatgtatctattagactatgatactagtacatgancgcncgnctcacnctactctgatngagctgactcactgatcatatatccgcgtcggtatgtagcgtcagntantgccntgtgatcgtatctgctgctcgcgttctatatccaagtcatcntcgngatctcacgtcacctgcaatacagtgtgcacgcgcattagcatatgtatgtccagcacgcgatcgtcaacagtacatccgcgcactcgttcgttatagcgatctgcgcacgcgancatcacgctacgatacanatctacagcatat

SEQ ID NO: 9801 - DNA, 2000 bp, Homo sapiens
  misc_feature (1)...(2000): n = A,T,C or G
attacggcgcataagctgtagcntcagcnctgactttccgacgtcgatagatctgtattcgcggactgtagtgatataccntactttgccgagataggaatctgatcgagctgatacgagcgccaccatgtgtccgtgcagattgcatacatatgtctgcgccgcgtactggcggtgcctacggatcgctcgcgtactggagcntggacacgacatgcagacgatagttatatgtnaccagacgttatangaatcatatactctctcnatcatgatgcgcgactgactgaggcgcgacttatagtgtgncntgctaagcagcatagcgacgtatgtcgagatcgcgtcaagtgactgcagactacttatcgctacatctcaacgagtcagtcccncttataatatcgacgagtacagtgtcantcgngtagctctncatcatgctacgacgcgcncagtagcagctgtcncatgccgctatngagacgactgtctantcgtgntccgatagcccagactccagctgtcgcgcccgtcagagacgtactaaatatgaatctcggtagtgctagtgacagcgcaccagncgagtcgatattgtcgatcgttacatgatgtctagtgcatgatcaagggacggcgcgctatagcatttagtaatggtggcgctcagcctaggatcacggtcacgcgcgatctntgtgtccagcgcgcgcgcgcgtgcacatgacaccgtgacgtgggtcgctncatggcacatgtagctgccattcatgtacgtcgctcacgtgtagtagtctccatacttatatgtcgttgaggcatcgacgacgcgctcgcgccgatacgcgcgcactatcagtccctactccatcgcgcacgttagatgagatcgatcgcactccttgtgngtcacgctgtcgtgcagtatgctagtagagagtgtctcgagcatgatagtctctctgatgtgtcagttgtgccntcggtgaatcgtgagcagtcgtaggctcatcactgcacgctgatgttgatatactccgcgtnactgctgtcttcgtacacactgcctgttatcattcgtatgagacgtactgcactcagctagaacatcggatatacgcactctcgctgagcgacgcacgttaacgtatantncancgcttgctgcgtagatgtgatcnctatcanatnagatanatcgtnatgagtangtatntactntacgacntggacgtctatacagctcgtagtgtcggtacagacgcacagagatgtncgncangangnacntcnanagtngtattagtatgagtagacncgcgacgncagccgtcgctcattancntcntacgcgtagtactagatatgagagcgncgtctcgtnactctcgcgatatcnagtggcacgacatataggacncgcgatcactnagtggtngatatactcnactgaccagatgtcagtagntcntgtctacgtgtcgtgtnactctgctgatggatgntgacggcntggcagcgcgcngcagngcggtgctntgcagtgtagtatntgatctatgagcgatatacatgatgcgcgactgcacacagacggagcgngtagntctgcnagtctatgctccgctgcccgctcagagtnctcgtgagctttgntantgagacattatgtcgcgtgcgcgcncgatgtccgtctagtcgatgtccgancgctgctagtgatngcagtagtccnactgctggttngttagatatgnacgatctatcnttcnatcntacgcctnctctagcgtgcagntgcgtcgtcactncgcngacgncagccgatgncatgagcagtgtatgatcntgagcacncagctngtaatttnnagtanacncgcgtcgtgnttcacgtatgatacatcttgtcacgctncattgnangttagngatgattgagcgatcgtcncnagaacgntcgacgctagagtacagtagatgatatctnacttnat

SEQ ID NO: 9802 - DNA, 1042 bp, Homo sapiens
taaccgttaccccgcatcgcacacgcccatccaggcgggaagcgacaaagaagaacccctggagagtgaacacatactctcatgtgaggtaactgcaacgaggggtgggacaaggaggccattgctatcacaggcagacgacagtcttcatggcctggaactgtgtcctgaaggcgctatccaaacactgcaaggatggtggggagcgcgaaggacagttgaacataaatcgatctctagacacactggtatggaataggtgtgccgccgttccgagaccaccaccatcccaacgcagccccgccgcccgcctgcaccgcccccacctcccttccggccggggggggctccaacccacggaagaaccggcaaagaccagggccccgcggcgcgcgcccggagtccccccgccccgcggtcgccggaggagtcagaccgccgaccccagggcacgctcacacactgacaacccacacctacgcggcgtcgcagcagcgagccgaccatcgcgcacccccggccccacacacaacgacacgacacacaaacccacggcaaagcgcccgtacaaaccgcgcagccacccaatcgaacacccatcgggaacgcgtccccccgccacgcggtgcactgcccccccgcgccgtacccccccacggcgcaccgcgcgcgcccacgcgcactccgccccggcccacgccctatccgcgccaccccctccgcccaaccacaccggacgcaccccgtccgtcccgtgcgacgttcccgccgtctcattcacgcccagccagccgcacagaccggcgcacgcgccctgcacataggcacccaacgcgcgcccgccccctagcggcgatctacacacaccgacgcagctacgacaccaccgcccgaagacgccaaacgcgcaagcacacgcgcgacctcgatcacccacgcgacccgcacatccccacacggacgccggccgtgtccgccgcgcactttcgagcgaacgtaccacgactagccacctcgcgagaccgtcgacgcagtgccacca

SEQ ID NO: 9803 - DNA, 1210 bp, Homo sapiens
  misc_feature (1)...(1210): n = A,T,C or G
caggagcgacgaagagagacaagtaagtcaaagagacacaacgacacacagacacagaacagaacacgagcannggacgccttttangnacgngnaancncatnagcatctncactgttcgagagtaagctcgtcaacggagnggnagtgggnacgcagagaagcgccaagtngattcatacaactagtgcagatacggagcacgtcctctctattgccactcgtatacgctaggagccccgtcgcatacgcgcgcttgcatcagcaatcactgtgcacacgcagcgccagtggggcgctgagcacaggaccatgctgcaaccatgcagcgacgatcctcgcgtacacacttggctatgcgctcagagtgtcgcngtcggttctcgccgtacttcaagcttaccttcacagcagcgccactgcccttctcgcgcccctgctcagacctgagccgcgtagtctctctcantgctacgtccaagcatattncgcatatacacccgcgacgccggcctccacctccgtgctcgcaccacgtccggtcactatctcgtgcctgcggcctcggccacctccacggccacccacatactcccttgttgagttcgaacgcgcgtcacaccaccaacgacacgaccatactgcacccccgacatcctacacgcgcgcccacgccgccacgaccgtgagactacgctacacggacactctacccgccactacccctcacacngcaccacaaaccaccggcaatctgcaccaccaaccaaccgccgcncaccaacttgacgtcgccgacctgcgccgcgccccctccacggcaccacccaccacccaccactaccaaaccatccaacaccgagcggccgaacccacccgaccacccgcgctccgcctcctctcccctctcaacgcgacaaccacccccgccaccccgcccacccccccctcccccgcaccccacacccccgcacaccgagaagccgcgagccgcgacaggcacaccacttcataccgcacacctccgttcccgccccccgctccactgcccccactccccgtcgtaatctcaccctgacaccttcagacaatacaaccaccctacctcccccacactccccccccccaccccacccgctcacccgccacacacccccacaccccacgacccgcgccacaccacgccaacacaagaacaatcgctcatcag

SEQ ID NO: 9804 - DNA, 180 bp, Homo sapiens
tatgagtaatgtattggttggttggaccaaagcaaatagtacgagatgacgggcaccggttgagataacgcgggggtagggtataaaagagcagcatggattcctgaaacgtaaaaaggcggtcagggacctggtgactcgacatattataaagcagcaaagcgtcccagagggattaac

SEQ ID NO: 9805 - DNA, 1669 bp, Homo sapiens
  misc_feature (1)...(1669): n = A,T,C or G
actctagntatatgcgttgactgcactactgatcacgacgtcgctactatacgtcgcgtcgtgctgtnctgcgatactcganatgactacatcagtcntgctacgtnctcgnctcactgtgtatntcgatcgtcgacgtcgtctactctnacatcacgtctctacgactctcagctacgntactnctcatactnttactatctcccacgtcggattctctactcgtgcttcgtgcaactatgtactgctctacgtcgtcgcanttgngacatgacantcangactgatgtcgactcatctttcanctagctnacagatatcgcgacgactcctcgtacgctcagctctcatgctacatcgctagactaacgcatactnccaaccactaccgcttactcatacttagatctacactanntagncganagtgtaggctctcantgtgtagantagactgntcgtccgatacgcatctcacgctgccgcgcgatctctncttnacgcactatcgctacgtcagacacgctgacgtgattggacacgacatcactctctagcatactacactgggtctactgcaagagtnagttgctgttacgactcatcancgacaggtcacacactcgactgatatgagngtagtatctancatctcatactatcaacacaccgactgttntcatccatctactaccatctctcacatatatattaagtcgcgcactgtgtcaacactctatngccactagaaatcagtactcatgcggagtcgtagtagaaacgcgcgcgatagcgctcgcacgagcgtcacactacagcacacgtgcgcgtgcanactctacgcgatnaatctctatgagtaagcagtgagtgcatccagactctgcgctacgctttatagtgnatacgaattgtcatcgttcgcgcactacgcttgtcggacttatctgacgcggtggactactgttagacgtgtcatngtcggtctgtgacacacgccttactctgatatggtatagtgctcgcncgtgtcctccgctctctctttatatntctctctctctactctcatctcaattatcttctatatacctcatactatanatctactctaatcgcgtcattctctcgtatactcaaatatatatatactatatctcaccaccatancagtatatcatactatcttaacaactactctccatacttcacactctcaacatctatctactttcctatttcctaactgaacatttataatattttattcgcgtgttattgatatcgttgtcttacataaacttaattangtcttctctcttttctctctcatcttataacatcgctctgcgctattatccgccctcctgctgtgctctcttctgcggagaagagatggaacgactgattaagangcaacactcttcagattatctaactcgtgcacctcccaccaacgatacgttggtaatacagtaaatagagtttcatcatgcgctgctgatctcgcggttgctgcatgtgagtcggccatagtgcttctgcgtatcgctctctcttctctattaaaagtattcccttgcgcttccgtcnctctgtaatttctgttttatagatgtttatgtggtgtctgccctgtggtctgttttatattttaggtgtttttttt

SEQ ID NO: 9806 - DNA, 1723 bp, Homo sapiens
  misc_feature (1)...(1723): n = A,T,C or G
agaggaacgaacaagtacacgctnagcgaatcagattcgacacgcgtcgtcatcgtcacatacataacgagacgccgcgtgtattatctgtttctncgtcgcgcactcactcacagcacgcccgccncggacccagatatatctacatcactgcanntcgccacgccaccctagtgtccttantcacacagatccatacgcaatctattacgttatatactgacgangnacagtactaaancncacgaggagacagcagtacgcgataaatcgatgtgtagcgccgngcatcgatgtgacccgggcacaactatggactacaccagtgaatccaagtgcttgcgatgcacgnagtcgctagcngtcataccacacgtacgactaatgtagtgctcgcgtctatggatcgaganagtngatcgtcagtggcgcggagcaatcacgcatcagaatttgcgatatactgccattatanttcttacatagccatagtgtgaaacaagatcgatagagtgactcgcagaacgacacgcangtgtagtctcttgcgcatgatgagtgtgtacatcgactaagatnagcncagtgactcgatnagcagatngtctctagttataggtgatatatgacagagagatatctaacgagagngntgatacagacgcagcgccctcgcgcgatcatatcagtacncgacagagtatgtactatgcgcacacgttatcacactgattngacgacatactaacaactctacacacttgtctcatcatagttggcatcgtcgntcgatnagtacatatntctgtcattatatncggacggcactcaccgttcacatcatgcgatctcatncacatagtcttgactacgagtaaggatgcagtactatcgncgtcatacgtctcacgnncatacgaatatgctctgtacatcgcactcatatacgtctattcgcgcagatcgtacgaagatctgtgacgtatgtacgcgagcagagcatgtaacgacgcgagcactacaccgtaccccactcgctctcgcacgtcgcgcacactgatcgtgatgatgcgtcatggatcgactaacgagacacatgactcntcatatgcgtcacagtgtcatcttgatctgcgtcgcacacgngcgntgatctcgcgcatctatcgtactatcacactatctaaacgtgacgcagagaatatgtgcgatgctcgtcgtcgcatatatagactcgtatnctccnatccatcatattatattccgcatcaccacatgtatgatattatataataagcttgacatncgagctcatagatatctcgcagcggtcagtattacacgcacacgtgaacgatcactgcatggtatacacagtnacatcacattataaatcacactaggccgccgcggcgagaacatgcatgtattatatntctccagatntacatcacgagagctgaataggtggatagcagagttgtatctccgcgcgacacgtcagagataagatatataatcactagaatgtcgtacattatcatgncgcgtcatgtgtatcacgattcatatagantctnatccactctcgtatatcatcctcgccgctcgtgtaggagcagctaactcacgacacataatatatatactgcagcgtacatctctcgtactcgcaccagagacatataccgccgaccatagaatacgacatgtagagatatat

SEQ ID NO: 9807 - DNA, 1610 bp, Homo sapiens
  misc_feature (1)...(1610): n = A,T,C or G
cctcgcgttaagatgngtgtgnnncaatcctanancagacgctcataggaggntcgggtcnagnnagnngaacanagnnnacacacannnnngannangnnanntnnngatnatnccnncaaacagtatcgtgcgtntactctgtatcgctcagcgtcttgtcccactgcggccgcacacggcggcgtcgttgtgcgacacgacctcacactactctatngacgtccgtctctgtacatccactctctanatatgataacgctgtcgagagtttagtagtacgagctcgatggctagtggcagagacatcataggggctatgtgagtaggtcgaccgtggactggcggcagcggcggaacgcgcgttcgtagccatgcagtaagtgtgtgagcagtgtgacactgtgtatgcgacctccgattcagctgacngcatctcgtcgccgcacatccatctacgcgcccaccacgctatatcttctcttcgacaacacgcgagcggtgtcgcgtaggcagcgtagaacagctgtataatgtacgctacgtagcgagactctgcagccgtaacagtcatacatatgcacgtagaagtagtgtcgcgtatagtacacacacgctaataactcaaagtcattcaacatgccatataccgacactnctatcgcgctctatcaggcgcgtatgggtgtgcgtaagagctctacagcactcgagcgtgcccggacgatgtcgtcgctcatgcatcatgcgtgctcaccanctctatacgtgcacactacacagctacgaacgacgcantattatcaatcgagcaacgcgagactatactcacacgacgcgcacatganagcagaatgatgatcgaagcgcgcacacagcgctgtatctgtgtganaagtaggtatgcggtgtcgatatgatgacgacacgacaccgacatcgcgcatagagatagaacgaagagcgcaaagagacgacgagctgttcagccgcgagagacatctcgctcagtcgtatacgatacgaccagcgcgcggttcggcctgacaaccgtgctcccgcttcgtagagcggaccgcgacgtcgcacgctcaatcatcacaacaagacttctccgcctactatgacagatccagcggacnagccgcaaggcgcatgcncagagaacangagaggcgatantgacacagtaatgcataacagacgacactngaacatgctatatacgcactccgcaccactcgcatacttcagcatcctatccgtctcacgctatgtaantaatcgcatccnggcactgcccgacgcacgccgtcggagcntggtgatcacgacgaactcatccacatgacataaatatgcgtcgcgagacagcgcacagcgcgcagcgagctgaacgtgagagcgctcgagagctgatgaatacgcaagactgtcgactcncgcgtgcgctacggctgctgtagatgttgtgcgacgcgcacgacagagacgngaatanagacagtcgacagangctgancaacnctgtcggacgataagctgncgtctcatcgtgtgtatagatacggtcagctggtcacgantgaccngcgcgctatgtgagtgat

SEQ ID NO: 9808 - DNA, 783 bp, Homo sapiens
  misc_feature (1)...(783): n = A,T,C or G
ctgtctatggaaatgatgttaggtcaaaaagcaaattcgagcaattttcttattcgagtttgaaatgggtcataaagcaatggagacaactcacgaccatcaacgacacatttggtctaggaactgctaacatacgtacagcggagtggtggttcaagaggttttgcaaaggagacgagagccttgaagatgaagagctagtggccagccattggaagttgacaaggaccaattgagagtaatcattgaagctgatcctctcacaattacacgagaagttgctgaagcaatcaacgtggaccattctatggtcctttggcatttgaagcaaattggaaaggtgaaaaagcttaataagtgggtgcctcataagttaagcaaaaataaaaaaattggcgttttggagtgtcatcttctcttatgctacacaacgacacgaaccatttcttgattgaattgtgacgtgtgaaaaaaagtggctttaacacaacaaccggcaaagaccacctcagttgttggactgagaagaggctccaaagcacttcccaaagccaaacttgcaggaaaaatacgtcatgctccctgtttggtggtctgctgcctgtctgatccactacaactttctgaatcctggcaaaaccatcacatctgacaagtgtgcttagcaatcaatgaaatgccccanaattgcacgcctacagtaggccctggtaacagagagggcccaattcttttccatgacttcacctgaccatacattacacagccattgcttcaaaactg

SEQ ID NO: 9809 - DNA, 470 bp, Homo sapiens
ctagttgcagcacagagctctgcctcatggtcacaggatggctgctccactgccaggcatcacaacccacttcagaccaaagaaggcctaccagccacggggaaggccagccaagacttcctttaaaaggctttcctggaagctacactagcaggttccatttgcatgtcatggggatcaactcacgtgactcagttctgaacaaacacagacagacacacggagtgtctagcttcaaacgtgctagcttcaaactccacgtgggtcgccttcagcatggaagggcttgttcctgtctgacctcagccagaagtcccgtgcaaatcacgaatacccacccagggtggtttataggagagatttatttgaagaaatattacaacatataaaaactacataaagtcttaatttccactcatacagtggtaggtttgatataatgcataataaaaaacttttaaaatccaaaa

SEQ ID NO: 9810 - DNA, 1297 bp, Homo sapiens
  misc_feature (1)...(1297): n = A,T,C or G
gagggaggaagaggaggaggacaagaggaagagcgcacgaggagagagcgcgcaccgacgngacgaaccggagaggnccctcnggnaagangaggacgagggcggcggcgggnggctcgngnggaggggaggagagcacngaaggacnggcgggaggggagagggagaagagaaggaagaagggcaagacgacangaaagcagagaaaagaggaagaaacgcggggagagaccaaagagagagagacccgagacgccagacgaagagggagcgangcgccgagacacaacaggcaggaagagaacacgcgaagagagcggagcgcacacgancganagacaccaaaaccgaaaacgaagacagggacaacacaccaacagaccaagcggagacagccacccgccgccacaggacaggccgagacaaagacaacagacagggagggatttttggcgaacaagcgcagggaggaaggacacagaggaaccagaacagaagggcacgaacaacagagaagccggcgagaagagccacgaacgagagagacgagaagaaggaaaaacaacaccacacagagacgaacccgaaagcgcaaagaanaagaacggacaagaaacaagggagacaacacgcgcaagagacaccaaccacagaaaacacggaaacgaggcgagagacaagagccaacggaaaccgaaacgccaaagaagtagaggcagagcccaacacgaacgaacacaacaaaggccagagaagagagccgagaaggagagggggaagcgcgcagagagaagatacaaaaggcggaacgcaacggaagaagaccgcgaaaacgcgcacaaaaaggagaacaaaagaaccaccagcaggacgagcaagaggcaggagagcacgcggtcaaagagagaccgcggagacncataaggggaaagagaagaagagcgaaacagaaagagtaacggacgaaagacgggaagagaaacagacaaggagagagggagaacgacacgcgacgcggaacaacaacacgcggacgaagagacgaatgagcgacaacgaccccaagacaacgacgcagaacaccaacacaacagccaatacaggggaagaaaaaagagaaggcgcgacgcgcaaaaccgcccgcacaggaaanacaggaagagaacaaagagaaccagcgcacaaagatccagacgcgggaaacanaagacagatgagacagacacaagagagcgcagcaaagcagagcggccaagagagagaagagcagcaagccacaagagagacagcaagaaaa

SEQ ID NO: 9811 - DNA, 221 bp, Homo sapiens
  misc_feature (1)...(221): n = A,T,C or G
tgaaactaccccgaagaccaatttgagacacacaaaatatttgtatgggtgacttagctcgangctccggggttccacagaagatgctgcagaagatattttccacattaaagaacatttgatctgttccaccagtagatgaaccattagcagaagcaatcattatcagagccagtaaaaggaaataaagaaatgaggcttggtttttaaaaaaaaaaaaa

SEQ ID NO: 9812 - DNA, 209 bp, Homo sapiens
tagtaagaacaggaagtagacaccacagagagcgctcattcagcaagcacaccaggaaagaccatgtgaagacacggtgagaaggtggctcgctcaagccaggatgagagccctcagccgaaaccaactctcctggcaccttactctaggacttcgagtctccagacctgtgaggaaataaatggctgttgtttacaaaaaaaaaaaaa

SEQ ID NO: 9813 - DNA, 1658 bp, Homo sapiens
  misc_feature (1)...(1658): n = A,T,C or G
tgaatcacttcgactatgctaattaacacgtgcgtcatatcgctacgccgtgcgctctacagacgtaagctanacgtcctaaacctntatgagaacaccaccnacagattatatcatatgcgaatagtattatagaatgttatcaatagctttaacgcctgtcacanatactataaatcaccangtagatcggtccatactgtcgagttgcaagcatcacgatcggcgtactcatagtagaccgtcngtttcgcttatatgctgcggtcgagcgatctactacatacagcaagagcnttntacgggnacagctgnctagtatctagagatgagcgatcgtgaggccagcgcagagatctntgcataccgtgtatctcatnttcgcgcgctacgtcgctctntanatgaagacactatagtgtatctgagagcatgtaatcaatgatagtacactataacatagaantgtatatgcgacagagtacgcacaatgacgcnccactgngtcttcagatagtgatgtctcgcntgatcatctctcattatgtgccgtgcacancacgtccatgacgcacccaccatcgcactgatagttatatatatagatagagagagtaacagaacgcagaatgagatagagtgaatgacgagacanacgacgtagcgactatgcgcactcgacacattacactgctgtantgagctgagtgtacagaggacgctatagtgngattaatcatactacaatgtagagtagagtgcgagacagagtgcaggagacacacgagtcacttgagcatccgtgtagacacnacntgatatgatgcgtatcattactagagtagccacgcactagtaccgtgacgcaagaggctctgtttacactcncgtctcacgcacgagtataacaaagagtcagacganactaccacgcacgaacgttcgcatatanactgcgagatgttacagtgcatattatagantaactcntatgtancggagtnacgtgcnaacatggacagacggtactacacgcggtgagatactggcactcattgataatgtgatgagcgatatagctatacagtctcttgagtcataagangcgcgcnagagatgaactcgtattcantatncacatgccaatgagttgatatcgtctgatgtctgctcgtgcgtgtcatcgtgtgtgtgtgacatgatgaattcatcgaggttacncncatcccnancgagancgtcantatggaaactgatacgcatgcacgatcnatgcgananagtatgtncagaganagatgtatggtgtattatccatcattgtatatagcaacgacacgacacacgctactatgagcgctncggtgtgtgttaactgctattgcgtgcatagtaagcaacaaatacacacctcgcgctccgnacgtgcagcatgccacagtagcgnactacaatagcacgatgcgcgtatactacactnagcatncaatcatatagagtctcacgcncctgtctgctaatgcgtatgancacngcgctgntgtgacgatcatatactgcggacactcanacctnctagtacagcagattttaatcgtagtcatagtantgtctattactcgcgtcgatatcatctcacactatatatgaagagtngg

SEQ ID NO: 9814 - DNA, 152 bp, Homo sapiens
cctaggtgtgacacaacatgaaggtggccatctgcacgccaaaaagagagcctttaccagaacctgaccattgctggcacccgagtcctggatgatccagcctctagaactatgagaaataaatttctgctgttcaagcaaaaaaaaaaaaa

SEQ ID NO: 9815 - DNA, 123 bp, Homo sapiens
ccctaggaggaacatgaagtcaagggtttaccatccacagcaaaagatgcttgccaaactcccaggttcctggcagaatgaataatgtgaataaaatgcatgtttagtccaaaaaaaaaaaaa

SEQ ID NO: 9816 - DNA, 170 bp, Homo sapiens
gctagggccccagaacctgcatccctagcaagctgccaagtgacctgctctagggatttctgaaactaaagaagggagctgagtctcattttgtatccttttgtcatttttttctcacttgtatatacttttaaataaagaatggaggctatttctcaaaaaaaaaaaaa

SEQ ID NO: 9817 - DNA, 320 bp, Homo sapiens
  misc_feature (1)...(320): n = A,T,C or G
catacaattacaaaaacactcgccaaatacaaaaagagaagaggggaggggcttatagcngacncgcccggaagctgagccggccgaacnnagaagaggaggaaaacaggaccggggaagaancaggggcaaaacgaagccaaacagagaacgaggagaaaagaagaagccaaggccgcagacaaggaggacncgagcgccacagcactccccgaacacgcccagcacgccgacagccacgaacaggaaagagcccccccccaaaaaaaacaaaattttttttactaaaaacaaaaaaaaaacggcctccaaaggcctaa

SEQ ID NO: 9818 - DNA, 428 bp, Homo sapiens
taggaatctcagaagcttgtgtccaggtgatgcctctctcagcctagtctctgagtgactcagcaagcagacattgcttccaacttgtgtcaaatatgtaacatgagcaatgaagaaaaaccccctttgcatgaaactgctgagatattggggtcatttgtttctgcagcaaaatctggctcatcctgactaatgcagctctaaaacatacagtctcagcacctgctttgtattgctatgtccagtctctgggtagaacctggatccacttgcccatgatccccaatgcagctacaatgacattcgaagaggaatagaggggaggactagagcacaggtgaacagggagtaaaaacaggaggtgctgagcctggggtgccccaccccatgagaataaatgttgctgggcttagggaaaaaaaaaaaaa

SEQ ID NO: 9819 - DNA, 393 bp, Homo sapiens
  misc_feature (1)...(393): n = A,T,C or G
ctctatttgtaacttcaggttngtgggtagaggaagaagcctgaagagttatcctccagcaatcattagccatgataagggcatatcttgcaggaagacaatgaagaccagacagtgagatcctaccctgatgatatcatgctgttatgatacagatcgacatgatgaactgcaaaccatcacggctcatgcgtgctaaggcagctactgcacgtgcagtgtcgccactccctccgtagttagggtgcccagactctggccagaacctccatcccctctcccatgatccccatcgcacctccacctgactccccccgagcactcgaggcgcacccccccgacctcagcctcaacaccgcatccccaacaccgacgcgcccgttcccgcgcgcg

SEQ ID NO: 9820 - DNA, 293 bp, Homo sapiens
  misc_feature (1)...(293): n = A,T,C or G
tgaggccaaagaggccatttttttttttttttgaaaggaaataatcgttttattcaaatgatgctaaattaattggatatatgtattaaagacatatcctttagctgggcatggtggtgtgtgcctttaatcccagctactcaggagactgaggcaggagaattgtttgatcccaggtagaatctggaatgagctaggatggtaccatggcactctaacgtgggtaacagagtgagtnctaggcatctttaaatttttatatataatatattttttttttatttaataatatt

SEQ ID NO: 9821 - DNA, 1025 bp, Homo sapiens
  misc_feature (1)...(1025): n = A,T,C or G
gcctacactaaccaaacaccttcacaaccatcaacagagagaagngggcggggtccttaaggcgaccaacgtgnaggtagaacattatnctcgnaacctcgaagaagttgacagatcataatggaagatacagagaaacaaacaggataatttcagctattatgatggacctttatgtattacagaggtgctatacggtagctaagatgaaaggaaagattacgatatagatggcttagtgttatatctagtggactgattatcgattatcagtataaaggaagaaagtaggtcgtctgcaagaaatcattacgaaggtagattgtgagagtccgttttccagttcaccagaggaatttactaacttgaacatcctccagcaaataatatgccgtccgaaacacacacactttgacccgcccacacattaatcaatagattatgtaaatccgcatccaaaatcatcacatatattttaagacgcggatcgcacagtccccctcgtgacgtactaaaatattctcctgaccattacaataaaaacgtattatatactacagcacattagcattcccccctcctattatcacctctctggccaccaatattattgacatcctagttgctcccaccgtaaacattctctcgctactatatatatagacatgatattctactcccgcccatgtcatctccccccatgcttacccggaggaccacttcgtatatgatcaacatacctcttattcagcggaggccgtaccagcagagccaacgcaactataagacaatatcaattacatgattgcttctctatttggagacgctgccgccacccctcgactcaaaaagtcaagcacattcgcgacgcacacatccccctgcctatacgtatcaactactaactcaagatatacacctntatcgtacggcgagttactctaggacgacccacatacaaacactcgattcttatctatgcccctcgccatatatactcttcactcttattttcgcgtttctcc

SEQ ID NO: 9822 - DNA, 242 bp, Homo sapiens
tgaggccaacgaggccatttttttttttttttgaaaggaaataatcgttttattcaaatgatgctaaattaattggatatatgtattaaagacatatcctttagctgggcatggtggtgtgtgcctttaatcccagctactcaggagactgaggcaggagaattgtttgatcccaggtagaatctggaatgagctaggatggtaccatggcactctaacctgggtacagagtgagatccagg

SEQ ID NO: 9823 - DNA, 302 bp, Homo sapiens
taggtgccccgggccaggacttcagcatatctttcaaggagacaccaccaagccacacagtggaggaacccaaagcaaggaggggccgggagcctcccacactgctcagacaggcggcccactcacaagcacatcacctgccggccctcgacatctgcggactagctagaggactgccctctgctccacctctcagggccatccagaagtgaaccccttgcctgtaaattctggcccattggctataaactgtttgtaaggttttaaataaacacttacagcccttctgaaaaaaaaaaaaa

SEQ ID NO: 9824 - DNA, 321 bp, Homo sapiens
atgggtctgctgcagttcactgggtgagcacgccagaacgtgttcgactgcgaatcaccagtggagaccgcagaatagcaaggactgccgcctgctcttgcctcaagaagccacgatcaagttggcttcatccctgggatgcaagcctggttcaacatataaaaatcactaaatgtaatccatcacataaacagaaccaatgaaaaaaaaacacctgattatctcaatagatgcagaaaaggccttcgataaaattcaacaccccttcatgctaaaagctctcaataaactaggtattgatggaacataaaaaaaaaaaaa

SEQ ID NO: 9825 - DNA, 1193 bp, Homo sapiens
  misc_feature (1)...(1193): n = A,T,C or G
ggagtaagagagagaggcagcggatgtaaaaggaaagacgaaagggaaacaagggaaagagggagtggcgctgtggcgcgtcgctgcgagggagcggcgcggtagcaaaagaagcaccaaagagaccgagacgagtagcaccagaccaacgcgcgggggcgcgaggggggaagatgaggatagagggacagcagggggacaggggcaatgggggggcgggggagagagggaagcgggcgatcgaggcgtaacgagagagaaaaagagtgagaaagagaaggggagatcgccgaagggagccggtgcggcgggggaggaagaagggggagggggacgaacaaacagtgggatatgaatagagcagagatcatgatagagggacggagccctacttcacaggggggcataggggggggaggagccatagtgggattgactacgcggaaagatggggacgcagagacgagcaggacgacggacgagacgcctaagtgatggcgagcgatggaggaaggaagacggaggacgagcacctgggcggcgccgcgcgcggagcgcgggcgagaatccgcggagagaagggtacgggatgagacaaggaggggtatgatggaaggtggtaggaggtgcagggacgcggataagagctcttgtggaggttatgtggggtcgcagtatcggancggaagactggaggcaggctcgcctaagggagagaaccatgcaacgtatagtcagatggacagaagngcaagcaaaagacaacacgagngaacacagacgtgaacggtganagagggtaatcagtgtatatgtgtagcagatgcgacacgcgagcaatgatgctgctcactcagacatacatgatacaatgtatacaaacggactaagttctacacaatagcaggacagagacgcgatagcagcagacaaggtgnggtgcggcgcgagcgttgacaccgagagcgccgaagagcgagagacgcacggacggtgcacgacgantgaacgggaacaaacagacgacagagcgcagagcagagcggaaagatgggagaagggcgtgtgcggatggctgggtcacgtataaggagacaggtggaggacgagagggcgggagcgcgacgggcagacatgtgaagcacgacgagacgcgatgcgcggagagaggatcccgtacggcggaggatgtg

SEQ ID NO: 9826 - DNA, 191 bp, Homo sapiens
tgcgttgtcacgaaaaatgaatattcaagcacacaggcaagaatgaccatacaacaaaaaggaaaacatcatggattgttctggaagtcattaactaaattgtctatttacaaaccttagcatgactctaaaattacctaatgcttttcttgtagaaaataaaaaagaaatagtatctaaaaaaaaaaaaa

SEQ ID NO: 9827 - DNA, 1142 bp, Homo sapiens
  misc_feature (1)...(1142): n = A,T,C or G
catactctaacaatttccccacacactcaaccaacataggagccaggaaccttgagngaggaattccaaaaggaaaagtatcccgccgcagccgtcaaattaccagtagggcacattacgtggtagcatactcattgctagatataatagagccaagaaggaatcacgaaacctagaagttcgaaaagagctcatcacatgaacacagctcatcagcggcatgcctcaaggtaagcataacaataggcctacacaaaaagcatatataaaatagcacatgccctatcggtactgcatgaataaagagctaccttactaacaagctcgacaacctcaattctaaatacgattaggtgtaaacgtctacgagacaccctacccaatagtctcgccgacaataccatctggcaccaacctgccttaaaacctgacactatatctataattctaattaagattaatgatattagcgatcctatacacaccacacccaccctacctaatcacgactctatggacactaccctaatagcagttatatataccacatgaccggtcccaccaataataacgacccgaccttttctccctctatcacactttatctgaccatcaataacctatccatcacccgcgatcttactccacgttttcccctacgtaacatacttatacacactctacatcatcagtaccctcaccatccaccatcaaataatattgtataataatagaatacaaccatcacctactatagaatacaccaataccactcaaataataaataatcatccgtcaagaaccataacacctgactatattcagtcaccacaactcaacacactcacaccgctcgcaacaccaacactcgtttaatgcgcatagcaccattttccattcaactatatcaccatctctacctatcttcttctccttacttacattttcatactaatatctcaatcatacatcgttccaccaatccatacataagacaatatactacaatattatatacctcacatctctaccaactaccttaccatgcatatactcanacaataatgagtatacacctctaatcatccgacttgcacatcaaatcatcgtacaataccttgatagttgctgctcncaactcc

SEQ ID NO: 9828 - DNA, 1008 bp, Homo sapiens
  misc_feature (1)...(1008): n = A,T,C or G
ccacaatttnnnnnnnnnccncaaaaaaaaaaaaannnnanncctactgagggacanaaggacccgtgtgctgctaacatattctatgctgaataaccatgaggatggacacagcccagtactcaattcttcaaggtatacatatctggacactttncttctacagtaccctgaaaaaatttcgaagaagtaatcatagaaatgcaatctcatttcaccatgagctacaacaaaatgataaaatactctaggcaacacaacttaacccaacagaaatcgaaaaactctctacaactgaacaactactaaaacacttgactgaacagtaacttgaagaaggataccacagaaatgcgaaatgtcattccacagttcactgaactccgaagaatgcaatgcttgttaaaaatgtaccatatctatacccaaatcaacactattacaatttaactgcacatcctttactcaaacctaccccactgacacttcctctcataagaaactaggaatacaaatacaacacaaaacctggccctcagttggccctgcagcggtaggagcctcctgcgcgcacgcttccccttttagcagaagggcctaacttaataggataccctcgctccacttgacttcacttgcaacttcaggcccgttccggcttgctggcggagtcaggaatcaaccttcacttcaaatggccggccaataccgggtttattcccacaggaatccaagggggattaaccgaagtgaaaagaatcatggtgaagcacaaagtgcccatctaaaacggtcacggaaacccgctataaagggacaccgtttgctgcggtgttctttcccctaaggctgccgcgcccccctgaccagacgcttaccaaaaaattcgaacgcctcacagctcagaagcggtggcggataaccccgacacaggacttataacacatccccagcgccgtctaccaccctggagaacgctccctctcgggcgctgttcctgttaccaaa

SEQ ID NO: 9829 - DNA, 831 bp, Homo sapiens
  misc_feature (1)...(831): n = A,T,C or G
ccctattnnnnttttnaaaaactaaaaaaaanannnnctattgggacttagctcccatttttgnaagcacatatggtatctgaaggactctcagacaaccgttgttaggaagatggctggaaactcatttaacacacccagaccactctccagactgtttacatcattcaggaaacaaagcaccctggacagtcaagactgccaactcctgaatactatacaagtcagttgctctctgaccgacccctaccccccacaccaactgcccgatgctctagatgagccccacccaccccccgcattctctcccctacacacaaaatcggcctcacccgccccagcgcaccttctccgtcccccaccccctctaaccctcgcccacccctccacctccctcccctcctccctcccgaccgacaacagatcatatcccagaactattaagccactccacaccacgccctcttcaattccccaaagacctagactacgctacacaaaactctgccaccctaacattactacaacacctctcctcccccacaccaagacagacggtagcgagcccctaattcgcccccacccctcgtccgcctacctgaccgctctcggtctacacacaccacgcacagaataccagtacctaaactaatcgccgtaaccatggtattaatcctaagaaaccgacgctcaccctctaaaccgagccgcaacgcgaccgctgatccaagaagacgacaagactcacacgctccgagacaccgacaagcccacctcatgggcccacccactacgatacccagatcacagacgatagaagccccccgcccc

SEQ ID NO: 9830 - DNA, 167 bp, Homo sapiens
caaaagatttcctgccccttcccatcagacatgcactcacttctaattgggcaaaactgtgtcacatggccacccttatcttcatgggcctggggaagccgaatactacttgacttaacggaatctatcatcctgaacaaattggagtttgcacaaaaaaaaaaaaa

SEQ ID NO: 9831 - DNA, 1328 bp, Homo sapiens
  misc_feature (1)...(1328): n = A,T,C or G
agaaagagaaaggaaagaanannaaaagnganaaaggaagagatagagagaggaggaaantgagagagagaaagaaaganagaaagatttgagaaggagaaaagnanaagnaagaagaagatttttaaagaaagatgaagngtcggttgagagagagatgagngaaagaaaaggaaaggagaagatataaggagtttattnagataagatgagagaggagagtgngagttgagngtgaantaatatactgtgtatctcgtgacacacgagagtcagctccatagagttcaccagccggctacacatgcacgatagagctagacaccgacgctactcaaagacgtctagtatagcctcgtgaatagtagcagacgnataacacgaaatagagaggcggtcgcagggacaggaacgaggtgtgcagagtaatacaagcgnagagaagggcgggtgcgcgcgggcggagcaggaagtgcngtgaagattgctcaacacagagcgacacacctacccagccacacatctaacttacatcacggacatactacgatcctcacaaacgaccgnacaggcgagaacgacgcagtcgctgaagctcattctgtgaatgctctctgtctctctgtctcgtctacacgtccgttctagtgtcgcacgtcgcatagtctgcctcttgcccccacgcctcacttctctcatcctacctctatctaccttctcccgcttcgctccgcacgcttagtcgtcgcttcggcctctacgtgtctcctcggcgtgcttcggacaggaggccgaacagtgtacaggagcagggagctgtgttgtgaggtagtgctcggncatacttagatacgtagatagtagtcatcatgagtggctgctcgatttcagtgtggagtcgatattagatcgcactaccgcntcgcaatgtcgcacctaagtgacagcgactcgctgtcactctatctgagctccgtcgtatcattttcgtatctcctgcatcgctgatcgagagacgatgacaatagttgcagacgacacgcgctctgtctcactctcgtcgtaagntctctggttccgcgtcacattgccgtcaccaacgcgcgagtgattgtttgtggagattgctgagaggacgtacgtcctgttcgctgcttacgtcagcgtctctgatcgccgtttcacactctcttcaccactcctcgcctcgcgtactcttatcctacgtggttatctttcgctctctcctctcagcccagatgtcgtccgangcacacgtgatatgtcgatcgttgagtgagtgctgattgtanaatatgtaggcgcac

SEQ ID NO: 9832 - DNA, 1484 bp, Homo sapiens
  misc_feature (1)...(1484): n = A,T,C or G
aggaaganagggaggaaaagaaaaaagaagnagntaagaagagaggggacagggaaacnaaagagaaangnaagaaagggaagnaagaggagaataggttagaagagaagganaagccaagaaagagaaaagcacaaccttaacagaagagggagaagaggaggcaagcaggcgagcacacgagagagaagaagacaaagaacgaaaagaagagacctctaaagaagaaggcanaacgacagcaacgcacaanaaccaaaccaccacagccacacccaaccaacaagcgacgcgaagcgcagcacgcctcacggcagaccacagagcacaggcgacagaacacaagcacgcacaaccagccaccaagaacagaacgcgacgagcaacaaacggaggaacacaaccaagaaccgagcaagcccaaagagacaaccaccggagcaagccaaacaaccgaagagacacacagagagaccagacacganacaacaccgcacagacacaccacggcacacaacaccagcgcagacagaaaacacagacgccccgacgaggacacgcccggacagcgcaccaccaccagccaacacgaaaccggccagcgcgagagaggaaaggnagagagacagacagcaggcacaagcggcgaaggagagataagaaccggcagacgccacgcacgccgaggccagcgggacaagcccaccaccaccgccccacccagacccacacgcacacagacacccacagcacaacccgagccgccgcacaccagncgcgagccaccagcgcgcgacgacgcagcccagccacggcgccgcgcgcgcagaagacacctaccacctcacgcacgagaacacgcgaaccacagcagccagagagccacacgacgagagcgcaggcccagcggcagcggacagcgcgcgcgcgaccgcgacgcgagcgcgcggatgagaccgagcgtagcgtggaacgacgacganacgcggnagcacgcgagaacgaacagacgagcgcgccgacatgacagcnccgccgagcactccacgccgccacacgctgcaacgcaggacaccgcatcacgcgatcgacgacncagagccgagacggcgnccgacacgagcgcacgagcgncacacagcncacgatccacggcccagacgacgccagccgcacacagcagaacagcactacngtcacagancagaggcagagcagagagcaancgcagagacgngacacncgcacgcganacgcaggcggcacacgacagctacgcagacgtcnactgtaggcaagagagacaagcgcagagcgaggaaacacagagagaagaggacagcacgcagcacgccgagagcagccagcggagcgcggagcgcgacgacccacggagccggacgcgcaagagacgcgantacagcagaccaacnacagaacgaaccgaacagaacagcggagtaggacagaggacagcgatcaag

SEQ ID NO: 9833 - DNA, 1184 bp, Homo sapiens
  misc_feature (1)...(1184): n = A,T,C or G
atgttatgttttactattttttatttcatctttccgctattatcatccttattctctttcgactattctctcttcatctctccctacatattctacatacactggctcgatatatttatataatagtagtcgtgagtatgctattcatacaattatacacgatgagatttatcactcttacgccatgtgtgaagaaaatcactaactacagaagccacatactcatttatatgcgtctatattttacggagcgtaccatattgctagtggctcggagttaacatgtatatagtaagacattatcactcttctaactgtaactgagcgagacgttggtgtgttacgtattttgttcctctttgtatttatctccctgctctcctctttttacatctctacctcgttttctattttttgtctttgattatcttatgcaaatccctgatcatctgataggtgcgattaaaatataatataaaatgtaatgtcgcaacacagtacaacgacaatcaagtataacggcagtttgtggtatacttcatgttacttatctcaacctcataagcatgcttatctttgaacatcacatccactttaccgctttttgttcaagtatatttagtctatcttaaatgaatgccgtaccctctctctcatactcgtacaangtgtattaagtcctacacaacatatttattattcaatattcatctntcatttactttccatatcttgttatttattgnttaatattcatcgttttttaatgatacattctaactgcattcttgctattctcttctgtctattctatctcttaatttctcattatactaagacaatatataattaacgatcacatgttattctaattcttaattgtaatctagactagctagccacatagtatatcgacagaacgcgccacgcatatgagttctagctacctgccgtctgccttagagtggtcattgcgtagtacactcgtatataagagacgatgatatttgttataatgagtcttgtcttgggggttataggcgcgctgttcnttgttttctactcncttcttataaattatttatgacgagcggtcgaccgaggccgtgtactccgatccttcactcgtcgaaatcgtagtttcagagacagnaagtgagataatgataaggaggaaattgagg

SEQ ID NO: 9834 - DNA, 254 bp, Homo sapiens
gtcgttaagtaactaggcatccattttccgcgtatgacacctccgctttgccttccactgaaagtggaagcgtcctgagaccctcatcaagagcagatgttggcaccatgcttcttgtgcggtctgcagaactcaagaaggccctcatcagattctggttcctcgatcttggacttgccagcctccagaactgtgagcccttcaaattctccccattacaaaaaaccttttttaaccggcctcgctgccctcat

SEQ ID NO: 9835 - DNA, 1239 bp, Homo sapiens
  misc_feature (1)...(1239): n = A,T,C or G
aggagacgtgaaacgagtattaagtanataggtgtagagttnccngcgtagtcgtgatatacatgtaggtagcgcgcgagtgagtgacaagtggcgcgggacttgcggatgggtgctagtacttagcatgcgcgagcaggcgtaggagacgcantaggtaatcgtgtacgtacgatcgcacacagtnggagcggtggtcacgttctgtgtcggttgctgaatcaactacatatggatgctacgcgtcagctactatgactgcggtgactcgcgatgctgggtacgtcatgtcggtgtccagagactctaccgagagcggcgtcgtgaaggcgaacggagatacattgcgancgctcgtatcatacgagacgacatcacagcgatgtctcaccgngatcggacagcgncatacgcnctgagtgcgtgcgttggtgtgngtcatgagctggctgcggatacgctttgctgtagtntgtntgatgtccgcgtcgttgacgntgtcgatacccggttaggtcacatgtcaattggtggtgaggttgttgctcgttatgntctgtgcggttgggcgatgacgagtacgagcgtggagtatgcatgatagagtgcgagggggagaaaagaacgcgcacagacgacacagatacgcgcgtcacttctctcgtgatgtatctgacagaagtagtatagggtgggcggagagatgtcttgggtgaggttggtgattggtgtcgaaacgaacacaggtacgtggcgggtcctcgaccgtccatgcagcgagagactggacgtcctgtcctgtcttgcttagtgactatgacactctnnctctctnttcataccttttcctcaccgcgcttccgctcttcttactcttctctcgcactctctgttctcttgttactcgtgtcccggctcccactagactgctctgtcgtacgatcctacggcgtcataccaccaggncantgaagtttttantgaggaggtatgtctgagttgttccgttctgtacgcattgattgggtgttctggccgcgccgactctacaacggggcctggtgcgcgtggttgaggcactcgacgcagtatgtaaagaaggttggagaagaagagggtcatggatgatactattgaaatgatnccaccattcacatataaagaatnatgtcaccacatcggcataaaattgattaatgaaggagtataataaaaacatataaattatagaaatatatg

SEQ ID NO: 9836 - DNA, 678 bp, Homo sapiens
  misc_feature (1)...(678): n = A,T,C or G
cccctcccnncatnnnnaaaaaaaaaaaaannnnnncctccgggggcttgagctcccatttgctgntancacanncnatgctgaataaccatgaggatagacacagcccagnactcacttcttcaaggtatacatattaggacactctcttctacagcaccagatatagaaagaacataaccatctcactctatcaacgagaaaacgctggaggaactacaaaattgaacgagcaatggcctctccaaggggagtcttgagtctgcagaacaatacaagacgacgtgggaggcattcaaatgggcacaaagacaagagctaagatttcacagaattgtcaaaataatgagctgctggtagaacactcgctagtatccaaaccattggagacccatcctacacacgcggaaacccacacacaaaaaaaccaaataaaatggcctaggtggcctcagagacaaagctttgaagcccgcctcgctttgacgcacggttaaagtcatcatcactcgcaccatcgacacacctatccctacctgccactcccgctgccccaactcagtcatcagccaaacacacacgcccccactctgttcctcacacaatcacggggataaccccacgacagaccattgcgatgcaaagcgccatcaaaatgggcaagaaacccgaaaaacg

SEQ ID NO: 9837 - DNA, 768 bp, Homo sapiens
  misc_feature (1)...(768): n = A,T,C or G
agaaacttagagaaaacaaaaaaggggtctgggggggaaccaggggggaggaagagaaaaaaaaaaaatttagggggaagaaggacgaggggaaggcggccccccgacggagggcgagaacagggaggaagggagcacacaagaggcgggcgggggcccggggaggaaagcaaaaaaccagcgcaagaggagaaagagaaacngacggggagaaaaaagcggggggacggggagcgcgggggagcgggagccggagacgccgcggaggggcggcgggggcggacccggacccccccgcgccccgcgcccccaccaccgccgacgcaccgagacccgcgggccgcccccgggcgccccgggcggccaccgcgggccccgccgccccacacccaccgcgcgccgcagcggcgggcaggccgacgccagcacgcggcgaaccgggggaagacacgcccgacgagccagcggcgggcgacggcggagggcggcgcgcgcggggcgaggggcggggcgccgggggccggcgcgcgcggcgaggggccaggaccccccaccccggcccgcccgcgcgaccccgccgcccgcccccccggccccaccaccgccgcgagccggcccgcgcgcgcagcgagcggaaaggggcgggaggggcggcagcgcggacgcagcccagcgacacagagccccgcgcggccggcgccaaacccggaggacggcggccgggagagcaagccgccgccggcggcccggggcgagaccgaaagccgg

SEQ ID NO: 9838 - DNA, 811 bp, Homo sapiens
  misc_feature (1)...(811): n = A,T,C or G
tctgttatgttactanaagcatccttcttattgtgaagaccatcatgnctatctgaatggagctctcaagaacgtgcattggttaggaagactggctggaaactcacagttaatcacacccatgacaaacctctccagatctgtttaccatcattcaccgacacaaagcactctggacggttaaagactgagcaaagccctgaactttcctacctcttcactgttcctcttttttgtttccctaccacacacccaaagtgcctgctgctctatatcacaccactcaagacctgactatctcacaaactccatccacaaaatgcccctccctggcctcacccgcagacctttcgcggccctttccctttagcgccggccacccccagacccctagcttcctccctcctnttcactcggccgctagaatgccgccatctggcccccctttaccctccgcctctatatcccctcactcctccctagcccttgcttcccccttccctcactcaccgctcactctatgccccccccaaccccctccaccccctaacaccccccgtcccccgcccctccccctttcctccccccccccgcccgcaccacccactccgacctctatttcaccctcgcctaatcccttcatgattcaacgatcccacgtgttccccccgcaacctccttcgatgccctacagttcgaccctgcactaacccgaatcctgccccacttttcccctcggaaaccttggaccttactaatacccaaacttgcagtttcatacaccccgcacgttcgtacttccaaccaccta

SEQ ID NO: 9839 - DNA, 1663 bp, Homo sapiens
  misc_feature (1)...(1663): n = A,T,C or G
ctagacgctnctatagtgcgcgtgttcgtcgcggcatgtctacgtcatgcatgngacgctcggtgtgctgtcgcactgctanacgcctgctctgcgcgtgtcattgttcgtacgtgtcctntggcgactgcnactcncatcgttgctcctcgtcngtcgcgctcgcgatctgtctgggctgctcttcacntcgtctcactcgtcttgttcacacgcgtgtcatcctgtcgtgcgatgcgatatgtgatctgacgtgtctcgtctactgcctntttctcatctactcacntcnccncttatagcgagatcgcacactcttcctcgtatgttctgtctcgcgggcgctgngtcagttcagcgctctccgtgacaccgctcgagcacgcgtcatcaccgcgctgctcacggtcgcncncacgctgtatgcngcggtngcgacgctgatgtgcgctcgtgaccttcgtgtcggctcgcggcgctcgtactgtctcgtcctctggngggatggtggcgtgaggccgatgtatgtgagtatgtgtcgtngactctcgtcctgctgtgctagcgccgtgcctgtcgagtgtgagncactacacctgncgctgcggctttcgtgcttgtgatcgcctctcgactgcngtcgtgcgtgtatgtgnactgagcgtcgtcgccatcgagctgtctctgcgatacgtgtccgtcgtngtgcgtgacgtagcgcgagcgtcgcgtnacgcacgctncngngtctggntcgtcgcagtgctctaggtggtacgnctgtgcggtctgcttcnctctcgtgntatctgttcgcgtcgntgtctgcagcgcgcagtgtagngtcgagcgcgtgctcgtgcgcgtgcgtaacgcgcgcgcggngtcacgctctgcgtccgtcgtgcgtcgggcctacgcaggcgtggtccgacgctcgtctatctngnttcngnctctactcctacgatgctgcgctggcttcgtcgcgccgtcattcnacgatagactcgtacttgcgctccgctcctgtgctgtcatactcgcctgtnctgtctatacactctctcactcgtctcgcgtgtcatacttccgatgtcactactccgcantcactccnctctacttgccttatcttcgtcgcgcactctcgcttcctatactgtagtgtcctntctcggctgctctgctctgtgcctcttcggctcgatcggnggcgcgcactcggtcgtactcattactctcacttacgcctacctactcctcgctctccggtactctggcgtgctggcctgcacgcgcncgcgtcgtcgaccatggtctacgcgcggcggatgcggcgtgtgccgctcncgtgcgtctgactgccgctccgactagcggagtcgtgacgatgcgctcatggnacgcgtgccgtctatgctgtggtggcggtcactagagaggcgagggtgtgggctgtgcgatgcggttgagtgttcagcgtgcggagtgtaccagcctcttggtgtcccttccgtctgcgtcacaaccagtctgtgtgtttagtgtgttttnntgttcttaagggcttctcctagtggtcttgtttgttcgcgtcttgtgtggtgttgtggggtgtgcgtgccggtcgcgatnggggtnantttattgttttattggg

SEQ ID NO: 9840 - DNA, 435 bp, Homo sapiens
  misc_feature (1)...(435): n = A,T,C or G
ccccacaannnnngaaaggggnaaaaaaaaaaannnnnnncctagccgtggactncagcatcccttttttgncaaaccatcangnctatccgaanggagcncncaagaacaagcanngcccaggaagacaggccggaaacccacgcaaaccacacccaagacagacccgccagacccgccaaccaccanacaggaaaacaaagcaaccgggacggcccaagaccgagcaacaccccgaacccccacacaccccccagcaaacaccgaatcgacaccacaccacacaaacaaagcgcccgcagacccagacgagaagaacaaaacaccgacaaccccaaacccaagcaccagcccacaaaacccaccacgaagcaacaaacacccacaaaacaacaaaccacgaaacaacaccgggcacaccgaaaaaaaaaaaaa

SEQ ID NO: 9841 - DNA, 1718 bp, Homo sapiens
  misc_feature (1)...(1718): n = A,T,C or G
gtgaaggtggannagggggtgggnttaagnnagagaaagggangagtactatgaaaagattgtggnagagagagngaangnaagaggngagagagagagtgaagangganaggacgagagaatatangagaggagaggagnngagtcgtaggtgcagagagacctactgtganaaagagtatgagtatgatgggagtataggngtggggacaaggagtagatgaganggagtgatgagaggaggtggagaagggtnagaagcagagaagatgtgggagtagacgaagagaaacacgtatgataagatgtcncgagagtaatatcggcgagcacnacaggagtcgcgatagtgnatgagctgcagcatcacactggtagacgatcagtagcagcgactattgtnaagatagtgagtaagtagcgcgctacgtgcgcaccgtgaagtatgagtcgacgtaccgcgagaggcaggaggagatatacgacgaacagacggagagagaacacantcgtaaagtatgcagatgcacgacaagatacgacgannatggatgagatacganagngagcgagacagcagagtacaacgttaggaccagtgcagagtgagaagcgctgtgtagacctactgacggctgcgnancgcacacatcctatgcgcagaagctagtcgacagcgtagattaggacagcancgaacgacgccgagaccagatccagtgcacacncgagncgcgagagcgacgancgtaggcactgcgcggtgtcggtacctatctacctgatcgtgcgtcctctctcgtcacgcgtgctagacatgctagncgctggcgacgccgctcgttctcgtaacacccacgacaccaacaacagccancgtctccacgaccacaaccactcnccactacccatcctctcgcactccgcgcctccgcacgtccgcgcctcataccacaccnacaccatatactctactcnactagtccagtcacctcanactacagtnaagtctatctaccagtatatagcacacgctaccatagaccatcgcgcagctactgctcgtctgtcactaggtaaactatcgtgtagtctgccgcactcgataagatgtanacggctacgatcaatctatnggttgtccgcgcttagagcagacgctncatgtgacgcacagcgagcatancatacgacacatagctgactttgcgacattgtccncgctagttgctgctcgatagcttagttccgcgacctagcacacagcctatacgacaacagctagttagctgtatcgcacgcgtacgcacgaccgacggacgcctccgnctcgtaagctggtcgcactactaagatggtatcgtgtntggtcgatcatcgtctcagacttagcgatctcattcaccnacgtaccgtcatctcatacaccttcacacgccacgcgaaactgcgtcgatacgcgcgtaatccttcacatcanagcgatcgcanctcactctgctagacagacagcgagtggagctagacacntcngtatctctccacgtctatcgtcctatcgcccgcagacctaatgcagcgctctaagaccgttcgcatcgcactcngcgcatcacagtcgacactcacnacggatactctctcgcggcgacacgcncatcaccgtagttccgctctcgcgtgtcgtagcgtcctacgatcgacacaccgtcgccacg

SEQ ID NO: 9842 - DNA, 1259 bp, Homo sapiens
  misc_feature (1)...(1259): n = A,T,C or G
atagcacactcgctctgatatgattagtcgtgacagcattgtgataggctnctattctcttctagttgagnttataacgtgcggngatagtatactaatcgaacacgtgcaggcatctaagatgaaagagtcatagctgacagtagtagtacgagtcacgacgactgcttcgaatatatatggataatattgatagacagaaagggaggaagcgatgtgactagccgcctgacatagacggcgcgagagacgacgagaacactgatgaatcgangtgcgccnggatgacataggatctngaatacttagatatggtatgactgtgtcacgtgtgagctttgtgtattataacggctgaaccatatcgagtataatatatattagaatataaagtgttgttaaataactggtagattcaagacagacacgaggagtactgacagcacttacacggttgacgacagtnggaggatgaagaagacttgagattgtaagatgagtgagacagtgtggtcgagaaggacaggtataatatgttagataggagataaataagagcacacagatagaagtacaggaatataatgactataaatcggagtaacagatataaagagagtgtataaaatgaatacctctaagaaaacactcggagtagaaaggaggcagtgaaganaagatagaaagaagtaagaaaagcggtgagcgggtnggcgggtaggttccgctcgtgtgggtcttggcgcgggaaatgataggtgggacgtactaatgttatgattaatcgccactctataatgagatggttacggcgtagaaaaagacataatacactatgcccaattgcttgggccaaacccacaaactgttaaaaaactaaacaagccaacgacgcgactagacatacttcttgcagcacaaatccaaaacgctatgagccagacgtaaaaacagatcatgcaaaactcgggctcagcttgagcggcgaaacgggnggacacggccgtgggtgcagtgcgagggggggaagggtgagtggagaagggtaaaaatagaggaatggcaagttaggatgtggggggtggggtctttagatgggattcgaatttgttgagatttttatacctttactttcaatagagagtcttgtntgatactcttgggaaataatgagggagagagnaggagggtgaacagagtaggaaagggagagacgaaagtaggcccgagggggtgtagtaataggattgtaggagtgg

SEQ ID NO: 9843 - DNA, 128 bp, Homo sapiens
ccaagcaatgacttcagaatgatgaatgccctctcatatttaattgatctaattccttctccaggctgacaatatttttactgccaattttcaattaaattgtttctctcatgccaaaaaaaaaaaaa

SEQ ID NO: 9844 - DNA, 240 bp, Homo sapiens
caacggatcccagtccaagacaggtcgattgcttgagcccaggagttcgagaccagcctggagaacaaaactggcctgtcctatgtactcatcattgaatgaaggaacggatgcatggaggtgtacagacaacggattgagctacttcctaacacagtgactgggattcaggacatatccagtaaacgtctgttaaggaagtaaacaaaataaataaataaaacaggaaaaaaaaaaaaa

SEQ ID NO: 9845 - DNA, 191 bp, Homo sapiens
ccacccctccatcgccatactcacaagcacacaaacaaagaagccttctgccgacccgcgacatgactcagatgatgactgccctctcatatttaatgtgatctaattcacttctccaggctgacaatatttttcactgccaattttcaattaaattcgtttctctcatgcctccttgaaaaaaaaaaaaa

SEQ ID NO: 9846 - DNA, 928 bp, Homo sapiens
  misc_feature (1)...(928): n = A,T,C or G
gctactggcgagacattcccccgcagtcgagaaggagaacccggcctccgagagcgacaccngcnatccatttaattattgaagcattgacgaatcccacacttccaggctgacatcatgaaaatgaatgggaccccctgattgatatggaagaatcaaattgcaagagtcagaggaaaaacaaccatgtctctcatagggacatgattggttgctctgcaaattgtgtaactctaccatgacagagctcgcagcataagttaggaggcatacattcctctgaacagcggattccttccagcggtgaacatgagccagtccatcaaacataggtccacactctctacactatttatctacaatacatacaggcaaaaccatggctctctcttggccctcagctgtacgagcctactgcatgccgcttgcccttgtagtggagggttatcttcgtgattccttctctcacttgactccctgcagctccggtcacttagcctcgtcacacagcagtattaccctaactcaataggccagcaataacgggtttgctcgcgaattcgggggattaaggcagtgaaactaacatttgaatccaaaggcttcttcaataggccacgcaacccgttaataaggcccgcgttgctcgaggtttcttcccataagctcccgcacctcctggccatccatcctcaatcagcgaagccctcacacacgcaaggcgtgctattncccgccctggacgttttgtgggttcccgcgcggttgtccccctgggagctcgccgtccaactgccctccttgatgccaaccnctgccgattttccggtaaactaggcccgccttgattccttcacataaagcacttccctttttttacgtttcgcctctctgtctagttcgcccgaccaaccaccgctccagcacg

SEQ ID NO: 9847 - DNA, 276 bp, Homo sapiens
  misc_feature (1)...(276): n = A,T,C or G
tggcatttatagaaattgcaaagagccaaagttgtgcctggaatggacaaaacctttcaatcaatttcaccttctggcacaaagatttattctttggaaggctattaatgtacaaatgtttgcttgtttgtgtttcctgcaacacttatcatatgtcttttttaagtaggaatttattaaaagcaactttgaatatgatggtgtgttacaatctttagaataaagtgcaaaactcaaaagacaaannanaaannnnaatggccttcgttggcctca

SEQ ID NO: 9848 - DNA, 303 bp, Homo sapiens
cgatccagtaggctgagacaggagaatcgcctgaatccgggaggtggaggttgcggtgagccaagatcgtgccattgtactctagcctgggcaacaagagcgaaactccgtctcggtgaggggtggagagaaaagatactggtctggagtgatttattttagaaatatcagattctgttaagttttttataaattgtctttgggagtgattgaagaaatagtgcgatgttttgaataatccaagatctaaatgtaaacacaatttaataaaattagagacaaggaaaactaaaaaaaaaaaaa

SEQ ID NO: 9849 - DNA, 1544 bp, Homo sapiens
  misc_feature (1)...(1544): n = A,T,C or G
actacctgtntnagttcatgctgactgtcattctanctgactcactgtcgtgcatgcacgcacgtactagtctatctacatgtgtatgtgacacagtgactaggcgctcaactgcgagactaatcacatantgtgtgagtatangacngaatcgtgtggaaacacgcgcttgcgngtactgctgtctatccacntctgtctctatcgagttagttgagcgtgcgtctagtnatctagtgtctntttttaacgactgtgtctgatctnagcttccgtcctntatantatcttctcatcaggtagtagtacggacgtcaacgcactctgatatatcgattgcatgactgctnantcgtcgtgtagatctcgtagtcnaatgccggctncgatactctgacgatttacatgatcgatcaatataatcagatcgtcaccacgacagacatcgcgaccactgactaatacatatatattattcagatnagtgctgttgcctcacgctactaaacgcatgtacgcgttgcgtgtntctcgtctgtcgtattatgacgacacacgtctatntctcgattattatantnctagcgcactttccggttcgttactctctccactttctattcgatcttgtatttcaccgcacacttctactgcgtgccggtattctgangagcttgatgacgtgtgcgtttgatgatattgtgtatagtcgtacgtatatatataagcaggagatgtatgcagagaagacntatgaagagacgtagtagaaaatccgtantaacacacccaatcatggtcgtcgttctgagtccgtcctcacgtcctacctctgatccgctccgcacgcgctgctctgacttatcacactgcatgactcgactagtataacaatcatcgttacacactatattctatccgcccctcgctaacatatccacgctctatagttctccttataatattctctctaatcacgtcctattcacttccacaccaccatnaattacgcttactctcacataccgtcccttcgtctcctgtaatgcttctcctcggtatctcctctctcgcgttgttagtcatatnctcttnttggtctcggagcacgtgacccacagtactcgatatantattgctagatgtacttaagataacaagtgngaattaataccactatacagaacgtcggaagaatggagaagatatagatacgccgtactataacaatcagagcagacaggtgagncntagagcgtgcgcgtgcgtatactgagtattatgatcgtagttgtatattgatatatatatttgttgtcgtggctttctgcctcgttgtcgtatntctatcagtttcatgtgtgcttggtctgcgggtcgtcgcatgttgttggagggagtattttgtgttgattantgtgtttgttattactgcataagtgagtatanntagngctnagcggctggctccgagtatgtaagtgcacgtctctacnaacattcgcgttacatcagcgagtgaaatnnaaagtgtagagatagag

SEQ ID NO: 9850 - DNA, 353 bp, Homo sapiens
  misc_feature (1)...(353): n = A,T,C or G
ggatcccgatgaaaaagttacaaacatgtctagaatacacnngctgcaggggaagaagcaaccacataaatgaaacttcataaagaatgtagaaaacagccctgcaccgctgacagcacagagtgacatctaaggattgaacatgtggagcccggcatgctaggaccattaccaatcatttctactgtgtcattattcaaggctgtctctagttctgaacactgatacaacaattcattggaaatacgctacaacaacacaaagaaatggtatgtttgggataaccgctttggaaaactacaatgatatattttaaaaattaaagaactaaagacaatccaaaaaaaaaaaaa

SEQ ID NO: 9851 - DNA, 737 bp, Homo sapiens
tctttggtcacaacgcaatgctaaagagcaggaccagattccgaaaccagactcccagggtttgaattcccgctgcatcccttaccaactggggaccctgtacaagttgtttaacctctctgtactcatttcatcaaatgagtttcctcatttgttaaatgaggataatagtgtctaacatcttaaggtggctggaggattaaatcaatgaaagcaaaactccctccctttacggcctcgccggcctcagcggcggacctctcgcgccgcttcccttcagcgacggcccatccatgatcccttctcactgcctcctctgccctcgccccctccacccctcccagcaccctcccactcctccccccgccccctccccgctccccccccacaccccagcactcgcctcgacaccccctctcacccccacgaatctacaccgccacccacccctcccaaccgccgctcccactccccctccctcccaccgctcctcccctccccaccccccacataaaagccatgtctctccctccacccccttctccccctccccaatcccgcccccacctcccccgcccctactccgcccgcacagtactccacccaccctccctcacccgtcactcccactgcattccatctgtgtcctcacccttcccatcattccacgccccgcccctcaccttccctcgtccccaccgcctcccacaccccgctaccctcgctctacttcccat

SEQ ID NO: 9852 - DNA, 1550 bp, Homo sapiens
  misc_feature (1)...(1550): n = A,T,C or G
agtgtatgancagctgatcgactaactcatctacacgaaaccactacactccgtagtaacgacatgnttgcgaccgtcactcgatgcatctancgcgcagctagtagctntgcatgcacnatactagaatagcgangagcgcgatatgagacacaaatactatgccacgcactcagaagangatggcatgactaccgtgncaacacagagctacgaatctgcgacaatcatatagcgactantcatctattnacatgacgatcagctgactactatnanaatctatgactgactgacgcgcgcgcatatgcgatgancgatacgagtaccgnataacgagacgtacaatcgactactaccacgcatgccgctagctanacacgcctatccacagctacactacacgcgcgcatcgagtnaactcggagatagcgatgtacgcagcacaccncatgcaccnctcacgccactcgacacgacagatcacacatccatcatcactcgatgtcatgnacgagcttataatcgacctcgcaggtgcagtctatactacagatagacatntnacttgtaacgtcgctgtgtgtgtcgcactnggcgccgactggtcgcgttcgttcgttgcgtcatgcgtcatcncctctcatcngatactgctcgttcgtactgtcgcagntgnaacaggacgtaagccngangaacagctgtacgcggatgtcagtctcgatcacgagcaagcgcggctcactctcgcacacacacacagcagatacggcacatacagctcaacgatatatacagacaacaagtatcacacattcatataactaccttactatctnttaacgtaatatacaanacatctagatatcgcacgagtcaaatccctaatacatcataactcaccacaactcatagtacgcaatgttactcgcatactaacacgatggattagctgtgtggtacaatatattaacgaagtagactcaatgcccatacatcgactgagtttcgaactagaacancacatcactaacactcctccagacgacgcctcaccaacatccacgcntctcgtgcgctctacttcagtatattagatagacccaagacgtctgtgtctctcgctcaatatgtgcgcatatgtgcagtgacatcctagtgtagtacataccttctgctatanacatactacataattgaataggaacatacattcgaaacaacacacacaaaanttcagtcataccaagctaacaactaaagactatcataaagactgtccacaaaccatactatacacgngtgtgtatgttatgtgtcgtnaagatgttatctctacatcgtacaacaacacacaatataatatagattatngatctttccgtctgtgtcacaaccacacaacntccactacataactatactagcaataagagatagtccgccgccgcggtcgcctgcgaccacactgcanncagncatttaagtnagagcnctacacacttgatggatgtatgagngagangtaaatatganaatatagaggg

SEQ ID NO: 9853 - DNA, 280 bp, Homo sapiens
ttcacgatcccagtaaagagttgaactctctgatttggtccaggggagatgactgtgactctggcactgttctaaaatctgcaccatgcaatgcagaagcaactcgccttgtgaggctattgacgacttgaaatgtgtctgccagtgactgacgaactgaattcttaattctacccacccctagctcatctccaaccccaaaaagccacaccgcatgatcttgttaccaccctaggccaccacacgctgtcccccaccgtcgaccccccaccacgatatg

SEQ ID NO: 9854 - DNA, 1104 bp, Homo sapiens
  misc_feature (1)...(1104): n = A,T,C or G
agcatattctcacgagcgataattcgatggaagatagtttgtcagtacacggcgacttactcgtcgccagcggtagaggtgcgagagagactgcacaggacgtcagggcgaccactcctaacgaattgagcttcgcgctgcgtccttcacnattcgactcacctgtccaccganacacaccgaaacacgctcgtgacctcaccgtgctgcccgcattgtcgtcacctgcacgttacgccttccgttccaacctatatccgcaccctctcgcacgcaagcgacaccactctctccgtcgcacccgtccactgcacaccgaggttctgtcaatcgtgtggtccgcggcgcgagaccgacgccattcgcaacgccaccccatcacgcaactcgctaagcacctcgagggagcgacttgcacccccgcatgcactaccgcagccgcgacaccggacggcttggcatgacacgacgatgagttcgaaaggttaccccgctcccttcgtaatgtgcgccaaactacgcgtctgactcatcatgcctaactcgcggcgcgtgagacgccaggcccccgataataaacttatggctggcccctcgtgttcaaggtcgctgccgcggcggtcgacagaggcggatagactataaccatcgcctaacacgatctaaataaccgacgtcgcaccccgcacacaccctcccctccactctctcgcacactattactttcgccaccgcccgtctgcatcactaactattaccatcataacaaaacgtcgacaanacactaacagcaaatcaaataaagatgtgtaaacgtgttcgtaaaatattatgtaaacagtttattagacacaaatcaataaaaattatatacattgcgttggtcagcgtccgtgagtgttgtaggcaccgtgcgaaaaggaagaccagagcagcaaggcacgcggggagggggggagcgggggtgggggcgacgcgcaccggagggagaagtggcggagtggggggaggggcttcgcgcgcataagtaaaaaaaccctatacacgatggtgggaaggattggtgagaaatttcttccacaatggtaaagaatggataatggg

SEQ ID NO: 9855 - DNA, 1515 bp, Homo sapiens
  misc_feature (1)...(1515): n = A,T,C or G
ttcccttaaagggtncaatcngngcggacgcgcaccctttgaagatagannagcaatccnaaganacgtcggagagagacaacacctntcggaatagcgaacgtggcgtagagccctatgatgcacgacgaacgcataccatcatcatgcgctngttgataatgcagtagcacgtgtccgaccgcacacacgagngtgcgtataactcgcggcgtactacagaattgtctatatcagacttgtnagaggtgaatacacgctactacgacaccggcgcaagnggagcatcnacagacanacnagatatatagctgtgcgccccntcggnagtcgagcgcgatcgacgcacgcggtcgcggagacccatntagcgtgagctgcagcntangcacncgcntctgagatctgacngcgtcancnactntatacgacgagtatgcaccacgccgcgngccaccataaagcttnncagcataggcgagcctccnngagcncaggcnaccagngacgtcgacccagctagatagcagtgtgagtgctagtgcctccnaccatccagcnatgtgtctgatgcganantanctgtagttntgaatgcgccagccaggtagactagcaagagcgagcactaacacagtccaggaaagacacgcagatctatcagtagaatgacacacacacgagtcgcgagncgccgacatatgtggcgccatctggacgacnccggctanagacacatgcggcgcagcncgttcacgcagttgtgccgtctattctcatccccgttgaagcgctctcacacgctccgctcagnagtgagatcgataacgccctctctcatacgacgataacagtcgtgagacncgccttccaagnagatncaattcatgcgtctcggcggacgatagacccncacgcgacaaagcgaaccgctatacgataagagattagcgctaggnggcacgtattctccgcccgcattggcacaagcacaaacatcttcgaggcgcgcctgcatcgataacctatgtanactcgaaacacctctgaggccacgactctcgacgcctgtgtatctcactcagacgtacgccgcgcgtgttcgtacctccccgcttaagnatagacatagagcacgtctagtgcacatcgctctgactccacatgatacncactgacccggccatganncagcgcctcatcccctncgacgcntgcatccacgctgccgacgaggatcgcggtagtcgaggncgtgtaccacagcgcgctgagcgagncggtcagcgagcgncgaccatgcaactcgtcgcgcacgggtncttcatgnctcnaccgatcgacctgccgcgcagatcactctnatccgacagtagacgagagccgactacacaccacgcgctacacgcatctcactctacgcggcgatnagcgacaccgcgagacacgaactcgacgcccgcgatggcacganggacagccgctcgtatgatcatacaacgtgatcggatacgc

SEQ ID NO: 9856 - DNA, 1329 bp, Homo sapiens
  misc_feature (1)...(1329): n = A,T,C or G
gagagaaaaagaggngggggggggggggagaagaggaagagagggggaaagagggagggagagagaaagagaagggggcggtgagagggggagagggaggggaggcgggacgagctagnnnccnagagngaggagagcggaaagagagggagggggagaggnaggaagagcaggaaggaagaggcttaccggagaggggggagaggaagaaacacagagaagcnncgggacggatccacnaccagaccagccaacccacacgactgcaccgaccgccaccgcgaagcgcgagagcgaccgcgccgacagagcgaccaagatacgcggaccgacacacaaggcgcggggagacgacgcggcagcacggagggagcgcgaaggaagggaagagaagggaaaaacggcaggcgganccgagcacgcgggagcgcggggaggagaaggggggggcagggacgacacagaaggaagagcagaacagggaagcaaccaggaccacctntgcccaccagaacgcggcgcccgaacgcaaccggacaggcgcaagaagaagaaacgggcgggacaggacgcgaccgcgagcacggcgggcgccgcccgagccgcacagggagacaccgcagccacggagcgacgcgcgcacggagggaaggaaaggcagcgcggacagacagagggacacacgcacagaaggcgagccgaggacacgagcacgacgagggaggagggcgagggagcagacagaccggcgagacggcggacggaccaaacacgaccgaccacacaccgaacacgacggagaacggcagaggggcgcgcggagcgaaggaaacagcgcggacgcggcgacgggacgcggcgagcagcagcgccgccgccaggcaggagacggccaaggggaggcgggcgaacacagggcacgcagcgccacgcgcacacgcagcacgcgcggcacgcgcgagagcgagcacaggccggagacaacacgcgacgacgccgcagcagacncgtcggcagcccgaggcgcgcgcggacgacacgacggacggagcacgcgcggcagagcgacgcgcgcggcaggcgacacaggcgaccgagacaaccaggaggcgacgacacgacccgacaccagcgaagaggagangngagaagacgagcggggccgagcgaggcagagaaggggcaaggagaagtacgcancgagcgcgagcgacggcgagaaagcagccgcccgaagacgaacacagcgcgacaagcgagccacngcgaccaagcagccagagcagcgcggagaacacagcaagagaggcgacgacgacacggcggagg

SEQ ID NO: 9857 - DNA, 1001 bp, Homo sapiens
  misc_feature (1)...(1001): n = A,T,C or G
attaagatggngtcctcccagaatacccaccacttgtataccgaatatacggnattccaccgtgggattgtacatgtcctagcacgtgcacatatgtaacagcgcctaccaccnnagngcccactgtcacgcgtatggagagaccttagatgagcacgcgctgccccccagaggccactcgccgataccgtgctgccacacgtcatncacacgctaccacggnaccaccaatttaacgcttaaacctannntccacaatcgacgctcacgaatatagtgcaatctgtcatgtcgctccgtaccgctgaacactatcactacacaacaatatgtgngacacaacacggacggcgactcacacctcccctcccactgtanccgcgtngaaactcgacagcgctgctcctaccagacgganantaatgaactcagtgtgaattgnaattaactatcaccacacagagaacactcatacgctaatgcgccactgntaacacaaattgtnnaaacacannaaccatcatcctgnagagtganaaccataatnncctgtcacatcagacactctgtcacgcgaggagtagctggtgcgtcgggataggaggctgacaattgtctagcacggcagcactnactcacctacgcanactcttacgccacgccgccgcgaaagacgcaggnagcgtgcggatgagtaggagagctatgatctaaggggacagctgacgtccgtcgngcggtgtgcgccgcgacgggnaatgacggctcgactgtgagaccttctagcctggtccacctgcgcgtgctcggaatannnagagggacnagagatatagtagacgtgcattgacggagcgcacgcgaggngagtaggtantcatctactangtagcagtggnnggangggtnngtcacngncaccgggtcctcccgcgncacacatctctatnaagctctcaataatataacttananacaactgacacttannaactatnnat

SEQ ID NO: 9858 - DNA, 154 bp, Homo sapiens
cctagaggaacactgacgagaagatcttatgaaccagcgatattttgtactcgatgtggcagacgtgacaaatgcacagattttctatgcagtaagataaagaaaataaacatgaaaaaaatgcataatggattggacaagaaaaaaaaaaaaa

SEQ ID NO: 9859 - DNA, 122 bp, Homo sapiens
cccggttatctacagatacagaaaccatctaggaggtctggtgttggatacaactattcgtaccttgtaaaattcttacctgtaaatcattaaaaaacaaatgagtatcaaaaaaaaaaaaa

SEQ ID NO: 9860 - DNA, 708 bp, Homo sapiens
  misc_feature (1)...(708): n = A,T,C or G
cttaggcaacacacgctggtatattggagaaatcaacagaatgcatccaagaagtgcccatctgaaatataagagtttgagatgtttatttatagctgccgtccccattgttagacagttggccctggaccatattttcatttgttgagaggcacccatggcccagggacagaaggagaaaagatacacagcacacacttgaattggaacaatgcctgagaaagcttatggctccacttgcttctactccagataaagagatctctgttatgactctggatttgcctgtctctacagatttctgagtgtcagtttgctctgtaacctctgttccctgagagattcaagaaaacttgttgattttccatttgcttagctttttcttgctgtaagaaaatgaagatttccaagtgtgttacatgtcagagatgaacccagaaattttatttactttttatcaatttatcaaagcaatatctgcccatgtaataaaagttttagtggagaaacacatagagatatacagganaaatatcaactgataatgccatcacttagagccacagttcctttaagtttaatttgtattaaactttttaatgttaatatattttccattgtcaataattactcccaaatactgtttcatggttatatggctatgctttatcttaagaataaatatgctaaagtctaaaaaaaaaaaaa

SEQ ID NO: 9861 - DNA, 440 bp, Homo sapiens
  misc_feature (1)...(440): n = A,T,C or G
cataaacataaaaacaacacatatagacaaacacaacaactcttaggctaactcaagnaanaggtatcagcaaagaacctggagaacgaagagagagtgtggagaaaaagcagtgtccaaagccacaagcggagtgagctggggaagccagccctgaatggcagaactacaaagtgagcccaacagagtcccatggaagggagtcataaatataaaagatgaagcaactttccctataccacttggcacgtgaagaaaaatgaagcttatagtttcccaggtcttagtccaagggcccagcagcaaacctttcaagcacacaaataagcaaaaccaacaaaataaaccagagttgaccaaaaaaaaacatgcaaattaaattatatattttttccatttccatgagaaaaatttctaaaaaaaatataaaaaaaaaaaaa

SEQ ID NO: 9862 - DNA, 1443 bp, Homo sapiens
  misc_feature (1)...(1443): n = A,T,C or G
ttttttgggggtcnntnnntcntttnctccctttcncgttgtttcgnttctgtagctcttagcccccccccttttctatcgcctgcattacccttttattgttgtgccccctccccgccctgttggttggtttgcccggtttgtgtgggtggtcctcgtggagatagggatgggcagcggagagctcaaacttacgactcccattgttgttcaactcaacacgctcaagtttgctgacgggatgacagtccagcgcgtgctccgccgtcttcgctcttcatagaagcacattncgctaacagagaacaacacagcgcgtgattgtttgcgagtatgatcgcatagcggtcctagcatactgtttaaccagagagatcgaaacagcgcaccaccaacacaaataccagaacgcaataaatacgagcccggtctgatctcgttcacacaccctcacaaccccggtaactaggagagttttgcgccctgccatggcaacctggggcaggataataaagaagaccacaccacatggtagacatgtcagagtgcattgagcgacgttgtcgtaaaaccgatccaacgcctctaagagagaatagacgtgcgcacagaccgcgccacacaccgagaaccaataccccttgtcgatagatacgcgggcaaagcgatgcgctctctaatctctctcgtgtgcgcggtgacgagcgctccccaatctctcgatctcgtcttgangacacccacctgagaggtggatggattcgtcaggatggaggctgatgcgtgacaaaataaatgagactgtggtatataatatgcccagaggcaatcccgccgtaacgcgcccgccgacacggcccggagcgtgacagtagtttgccactttctatgctcgatacgccccgcccggtatgcgatgagcggttgtaagtataagtacgcgaaatcggcctacttgcccccctcatacatgattattgctgtgcggtccagcaaaaggtgatgccgatgtaatgaccaagggcccgtcgtagaatggtccacgatgtatttacaagcacgtttgctcccgactcgataattaaatagagtaaaccgaacacacacgcgggataaggagtggatttcgccgcgcgcagtggtgcgagtcgatatgcacacgagcgaacatagattaaaatctccgtggcccgcgcntcgtgtcacgccgttgaggaggtgtaataacaagccgtgcgcgcgccggagcgctcatccagtgtgtgtgaggangaattctccgcgcggtgattgagttatccgtgaccagtctcgtaccgcggagactcgtgtatgcgtgaaggcggcgagtatactactggtcattacacggacgtacgagcttgtatcgtntacccgagtgagaatcgcgcgggcgtgctatgtaccatattctactgagtg

SEQ ID NO: 9863 - DNA, 1146 bp, Homo sapiens
  misc_feature (1)...(1146): n = A,T,C or G
gcgttaagaacagggcttcaaccggctcgctcgctaagaagggaagannaggaggcgatccgctgggngangcngactagnagcacnaaccttgagaanggaagcaacccagannccacagggangnaggggcggcagaccaccccgcgagggaacaccccggccaggggggccaggggagactgcganccgagcgggcaccgcgagccgcagccgcatccacaccacagacanacacgcacgcgccggcacgcgcgcggaaacaccgcggcgcgacagccgcagcagccggagaacagcacagagaagcaccncgcgcncagaggaccccagcggggaagcagcgccacaccgcatacgcagncacaaacgaacagggctcttttttttacttacggtggtgacccgaacctctttcgcctgtcccttcttctcaactagttaggtatcacaactcgcagtatggttcgaatcatcggtcccaatcactgatagttgttaggaacgtataattaatattttatggcatgaccctactaccccacaccctcgcgcccgaataggctgtaactcgacgcctactcacacacctgtcttaaagtaactaccaccgtggcaggtcccacgcgattgagcgaccatatctagtacctgcgcctccgttagcgcacagcctgccctctcttcatcctactactcccaggacatcggggcggccagacgccccgcgacgcctccgcgcgagtgtttccagtcgcctcccagcgcacaggccgtagagagagtccgtgtagcgtaggcgactatcaataaccccaactcacgtatcggcaccaacgggcttatcggagaacaccgcttttcagcaatggctcgtctgattactgcacccaatcatccggcaggcgcgggcatcacgtgtagatgctgtcgatcgtagagagagagtggtctcagtcctggtgtgtgcagactagcgacttgctacggcgtatgccgtcaggcgcangtatctcagtttcggctcacctaaatgtggcgcgtatcgcgcgtcaagcaacgcaggctagacatacgtctgcaactgcagatacgagctctgcaccaccataatcgtcggactccacggctcggcgacaacacgtg

SEQ ID NO: 9864 - DNA, 533 bp, Homo sapiens
tgaggccaacgaggccattttttttttttttttaagttcaagaaatttattgtacagcatcatatctacaggtcatagaaatgtagtgtattcttgggcaataagggagatttcaaatgtcctcaccacaaaaatgacaattgagttaacatatatgttaattagtttgatttagcctttccacaatgtatgtgtatatatatgtatatatatattatatttcaaaacatcgtgttgtacatgataaacatctacaatttatacaacaattaaaaaaggaatacaaaaaatcggtaaacaaaataaatgaggcatttcttgtgaatatatactgagcctataccccagtcatagacaatatttattcttctcaatcacgtgtaaaacattaaccaatccagatcttattcttgttaatgagatcactcaataccatcgacaagttcctgaaaactaccggagttcctcaagaaactgaagacctatccatggatcgagtcatatttaagtctatatgatcctgtgcgtccaag

SEQ ID NO: 9865 - DNA, 333 bp, Homo sapiens
  misc_feature (1)...(333): n = A,T,C or G
cctangagatacattttggaaacggttacaagtattttcgctaccaacccgaagaggaagccaacacgggtggaagggagcccttggcataatatgcctggaatgtctgctattggcactaatacagtgctttattagcatccaactagacaagtgtttcctgttatttgctgttcaaatcatgctacatgattctggtcccttttacatacttctctcattttgattgattgagcccagcaatattccactttccaaagagggagaatgaactgtaggtaaccaatgttttatcacataaaacctcaagattgaaaaacaaaaaaaaaaaaa

SEQ ID NO: 9866 - DNA, 213 bp, Homo sapiens
cttagctgaacacatcctgatcattatgcatacttcaaagattgcttcaatggaccgaatggaaggaagaggttgctgataccatggaaatcagttaaaaggctcatgaaagaatgcaaacaaaaagttttttcaactgaatttgtcctgctctacacctcttcctccacccctccaaaataaaacaagataatactgccaaaaaaaaaaaaa

SEQ ID NO: 9867 - DNA, 194 bp, Homo sapiens
  misc_feature (1)...(194): n = A,T,C or G
cctactggnaactgagcccagncttcaggaatggatcggaattcagtaaggtgcttacttccttaattttggacagtcttctgataatgcagcaaactatcgtggaaagtggttctgtagctgcgtcacacactaggtccctattgggctttgtgaacgatgaaaactattccgaaatctgaaaaaaaaaaaaa

SEQ ID NO: 9868 - DNA, 814 bp, Homo sapiens
  misc_feature (1)...(814): n = A,T,C or G
aaggtgtagaggaggacgtctaatcacacactattagaccggnaaaacctttgnaggttttataaccttgaaactttaccacccttgaaaacctgttcactcatcgtgaaaatgagaatatactactgtctattttacatggttgatgaaagagtacatggaagaattcttataaagtatgaaataatgtgcatagcccttagtaaatgctcaataatggtgaaaataaagaaatatgtagacattactttcaacttgacaagagctattttgacatctatgcaatcaacattactctgaattgaagaaaaatgtgttctgaaatttattagtatttctcccataagcaaaagcctgggttattaacaaagtactagtccagtttctaatttagtaaaatattatttcaatccactactggaatacattttcttactgtaacatacaatatatcaactcaactgcagaattttaaaactcttgtattacttggagtgagttatattgcgaattttctatttatttctcttattttatctacatctaacctagtttataatccactcaggtttgagaggtattttttatattatacatgacatatatctaatgatattttattaattaaggaaagagttcataataaatttgaatttgaaagttcatgggaaatttactttaacttaaatttacaattaagatatttgagagaggatgaagtattgctaattgtaacaatttttaccaaacagaaaacgttttaaagtaaccctttaaagtataaaaatgtatttaaaacccaaaaaaaaaaaaa

SEQ ID NO: 9869 - DNA, 252 bp, Homo sapiens
  misc_feature (1)...(252): n = A,T,C or G
agccgatcaatcgtggtcctgctacanggacggaactgagagctgaacatctacagaggaactgatgagtgaccacgcgcgagagaacagagtcaacccccaccaagtggaggaggagggaattcatagaaatacacgactgaaacacctatagagcttcaaagaagcttcatatctcatccttgggcaatgaaaataaagttggagaagctgaaaaaagataatgaaatggcctccttggcctcagccgca

SEQ ID NO: 9870 - DNA, 552 bp, Homo sapiens
  misc_feature (1)...(552): n = A,T,C or G
gggacggagtgacgtgatacacttttaggaaaaagaaaaaaccttagggctaccagctttccgttgcggctgtcacgtatgganatactgcccatcagcattggagaggctgtgagtcctgagcatggtcgggttggacaagctcatctgggtgacagtggtgggactcagtggaataaaaggaatagaatcaaaaggtgtgcattgatgtgtttgtcttcctgaaagagaattccattgacatgtcagcagggactgtgactctttttcttttgctttgcccactgtgccagtcaaagcattatgtcagaagtaggcgttgttaacaatacctattcaatcaaaacttaacttttatttccaacttaataaagcaatgaggatgacctaacatgggatatgcgataaaatctatttctttagagggcttagaaaaagaatgcattctttttaagaatgggataacatgttctttgctatagccctaccaatatcaaccaaataaaagaaaatattcgattaccgtatcaaaaaactttaaaaaaaaaaaaa

SEQ ID NO: 9871 - DNA, 258 bp, Homo sapiens
  misc_feature (1)...(258): n = A,T,C or G
ggtcagtatttaggtgacagtgacaaagannnnnncccttangaaaacactcactgtgttgccaggccgcactgaagtggggtgatcacaggtgtgatcagagctactgcagcctgaggctcggggggctcacacaattcttctgcctcagcttcccaagtagctgggaccataggagcatgccatgacacgcagctgactacttcttaatatataaatttggcaagtaaaaatgttgtaaacgtaaaaaaaaaaaaa

SEQ ID NO: 9872 - DNA, 848 bp, Homo sapiens
  misc_feature (1)...(848): n = A,T,C or G
agggaagacaggcgaacccataaggagaagaanaaaaccttagcgcaactgaagncaaagctgaaagggcagaacgaaaacaggcacgacggaccgcatgcatgtggatacccacaccctgggcggtgggactgcccccacacatagaatagacccgctcatccccgacagccctgactcagccaggaccagagatcccacatagagtacactcgataggcacacgcacaattgtcaccgggagaccccggaagcagccgccgctttttaccatagaggagagatgaggtcagacgggacccccagggggtgacgcatgacactagacaagtgcttccaaccacccacgtcactgtggacttcactagatagaatcggccgagaaagggcaacgcggtggaacactgcggccgctaacctacttaaagggaaaaagaaaaaaacaccatgacccacgaggctggcactggaattctcagggggtccacgcctcaaggcacagaacacggggggtatcccgttaccccaatcaccaggggcaaacaccccacaaaccaggggtgcaaaaggcggctagaaggccccaaaccaaaaagaggggcaataccagggggtagtccaacagggctccaaccccaaggaaagcgggttatcatgggaaccggcgaagaagaacgggcccaagccggacgggccattagaaatcccggcggaaaccacagaaaaaaggcccacgaggcccaaggccgagacctccgggccccgaaccctgaggggggggaaacctcggagaaaggggcagcgtcccagagtcacgcttaaggtctccacagcgggagagccacccc

SEQ ID NO: 9873 - DNA, 1270 bp, Homo sapiens
  misc_feature (1)...(1270): n = A,T,C or G
acgtaagtggnaatggatgtgtgacgaggaggtnnnagtctgatgttgagggtggcgggttgatatcatacgacggtgactncggctgctgttatagtagcgtgtgcggtanngtactgataactcgtacgcagagttataatagtatgggtgataggtgtgagtgagatcgagaggganaggctatgtgtngngcactcacaggagactgaatcgcagtgaactattaactgctgagagatgcggccatgggtgacattgtgcggttgatgnggtggtgnagcggggctggtgagggggtgagagtggngttgggggatgaggcaggtngggtggtactggccatggtgtgttgtctctgtctgcgcacgtcgagtatactnggtagtacgtttgcggngaggatagagggacggatgcggagatatgtcttngagtactgacgtanaactcagatgtctgtgctggaataagtatcgaggtgatgcggtggcgcgacggatgtcatagtcggtagccgatggtagcgaaaagagcgggcgctagtgatatgangcggagtgtacggagtgngatgncgcgttgaacagcatgtggagaggtgaagagaanagcgagactgtgacgcgtggggaggcgtacgcatgtgttgaggagggnagtcgtggagctatggatgacgagtttcttggatgtagggggtgttgttcattataaatcacatagaatgangggaggaagcaggagaaggtgaacagtttgtggcagcatgttggcgagtgtgaaacacaacgaaggtgggagcgtggctgtgtggggatgggcctggattgcgtgtgncctcgtggagggaccttccgggccacgtgcggatctgtgttnntttctttgttgctcctctggcgtttcgctcgcgcgttctcctccatggtggtctcgggtcgtgtgggggctgggcggcctggacgtcgtgcgctgatgttgtncgcctttggcaggtgcggtgaatggggtgggtttcgcatgagcntgtgagngagaatgacgaagggagctgatgcttaactgttgggtgnccctagtctccaccacgagccagtatnagctagctcgtannnactctgtcctcatgcgtncctccgtgtcttntccttctttctcacgctcccttaaggnncctctcgtctcnanntcannncctaaannccnntcacttcttnnnccttnnnnncnncnnnctctnncccctccnnnnnnnnnnnnnnncccc

SEQ ID NO: 9874 - DNA, 1109 bp, Homo sapiens
  misc_feature (1)...(1109): n = A,T,C or G
gttatacttactagttgtacatacatagatactacnctatgtagtcatagttagataaattacagannnaanangaacccgtcaagtcgtngctacaaccacgccatcgaaggactactttttcaaagngacgcnanaggcatcgccacagccncattatttctagtcgcgctccacacgntagaaataacgcacngatnctattatctttctngtntacaagcagggcgactggagacgagngtaagtacttatatacacttncacaatcatatggngaactactctggagaacatcgaaggagcattcctaanaatatcgaganctatataacctatacttgtgtatctatggcgctcttctatatctacatctcagacaaaaggagagcagctgttactactactcacataatacaatatacttaaaatcctctctaccttgttactatggagggggagtggtcaacacctcgaatttccttaaggggacatattacacaccatacctacattccctagactatgttcacctatggcctgattactattgaggtaacctataatcaagatcgttactatgacaatttataacatatattcactaaattttagctttataagcagatagcgactctttagaacctcttaagtacaaaataaagaggcagagtaccccctcaaatagccccaatcggtttggaactttttcactacgctttctcctctcccctgaaggataaataaaaaaaacctccactctactaatctaccagtgtgccgacaaccccatcgggtaactataaaaaattgccatgaccctgaccccctaatgacagccaaacccggttactccctctcttatacaccgccttatcccccaataaacaaaacacctggacccaacattgctaaccactatagcaaaagaacctcaaaatcagcctcaagctacctccaaatattttaacaaaaaagctgcctacactcccgttacattcttatacacatgatcttttacctatcagtacctccctcgcgagaccacaccacatctccttttataagccaaacattttacgcctttggaaacctacataataacccta

SEQ ID NO: 9875 - DNA, 1400 bp, Homo sapiens
  misc_feature (1)...(1400): n = A,T,C or G
cgtgantcggacggggagtctgacgtgctggatnggatcggcgcgtgtggtgtacagtaggacatataagcgatcgaggcggcacgctggctaggagaccagcgattgataagctattcggacgctgtgaggtggagacgtgagatgtggaggcagtgagataagggtgagcgtctacgtcatgaaagcaganagccgctcggtaggcgtgttcggcggcnaactgtatatctgtagcggnacgtcgctgtcgagtggactgcactgctctgtgagctgancacgcgtatatgcgtcgtatgtgncgatctcatattantgctgtantatcagngacatgcaagtaagaggcaatgagcacgcactagtgggtctgatgaggtgtcgaccagcccaggggtacccgaaaagtggggaacgacctggnnncggagtgtgtcgtgtacggngcgcctgtggagcagcgtactgggcggctagtggcgggagcataagcacacgcacgctgccgagagaacgtagganggggatacangtgtacaaaggctgggccagtctaacgtcggagacccgcaggatggtgagcgggcggcgacgtatcgtacgaagnnggcacgacgtgtcatngnaggagaggagnaacgagagtgtcatggattatgccgcgacggcgtatgtgnnaagctcagtgaatctatcgacgcgtgagtccatctacatgancgcagatgagtngtgacggactacactatcgtagctataatacactctgnngcgctcgtctacgcgtctctatacgtngtgcncatacgcctactcgtgngcgctgcgtgcgcgtccgcggngcgcagcctctcgcgncaccgtnccgcgcccagcgctggcctggccgtcgngcggcgcgcgntgatcgacgtgaaccaaacgtgagggacgatcacaagcgacgccgngngcgagcgacatctggngttacgtcgtgcgtccctcatatnctatttatntatngcactagtatacccgcctgtggttcangtctantgcgcttggtnngctgtggcatggacatacggacgcgtcgctctaccctgttgnagtctacgcacgctcagcgactagtctagtgtggattgattatattanagtctcttatttcaactagtgttctattaatgtgcactcacgaaacgtcatccaatnnnccgactatcttnnatcaccactcctatctacatcccaatcattnnaccactgcacccctccacattcaacactccttnaagatccaactccaacnctnagcatacgtnncctctctcctccactcnncctcctattncctaaannntctctnactctctactcacgctcaannnnnnncnnnaacttnnnccaccctt

SEQ ID NO: 9876 - DNA, 313 bp, Homo sapiens
  misc_feature (1)...(313): n = A,T,C or G
tcgtgagctactagcaccaaccctccaaggcagacgggctacctctatcatcagtatcatcaccaccatcctcagtaacattcccaacaaaaactaccatcgtggctcctaacctgcaccacttccacagccactgccatcatcgctacttcctttaattcagcagttatttactgagcagttatttactcagttatgcactgaagataaccaagcactgttgctggngaaaccaggccaattgctccgtagaaataatgtgtatgggtttttgaataaatatagaaattgactctcctgaaaaaaaaaaaaa

SEQ ID NO: 9877 - DNA, 864 bp, Homo sapiens
  misc_feature (1)...(864): n = A,T,C or G
caaccccactctttcaccacccccctcaccccaccccccccccctcacaggtacacagaancaaattgaaggaggaagacaaagaaggaagaggaaaatcaggatgacataacaggaagaagctccaaaaatgttataaagattgtatagtcgaaattactgttcattcaaaaatgtgccttctgatttgatcgaatataatgaaactttccaaaaaatgccttgcaaaccgatatcacatctaaatacagccattacaataacatgcacaaaatactctcaaacacataaggatttcctctacaatcattcgctactacattaatgaatcatagatacacccgatcttatctatgcactgacgatatgaagagatctgatacaaccccacccctgcgttctcctccccaatcttacaccacctatcccattctctaatctaaaaagacccccgcaaccttctccctcaacaacatcaccctcctcacctgcccaagaccccacctccgcctctacccccaccccataaatctcgacgctgtccatcgtcctacccccctaccccgaagcctccttttgcaacaaacatctatatcaagactctcctccttctcaaaccccctcactcttccgtccactgccacccacatccaccacccatccatgcacctgcccccctacatacttacatctccccaatatataaaatttcaatccgcttttcctttcccctcaccaccctcacctcacccaccctctttcacttcactcctttccaccattacatctaatactccactcccccactaaacacaaactccccccacaccaacattataacatctctttccccctgaaccatac

SEQ ID NO: 9878 - DNA, 831 bp, Homo sapiens
  misc_feature (1)...(831): n = A,T,C or G
atggtaggtattagagccaaacaaaaaaagaaaaaaatttatcaggggacaacggctgagggtgccaaaggaaaacatancgaggaaatgaaaatggaggcccttttcactaatactcgtgcggggaagcggagaaggaagctcctgctcctcctaaagccgaaaccaaagcaaaggctttgaaggccaaaaaggcagtgttgaaaggtgtccacagccacaaaaaaaagaagatccgcacgtgacctaccttccagcggcccaagacattttttattctgggggcagcccaactaccctcataagaccaaccccggagaacaagcttgaccactatgctatcatgaagggaggactgaccactgagtctgccatgaggaatatagaagacaacaacacacttgtgttcactgtggacgttaagggcaacagacccccaaatcaaataggctaggaaaaagctctatgacactggatagaaccaaaggtaacaccctagattgacctaaatgaatagaagaaggccatagttggacgcgctcctgattacgatgcttcgcatggtaggaacaaaatcgggatactctgaaccgataccacttggggatcgcaaggtatggtcgtctgcccccgtaccacagaaatagaagggctgggagggaggcgtgataaacctgatatccgagcgcctcagaggccctgggaaggaaactgctgtaaccacgacggataagggggtatagaacgaagagctcgacctacactcaagactgcggataggagagaatttgagggagggaaaggaacgggcatcttatcctagatgagaag

SEQ ID NO: 9879 - DNA, 897 bp, Homo sapiens
  misc_feature (1)...(897): n = A,T,C or G
aagaggtcgaagattgagaaacctgttttaatcccccacaacacanntttaaagtggacgcacgaagnngttggcgggaacnaccgcagccacagnggancanaagggacggngncttgcnaaagganccaagccggncgcaaacaggccggaaacaaggcanccaccncagcngccagaggaaccgggacaacaggccggagccacngcagccagccagaaaggaanangaagggaaacgcgaagaaaacaacgcaggagcacgcccgcttttttttaatccatttcaacttctgctaatcggagtgtatattcagggcaacttgaatctgtgctcctgggatgcaatcctcaagcttggcccaaataaagtctccgcttgatcttaaaaacaaacaaaaaacatataacaggatttttcaatattcgtttgtattctattttcacccaaagataacaacatgtgttcatagagccgtattaattcttctaactgatcgacttaagtaatatgtaccaagaatcgaattttacgtccttgaagaggtgccgcattatctttaaaacatgatgagtgattctcgtgttttttgattatgctaagtgtatacataataatgcccattatttgtccgcccatacatacttttttattctctgtgcaagccgcggacagctctaatataagaaggccagatcattatagttatgataattcattagaatgtctaataaagatgcctaagcgcgagagcaatacttgttaaagagaattgtgaagataagatacttaattagtacataatatcactagaagtaaaaactataactctaacactaatatgtcgaaaatcgtgtatacccctatacacactgtgtttcacatatcgctagata

SEQ ID NO: 9880 - DNA, 548 bp, Homo sapiens
  misc_feature (1)...(548): n = A,T,C or G
gggngggancnattcnanagnangangcctggncnaanatttnaantaaaccaatcnncggtaanggttaccctctatttaanatgactcccaataaaaacttctaatggtttggcatnattagttgatcaagancttttaagcatttatctttttgatagggtcaaggaaccttgtctttaactccccaatctntgaccaaaatanactttgttttctataagctataaagccagatagccaattttatgagaantgtccctatactatatccatgtgagcgatgagtgcctggcatgaagatgcataaaggaggcagtaatatacaacaactgaagcataacctctggagccagtcttcttcagacaaatcccaattccattactcactggccacctaaacaagctacttaattcatctgcctcagttttcttcaactgtttaatgggtatgatcaacaaaccaacttcagtgggttatcataaatattaataaatgagagaatgcatgtgaaacaaagctataagcaatcattagtaataataat

SEQ ID NO: 9881 - DNA, 877 bp, Homo sapiens
  misc_feature (1)...(877): n = A,T,C or G
cttcatagaaccgttaacatcttcgagaaacgagtggactataaaggatggaaaggattgtggagaagtgggtgggatgggtgggctggttatcgatgggggttaatgataatatatngcagtagatgtttggtgcggagggatttgtggggtgatgtgaattgtacagggactgagagagaaaaaagatggggaggatcgtaccggaatattcattgaagtagaaggagatgggtgacggagcgggtatgggataatgaggggggaaggtcggaatggaaaggtggtgagaatcttcttgattagacgatgttgttggatatttggatttatatttttagnatatttttagtataatgtaaggagggagtggtcggatatatgatagaaaagagtggtagagggggggagtaggtatggaaaataggagttggattggtggggtggaagaggggcatatgaaaagaaaagggtgtagatgatatgggagggagaggaaggaactgttagncatgtcttagggtggggcggagggagngaaggggggagaatagatgaagggataatcttncncatatatgattaaagttttattgtaataatggggtgagatagtgaaggtgaagtgtgtgtgtacgattgtcttattatgcccgggacggtnnagtggggggtgagaacacataannncatatgatatataatactagantngcttgatagaaaataaatctatgaataataacttctctcgtcnccttatttnaatatcagttnactttaaacttncatttctatttnccttcttcnnnnntcttnnnctnnncttttncctcttctttctcttcctcatnnnnncctccactcacttcactta

SEQ ID NO: 9882 - DNA, 873 bp, Homo sapiens
  misc_feature (1)...(873): n = A,T,C or G
aanaantanagttatngaatnttnantnntnaaatntantcnttatatacnnagtnnangnnaaaanagaactncttggntttnnttgcaagatnaagtgaagatatnttaatngaattgtgagnncngaatnaaananagagatagcttagtagaaattntaggntcanngaganagagtataananntantctttatttntaaagtggggnaaagnatangtcntaaggnnancanntttaatagntgnaggnntgnggtnggaaatnaaantgtaaggtccaatgaggaactntngantncagtnagttatttgccaaatnttnngnntcatnccnatncaccccaanaaggaggtacttgtgtgattnntgtgatagggtggataangnggaananttantancctcatnantnntanttggattaancaannngaattaanacnaanttgccaaggagtgtaaagaatggcanttatncagacaggaaatnnggaaaatgcantggtgagtaactgnnagatgaanagcatgaggtactaaataggagataggtagtgganacggttcggataanaattatatnaaggagcaaccannanactnataaggtantgttacatgccaccatagagacagtgtttgcccccaaaatgctgtcnttgagacctgtactataagnnctngttacatcaagtaaagattngangattgagncngtnagngacangaccgtcgnagtnatatangatagantgtacgtaatgagaacatntanatcnggatatatagganncannaanaganaagtntagataaanagnaantgaagtgatataagtgaaagagatngtngnganaaaanagatg

SEQ ID NO: 9883 - DNA, 773 bp, Homo sapiens
  misc_feature (1)...(773): n = A,T,C or G
ccttgntacgcnccaccgaaaacctgaccactcatcggaaaagagaaatactacggacgatgaacatgggtgaagaaagagcacatggaagaatgctgataaaggacgaaataaagtgcatagccctaagaaaaagctcaataatggtgaaaagaaagaaatatgtagacattactgtcaactggacaagagcaagnntggctgcatgcaagcagacaaaccccgaaccgaagaaaaaagagaactgaaacccatcacgacggcgcccataagcaaaagcctgggtgattaacaaagaactagaccaggctccaagagaggaaaacatcatcgcaaaccactacaggaatacatcccctgacgggaacacacaagagagcaactcaacggcagaagaggaaaactcaagcacgacccggagggagtaatatggagaagcccccaaagaggggcagcacgggaccaacagctaacctagaggacaaaccacgcacgggcgagagggagcgtcgcacatccaacaagaaacacacccaaaggaaacccaacaaaagaaggaaaaacgccccaaacacagacgaagcgaaagggacaggggacaaagcaacgcaaccccaaccacaccaggaaaacacgggggagagggagaaagaagagggaaagggcaccacacgcgagcaccggagcaaacggcgagaaagcaacccacgaaggaaaccaaaaggggagcagacgacacaaaaacacaaaggcccagacggcccaaccccgat

SEQ ID NO: 9884 - DNA, 676 bp, Homo sapiens
  misc_feature (1)...(676): n = A,T,C or G
gttttggtgtaacactgatagctcttgagggtatgcactcttccagagctaagaaattcaagatccttaggaatgactacagtcaaaatcacaaaagaagtagaaaatgtaaaagtaaccccaaaatagaaagaagaaataatcttcaaagaggatgttttcttaaattgtttaaactcacaactaaattgaacaaatgtatgttaagcataatctacataagatttangtanaagatattacaaattctatatacactgaggttttacttactgtcaaaaacaatggaaatgtacaagaaattgtcccagtcaaatccaagacttgtatgcccctgatgaaattcctgcaactaagaaaattcaataattcacattttaaaatatgaatatttcttatcaaatgaagatttaattacttatcaaaacaaagaagatttgaaaagatattcatatcaaaatcacaacccaaaaacatcaaatgcatctctgcatttccctttaaaagatgcaaaaaaaatgacattcatgcattataagttgaatgagaaagacagaacctctggaactttactgtttattaggtgatgatcctaganaacagtccatgtgaactttctgacagtgtgagaatgtttcttgcaaaatacactctgcagcaaataaaaaaaaaaaaa

SEQ ID NO: 9885 - DNA, 338 bp, Homo sapiens
ttttgatgtcacgtctcactgtgctgcccaggctggactcaaacttctgggctcaatcaagtcttccatgtgagctcccaagtagctgagattacagccttgcacctccctgcccagcttccaggattaacgtacttataagaagagacaccagaaagcttgttctttctctctgcaccaaggagcacatatgaagacgtggtcagaaggtggctatttacaagccaggatgggagccctcaccagaaaccaaccgtgctagcatcctgatctcaaacttgcagcctccagaaccatgagaaaataaattttagttgtttaagccaaaaaaaaaaaaa

SEQ ID NO: 9886 - DNA, 332 bp, Homo sapiens
cctctagggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttttttttccattagcagtgtgccagggttcccttttccccacatcctcaccaacacttgttttcttttgtcttaataaaagccattctgacaggaaaaaaaaaaaaa

SEQ ID NO: 9887 - DNA, 289 bp, Homo sapiens
cctaggccctactcagaggtgatgtaactaaatgaggccttcgaagtgggtcctaatccaatatgagggtgttcttatcaggggagggggtctggacacaaagacaccagggatgcccaagcgcagaggaaaggccacatccaggacacagcaagagggtggccatctgcacactgtggagagagacctcagaaatgcaccctgccgacaccctgatcttggacttccagcctccaggggggggagacaataaatcatgttgtttaagccacccttaaaaaaaaaaaaa

SEQ ID NO: 9888 - DNA, 308 bp, Homo sapiens
  misc_feature (1)...(308): n = A,T,C or G
ataggttttcctttttttgagacaaagtttcactcttgttgcccagactggagtgcaatggcacaatcttggctcactgcaggctggggggcggagactcaantgattctccacttataattcaaaaagcagcaacaactgcggagcccccacttggcctctcttacttatcattttttttgtgatgagagcatatgaaatgtactcttagcagttttgaaatggataatacactaggggggggtaaatcaccatgctgtgcaataaacattcaataaaaaagttttttccttccaaaaaaaaaaaaa

SEQ ID NO: 9889 - DNA, 867 bp, Homo sapiens
  misc_feature (1)...(867): n = A,T,C or G
tgtcgcaggagatgttttattacggagaggagagaggaaggagggaaaaattttcaaaactacccttgatctgttctacatcctaatccccaacattccccttctcctcctccttgtggtcaccacanttggaggntgggtgtggatctataaaaaaaaaaaancgggagcagccataccctatcacaaagaagcaacacaccatctgggccctctcctcaccagagaaacacccccgacctagaggtctacaatgtcataaaaaaacaaagcgaaacttacttatctggggagggcgggcagacctaaacaatatttcattacaagtgtgttcgggagaagccactcccgatgacatgtgttgtgactataacaacatggctgtcaacccatcaaaaaagtgattttctaactcttgtcatccttgaagaaggaattttgaaaccaataacattaatgagtttctccccaaaccacatggggaggagtcaacgaccctggatcggttgaaaattgaaaattgtgggtattaagaaccttagtaaaactgaaccctgcccacattggaaaanaaatgtggaacccaaactccttctattttctctaagggaaaaatccccgaaagtgctttaaaccaatcttaacccccgggtcctcgtgatagaacctgaggctcctaataacctctttttagaagctcccccggtgcggctgatccttttatccccggcccgtcgatacggctcaaccttatcaagaaattactctccccccaaggtttgtaacctatagcgagcttcagagaaggcaatcttctgaaggtcattctgcatcccctagaggacagcacctataccttgcgatatg

SEQ ID NO: 9890 - DNA, 173 bp, Homo sapiens
  misc_feature (1)...(173): n = A,T,C or G
cgtgcctcctacgattgatcactgtaacaccaggtatcgacaacaaccctggagcctccttctatttatttcacgtggcggagggtgaatcactaactanaatatataatttagaaaaagaattcatttttggttactcaaatataacccattttaaaggaaaaaaaaaaaaa

SEQ ID NO: 9891 - DNA, 775 bp, Homo sapiens
  misc_feature (1)...(775): n = A,T,C or G
tcctttagtcnctagagacgctnctcaaatgaaagaaccaactgatgatatccctgcaacactcatcagattagtttttaagggagtgggggcgtgttctaacatcaaacatacaggtggaaaaattgaatagattcaatcctagaattttaatactcttcacaagagaatggaatcttatcttcttgtttccgaagcaactctgggaaattacaatattaaaatactctcctgaaacggggggcaccaaccacagacatcatagttccccatgaatcccaacgcattaatgggggaactgtttggcctttatattggcctttgtcagtaatatggctaatactgaataggttgattgatcaccttcacacaatgtgtcatattaaatgtaaaagatttgggtttttccccctttctttgaacctataattttttaggtccttaatggaaatttgaccataataaaacaggaatgggttctgtgtttcatagaataagagaaataaaatgggtcttttggcctcaacgggggagctctgcggggcgtttcctttggtgagggtaaaataatgagccttgcgcactgagtagttaggctggcgggcttggtgaggtaaccgaatcaatttccctcagagcgggaattcggattctcccttatttccgggatacgctgaaagagcatgtgatcactggggcgttaggcgcctgacccttaaaaggccggggtttttgggtttgtcataggctcacgccccgacgagcacgcaaaatg

SEQ ID NO: 9892 - DNA, 407 bp, Homo sapiens
  misc_feature (1)...(407): n = A,T,C or G
tggaggaggggggggaaggggaaggggagagggggcgggggggngcttcagtgtgacacaaaacaaaaaaatgtcaggtgctctagagcacaggcgctgcacgtatatatccaaatngcctcaaccactgagagtggggggnaaaaaaaaatnnccacttccttccttaactaataacacttacctttaaaaattccttctccttnntcaaaancttccccacttancaccttatnatanccacccctacccttcaaaaancaaccccctttaactttaatttgggggggggggcccaaatcctgtaaaatnccccaacaactatctccattcagtgagtctctattgggactcagcctgcctggacccaggggattaaaaggctttatgggtcaaaaaaaaaaaaa

SEQ ID NO: 9893 - DNA, 818 bp, Homo sapiens
  misc_feature (1)...(818): n = A,T,C or G
ggggggggggagggtgggagaaaaagggagggggnnaanngtcatgtgaactccagaaaagctanncctgcaaacagaaaggacaactttgatatgtgcagntcaagtttcacatctaggggacgggggcagctaaaataaanggagaaatggagaaaacccctgtgactccaagccaaggaacagcaaccaagtaccctgctaaatccggcgccctgtccagaaccaaaaagaaactctaaggttccctccagtggtggactttttaaaaacggggggggtcttgttaacactttgatgaagggggcaggaggggaaaaagacccccctatgcttgacttgtagcccttggagtccaaaaagccccgccatgggttccgcgccagcttaaaattgaagctccttatctgagtatacagataggcgggaacgtgacattaaaagacaccccggagtggggtgggcgggggagtcaagtggaagtcacctcaggagggcactagggtttgttagggggggccgagtccttgcagttatggtggggggcgcggtggggttttacgtgaactgggagggggaggagcggggggatggggagaagcagaagggcgaatacagaagggacggcgccaagatggggggcgcggggtgaggaccgacggtggggaagatggcctggtcgcggggcggaggggtcgggggatagataagagaatggggctcgagtgagcaccgcggggggttggggcctgcttcgttaagaagggacagtaatatgacccccggtgggtcttggagggtgagtgttggaggcggag

SEQ ID NO: 9894 - DNA, 1071 bp, Homo sapiens
  misc_feature (1)...(1071): n = A,T,C or G
cgctggttgcgcctcgcgcggccgcggccggccggggcgcgccgtccggtcttccgcgggcgcggcggcgggccgcgcgcggggctcggtggccggtcgccggtcgcttgtgggtgtggtgtgttgtctttctccgtggttgggcgtgcgtgcgcggtcgcggtctgtcttcggtggtgtgtggcggtgtgcggcctgcttggccgccgcgcgcgcgtcgcgcggggccgtttgggatgggctgggtgtgngggtgtgccgtattggctcttgtgctgtctccggctgggccgctgtcgggttgtgtgggggtcggttggggcctgcgcgctgttccgttncgggcggggctgcccgctgggcagctccgtctttccgcgcgtgcgcgggcggtgcgccggggcggcgtccgtctttcgcggtgggtgttgttgtgggggtgtggtccgggggcggcgtgcgtgcggcggggtgtgtgggcgtgggcgtttccaccacgtgcctctcctcggctctggcccgtcccggtgcgcgtgggcgccgggggtcggggctgcgatcgcgggtggggcgcggggcggggtcgccccgggcggggtcggtggcggggcggtgcgtggccggcccgggcgcttgcgcgcccgccggcccgcgcctccgtcttttgcgggctccttccccttctccccccctcggcccccgcccgcgggccgcccgtcatgggggcggcggcccgtaaaaatatctctctccccgctccgccgccccccctctcgcctctccccgttctgtccggcgtnggttgcgtgcgcgcgtcngctcctccgccgccccgtgcctttccttgtcccctggctctgcttttcggccctccgccgtccgccttgctcgcctgtcccctctctccctctcggtcgggcccgcctttngctttctttccctcctttctccccccccccctccccaaaanctctccccttncctcccccttccttccttctcctccccnggttttccccctcngagctcctctntccttgtttcccccntagggctctttttttttttttt

SEQ ID NO: 9895 - DNA, 862 bp, Homo sapiens
  misc_feature (1)...(862): n = A,T,C or G
tgcatatgaactctgccgcgcgctacgtgtcgaacgcccacttncgcacatgagattggctttgtgtggttcgttgtttaataaggagaaggatgatcngcccgaggtgtgtgggtgtagttggaggcgtctaaggcacgagagagtaccaggaccgagggatcggggaacaaggactagatgcgggggctgtncgangacaactgcatcagagatgagtccgtaggggcgtggggaataaaacctaagtcgtgggggccctcgcggactcgtgagctcgcgtgggggggcagcccggcgggctggcgtaggatcgccgagggtgggggggagtgcggagataacattcatttggtatgacggccgnnaatttgaagagttaggtcttagtagagcatccggggttctgggtagtgcgggtgggggtttgatatgggggggcggggggggcattaccgtgcgtgaccggggagtatagggggggtggagaagaatcganacgagagcgaagttgtcgattatgnccattgtggatgcgacgaagtaacggggggtatgaaggtgctgtgttggcattaggactggttggtctgcgggaatgagggtggcgtcttggtatatgagtgtaaaaatggttaatactccataaagtcacgacatttttnacttatgatcttagttaaccccatgataaatgcccattttttcctcattgtttttttgcccaccccctcccnncccttataacaaaaaancccctcggcctcgttggctccaccgggncgctctcttncctgattttnttttttnactaacatantttttattnancgtgtctttttntttattctttatattatac

SEQ ID NO: 9896 - DNA, 328 bp, Homo sapiens
  misc_feature (1)...(328): n = A,T,C or G
cctanggggaacttcatggaattctcctagccctaaactttgccagccatggacctgggagtaagcttaacaatgctgtggaatgaagcctctaacccatccaaatggacatgagcaagaaataaacctttgttctttcaggctactaagaattggaggttgttcattatcacaacataatccagcttttcctgactgacacaaagatgatgccaaattttccttatttgaggaagtgtttcttcaagtagaagtctgaagataatcagaagtctttcaactcagatgacccttaaaataaaaatgtagattggtaaaaaaaaaaaaa

SEQ ID NO: 9897 - DNA, 1547 bp, Homo sapiens
  misc_feature (1)...(1547): n = A,T,C or G
gaatgcctggccaggagtcgcacatctcggccgcgcacactagccccactcgcacgccccagacaacccgcgcgcgcgcagcaggcttttgaggcagacgcgaaacccaacgcgnggcacgagngatgaggtttggagcaggagtgacaggaggtaccnanctgctcgacgagcagctatggcacgatcgagtacgagtaggcgacacagangcgacagcgagctgcccncagagagcgcgaacaatgagcacgtcgccactagagcgcgcgcagaaactcagagcacgccagcgccgctagcgcgcggcctgtccgcccgcgtccccnccgaccccgcctgctgcgtctcaccgccgatagatagacacgcgctcacgtctatctcagctgccgtgtgacggcggagtccgccggcgcgcgtgacatggcgaccgattgcgatatcaatcacggactgcgacgccgcgcacacgctcagcgtattcgacaatatgagtggacacgcgcagtgtaaacgaagacggtacgaggagtgtctgagagcactcccgcagtactcgaccgccatcgtctgcgatggagtcgatgtgtctgcggcccacctcggcacatgcgccgcgcgttgtgcgcggatccgcgcgcgctgccatcgcgatcgcccagcacgtgctacgtacgagcacaacaagtaatgtgcatcgagcggctagacgacgcacgtactgagcgatgttgcgctcgactcccgcgcgctcagtgcgccgancngcacgtaggcacacncaccgcctgacaggatgagtcgttgagtgagtggcggcgtacgcagcggagcacggagagcgcggagaccgcatacccgcggctcacgaagatctgngagtcacatctccagccgagtcagtgctgcgccgatcatgcgtggacacgtgacaaccgagcacctagggacagcgcgcaaggcgatcgcatgcgcagccaccnataggcgatagcggactgcgacgctngctggagcggcgcctccacggacaccgtcgatcccgcagccgtgcttcaccgcgccccacgagcgcgcatgcctgcgcccgcgcgcactgacgccgataccgcgcacgcgaacgacagatcgccgacgacctcgagctctgctctaccgacatcgccgcngatgccgaccgacacgtcgtagtcgagcatagccgtacgagttggcggagactacctcgattggcctccgggcgccgccagtccacgacagcgaactaccacgtgagcccactacgcccaccgcatagagtgatgcgcaccacctctatgtgcccgactangctcnaccagagttcgacagaggtggctagcgccgcggagttgccaaagtgagtcgctcgcacgctgcgangcgagaagaacgagatgtgatgtgtgtcagcacgtcctcgcgcggtagacatgctcatgattntcaacgcgtgcactcgcgcatgtgctgggcgtcgcagtcgcacgtcactgacataggcgagancataagctgctcaacga

SEQ ID NO: 9898 - DNA, 801 bp, Homo sapiens
cctagatagatcacgtttgactgctgcaactggtgctcatctgggatctagaggcagatatctgaggatctgtattaacggaaactttttcacaatctccatgaaataaacagctgcttgcacacatgacttcattcctactacagtactgatttttcacaaataaaaagaaataatactttataagaacaacagcaataaaaaagaaacaatctcccttatttttatttaaatgaatatgttttgtgaaaagctgttttgtattcaggtggctatgtaatcctgtaatttctctagaagctttcagaataatttcataccttttttcattataggtttccaaatgcgtaacagggatgagtgagcttgtgagtttctttaatatttatttgaaaatttagtgatatagagttataattgatcaatattaccttctttgaggagtaatttagagactaaatgctatacattaattgtggatttgttagaataaaatcctctggataacacagagaagcaacagatgtattatataaggctatcccaaaagtaaaaacttttaaagaatacaatagttgaatgaacatagttttcaagcttttaatttgcttttctctccttgaaagcattccttggccttgctatatcagaacatcatcaccccatctaccactggatgttttatcaaaaggtcagcacaaaatgcataaataatttaaatgcagaatttattttttaattgcttagaaatacaattgctgagaggttatgatattatgctttatagctacccaactattt

SEQ ID NO: 9899 - DNA, 456 bp, Homo sapiens
ctaggtgtagagtcaaccatatctcaaggtacccctgggtctggtaattggaaaatggcatatgaagaccatatcctgaccactagaggtgctgaagctgacctgacccttgtttctgttcctatacagtggatgaactatgaagtatgcattgttaaaaactttaatatccatttatttctgctcggagtttggaagagaacaaagcagaattattatggattaagaattgctattattattattattcacaaatcgtgtatatgctaaaaaacactatgtgtatttgttatggaatgatatatgctgcaggcaagagagtcattcggctctttactgataaaactttcagggtgtattaagatggtaaatacattataaactatcattgacttattaaaactacaatacagcaaatgatgaaaaattattgctgtggaaagttttacactaaga

SEQ ID NO: 9900 - DNA, 322 bp, Homo sapiens
tgaggccaacgaggccatttttttttttttttttagttttttgattggctttactcagaaactctgtggtcaaaataggcatttgtaatgtgtttaacaaagaacattttgcaaaatgtctgacaatatggagtatgaggcaattgacactcatatatgaagtcatcatcatcattacccagagcagccataccaagtgccaacacaacactggctacccagcatcactggagggtgccaacaggaccacaggaggatgttgacttggaggatgtttctccagcgtcctagacagaattatagtcacatcgtggatatcaag

SEQ ID NO: 9901 - DNA, 296 bp, Homo sapiens
tagatcccagaagccttgagaacaaagagcccacaattgcagtaaaaagcagcagcccggcagccaccagagagggcagagtcccgcaacctcccaccactttgaaggagctggagctccttcaaagcctcattcaaaagaaattgtcattattttacctatctggtgtttcccgggaaccctacttgcaaggctggctttatgtgattaaagttcatcagtgtaaaaaaaccttttccctagtatgtttgtcaaaaacaattaaaggtaattgtttaacttcaaaaaaaaaaaaa

SEQ ID NO: 9902 - DNA, 460 bp, Homo sapiens
ctagactgtatctcatttggatttatctaattgcttcctcatgactagaatgaagttaaacacttttggcaggatgttatgtcctttctagtgcatcacatcaggaggcatatgtcgccagtttgtcaaacttggtgatagatgattgtgttcagagaatgctctctgagataaggttggataaagtgggaaccgggcccagctctctgaaacagcgttggcagaaataaggtgtcttcggctaggagaagagttttgcttaacctcgataatgacgtctattcatgtatccatggacctatgtgacaaaggagatgttttaaaaagactgtcaagaaaccttgactctaggactttctctaccagtatctggcattaaattttttttaagaagaagtaagtaattttttaattgtttggaaggaatcataaagattgtctaatctcaaaaaaaaaaaaa

SEQ ID NO: 9903 - DNA, 787 bp, Homo sapiens
  misc_feature (1)...(787): n = A,T,C or G
ctaggaaacaggatgcctgaggtcagaagttccctattatgaccaaacctgctaagactgatgagattcaacatggcagctcacttggcctctgaagaacttcagacttcattataatctaatttccatgctaaatgacactcccaccagtgccaggacagctgacaatcactactgaagtggcgtcgttgtccggagtaaatacccaaggttcgttgtttcacgccaagggaatcaaggatgtggacacacaagaagtgggtttagaagcaaaggtttaataggcaaaagaaagaaaaaggggaatagctctttttctcctgtgagacttctggcccatgctgaagtacatgggcttttatagactgctagaggaggtggtgtctgatttacatagggcccaaagattggttggaccaggtgtgacatttacatagtgcaaggaagacggccactccaccctaatctttttattatacaaatggattttctacttggccagcaccatgttgtctgctccttacacacacatggtttggaagggacagggaagatggagccaccatgttgaacatgcatagcccccaggtagccttttcctattggcacagctgccagcattcacctgtgcaagcttccagcttgcttgtctatgtctgcagctcaattttacaggctgccctttgttagaaaagaanatgatttgggggctgcttttcattanaaggaaaccctactgaggacttccctacctccctatctgccttaataattcttttaactccta

SEQ ID NO: 9904 - DNA, 850 bp, Homo sapiens
  misc_feature (1)...(850): n = A,T,C or G
cgtactatatatcctacctttatgacagagaagaaaaaaagcctgagtggtaacgnacttcaggttttattatgtacaacagatctgagttacagaccggaaagcagaagttatttgtagataatctgccttcaaactttcattttctggaagcttgagataaaggcaaaagctttgagaactgtaagggagactgggaaatagcctgctaaacccagcttgcccaaattggaaaaatgttcagcaacaccagggatagttgtgacctgtttcttacttcctggctgttctccaaggaaatggcaagacctcaaagaagaatggctggatggagtaccttgggaggctggactgtagttactgggggttcacaatcaagagagactctcatgtccaagcttgaccacaaaagcattattgtcattcggccttgaagcagaacttattcaataagggtatcagtccatgatggtgataacctgcaaacatgtgggcccatctcctatttgttttctttcttcctaaaagattcttaggttttttgcgctacttcttgggttggagagggaccaaggatgaaaggaaaaaagacctattctttgcattggtgccccataatgactgactctaatcattattttatagggtgggccattgaagagcaaattttatttgattcaccgaaatataatatttttttttttgtcgcccatacaatttcttgatgttatccactaaactcgaaataatgatgtataccctcgcaaaaaacctttaataacattttgcttggccatttccaatttgagcggtaaaaccccctatactaacaacaacaagtctatttttg

SEQ ID NO: 9905 - DNA, 177 bp, Homo sapiens
ctagggaaaacaattttcagatagtactgctacctcagcctgggctgtaaaatggaaagacaggagaagccaacctgcccccaacctgtggcctagagcagatccatagaacctggccaacaacatgtagtatgaggatgaaataaatattattgttggaagccaaaaaaaaaaaaa

SEQ ID NO: 9906 - DNA, 1593 bp, Homo sapiens
  misc_feature (1)...(1593): n = A,T,C or G
acgacacaccacacaccacagccccacacaaagcagaacgaaccgacagacacccaacccaacaccaccgttgaaagcggcggaaacaccacacgccgagacgagttttcacggaagagcgacgcacacccgcccacccgcacagcaagcacagacacagacagacaccaagcagaccgcagagcacaccacacaagaggacgcgaccagaggacggaaagaccacgctgccgccgacaagagaacacgcaatgccagcgccactcagccacgacaccccacaaggacgcagccaccacagcacancccatgcggacagcaacacgcgcacgcgcgcacagncctcacataaacgcgancacgcgtgcgagcaagacagcagatgcacaacacaacccagaggcacagagagacccacaccgcgccgcagacgagacatanancgacgcacncatgaaaccgatgggggacgaacgcggcggacacgcggcacagacgccgtcgtcncgatcgagacggcagttngacgagcacgcagcgcgcaccagactatgaattgagnacgacacgattnnncacactcgcgagcgagacagaagnncgcncagagagagcgagcatagcggagagcggaagacacccgcngagngcaacgnncggaacagatatagcgagctanacacgagagaggacgggagggtctcgcacgaggaggagaagagccgncacagcacacgcgacgccagcgcggacgccnacgagactcacgcgaagacgagaccagcaccactcncagccaggagagagaggcgcgcgtgcggaagacagacatgtacctgtatntccagtagaaagcgtagggagacgacgcgacgacaacctgcagagaagaggcacaatagaacgcnagacaacgtacagcgaacccacacaggacaggcggcggcaagaagagacagaaccntagagaagaacgagagggantactgcgaggagacgcgcgcgcgggagtcctagaaggatagagtcngaagagcaccgaaggaacagagagtcncgggccagcgcgaagcagacgcagagacgagagcctcacaggacacagacacacgacatcaccatcgacgaacggcgaagagaccntcaccgcggagataagaaacaccgacgaacacgcgatatccgacggcggcangcgcacgagagacgaaggacgccagcctcgctagcgccgcgggccgccacaggcncacgacgaaganggtagangagacacaacgaggtacacaagcagcagagcactcgtgcacacgcagagcggagcgagaacggcgagcgacagaccaactcgacggcacacaggccacgtaggacagacagcaggccaacagagcacctaagaacacanacgagaggagtaaacagagagggagcnnccagaggaggggagaggaaggagacgggccnnccgaatgacgncggtacgcgacgcacgagcacgagtgtaggatggagagaggaccgaggtcctggaacgacaacagctcccacgccagacgccaggcccacagaagatgcctagagtgagagaca

SEQ ID NO: 9907 - DNA, 1009 bp, Homo sapiens
  misc_feature (1)...(1009): n = A,T,C or G
agccagtcccttccaaccgcacgccccaagacaaggttgagtgactacgcacagcgctncagtagctggaatgcacagaccagcacaaacagaaggaagccagcagccaagccggggcagcttcagtctccaccccaaatgcaggactgtagaagcggtcacgaagaaaaccaccccctcttaaggttgtatatgggaccgatctttgcaccagtggcctacacccgggaaggcacatatccgcctgcacaatggcactacagaccctgtttttttatgaatacccttcacccgcactcatctattcgacgctactccgccacaccaggcccaagaactcccagctcgccgcactattacgcacccctcactctggccctcgctccagccgccccgcccctgggcgacgccgccacgagactgccctactcccgccctggacagccccggtggtcccagcgatagctcatgcctggtcggtcccctcgtatcgaattcattggccctcgtgctcagccgctttacgccctccgctatggttatcaggcacaacggaagcaatgccccagcgcaaacgtcgncctaagatggtgctccagtcacctactccgcccctcccgagcccgccgtcgcctgcgcactggtgactccaagtgtggcccgcgtcagctaccgtcttcggcctcctctcgcactcctcgcccgtcaccgggagggctctgattggatcccccttattagctccgtgttcccctcgcttggaactacgctccttggcaccctcccaggggtcgtttgtgtacaccagcagggaggccctggttggcagtttgcatgccccntctgaggccccgccgagtgcgacngctcgaggagcgcncaccacttggtccggtctccctttggatcttcatacttggcaccatagtagattctcccggtcggccgcccgcgccncaccgcggcacgccccgccatgcttcgcggtatcgccacatttcatactgcc

SEQ ID NO: 9908 - DNA, 321 bp, Homo sapiens
cctggctgtacagctcctcaaattcctcatttggcttaatgctgatagcttttgatattcacatggcattcaacttatgatccggatgaagaagcaaaggtagaaaacaggggaaggaaaacagaaatgttccaatatatcctggaaaaaagaaaaaggaaacaaacacccccttgtgaatataccaaaaaaggccctgaagaatataccttgttattgatgaaggttttgagagtttgtcaaaacttttgagagaagatttattcgtgcttacatttttatgaaaataaacaatatatatttaaattaaaaaaaaaaaaa

SEQ ID NO: 9909 - DNA, 939 bp, Homo sapiens
  misc_feature (1)...(939): n = A,T,C or G
acgcgccagcccccccgcaccggagacggcgtaacgaaagctaaaagagactaaaaagaanctgagggggacaaccacgagcgaggagaacagcaggaagagcccaaaaccaaagagcgcaagaagcgcaagccaacagcggtccgacgaaagaccccagagcccaccccggcggagacaagcagcgcctccgagggcggagaacgcacacaccaccaccaacgccggcccacaaccaacgaagagagcgacgaacccgcaacaagccacggatttgttccgagaaggagcacggagacagccccccgccaccgccccaggcgcacagagacgggacgcgatgccacgcccgccccccacagcgaaaccggcccgccgcgaagcccacatcgggagaggagcacacgcagaaggccaggaagacacacggaccggcacgagagaggcgaccgcggggggcggaccacccccccgaagaggacagaagctccagagggcagcaggcgcgagacaacggaccgccccaaacggagcggcgccgcggacgcaaatcccgccgggagacacacagaagataacgtcacgcgagaggcacagaaacaacacagaccggacaagaaaagacaacaccggcccacacgacagcgcgacgcggacgagccggacgaccagcctacagagacgccaacgccatcgcgcagccctaagcgtcgctgcgaacgcgagtccgcggcagcccgcgccgcagagccggaccaaccacacccacgcagaagcagcgccaacggccggcagcccacgggggacgcgaagagaggagggacgcacgagaaggagctgaggcaccagagacctcggaggacacagcaagagaagaaaccaccccacccacaccgcgcggcgacgacgagagacacacagcaacaccgcggacggcgg

SEQ ID NO: 9910 - DNA, 328 bp, Homo sapiens
  misc_feature (1)...(328): n = A,T,C or G
cctgcntctctcatgtagatatcattacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagccacaaaaaaaaaaaaa

SEQ ID NO: 9911 - DNA, 1092 bp, Homo sapiens
  misc_feature (1)...(1092): n = A,T,C or G
aacctacacatgacacccaatccactcagactcacctcctctaccccgttacttcgagttcaaaccacagtaaaaaaattatttccgaagcaaaagcaagtaaaagtatctcaatcctctcatatatcacatgaatcggacacacnattagctccttttagtgatcacaaatgacggaagcacacattcggcccgcacaccctagcattatcacttactacgttacatcgcgcctcctcaccactattatcgacagatctcgtgagctaaaatgcatctacctcacatcccattccaacacgagcaagataatgttctgtctccacaatgccatccaccagaaatggctcatgtcatctaacttcaaatgtccgactcactcgacggctcgagactgcgtatcttgaacgatgctatggccccccattgctaatcatagctcatcatctataatactcagcgtgtccatagtagtgcatgtancctcctaattatgaaccgctnctaggcgcaagtatagctcagaccacccacaacctactcgaatcacacttatccatagcncgcgcagataaagaatagactactcaaagcgcggcttcctactcgcccccatgaagatgtgatcctcacgcccgcactctctccatctcacgtggacagagtccctcaccatccccccctcgccccacccgcaatcggtctgcctatttccactaagtcctataataattgttataacattctaaactaacttaacgctcataccagtcagtttaatatttcttaagatataaacactccctcgcgcacacaccccacccgcccataccttcctagctacacactccatccatacctccccacaacatccccatcattaacaaataagacccatcaaggaaaattaggagaacaataaccagcaacaaattacactaacaatcacccccccctgcacctgtgtgacacacaacacttccgaaatatcgtaacttgtccccattgcccttagcctaccacccgtcgccattttatgctcttcacacatcaccagacacttcaagctcatcacttatccacaccgagaag

SEQ ID NO: 9912 - DNA, 1451 bp, Homo sapiens
  misc_feature (1)...(1451): n = A,T,C or G
gcaccatagatcaggtagttggatgtgcaagaaaagcgacgaatgcatacagaaagcctaacacgaccaaacacccgaggcgcagcgagttccgattagaatggtcagctcaccggtaacagcgatattgatggatagaggaaggcgtagatatacaatgggccagacagagcgcactgcgaatcgtccgcacgtccgccatatgtagatctacctcacgcctccttctaacccccaagtaagccccacgcgctagcagtcacctgcgccccgacaataggtgacgtcaccgcagggtgacagagtcncggcgacacgcgaggacgaccgcgagacgagcgggaggtacaggtcangtgattgctatagaatggaggtctagcccacctcacgacctacgacaactgagtaaaatntagtgattacacaagaatcacagtgacgaacgatgccacctgagcgcacagtagcacagagactgagtccatgatagactacactccctgatcaggtgtcncagacgagagagggatctctacagactcgcagccgtacgtcacagtcgagtgagatgcctccacagaataggcgccgacgaccgtacgcgcccgcccatgagtgtatgtctatncccgagagcgaggctgcggggcggagcgacatacgtattctcatagtgtgtgacaggatgagtggtatcgcgacncgtacgagnacggtgncttctagagacactagtagtaggcaagaggaacagacatctacagcactacatagtgaaatgtatccacgcgatatcagangacgtccgcgaatcaagtcgcacgtgacgatgatgcgcatcgacgtgtggatncacactgggacgcgatcagacatggtncaacacacagcagagacccgaacgagacggatcgcagaaagancatcgatccngaaagtcacgcccatactcgacagacgcnctccctaagatggattgtatcgtgtatgagcggtcgcgtgtgaggaggaggatgaatcntagaagcgaggagtgtcgcacagtcncgnacagtaatcgaagtcaacatatgaatgtcagaggataacatgacacgacgtanttgatactaatagggcgcagctcacagatgggagacgtagaganatgcgtgctgatcgtccatctcgatgcgatgagatgcggcgaagtcntacactagctacactgcgagaccncacaactgagtcgtcatgatgagcgatactagcgcaggcgcgncacttcgagtatactagtatgtgttctgtggcgntcatctcgagatgatacaatngtcgagcaccgtcactcaacgacatagactacatttactgatcgacgacaaccgagtagatctagaccgagacactcgcagactgtgcatcgtccttcatgatcgagagaggctgaagagatgctangcgtg

SEQ ID NO: 9913 - DNA, 1797 bp, Homo sapiens
  misc_feature (1)...(1797): n = A,T,C or G
aaaaaaannnnnnnnnnnnttttaaannnnnnnnnnaaaaaannnnnnnagggtttgaatttnangttnnnnantgtnganattatnagntatntantnnnnatnannnnnnnantnnnnanttangnnnnntnnnnnnnnnnaanataggataaanatnnnnattgtnganatagataantanttgagtanncatatgtgtaatatgacgagtatagtttggttgattannanaatggtgatatnagctnataaaaggatggctaagagtcaacgttagtattgtagtgagatgcatgtaggcgcaaagtatgcagagtgagtaagatgatttgtatnagattacgcgtactgattctcaggagagtgacgacggatcaacagagtagacagagcgcctcgcagacacagtgcnctcagagcaatagccaggagagatagcacgcggcaagaaaggcgtacgcgacacgcgacgagtagtaggtggcgaacacggcaagtatatgcctttcctntnttactatgtatattcgcggtgtagttgctggagcatgtgcgcgatngcgnagtgctatatatagagtagagcttaatgtgcatgaaacgganaagtgatgtgtctcctgagtacgtctgcanntgcatgttctatgaanagaggttngtgacctgcgcgagtgagcgtcacacagacatgnnacaganacgtaganctacgtaatgtantcagcagacgtcgccaaagtggcgcaatacacgcagccgcagcatcggntgctgacgacacactaggacgtgtaggactcactcaacacactcatcgccgcctcacattcacgacacgcacaaggtgtcagcaaactactcacgccgaatgcgacgcacgtcgcgatgtgcaggacctgccgcnctgacagcactatcactcgtcctcgctgctctgtctctcgtcgtcgctccttcntctctctctcgcgagtcgagactntatcacacgtgacgtctagtacgtgatgccncagcttctgatggactactgtcgtatgatggntacgtgcgccgacnctagagttcatgtgtagcatgtgtggtcggtcggcgtgacaacaagcttagagtgtacnagtatnatatatgttgtatgacgagtctatgagtgagtacgatagtcgactgntngacatacacatgatattgancangaagtcgntcatgtactnatcactcatgtnntcacatacatagtgtgcncgcangtcgtggctgtgctgtntcgaccgagtgagttgtgtgagactttgccatcgtcatctnctgccatactgtcgtgctccgcatcgttgcctcntncgctactctgccattactgcatcangtgcnncatctcagcngncagtncgctcgnccgctacgcgtcgagtcgactgtcgatcgcgatggcgcncgcatgctatgagagtgagagacataactctactagtgcgtggatgtgtatcactgtcgtgaacagacagacagacacancgattaatagacacgcacganagtgttcgcnctacgcatgccgtncgctcgtctggcgagancgtcacgacgtaggttccgtcagctgagctcgtgagatcgatgagcctcgntncntcactatcagcatgtatgcntagtttgtgtncagcntcntaccacagcnancgatcgcgacatncatagcgcgctgcggtcggcgtcgtactttcacagtgagacgtatcactcgttcgatcatgtgcacgagtactcagcgnatagggtggattg

SEQ ID NO: 9914 - DNA, 825 bp, Homo sapiens
aataaatattactatgaactacctctaaaacgagaagcgaattactggaacgaacatgggattgcggggctacacaaagatggccaaagaccagaataacaactgcatattcgccatgctggccagccttcctattgtgtgagctgatggatggtgaagaggaaggacttgactggggatggctcatacatagggaggaattcatccgaaatctaccagcccctgccatgtgggatgcacactggaatcaatgaaaattcaagtgtttttttgatcctgtgacgctctcataacggtaaaggttaccactattatgattactgctataaccagatttgcattatagattcactgtaagactttagatcatttattatgctataccaaggatggcacaattcttactctgttacatcgaacttacctcctctgggagaaaagttaccccggagcaaattacacattccgcttaaaaatctagcaaccaatatggaggctatcttaaattctatcagttatatcatacacttcgtctttcgtttattctatccttgtatattaatgtgtgaacaaaagtgatttaaccagctctgttattaaaaattacattattgggtaacttatacactttaaaactttaaaatacaccaaaattaacgctattaatttccgttccacacctacatgtcgctttcaacccttgtgacaacctatcacattttctccaccggatgaccagcgtataaatatcagtgtacacttacctatttcaataagtttcccaacaccgctactacatgaccactctccacaccatctcccaat

SEQ ID NO: 9915 - DNA, 261 bp, Homo sapiens
cctagacttgcatactgtcggcttctagtgtctccatcattcataattgcactgtgttggtccacccactttactcctaaagaagaggtaagaaacagaagaggagatcacagtggctcttcaactgttaatacaccacagacttcaataacaaatgaagagaaacaagaaaagaaagcaatgcaaaaagaacggtactgccctctttctctcctgaaccatcaataaatcaagggtagataatagccaaaaaaaaaaaaa

SEQ ID NO: 9916 - DNA, 819 bp, Homo sapiens
  misc_feature (1)...(819): n = A,T,C or G
ctggtggtactagaggtgtgggtangatatcaggacatgcttccctcaggaattgatgtgcatgaggaatcctggagaataagaaggcatgaagtagagatgaaagagaatgtttcacacaaaggaaacatatgcaagcatcaactcaactctatgcctacagttctggggcagaagaactgccaagggagaaattatgcattgcctgcccccagttccctcaggatacattacattaaggaagaaatcattctcaaaatgtggaagccaaagcaaactcccattcttgactagaatattcagcttgccatttaccattccattctgagaggcaaaagttctttctctcagtcccttttccccagaaactgtgagaaggtgcagagttgttggatgaagaagcccgttcatcaagggctcctccctgtttcctgtgctctttctcaacccaaactcagtgtgcctccttggccttagcagtttccttcactcctggactgatgggtggcacatgattgtgcacctaaataccacagtacaaacgggaggaacacctggctaataactcacagccccaatttctcatttcataccttaacccatgtaacccagactagctagagccaggaaggtcctctctcattcctgattacatgcctcatttattacatccctaagcggagatgaataccttcccatttcaacttgtcctttaaacatttctttaagctcacaggaacattagcaagtagcttttcttagctaattaaagcatattgactctttagactgtatcagctggactaagccttcctgctt

SEQ ID NO: 9917 - DNA, 790 bp, Homo sapiens
  misc_feature (1)...(790): n = A,T,C or G
cttcaggtggactgttgcaatgtaggctgtttcttctagagaggtcagcatcaagaagaatcagcaaatttcaaccttacagtatatttaattcaaggatcagattttttaaaattaccttaacaagtgatgaaattattttcacctgtaataggacaaaccaatttcatgtgttgcactgaggacctgccaccttatgtggtgtttttgccaaaaatgcatgacctgaatctaaccctgaagaaacatcagacaaacgtaaagtgaaggacattctactaaataattgaccagtactcttcaaaaatatgaaatttaggaagacagagaacggttaaggaatcattccagattaaataacagaaaagagacataataactaaatgttatacataatccatgattggatcctaaaccaagaatttttaccctggacaggacattattgaaaccaatttacaaaatttaaatgtgcattatagattaggtagtagtattggatcagnatctgctttcctgattttatgctgnggttatgtaagagaatgccctggatcttaggaaatgcaactggaactacctagagataaagggtatgatgaaatcatgtcttcaaagtattcttatatgtttaagaaaaaatatgccttgcatatattgtattttttgatatactgaaattatgtcaaataaaaataaaaatccccaattgtattttgtcaaaaaaacataaaaaatggcctgtttgcctcaccggagagctttgcgcccgttcctttaggaaggtaat

SEQ ID NO: 9918 - DNA, 283 bp, Homo sapiens
tcctgataaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagccaaaaaaaaaaaaa

SEQ ID NO: 9919 - DNA, 745 bp, Homo sapiens
gctctacccctcatggagatgtctgctcagtcctatggctccgcatttgaagcctgcttgcctgcggatacatgatatttcacctcatggaaggcaccatcagtgaaagtggcatgatgattttatgtatcacaaagaaagaaaaacactgaccatgaagcaatactttccattctatcactttgaattttttaatgcttactgaataagattgtttctttcaaacatacatgtttatgacatgtcactcttttgtgtacataaaaaggaaaataaattgctaatgcatacctttaaaattcaaaaaccaaacaatcatagcctcattacattcgtagaacaaccgcgtccgaaaactagagccgccaattcactcgctgaaactacactcctgtgaagtatcgcttactacctgcgatagaatccgtcgctcgcctccccgcgcccccctgcctatctcacactttcatttagccaccgccccgaccccgccctccacgccccccctcacaccactacgaaggccgcgcctgcagccgccactgtgtcagtgccgatccacgagggcgaccaacccaccttactaatcatgctacaccccccccttccacacaccgcaataactaccccccgcgcatactgacactggatacgaccacaccgtcccacttacacctattactccccccctacgatcgataatcccgcccgcggcctcattcccccacatgcccacagaacttgg

SEQ ID NO: 9920 - DNA, 1428 bp, Homo sapiens
  misc_feature (1)...(1428): n = A,T,C or G
ctctgctcttgcgtcctgtccggcgtgttgtctctacgtcctccgtgngacgtcgcctgtacgcgtctcgctcgctctccttggcggccctcgtcncnttttcgactgcgcgtctgtgtgtgtgtatnggctcctgctcgtcgctgatgtgctgtgggcgtgtgtcgctggtcgctgctgcgcgtcggcggcgtgtctcctgctccgtgccgctggctcgtcgcgtcttacgtgttctctcggacctgactgctctctcagttggctcgcgcgctctcgcgcgtccgtgcgcctcttcccgcgccgctgctgcgtcgcgtaccgcgcggtcgtcgtccggctcgtgtgcgtcggtgccctctgtctgctcgtgtgcgttgctctcctcgcctctaggccgtcgtgttcggtctagctcggtttgcgcctcgtcgtcgctctcgttgctcgcttctgcctccgtcgtatcgtgtcttcgctgctgactctgtgagggtngctccttggttctctctctgctcgctttgtgcgcctgtcgttatggtgtcgctctcgtcccgcttgcggaggtctgtttcgttcctcgtgggcttccttcgggcggggtccgcgtgtctctcttgccgcctgtgccgtcttcctctcttggtctcgtctntctctntctgctccttccgctcccgcgcccatccctcttntnttgcgccgtcgctcgtcgtcgttcgcgtggttgcctctgtccccgtcggctcgctntcctcntgtgcgcgcgcgcgtgcgtctgttgcgtcttttgtcgcgtgggcgcgtctcgtgtgcctgctggcgtcgccgcgctcgngcgtctcggcctcntccgcggtngctccccttcgtctgtgcttccgcggtctgcgtcgntntggcntgtgcgtnctctgcgcgtgtcgtgtcgtnttctgtgggtgtgtggctgttttgttctntcttgnctngntctgtgtgtnttganacaacagcagatagtctgtctncgcttcgtgtcncgccggcgttgctcgtgttcttgcgctcgtctgtgttctctgcgttagcttctcattgtttcctcgactcggcgtcctactcctcgcgcctctctggccctttgtgctgccacttagagtgttttctgatcggttcgcggagcggcccgcggtgtantagcttcgtactatcacatgtctacatttactcaattaatacaacaagagtatttggttaaacacaacaaaatcagaaagaacataataagaataatagtaaataataaaaatagaggagaatatggctcctncgtctgcgctcaccagctgntgtggtagncgtcnngcgnngccaaccnnttcttttnntttttgtcctgctgcgtgccctgtgtctccctcgctcggtcctgtcctctgcttc

SEQ ID NO: 9921 - DNA, 780 bp, Homo sapiens
  misc_feature (1)...(780): n = A,T,C or G
catctgtggctgagatatccccagtctcatctccaggccaaacttgtcttcaatgttccagactcaataatcccggggcacatcaaattcaacatgttctcagctgtgccgatcagcaagcctgaaagaacanaaagaagagaggaaagcaagaaggaaagaaagaactcgctttttcatccctcaccttgtgaaatgactcagtggcccgtgcagctgctctgccagacccctgggaaccattggcgctcgtccctccctcatcctctgccagcacatagcacagtatctaccgctctcagtatctgctccagtaacgactgctcaccggtgctcagcctccatccaacacgttctgccatgtgatgtatctgctcatgtatccaacaacctccctaacatgtatggtctcctcaaggataggacccaattcatcttggaatctcccgtgcccaggtgccaacaggctgcaagacttctctgcagatttatttgaggcctgggccccattgggccatgaggccccaggcaactcttgttatatcatgctgagatgtggggaaagggatgagctgaaagggaaggaattccagtttagatgctggataatgacataatttatggatgaactaatgtcagttcattgtattttacccaagtttttgttttgaaaatttttaagcctgcggaaagttgaaaatatagtgaaaactcatctttcgttccaaaaaaaaaaataaaatggcctcgttggcatcagcggtggagctctgcggccag

SEQ ID NO: 9922 - DNA, 944 bp, Homo sapiens
  misc_feature (1)...(944): n = A,T,C or G
ccggggcgacggtgcagcgcctcgcaggaaggggggggctagtgcctcgctgtggctgcttcagggacaggcccatgtggcaaggaatggacctcaaccaagaaccctcagaactgaatccctccgacaaaaaagagagagagcttggaagcaaatccttccctaagcagagccttccccagccaagccttaagatgagaatgcagccccagccaacacctgtactgtggcctatgagaggtcccagagcagaggacctaactaagccacgcgtgggggcggggctacagaaaagcatgagttactgaatggtggcttcaggccaacggaggcgagaagaacgggctcgtcgggcgctcggccgcggaactcccgcgggcgggtgcccgtcgagggggctgcatttcacgccgctcggtcgcctcgtgtgctggcggggcggggccatccagaggggggcggcggtagccgggacccgcgggagggagtgagacggtgagcgcgagccctgcgcccgccccggaccgcggtcgcggccatgcgacgctaacaggggcagctacccggcggccgtggcgggggtgtgggtgcggggtgcgactggcgccggcggcgtgcggggtcgcggcggctctggcgggccgcaccctgaatgatcgcgcccccgcgagccaacacggcccgggcgcggccccgacggcggccctcctcacggcgccaaaggagcgcgcgaggcgtggtcgggtggcggccgcggggccgccgtggctgaggaaggggccggtgtcgcgcgtccgggcgcgcgccgggcgcgcgcgcggtcgtgcggtcgctcgtgatacgcgtgcgcgagcgncgcgccgtcgaccgcccgtcggggtaccgcccgggtgcgcgcgcgacgccgcccatggcgccgtgatagtctctagcgtagaatagtg

SEQ ID NO: 9923 - DNA, 783 bp, Homo sapiens
ctcgtggaaactgactgctggcttttaggaagaggacgacaaaaagagacaagaaattgagatacttcaaatgtcaatgggactggaaaggatttgataaagaaccagaatccagaattaaagctgatgagcttcagcaatacccgaggtatgaagttctgacttgcaggttggagtgcagcgatctcggctcattgcaacctctgcctcccgggttcaagagattcttctgcctcaggcttctaactagctgggattacaggcaccagccaccacacccagattcctgatgacaacaaatatacactggaacccccaagggctttgcgatggggtttcaccatgttaccgaggctggtcttgaactcccgagctcaagcaatccacccacctcagcctcccaaagtgctgggattacagacgtgagccacgtgggccactgcaactggcccaataggttatttttgatacgtttctgacatgctatagaaaagtaaataaatttactggttaattatcacattgcttttatgatgactttgatttgtaaaagagaaattgtgacttttaaaatatttgtaatatgtggataactggggtaagtaggcaaaatactttatatataaacttggtctattactaaaaaaagttatataacttttcttctagaaaaagagaaaatgacattttacaaaatggcagtacataaaagttagggaaaaataataataatgccttatagtttttgtacattgggcttctatattattcttaatttacttg

SEQ ID NO: 9924 - DNA, 697 bp, Homo sapiens
  misc_feature (1)...(697): n = A,T,C or G
cctgatggaactaactgatgtcttangagactggactggatctcaagagaggaccaaggtacaatgtggtacagtctatgtttcagctaaaggtatcctgtgcccgtgccagaggatttcccatggcctgtggactacctgtgaaatgtgacaaagggcatgggcagctccaatattcaccagatggggacctatgtctgcctggctgattcactgtgatccaccttccatctcaagcaacgcaggaggaatttatcaccttaaagtaatatactttattaccaacctctcactgtctatgccaattgacaggggatgatctctagatttcacattgatgaaagatttctgttagtctatgcttataatttctatctcaaatagtttaaaaaggagaaaaaaatcatttgcaatcaagaatttctctagcattgtctcaactgccatcctaatttattgtctttttaatttatattgtgtttggtttaaaacaactctgctaatagattgtttgaggggttctatagaggagcaatattntattttaatgtgaaaccaaacaatattcctgggttacaaccaggaaaactgcttctaaatctagcaaatatattttcatttataactaatcaactgtgatcatacatttgttatataaacaataaaagcctatactacaaagctaaaaaaaaaaaaa

SEQ ID NO: 9925 - DNA, 2005 bp, Homo sapiens
  misc_feature (1)...(2005): n = A,T,C or G
agctgtagatgtgtatgctgtgtgactgnacantntatacgtatgaggtggtgcatanataggtcggtgtagctctgcctgtacgtcttacgatcgcactctctcctgacgctcgccgccgaccccgatagtcactgcagtatctcgtctgttcggacgacggccaggagtcgtagcgcagagtctgcgcacatgcgtctgtgcggcgtacgagcggcgagaggnagagcagactgagcgagtcagatagtgtgtattgatcatgaggatgntcgtgagtttcggcagctagnantgacaggagcgagagcgcanangtctccttgnagtattntgctgcccngacagttgcagctgcgcggcagcacgatgctagtatacctgtcagattaccgcgananctgcagaccgtgtcacactgtacattatgtacatctattntcacgatcagccgcgcgcgantgtagttagtcatcatntcactatacatcnaatacgtgaacgtagtctattgcgtcgagctcgcgcacagtgtntattgtgacagaatgagtatccgactgctntcgcgtgatatgcagtgagatgtcgctatccanatctatgtctattgtgtcacctttactctctccagtgtatatatnagctcgtgctgcgcgtcgcngttacggacatcgactcagcgcacgtaagtctagtncatgtcacacgtaccgagcctatctgctagctactgcacgtaatgtgatatagttataagtgcgcgcgtcgcgactactgcattcacgagtgtgcagtacgcgcgtatctagtcgcggagccgacntgtgtgtactgtgatatggctggcgtccgtcggcgtctgttgcagaccgtcggnctacgcgatgataanatggcggtgaacacgcgtgactcgccgactgcgagctantcaggngtgacatgatctcgcgcgacgcactagagcgaagatgcgcgcgtcgcgagatgtcgtatgtacctcagcacgcattagtcgaactagacgtcgcngcggcgcgagctcatataantatatatactcgtatatgtcgnagtaatgtccnagatacatgacagcacgccgctcgagtgcgcatccatntatcattactctagnaggacactngacgatatctgcggatagtgcgcgacagtatgcgacgtgatatatataattccgctacagatagagcgagtgcnatctcgcgtgtcgtaacgcgactgcgtatatacagctgnaatagcaccatcaccagcgatatagaatagcgtcaatgatgcacgagtangngngcagcgcgtcgtcgcgcagacgctgccgagtgcacagctganancgatcatacgtactatcgactatgtggtatatcgcatcgacnnccntcgaccgatcttgtntcacagctgcatgtagatctagccgaacacgcaggcnactcgtatgatngcgaatnangcgcagctgatgncgcagntantcgttagcgnggactagtaacggnctacgcaagtctctgcgatcgatatcgtgactatgcngctgtagatacancancgtctagtatcgccacgtcgttatatagcgcgtacagcgcgtctgagatatcgtaccgcngacgtcgacntatgatctganatatctacnacccatcgcncgatcgcagcgnaaaactgatgtcatgatattgagnagtacagccagactacgcgcgcgtaggaggcatcgtagcatatgatccagacgagntgtgacgtcngtgatagntcgccgcagtatgacacaccgcgagtntncngcctngctgatggttctctacgacgacgtgtcgcncngcnttgtgcgactctcacgcggnagatagtcatctcgactactgagataagcacacgacgatatcagatcgcagcacgctgcntctcgctcatnatgctgctactagactacccggatgcnatncncantgctcattctgtanctcat

SEQ ID NO: 9926 - DNA, 1594 bp, Homo sapiens
  misc_feature (1)...(1594): n = A,T,C or G
agtatcagtagtacgagcgaaagagagagaacagcgaggacgaagcgaataatgcacaacagataacgaacatagcaacgcgacacacatgtttttacggcacgcgcgacgacacaaaacgcgaacgaaaaccgaattttatggngngaggcacgncgagcaccanacgagccgggtagcgcgacgcgacgctagaagacggaggcgcaggaccagacagtcttgtcgacgagcgcggacgcggcgaaagaccccgcgccccaacgagtagaaaggcgcgcgancagagcgaataccgcgcagaggcgcggcaggacgcggacggagagcgtaagcgacgtagagagcgagaggaggcggcacgcgcgacggcgagcggcgagacagagacagtaccagacacgagacggagagcggcgcgggcggacgacgagcaagaagtgtaagagcacgcacacgnggaatacgaacggcagcaggagagcgagcggcggagcgcganacacccgcagcatagtggacgatacgaccacgacgcgagacgacantcgcacagangnagagcacacacagccggagncgccgaagcatatcgttcgtgcatgatacgcacggcgacgcacacgccgcgcgacagagtcatacgcgccgtacatacgcgcgatgcgcgacgccgctgtcagcgatcactagtgaagcagcaagaacacgcccaacanaacaagacgcgagcgccagagcacagatagaagcagccaccgacggcagaagagcggcgcggangacgatatgcgagagtacngcagccaaccgcgtgacatagcgaccgcagacggacagatgcacgaaatacgcacagagctatcgagcagagcgccgcggcgcgaagacgtcgcgagcgagcgcaacaacggnacccacgaatacaatcagaacgaccccacaacgcctcagcagcagagcacatcactcgcgcgacgtgcagaccagcagcccctagcacagcccgacagacagcccgccacgccgcgcagccagcgcanagcagagacgcgacggagacgcgcgcgacagcaaggagtgcagaccgacacgacgatgagcgcgcgcaacgagataggacgagccgatgcgcgcatngcgactagagacacagaatgagcgagcagacgcgcggacatgaggaccagcccccggcgcgaccgacgtgtcgtgagtgcgaagagccagacgcccgcgcatgtcacanagcgacacgcgacacaggatgaacaacgaacatatcaccagacagagcgtcacgagcaacaccacgcaaccacgcgaatagacgcgcgcntgaacgcggcacggaccgantaacgcaccgcagaccgggagtacgacgcagcgcgcgcagnctctgcgcgcggacacgcagcctagcgcagccaaaacagcaaaacaacacgacgacacaactaacccgacaatccgcatcctagcagacagacagtacgnacaatcgccacacgagcgggcgcaaagccagagaaatcgccacagaggaccacagggccgcngaagcgccagacgcgcgaacgaggacgaagag

SEQ ID NO: 9927 - DNA, 639 bp, Homo sapiens
  misc_feature (1)...(639): n = A,T,C or G
tttacagtagcattgcataactccaaggttgaanagtgcatctggtccacatgatgtggacgtggcatgatgcataccaacgaatgcagaaagctcccatgtggatgcngatggactcacananagcctgctgtgttnccacaagcacttctgcttcctgccgccttttgaagaaagtgccttgcttctccttcaccttccaccatgtgtatttcctgangccaacccagccntgctnaactgtgcggaggcttatgcttataaacccaatgctttnggaggctaaggcaagaagatcacttaaggcctggantccaanacatgcctggacaacagaacnagacttntctctnaaaaaaaaaagaaagaangaaaactgccctcaaaatgatctcntnanactcacanggaaatgaaatnactggttattaaaatttnaaccttgttatccnccttttnacccccacnttnntctttnnggnnnttaactttttnctnngnttnaaaaacccccccaaaaaaaannggngccgcccctttttttttnnnngggggaaancaaaaccccnnccnaaancnnncccnnnnnnnngggggggnncnnntttnttnnttnanggggnaancnnttaccaaaaa

SEQ ID NO: 9928 - DNA, 815 bp, Homo sapiens
  misc_feature (1)...(815): n = A,T,C or G
ttaggataactgactgctggctttaggaagaggacgacaaaaagagacaagaaattgagatacttcaaatgtcaatggagctgggggggatttgataaagaaccagaatccagaattaaagctgatgagcttcagcaatacccgaggtatgaagttctgacttgcaggttggagtgcagcgatctcggctcattgcaacctctgcctcccgggttcaagagattcttctgcctgggggggtctaactagctgggattacaggcaccagccaccacacccagattcctgatgacaacaaatatacactggaacccccaagggctttgcgatggggtttcaccatgttaccgaggctggtcttgaactcccgagctcaagcaatccacccacctcagcctcccaaagtgctgggattacagacgtgagccacgtgggccactgcaactggcccaataggttatttttgatacgtttctgacatgctatagaaaagtaaatanaattactggttaattatcacattgcttttatgatgactttgatttggaaaagagaaattgtgacttttaaaatatttgtaatatgggggataactggggtaaaggtaggcaaaggactttatatataaacttgggctattactaaaaaaagttatataacttttcttctaaaaaaagaaaaatgacattttacaaaatggcagtccataaaagttaggggaaaataataataatgccttattatttttaagacattggggctttctatattaatcctaatttaactcccgggggccaaaccaaaattaatgggta

SEQ ID NO: 9929 - DNA, 715 bp, Homo sapiens
  misc_feature (1)...(715): n = A,T,C or G
caaaaggggagggtcttttaaaaagcttagaaccggggccattgcccaataaaattggnttaaccggggcggctggcacgccaagggccaggcacagcgtaaacccttcctaaaagataacggggtcattcattccttccaaaaaacgcgtgtagcaagtaggcacaggcgtgcacctgctccgaaactactcaccaagacacacgggctgagcaaacggcccccgtggatggagacaaagagctcttctgaccatatctctcttaacacccgctggcatctcctttcgcgcctccctccctaacctactggcccaccttttgattttagtgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacatggccgcacccacacagcacgtgctgtgacgatggctgaacggaaagtgtactctgttcctgaatattgaaataaaacaataaacttttaatggtaaaaaaaaaaaaaaaa

SEQ ID NO: 9930 - DNA, 806 bp, Homo sapiens
  misc_feature (1)...(806): n = A,T,C or G
atagatgtggcatcttattttcctcagcatccacctgtctatcttgatttgtccaggctttcctaatgcattagtgcttcagtccgttctccaggttgagatagcaatccctcatatcactttggaataagttggaaggccctcatgacaagaaactgatgaaggcttccagttgacagccagcaagatatagaggtccccagtccagtagcccataagggactaatggccatcaacaaccacatgaccttgaaagcgaatatttcctcaactgagcttcagatgaggctgcaggtcctgccagtacttcaactgcagccttgtgagatcctgaagcagagattccagctgagcttttccaacatccacccaaatagtgagacaatacatgtgtttttttcttttttttcagtcactattatacagcaatatacaagaaaacattcaatatatttatataaatatatattttaagtataaaatatgtcagacatcataataggttgtttaattactacaatatttaatctgaaaaatgagcaaaagtatataactcaaaagagggggatttacgttattcaacacanatttgagtggggtggattcttggatttctgggagagccaaacttggtcatgtaactttaaatttaaagaataatgtttttggacaatggtagccttgaattttatataggggttaataattttataggtatggagcttaggttgtttttatttgaatgagaaaggccggagattggcccaggaaaagggggacccggttgcccttgccttttgattatt

SEQ ID NO: 9931 - DNA, 834 bp, Homo sapiens
  misc_feature (1)...(834): n = A,T,C or G
tgtggatgttgaggtgagtgtgcagagagaagggggagagagnaaagnccttgacaggtacgnngcgcaattgttaanaacttggaaccaaccatgatgccgatatccttcagcaagtgaacaaataaattaagggtggggcgtcctgacaatggaatattattcagcactaaaaagaaatgtgctatcaagccatgaaaagccatggaggaaacttaaatgcatattactaagtgatagaagccaatctgaagaggttacatactctgtattccaattttatgacatgtggggatgacaaaactatggacaccataaaaagatcagtggttaccaggggttggggattgggggatggatacctggagcacagaggatttttaaggcagtgaaactagtctatatgacactataaaaatggatatgtgtcattatacattggtcaaagctcataggatgtacaacatcattagcaaactctaatgtaaactgtggacttttagtgattatgatggggcaacatagggtcatcggctggtacaaaatggaacccctgtgatggagctataaatatgggacacctgggattctgcttaaaggactactttactttcttaattcctttacttctttgatgtctgggttacttatcaaatggttggggtgggaactggcacctgatgccacgtccagggtaagggacctaaatgaaaaatgtcccagaattgtaaacgagtgattataaataatgggattctgttttattgcgttgatggagcttgtaagaaccaggcaagaaatttccatacatatgcgtaattcaaagaacttgag

SEQ ID NO: 9932 - DNA, 494 bp, Homo sapiens
  misc_feature (1)...(494): n = A,T,C or G
atgttagatgcggagagggcaaaaaaaaaaaaaaaaaaaaaaacctcaggggnaaactccgctttaggtggtgagtcagactattgccatgcctcttaagacatctgcttacatcattttcactgaggctcctgtgtccaaagcaaaagcaagacaccttacctaaccaagtccaaggtcaatgaagcatggaattatactctgcctgaaccttgaagaagaagggaatgaatatttgctgaataggagtttaatccttcacagtgctgttttttagagtggagagcattttcaacagcataactcagaagagttgtcttttatctgaaacttgttctaactataatgaagatgcctgagaaatcccaaattgttttttttttttcattgctcttcccaaaatatccttctttaatttttaatgagatcaaaaagcgttttgcattattaaccaataaaatccaagaggtgtttttaaggtaaaaaaaaaaaaa

SEQ ID NO: 9933 - DNA, 866 bp, Homo sapiens
  misc_feature (1)...(866): n = A,T,C or G
gggtgggggaggggaggggaagggaagggaaaagaggggggggnctttcagtgtaacatcaccatatctcaaaggacccctggttctggtaattggaaaatggcatatgaagacataccttcggggaagggggctgaaactaacctnacccttntttctgttcctataaagtggataaactatgaaatatgcatttttaaaaactttaaatacattttttctcctggtgtttgaagaaaacaaagtgaattattttgattaagaattgtaattattaggggggggggaaatcccttaagtgttaaaaaacaataagtgtatttgttatggaaagataaaaacttgaaacaagaaaaaaatgtgtctctttactggataaaactttcagggtgtgttaagatgggaaatgcattataaactaacattgccttattaaaatagtaataccaggaaatgatgaaagtttaaagctgggggaaagttttaaactaaaaaaaagaaaaattggggttgttggcgctagatgtgggagctttgcggcagcgttcgctttggtggggggtgaatcaagaagccctccgtacgacacgctctaggggtagggcgcgtcgggttggtgtaaacggtgtttaggctgcattcagagggggggaatactgggtatcccacgggagactgtgtattaacatagaaaaagaatctggttgggatacggccctataaagagtgcatggtatctcggaagagggccgtcgtagtagggtactattcgttgagggtgcgccgccagggaagggatggaagaaaggagtcgcgggctgggagaggggggaggaaattccgctagcgctggttgagctccgtgc

SEQ ID NO: 9934 - DNA, 709 bp, Homo sapiens
cagtagggtgagggtgctcagccatgtttaagtgtggtggtccagtttgattatgaaccatttcagggccagcattatggtgcactcccatctacactgtggacactattacgcttatattaaaattgtccgactcccatcaatatattctatcagaaaggggcgggatacatgtcacagatgctttcatatcactgagaaaagaaaaaaactttgtctttatttagcatgtttatatatggtacagctattgagggcctggatgctcgtctgtgcttaccacctcactactggggaccacagggatgaagactgtgctgatttcaagttttttgtatcactatactacttgcacctgtactcagttgctgcggtctacctcttgtcattgccaacaccaaaccgaggctagctggtgtacctttccctttacttgatctccactggggacccatgataatacctcttacgtataaaaaaatatgtgcctgctgtataataaaaagcgattggcttgttggactaagtgggggatctttggggcaggttgcgtttagggagggaaacgtctggatcttcgtgacttagcacgtgcccgggtggtggaggctgtgggcagcgggtacgcgctgattcaagcgcgggagttctcgtttccctccgattccagggggtgtccggccgaggcaatcattgagtgtaaagggcc

SEQ ID NO: 9935 - DNA, 172 bp, Homo sapiens
  misc_feature (1)...(172): n = A,T,C or G
tcgtttgtactccccgccanccttaatggaccaacctgagtctcaactttctcatctgcaaatggagatgaagactaaatgatataagaaatatatgatgtaattgttctatcattgcctaatttttatgtgaaaaaaattaaaatgcgaatttgtttcaaaaaaaaaaaaa

SEQ ID NO: 9936 - DNA, 739 bp, Homo sapiens
ttgttcttgctgacttcaagaacgaagccatggactctggcagggagggctacagttcttaaagatggtgtgtctggagtttgttccttcagatgttcagggtgggaattgtaatagaccttatggagggtgaagaaggaagatggcagagaggccaaagaagacttgatgttcttagaggaacatgaagaaactgggtgggtcctctgcattctccagtaggctaaggggagccaggatccctgtcttaggctcatcaatccagcctcttccccaatattcactcacaaatcaatctaatctcttctctcatggtcagactggctctgagacaagtgaggatcttctcatacaggatttcagcctctcaggagctctccaatggaaagctggcttctcatgagggtagtgaggtaggatgaaaagcaggaacactgatgtgagacttgcctaaccccctttcctgtctttcctaccttttctcagaagggtagtacattcaaagcaataagcttaacagcatatgataatgcatctgaaaaaacatacaagcctaatgtttcatcttagtaacgcatttttatggcaaaatatgctaaagtgccttactttatcttgatacgacccttggaaataaataccctttattgcccttatagtgagaactttcagggcttcagaagggtaatatttttctagtatcccccagctatgcttgtgattcctatccatctatggg

SEQ ID NO: 9937 - DNA, 847 bp, Homo sapiens
  misc_feature (1)...(847): n = A,T,C or G
ctttggccctcttggtgcttttccttgtgtgccttcgcttttctctctgcttttcggtttgcttctctcgttggcctctgtcctttgcctcttttctgtcccgcctgtggcgtgcttttctccttttctcgtttggccgtcggcctcttttttcttctgtgtttgtcggtgttggtttgtggcttttgttcgcgccgtcgcttgtgcgtgtttcgttctttgttttgctttttcttggcgttttttgggtttggctgcttgctggtgtgtttcgctgggggccttgttcgtggggtccctttttctgcccttttttttgtcgggtttctgtgcttgggtcggttttctcgtggtttttgtgtctctccgtttgttgtgtgttgttcggtgccttctgtgtttgtgttcggggttggtgtccttttgttttgtggtcgttggggtgcgggcttcgggttgtttttccctttttgtgtccccccttggtggtcgtgttttcctgcgggtggctgtcttggccttgctcgcgtcttccctgctgtcgtggtgcgtttttcggttgtgccctgttctggtaaaaaaatgttgttggtttttctcctgcgtttgttgggccccttgccgtgggggntctcttttggcgtttgtgtgttcttgttgctttttcgggttcctgggtggcggtcttccttgtgttgtcctgctttttttcttggttcttgtgtcggcgtnttgcaattccgtctctttgtccgnnntnntnntntnnttgtctcgctggccacagcggggtgcgtcngctacaagcttttttttattttatattacgcggtcgtgtagtgagtgg

SEQ ID NO: 9938 - DNA, 578 bp, Homo sapiens
ttcgggaataaatatggttcaaacccaccgccctgggataatgtttttcctgcaaacctttggattgatcctaggttggcgttctctccggctcttggctatatatgagcaaaatattaagatataagtgaggattttcaacatctttcaaaaatgcatttatatagtcttactttgtttctttcattgcactctataatgatttttaaattaagaattttttattttaggcaaagtgtgtttctttcaattcattaacttattaattttataaagcagttttatttttggaaacatataaaaatcagactgtccttaattgaaattttgtctttggtttccaaccccatgatgaagctcttgctttttaaaaagtagttagtaaattttgcatgaattttagtaaactttaaaaaatagattttttccctaaaaaaaaatgtttgtagaatttaaggtggacaaatgcctgttggggtaaaatcaactgcaactttttgatgttaatttttttccctgggcaattataaactataagcaagttaagtgacaagcaaatgtaataaagactagttttt

SEQ ID NO: 9939 - DNA, 971 bp, Homo sapiens
gcccgtgttacaactagcctgatctccgcggcacggagggcctaaatgtaaatggaggcccacttgaggagttatacgagattgcctgtggatcctgacaatgaggcttatacagtagtccagacatagcaggaggagatgcttcacagagaggaagccgaaaacaccctgcgatctttcagacaggatgttgacaatgcgtctctggctcgtcttgaccttgaacgcaaattgtaatttttgcaagaggagattgcctttttgatttttctccactaagaggaaatccaggagctgcaggctgagattgaggaacagcatgttcaaattgatgagcatcttctccaattctcgatctgccgggtgtccctgcctgacgttcctttacggtttatgggaggggtcggtctccctgttacagtgtatgtaggatagcgtaatccttgccaagtactaacttttcttgtccgaagcatggtggcttgccacgctcgcgctaaggcgcggatctgtcacgtcgtctgccaaattcgaatgcacctgtatatctcgcgcatatcagtgagactactcttacttgactctaggaagacggcccgattccaccttaagtcagagctattagtgtgttctctggtatccgtctccgttgccgctaatcgttgatatagggcagtttgggtcgcggatgcgccaggacgcgctgaaccggcaatctgaactcgcctccgcctgttgaatcttagaggttcgctacgattatgtgaggctaccagacctctctatgcgcctgagctatccccacgtcggccgcgcggcgggggttaagtgggatgcctggatcatctctatcgagtcaacttatgcgattagtcttgatgagtagcggtcgcagagattcggatcgcttagagtggctctatcgtcactgtattcctctccattattgtttgctgtagcgtctgttttgt

SEQ ID NO: 9940 - DNA, 1346 bp, Homo sapiens
  misc_feature (1)...(1346): n = A,T,C or G
acctcccgggcatccgcagaactgcgcgcacagangaacgcgtgatgacgtagcctctagaagagaatacaggcaggtacngtagacgagtgcanccacataaggtgtatcgcgtaatcgacgtgccgatttcaaccacgcgagtttcggtggtgctcatagtctgttgccgctgttgtcactcacgcatatgcatacatatctagtcgtcaggattctgcgaactcgatcgcgaactctatttcactcatcaacgagttgtgattggagcggcgcagaganacgcagcatacagcagctctataggagcgtctgtcgtgcataatgcagcgtgcgcgacatgtctcaatgtatgtactgccgacagcatcgtgcgcttatcgtagcagagcggactatcggccgctatcagtggactgtcgtggggtnaangtccagcgagtttgatgtctgtctctgcctcgctacaccccatgatagcggtagatcgccgatagaatagcgatnagattggatccagctcggatcactacagtcgccgcactatattacctctatntccatacgagcgctagctgttacggctctagcgtcaatgctcacattntcacgtctgcgggtaagtaatgcgagtgggctattgtgtatggctgtatcgcagtcgccgtctagccgatgctgtagtaccactaatagttgtcacactgcggcgcgatatggcgaaactaatgcgatagtgtgggcgttcagtaacaatttacagatgacaggtatatttgcgagcatggagggaatggctcattccttcgcctctataacgtacctatcttgaggtttgataactcgatctatgcgggctccattttcaatatctggaacgacacacgatgtgaaccactccggcgaccgctgaagcttgagtcgtacgccgccgccacatactgctcgtgatcttttcctgggaatcatcactgcatagcaaggcggatgatacgtaggacttgcactcgtaaaaggaaagccgacagtatccgatcctacgttgatgtgtctatactgcaagcagcgagtgactttgngttcctcgcactgaagtacagacgacgtgacagagtacgcggctgcgacgggacacagcgccgttcgcgacctactcgccggtagtatcggttgcgcagggcgagcgccgcatacaccatgcttactaatatatgtgcggatttactctaaatacacgcttttattggcgctcgaacgtatgtaatgtggcgtcactgcttccaccacaaaggacataaaagcacgcggggcgcactatgtcactttcacatattgtcccgatcata

SEQ ID NO: 9941 - DNA, 729 bp, Homo sapiens
ctctcaaaaacttcaaatagaattccatggcccacaaatgcaattgtgggcatctttcaaaggaaagaaaaacggtttattaaagagaaatcagcccccctatgttttctgaagcactattccagtaggcaagatatgaattcaacatagatgtccaccaccagatgaattaagaaagaatattcggtatatacagacaatagaatactattcagccataaacaaaaaaaatcttgtcatttgcggcaacatggacggaactggagatcactaccttaagggaaataagccaggaaccaaaaattaaatacttcatattctcactcacatgtggaagaaaaaaaaaaaaaaacaaaactaaaaaacaatacccaccggtctcatagaaatgaaaagtagagcaaagaacactagagggatacagagagatttataaaaagatacaaaattatagctagataaaaggaataacttctagtgttctacgcaactttaggatgcatatagttaacaataatatagttttgaatatttagaaggaggatattgaatgttcctaacacaaagaagtgataaatatttaaaatgatggatatgctatttaccctaatctgattactacacattgcatgtattgaaacatcactatgtatcctcaaaatatgtacaattattaggcatcaattaaaaataaagtataaaaattaaaaaaataaaaaaaaaaaaaaa

SEQ ID NO: 9942 - DNA, 1811 bp, Homo sapiens
  misc_feature (1)...(1811): n = A,T,C or G
gtcgctcgtgggggccggtggtgggggngtgtggtggtgtgggtgcggnnnnttttttttctgtgcacgacacgcgngagacgcacgccagaccaacgccggcgcggcggagggacncccgcgcgcgcnactcaggttacgccgctccgaaccgaccaccctctgatccgccgcgtacccttacatgncatgaattaggtggtcgcgtcttgggacctacagcacacgagatcgcgaccatgcctgtgtgcagcaacgcgcacggcacctagcgtcacccgcggacatcccgacgcgcggtggccttngagcactggtatatcactaatgtcgaacgagagacacaacgtacatatacacgcctcacacccacacactcctccgtcgcgccggccatgcggctgcgcgcacgcgacgcagcccgccgcgtcgcgcaacgctcgatctcgcggtgacacacgacgcacggcgcgacgtgtgcgcgcggcatttgtgcgactgttntnctacttactcaagctcatactggactctgcgagtaagcgatgataacagttagagtggcgcangagagtgtagagactcgctagcgcggaacgacgagtcgcggtgcgatcgatcgaccgtgacagcgcagcgacgcgaaggcggaactgatcgccaccgccgcagcacccgtcggcatctgatatgagtnagagcacgggggcgagcccgcgcccgcgcgacgatgtgcgacgcgcgaccacacgcganagcagangcgcgctgcgccatgcgcgcgacgcgccgaccgccagacgatgccacgcgcgcacgctacantctaccgctgcangcgttcgccncgctctatcgctcttgaacacggtcggcgctactcaccgttcctgtattatcatcattgatatctacacgtctccgcccacgcgcgtcgcccggccgacagtaccgctatgccgtcgctctcgcgcgcccgntgacaacgcgcgccgcgccccgcccgntctctcgctttgactttacggtcgcgctcgcgtctgctgctcgacgcagcgtcgngcgtcggcgaagcgtgtcgtcactgtcgcggcacgcacgccgatgacgcatctagcacacacaagatagagcacactcgcacgctcgtcttcnctgatgacatccatcncntgtgcgtcgtgctccgatgcgccgcaagcagacgcatgtgagttgtagaccaccaaccatcgngcccgccgcgttctatcgtacagtgcgccgctggtagatgtgacggataccgcccgacacacgacgtcgcgtacactcgccgtctagtacgccgctggcgcccgcgcgcgcgcgtgcgtgccgcgcgcgcgtggtatcgcgcgcgcgtcgcgctgtcgtcgtggtgcgagcagcgcgagtcgcgcgcagaagtgcgatgaatttagacgantccgcgatgtgctagagtcgccgcgacatcgcacgcttcttccgtgccacgagtgcgctgcntcgatgtgcatcgcggcgcgcatgcncactcgcgagnacgcgatgcatatattagataatcgacggagtcacgntatcgtgngatctggcatgcggatccacatgtacgctcccgccagcacgtnctagantngcgcgacagaaccgcgnccgtangttncgcggcgagcgantgcgcggagagcgcagcagtactcgtagatggcgccaagtgtgcacgccgcgacacgtgacggcgggacggtagtcacgcgtatattgtagagcgtgcgccgccgcgtcgcaccggncggcgatccgcg

SEQ ID NO: 9943 - DNA, 618 bp, Homo sapiens
  misc_feature (1)...(618): n = A,T,C or G
tgggttttgaccctgcaagcgagtctccactacagattctgcttcctggggacccaaactctaaagatatctaagttatttatcatccttggttatttctttattttatacaatggtcttagtcatgcataatcctgtaaacaagaaaaataataaatttatttgctagacatcanctggaaataaaatacagtatgctctatctgtaatagatttggtgctgaaacccaacaaaagtataattaatactcattatttagcattctttttttacgatcattacttacatgtacttttcagtagtaaagacagtgggtaaattatttatctggattttttaagctacagtttgaagaattaagttaacaaacaccagactcttgagttaaagtgttttcatttattcatgtacaactattattacagaatttgatctcacatttacaaaggtattttctgtcttttgttccctgtattgtaatcaacggtaactatgtcttcaacttttattgtcaaattatcctgactattgtcatatcttgtgacatgtgaaaaacaaatttaaagagagaaaaatataataaagtttaagcttgttttagcanaaaaaaaaaaaaa

SEQ ID NO: 9944 - DNA, 1082 bp, Homo sapiens
  misc_feature (1)...(1082): n = A,T,C or G
ctcgcgtctctctccttctctcgttgcctgtgtgtgtcctgccgttccctctccgttccccgttgtggtccgttcggctgctcgctctccttcgtagtgtctttcgttcctctctctggccgcgacccggcgtgttggttgtggcgcccttcgttgctctccttcgtgttccggcgttgcgtgtccccttccttgcttcgcctctctccgtgtccggccgcctcttcgcctttgctcgttcttgtggcgtgtttcttgcttcccttcgcgcgttttgcgctgtgcgtcgggttcgttgcctggcccgtttgcgcgctggtgtgttcgcttcgcgggcgtgtgtccgtggctctgtcgctgcttcctgtctcctcttgctcgtgtgtgtccggcgggggttttccgccctgggctcctctgtccgttccgggtctccttctgctggccgccgcctctttgctttcgcggctttttttctccgcggcgtgctgcgtttcttcgggctttggccctggcccgccgcgcttctcctgctcgctcttcggcggtgcggcgttcttgtttcttctctcgtcgtcctttcttctctccgcgggtttggcttgccggttgggggctccgtctcctgccgcgcctggttgtgtcgtgttctccgtgtgggctgtgcgtcgtgccgtcgtctgttcgcgtgccgtcggcgtcgcacaacgctccgtggccccccccttgctccgtggtggggctcggccgggtttgcgtctggggctcgtggtttgtggtgtttgggctggtggtcttctccttctccgctcctcgtgttcgtggtggcgctgttcttcgcttctcggcggtcgctgggcgtggcgctctgcttgcggcccttgccgcttccgctgtcgtcttgtgttcgtctgccccgcgcctccgtgtccgtcggcctgtttggctctcttcctttcggtgtgtgtgctctgcgcgcgctcctaccgccggtgtgntgntgtttcgcccccgaaagcttttctttcgtgtcgtttccgtggctctcgggtgtgttgctctgcgttcctcttcttcgtctc

SEQ ID NO: 9945 - DNA, 428 bp, Homo sapiens
ctgatcatccagagatcactagattctgtatccataactaaggaagaagagatgttgtctggaattcctggagttgagatggttaccatgactgttacactttgtgtctaccctttcagaagagatgaaggatgagagtgtctccaatctctatttttgtttctttcacctatctattatatctctttacacacatagaaaatagtgtaaagaaaaatatcaacattttaagagtgtttgctcctgaattaggagttatgacctacttttctttcttgtttgcatgctcctgctcttttcaaattatctacaattcacttctgtgctttctatttttgttactatacgtattgtattttcttattatgttcattgacataataaggaaaataaaaaggtaatatatgatttcctcaaaaaaaaaaaaa

SEQ ID NO: 9946 - DNA, 849 bp, Homo sapiens
tatctcgtcggcttcgcacctgtatgaccggagaacaaattgaggggaacaaggttgatctctcagagagacttcagaccagtaccaaccaggagacagcaccagacgaatctgcataataaactgtactaaacagcatctatctaccataccatagccttcccagaacttgctgcccctgaagactcaaagtcctttccctttgccctgtcacttcactacaaattgtactgttctttgttgaagacattatgtaagctgaaattctaagccacttctttgagatttactcattttccctgggtatctcctatgtatacatgagatatacatgttaataacttctgttagtttttctattgataatctatcttctgttacagggggtccttagccaagaacttatgaaaaccataggaaaaattatttgccacgccaacaacatcataaggatgttcccatgccttttacaacattttgaatacccagttcttaagagtatatagcatttactaatgcggccctacggtgattgattcaaccaagcccctaagtggaataggtagagttgtctacattacgttcgcgaataaatcctccggttgtgcattcgcggatcctttcacctacaattgtaataaaggacctcaatcgaatattaaagtgaaactatccatcctagaatacggaaaacctcccatgtattgtgaatacctggttgttcctcgttacatgtgatacgggtatcttgatgaggaacaatcctccaacacatatccgacttgacctgagacgcctactcaataaggcatcacattatgccacgcgcgcgtaacaccgatatcaaac

SEQ ID NO: 9947 - DNA, 747 bp, Homo sapiens
ccctttaaaacaaacaattcttcacgggggaggttttaccatgtggcatcaaccctccagataaatcctaagcgaatcagcaaagattgataaaaataccttttaacgggtttttagcccactcccagatgtttagggttttagaagctttttctaaaaaataatgaccccctttcccaagggcaactttttccttttccctgggattgtagtgaataattccaagattccagtagacctaatgacatttgtattttaagatcttggccgtatttaatggcataggctgacttttgcagatgaaggaattttttgattaatgttgaaaaaaaacccttgattatactctgttggacaaaccgagtgcaatgaatgatgcttttctgaaaatgaaatataacaagtgggtgtatgtggttatggccgaaaaggatatgcagtatgcttaatggtagcaactgaaagaagacatcctgagcagtgccagcttttttctgttgatgccgttccatgaacataggaaaatagaaacttgcttatcaaaacttagcattaccttggtgctctgtgttctctgttagctcagtgtctttccttacatcaataggtttttttttttttttttttggcctgaggaagtactgaccatgcccacagccaccggctgagcaaagaagctcatttcatgtgagttctaaggaatgagaaacaatgttgatgaatttaagcagaaaaaaaaaaaaaaaa

SEQ ID NO: 9948 - DNA, 1419 bp, Homo sapiens
  misc_feature (1)...(1419): n = A,T,C or G
aagaagatggtgcgacgagcgncctgagcggacgcacgagaggagatacggagagagngnagaagaagagggagaggnagggncctttgcaatcggtntnngatcttngcgnggcgtcgngngnaccttcnnangcgccgttagccatagcccctgnactcgangcgaagcncagacaggnngacaancggggngaccgcatggccccctgcatagggngaaagaggcacnanncgaantgactnctncgtagtgagcaagngagtncacaccggangggaagtccaagactccagagncgcagcactaagcaggagcaaagaccgtagagtatcgcgctaagaatgacgcaggactacacgctgagaagagagtgtacgacacgcgcgaggcacagataatactaggaggaagccaagccgaaaggcagctgatgcaccagagagtaacagcagagtgtgatttcttgtctataacaccgcacaacgcacanaggcacagnccacacgggcacacgcaggngccaagaaccgacgagcgacacgaccacgcaggccgagcgatgcaggcacaagccacgacagcacaacgagaaaagaagaacccagcgaaccagaaggaagcaggagagaaggagcggccacaccgcaccacgaacggcgccccagcagagcgcgagccgaagcaggcaaggcgggcaccggcaagacccacaacgcgcaganagaggcagcgagactaggcgcagagaaccgncagaccgcnagagaggaagaagaggcgcgctagaccgcgctgcgcacgagcacgtagatgaccggagcgagaggacgaagaaggnccgagtgaggatagaggatgtgcgcgagagcatacgcgggcgcgacacgacgccggacagaagagaacgcgacagcgcggcggccacgcagcgcagcggcatatagagcgagcggagcgcgagagagcgcggtacacaccaccgaacgntagcgaatggagaggcgagccnagcgatgcgagagatctggcacagcgagggacgacgcagcccgcgccggccgagccatacganacagaagaagacgccgcgacagccacagctaacgcgagagacgagagcggtaaccgatcgacgacacgcgacgcgcatggacacgcgacgcatgcggcgcaaacgaacacgagacccgccacccgctgcgagatatacaaccctacggccaggcacacgaccgagacgacgtgaacacacgagtngcgcacgagcgacacgcgcagcgcgagcacgagcgacgcacagccatccgacactctacgcaggagcgcagacggtcngagccgagacgtcacacgaagagacggnacgagcgagacgctcggagccacgacactaacaacacgcagaaggacgaccag

SEQ ID NO: 9949 - DNA, 1143 bp, Homo sapiens
  misc_feature (1)...(1143): n = A,T,C or G
cgtgcgtgtccgtgtctgtgcgctgtgtgttcctcgccgtgcggctccgctccggtcgcattccccgctcttcttctcgtcgcgcttctcgtcccgtgtcgtgttgccttcccgcgtccgtccgtcccgtgttcttgtgtctggtgccggtttgtgcngttttgcttcgtgctgcttccctcggtgttggtgtttcgggcgtttgtgtcgtgtgcgtgctggcgggtggtcggtgcgcttgtgacgctcctgggtgccgttctcgctgctctcgcgattctcgtgcgtactttgtttgttccgtcgtcggtcgtgcggggtgtggttgtgcgttggcgcgtcncgctggtcgcggcggctnggcgtcgcggcgcgcggcgctctctgtgcgccgggtcggtgcttcggcnccgtcggtcctgggcgtctgcgtcggcggcggctgcgcgttcatgcgtcgcgttggtgtgcgctgttgtcttatcgcttggctcttgtctctcgtctttgggcttttcgggggtggagttgcgggtgtacgctccggtctgacgtggtctggggtcgtttctcgtcgccgttttctgtgtccgccggcgttctgctcgtcttttcggtctggtcgtgtgttcgggggcgtgtgcgtcttgcggtttttgcgcgcggggcgcgtttggttgtgttgtggtggtgtcgtctgtctgcgcgccgtgctcgttccggcgttcggcggttgcgcttccgcctggcgtcgctgtcggcggccgtttgtggcccggtgtttgctgtgtgcgtttccggctcgccttcctcgggaaaaacacgtggttctctgtccttcgtttcgcggttggtgggtgtttttcgtgtgggctgttcttccgttgccgcggtcccttggtcttgggcgcgtcgttgcttcggctttgtctcgccgcccgctcccgcgtctggggcgcgcgtggctcctgtcgtcgtgtttgtccctgctttttcgctggtggttgctgccccgtggcttctccggtgcgtcgcgtgcgttcctttctcggctggtttttcccctgtcaagctggcgctgtgttccccccagagttctgtcctcgtgttgcccgttttggttctgtgtgctcgtctcgtgtg

SEQ ID NO: 9950 - DNA, 1332 bp, Homo sapiens
  misc_feature (1)...(1332): n = A,T,C or G
cctttgtccgtcgctgtctcgtgtgtccgggccgttctatgcgtcctccgtgtgtatgtcgctgagcgtatggtcgggtgtgtgttcgcgtgttgttgatcggtgtcctgctgtgcggtctgctacttctgtccntgtctgctgcgtagcgcacgcgtggcgcgttccgcacgtgcgtcggcgcctctgcgggtgtgngctggctgaggagcgtgcgcgtacgggaatggcgtcttgcgtgcatgtgtggcgttctggttcgatgactactctccgctggcagcgcggctgttccggtccgccgtcctggctgcgtcgtgtctcggcgcgtatcgtgcgccgcgccgggaccggtgtcccctgtttccgcgccgcggcgatcggtcgcgtttgcggtngggtcgtcggcgcgggcggtgcggcgtgggcggtcgcgtaggggcgagccgggcggcgcccggcagtcggccgtcgcggcgtccgcgggtgctctgtccgcgtccacccgtcgtcgccgcctgcgcctttcttcgtcgccgcggcggcgtccgattcgcggtggtgtgcgcgctcgtgccgcggcgcctgggtctcgccccgnggcgcgtcgtcgggttggtcgctgcgcgtcgggcgcggcgccggctgggttcttcttgtcgccgccgtcgtcgggtctctgcggtgtcgctgcccgtgcgtctgcgtttcgtcgcgacgctgtcctgtcacgtgccattcgcttcgtcttgttctctctgccctgatcgtttcagattttctctccgggccggtgttctattcggtgttctttactgttctgcttcctcctgtccgctgctctcctctcgattgaaaccgttgtggcggttgctgctgtctcttangcttgcntccttagttcgtctctatgttatcttatccttctcgtgtcctgacggggactcctgccctgcgtttcccttctttattcttggctattttctcagcgcttcggctcgactgtcctggtcttctgtctcgtctgctttccttctgtgcacatctctccctacgtcctccccccgcctcctcgtctcaacccctccttctctcctctacctccctctacctctaaaaattcttctctcttctcttctctcttccttttttttctccgnctacgtcctgtgtttttncccnttctttaaagaactctttttttnntntntgttntncctcttttaaggttatttttttttctcttcttttcttcttctttttaattttctctcttttacttccttcccntcttttttattctttttatatacaatattttaanaanaaaat

SEQ ID NO: 9951 - DNA, 889 bp, Homo sapiens
attacctccatccgaccactactcatacatcctactctcccaccaagcacacctcatttccatactaatacaaaatcaacattccaaagtataggctggacaatataccacgtcgagatcctcagacaccgtttgaatggagactggcatctctttaagaactacttccctttctccacagcttaacatcagaaacttgaaggtcactcccaagggcgacccttctggatagaaagatctgctctcagtgctgatttatgaactgcaccgtcacaaaccagtattaattccggagttcattcttccccacagctttacgtttacttacagccatctcttatccctgacaaacacaccacctccatcaactgcgctatatatcatccctaaagaacacacacttctacgacccttactatttcactcactcacctgacttaataacacaactgccaaacaatccgcctaactgtgataaattataacgtctcaattacactctatctccaataaccatcactacatcttctcttctatcattctcaaacctccactcttttctatcactttaacagacacctctaccaccccgctttaaatacttacatcggcgaacctgactgcctctataactcccccatcctcctatacctctctctcacccgaccaccatcatctaaaccccaccactccccccaccccttattcaacataccacccataccgtacgcccttctacacctgtttatacttccaccttctacatgccttaccccctccataattcctccacctttcgtcaatcactccccacccacctcccccttcctcctcttccccccccctcctcatacaacaataacctctcatacaccccatatctcaatat

SEQ ID NO: 9952 - DNA, 794 bp, Homo sapiens
  misc_feature (1)...(794): n = A,T,C or G
cctctttctgggcttcttctgctgtggctgttcctgggtgtgtcccctctcgtccgccgtggggtctcgctttcttcctgttgtttgtgctccccgccgggctggtgtcgtggtcggtgtctcgtcgcgtgtgtttgcgcgtgggccgccgtttgggctttgttccccctgctgtctcttggtcgccctctccgtgtttccctttcccctcgggttttgcctcgttgctggtctccgccctttctggttctttgttgcgcttgtttgttccccggtcccctcctcctgcggggtctttgtggtgttttctctgtgtcctgcgttcggctgcttgttgctcctgcgggttggcggttccttccgggggtcggcgcttggtcccgccttcctggtttgctcccccgtgcttctgcggttggggttttttccgtggctctgtccgtccccctttctcttgggccttgctttggtgtttggcgctttgggggtttcccctctcctctgtggccccacaaggagtcgcttggggtggttgggggggggggtgcccctggtgttctgtccgttctgcttcttgttgtgcctttgcgtgttctctttgtgtcgcttctttgccctgcgctcttctgttttgtgcgtgtttccctatgcccgttgtccctccctttgcctattgtcttgtttggctccgtgtcnnttttttnatggtttcgcgcgccacngcggtggngcgtcgccgcctaggtttttctctttgtcccgttctctggctcgttgtccgtctgcgcgcgtct

SEQ ID NO: 9953 - DNA, 760 bp, Homo sapiens
attatcccttccccaaatcaaaactcttgtggtttcctaaggcctgtctttaatctcttaatcccatcatctttgtaaagtgaggatgtatgtcacctcagaaccctgtgatgattgtgttaactgcacaaattgtttgtaaaacatgtgtgtatgaacaatatgaaatctgggcatccacaaagaacaggataactgcaattttcagggaacaagggagataaccataaggcctgactgcctgtggggccgggcagaacagagtcatatttctcttcttgcaaaagcgaataggagaaatatcgctgaattctttttctcagcaaggaacagccctgggaaagagaacgcattcccagggggaggtctctaacatggctgctctgggagtgtctgtcttatgcagttgtagataagggatgaaatacgccctggtctcctgcggtgcccccaggcttactaggattaggaaattcctgcctagtaaattttagtcagaccggttccctgctcttgaaccctgtttcctgttaaaatgtttatcaatgacaatgcatgcacagcgggacatgaaattttatcagcaattctaatttcgccctggtcctgtgatctcgctctgcccccatttgccttgtgatgttttattgccttgtgaagcatgtgatctctgtgacccacaccctattcgtaaacaccctcccctttgaaaattgctaataaaaacttgctggttctgcagctcaaaaaaaaaaaaaaa

SEQ ID NO: 9954 - DNA, 798 bp, Homo sapiens
cctagggatcccagaagagcaaacattcccggactaatagagtagctctgcagtgccatcagagctggaggccccttctatttgttcattctgtcatccttaacatgttctttcattgttatggtttcaaatctgttccacttcagtcaccatgccaacaatccagtataaaaataaaggaacggagagaaaaaataaagatgtgcccttttctttttggcacaattatgatcctataatctatattacccttaactggcttttgctgtaataaaaccataacaactgtaatctcaactaatagggagacagaggcaggaggattacttgagctcaggagtttcagcttgggccacaaagcaagacccagtctctgaaaaagaaacaaaacaacaagatacaacaataaaatcataacaacaaaacactaagaaatcatttcaggtcagtacatatttaccacacagaaactaatgtaatattaatggatgtgtaagttttaaaattttttttcataaatggaagcaatgttacaagggaaacacttgggaatgtcttgcattctttgtgtgagtataacattagataatttttttagaaatataatgtctaggtaaaggcatataatatttaaaattttgaaatatgttgccaaaagtcctccaaaggattgagtcataattctaacagcaatgttgagtatatttgtcttttaccacctttcaaaatatatattttcaaacttgaaaacaaaaatacgaagataaatatctcagatcgctcgacaggttagccaag

SEQ ID NO: 9955 - DNA, 740 bp, Homo sapiens
atggcaggaagttgttaccatgattatgctgaaagaagaacccagaagaccaccttactggatctagaagccaggactacctgggagaagctggaagtacactacacaacagacttccattcatgcagtaaagggttgtttggtgggtaatggagccactgagaaaaactggccatcgctggacttaacagtagaggtagagagctacagggaaaaactgtggagtgaaaaaccttgacttctcattctatcctgccttcctatttctattgagtgtgtcccattggttggcactagttgaaagccagtgggcaaggggttctggaaaatttagtttcctctgatatagataaaaaggaggaaaagttggagaatgaaaccgagagcagataggtaaagtggaatgcactatgattttaagtagaaaaatgttcacttttaattctttatatgggcacattcaaccttatcacagaattagatattatatttttctgattgcatttttaaaatatcctcataaaacaaaatataagaatgaacatacaggagcatagatatactattttgtttttattttcccttcgtaaactatatttgttaactttgtgggtggttttataagcttcttggcaagaatgtttattgtagttgtattttctatagctattatgattgttatttaattgacagataaaaattttatgtattgatcatgtaaaaaaaaaaaaaaaaaaaaa

SEQ ID NO: 9956 - DNA, 242 bp, Homo sapiens
cttggaatggacattgactgcaaaggtgcacaagggaacttcctgaggtgatggaaatgttttgtcttgattgtggtaatgattacatgactatgtttgtcaaaattccagaactttatacctaaaagggtgaattttactgcatgtaaattatacctaaacacatgactttttaaaaaggcctgaaatcttaactactcagctaaaaataaaataaaataaaataaacaaaaaaaaaaaaa

SEQ ID NO: 9957 - DNA, 325 bp, Homo sapiens
cctgactcacactgttggtctggattgcagctggaatcggaagggaaatgcatttccattgaaggaagaagtgtaacagtgagcaggcaggtgtcagcggatctcaagagaataatgtcaactggacgatggcttagaggcaggaggaggcagatcagctaggcagatgtgcagaagttaagtgtggtttcatgcagaaacttccaaatggattcaagagccaaagccttcaagaagttggtgtcattgtcacttggaatatgtttgtattaatacaggtagaatatgttaataaaccatattcttatcaagaaaaaaaaaaaaa

SEQ ID NO: 9958 - DNA, 887 bp, Homo sapiens
  misc_feature (1)...(887): n = A,T,C or G
tctagctcgacaacggcccccacactgcgacccccatacaacccnctgacagatctcctcttcacagtcttggaaaagcagaacgagaagaatgaagaaatgtccacaaaactgctcctatcctttacaccacataggaccaaactcttacctttcatcagttttcagttcgcacattaacgcatcctgctgaagctcctcaaccacttctcgcacattcaatcctaattgatatcccgccacattatgtaatttgctgactcgcacacctgcctgctcctgaatgtactcggaccccaagcctccttgccactctacacgctatcccccgacacgctacgacacccccgcacactccctcaaactccacgaccgaccgggcccgcctaccaattctcctttctcatacgctcctagaccctccatccaatatnccccccacccatccttacccactataaacccattataacccccgtatataggnactccacacctcccaatctgttcacgtccccagcctcattttccccacttcacacaantaaccctcatgactcataaccgcccaccccaccgacccacccccgcatgcttcccctccgcccccgcccctcgaccttcatttgagtcagaacatctagatcggccccaagcgcacgccaacggcgcacctgtcgcacccaggggcccccacnctagatcatgcccctcagcataaccccattcataactcccctcagcctacccttctataccctcctccccccgttctgcccccattttccttctctcccgttcagttctaatcgcgtccctcagcttatgctcttgttcttcacgcccgctcgccctctcccacacctcccccccttcccttccccata

SEQ ID NO: 9959 - DNA, 1557 bp, Homo sapiens
  misc_feature (1)...(1557): n = A,T,C or G
ggcatggactacccagtcgggacgtngngantcgtacggattttcgagtatcactctgtgtntgncactcgctcgtgcagctagcatcgtctgacgtacgacgntgncgctcgctacgtcgcgngactgatctatnctctcgangcgantcgctatctctgtgtnggntgcncgctatgtcgtantccacacgtactcgtgatatagcgtcaaaacgtgagtgngcgacgacagatcagcgcactacagcgncacacgactagtcgcactctnctgtcgcgactagctgtactgtcgtgtgncatatactgcgtggccgtcggccgtacttcgtctgatcanactgatgcaggccatcagcgcgacactgtgccgatcatacaactcanagtcgagtagatacggtagacntagacacctagcagtcagcncttacgcatgaggtgntcncatactgtgantagcgcagcnccactgannctctcgttaacggtataaatctataatagaanggtacgagagttgnggctcgtctgcgtcncaccgctcgagctgagacntcgcgatgacgagacgcacagtacagcngcagacacagctacaagactcaacgactgctgcaactcatgctagtcgtactcttcgtagcgngctgactaatacatacactcacggccagctatgcacgatagactcatgtatgtagatactcgtcgtacgatcagtcgactagtgttctctccagnggatgnaccgtcatcacgttagtactgttgcgttgaagagaataggctggtctagtcgatcgtggactctgtcggattcgtgcggctgcacgcgcgcacgctaagtttatgaagaccactagatagagtcagacagacggactcaagtcatgaaccatgacgagacagtcactcgctccgctcgctggtatactcgctcgcagcgagtactacggcaggacgctgatagtacctcaccagncgcacacggnttagtcgagtatggcatatgcctaccgcgtatangctgtnacccattctgcaatacataaccttctcagctcgacatcttcactttcacttcatactctaacgtcaccactactacatattattatagtaacctacgagataactacntacatacactataataataatgcgtaacatccagtaatatacttctgtctccatcttatcccacagtcatgtgtaatgtatgtgtcgtaatctntatctgctgctgtgtcgtgtgttcgtgctctatgcgtcataccgtagtatacagagcacactgacagtgagaatagtagagaagagcattataagtaggaggacgcgctagcgagacgccgctgcggaggttaccagctcgcagcggcgaagtcctctcacgacgctcgccgactgtcgcatattctctccgtcgctttggtgctctgctggtgcgttaacacacgtaatatgctaaagccgcgtctgcagcctgtcacgcgagtcactatgttgtctatatagctatctgtatagcgacactnccgctgtccccgtt

SEQ ID NO: 9960 - DNA, 1150 bp, Homo sapiens
  misc_feature (1)...(1150): n = A,T,C or G
attttattagtggttctagcatatattgaggtcgtagggacgcgcgtaaataagcaagcaacgaagagtaaagattaaggcgctcagcatatcgttagtcggacttgcaaagagcaagaggggaacagtcgcactattgtcgagtatagagaggtgaagttacacatgcgaccatagcgtagtatggacgaccttacagaaggtcaccattggggacactagccatacagatgaggagatgaggagaagtggagaaagtccacagtggatgtatactggtcggagaaaagtgcgctcctagcctgcgcgacgttaacgaccgagaccgtttagatggtgatgtccgcagcagttatatcgagtgtgtagtatctaaatgtgcggaaacaggtgctagagcaaagtgtgtactggagtgaatatattgaaggtgtcgagttgttgggatgtagttactgaaacactatatagatagagtatcagggagacgctgctagttgaaaggaggtgtagagaaacgcaggagaatatgaggtaaattaaataaatggttccttcaatatactgatttctcatatctctttatcaacccgacattagggactcgtaaatttttgtgccatatctatctaggtattacaagtgttgtgacgaatttaaggtattgcatggtgtaaggtacctatcaagccatgtgtctatctaacacttctgattgataaagttatagttgtgcccgacactcaatatcagtatgaagaattggagcagccatgcgagggctgacgtgtaatcattatatgagataccagacatcgtactcgaagtgaattcgcacactgcaggctaatgatcaattagttgctgcgttttctacgaggcgagagtagttcaggtgtaaggaaatagcattgatctcaagtctatgttctctataagacttgtccactaattcactaccatgtcgaagtaatagaatattatggtgtgattactctggataaataagaataaatagaatagatgtgcgctgcctctgngcttaacagccgtgtgttatgntngtttccgctgctcaacggcctctttgttattgtcgtttcgtgtaatcgaaacatcaatgaacactacataatacttttacatgaat

SEQ ID NO: 9961 - DNA, 1028 bp, Homo sapiens
  misc_feature (1)...(1028): n = A,T,C or G
agtgagcagtgtggggttgagtgggattaaagagataagtccatattgaaggagtggtgtgtggagcgggagtggggtggagggtgaatgggtgtagagaggcggccgggggagcaggggcgagtcgtgacttctacgtacgcggagagtaacgtgtatgagtgcgatattgagacgttggacaggctgtgccatatggaggtggtgggcctcgtcgtgcgtggagggggctgcatggcagaggcgaggggggggcggcggggaggtgggggaagtgaggtgtggagtgtgttgaggggggtgnagtgtgatggacgggggcggtaggatggggggtgggggggggggagcgtgggggggggggtgaatggggacggcgaggcgttgactgggcaccagtgtagagtagggcgtcaagggaggaatgaggtagagaangggggaggggtgtgcggcaggggagtggatggggagcgtgaatcagggtggggagcgggggacgtgggggggagggttggggaggggggagaacgtcgaaagagcgtttgttgtgattatggggcccagcacgttntnactgggcacggnnctattgtctgcgtatgcttacttcatctctgctacattgctcttattgcagttcgctatgtcataagnatcataagctacagtaaaaaaaacaaataaataataatatttataacttcaaaaaaatatgtaacacaaannaaaaatcaaacttaaactaattnaaacaaaacatattttaattattgatttttnnnccttttttattatctaaaattatttaatgtaatataaaacgctccncctacaccaacaccattgccataccgtcatgtatctaatactctacaattcacaatattcttaatataccanncaacctnaaatatcatcaataatttaacctaacaacaaataattatcnttactcaaacatacaaatatatatnnccatcctaccctaaataaacatctttatatcttatgtatcatactcaaaa

SEQ ID NO: 9962 - DNA, 1246 bp, Homo sapiens
  misc_feature (1)...(1246): n = A,T,C or G
cgtcgtagagtcacnaacgatggaggaccgttcgcacgatgctcgcacaagcgctatgcttcagatgaagtcacacgtggtctcaacagtacgtcgagacagtgtacagcgtgagcgctcgcgacttggatcactccacttctcagtctctactacgcttagnagagacactccggcgagcttgatcgagcgtctataatatggacactatatactgagtcncacagatctctcaatgttggtgtgagtaagatggggtagcgctatcgtgagtgggtactataaaccagcgcatacgccgacctcacgactgctgtcagcataatacatatactagcagtaggaggatgagagagagaggaagagcgatagtaaggtaggctattgagagaggccatcgcagaggccatactatgatagtcgtaattaggagcagtcagtaggtgctatttaatctagcaagagaaagaaacgagantcacgtgcgtaagtgagctggtttcgatagtgctgatagtgctcagtggctactgctgtatntccgatgatactgtagtatcgtagtgagtactgtattgacagggatgagaacgatgtagcgtgtgatatgatctngacgccgggagacaatgcgcgacttctgctcgatcatcgtgtgttagattatgactattgtgggcgccggaaacggatcgctagacgagctcgacggttctggggcctagcatgcgttcgctaccatggtgtatgactagatagcataatagtatattattaagaaaatgatcattctgagtcggctctcaaatacaggaaggatgatcaataagagtagtatgggatataggagaggagagagataatagctcaagagatattaaaaacaactaagaagaaaatataagcgaagtacataattaaaaggctacaacgcttaatttgcatcattctccaatttctgttaaacagaaattcatcctatcaaacccacaagacgaatctctccaatctgaattattctatcagggggtgtggctaaccactataaaataaagagcgtattactaacggccccccacatacaaaaatacttaatctcttgagcgaatctccataataacaaaaaattagtctgatgatcgtatctaggcacgggtaactttgatgtcaagagtgcagttgggacagtgagccgcgctctgggaagaatggaacaggagaaagtataccaatttagaggacgctt

SEQ ID NO: 9963 - DNA, 320 bp, Homo sapiens
gcctgatgtaacatacttcagagactaagacttcatctcctcatcagagtgtgatatttaagaatgtgggctctgccaacagactacctgatttgaatcctggcttcaccattttttagctgtgtgcccctgggcaaggtgattaacttctctacgtttcagtttctttgttggtagaatgggaataatatctgctttaccttataagtgttgttcagcttctatgacatattattcacaaagggcttaacacagtctctgtaatgtggtaagcattttaataaagacatgctgtcattattattgtaaaaaaaaaaaaa

SEQ ID NO: 9964 - DNA, 341 bp, Homo sapiens
gtttaggagctactctggagaaacgcttaggcgaagagaatggcagaagggtggtgtcccaaggaaagggcagaaaacaggtggctccagatgccttttaagagaagggctgccccggccccagactcaccggctggtacagtgaccactcagcagctctggactggctcccgtgtggccctgccaacaggatggggagggcctggcatgtgtgagtagccatgcccacccacgtatttgcctactatgcctgccaaccgggatgaaaaagctttggatctggctaagtttctgtgaaccaggtaataaatctgttcttggtgtgctgaaaaaaaaaaaaa

SEQ ID NO: 9965 - DNA, 715 bp, Homo sapiens
tggtactccttttattattcttttagcgcttaccttcaaattttaaatggacattattgaggcttgtcaacgtctacaaaagtgtactggaattttgattgggattatgttgaatcactggatcaatttttggagaactgacaactcaacaatattgagtgtgtaggtttatatatgtgatatagctctccatgtatttagatttttagtttccctgcacaatcttttatagttttaattaaacaaattgcacacatattttaaaaaatgtatccctaggtattttatttttgatgctattgtaaatgctattgggctttctaaaaaatcgtctcaatctttctgttgtttctcgtatatataaaaatgcaaataatttgtgctcatacaccttatatctggaaacgctgctaaatgcatttttttattccattaactcttttgcttattccttactattacctttgtgggccgccatgtcattaccaattaacattattactcctttttcaacctcaaaaaaagagaaaacggcctcattggccaaaaacgcagaatatctccggcgcttcccttttatgagggttattacctggtcccatctactgactacctgcctcgactatttattagcgccaagcgttacccctaccacacgtcgatacccgccccccccttaactaccggattcccccggtaaaatctcgcttccaca

SEQ ID NO: 9966 - DNA, 1269 bp, Homo sapiens
  misc_feature (1)...(1269): n = A,T,C or G
ctgccnatcctctaccatgcagcgaatcctctcctcganttgttagtgtgtccgccttgctatttgtgtgttgttttgtctcgtgcgtgcgacttctcgcttgtctgcgctgtctctccgcgtggctcatgagcgagcgtgcgcggacgcgtcgcgcangctacacacatctgatggtggtgatcggcgcggtccgtggagtttcttctggcttggggcggacgcgtgcgtcttccggcgtcatgccacggaggtgcgtcggcctcactgtctcattgcactcacacacaacatcacttatcactgtcctcgcgtgtgggtctaccggacgactctatctctctcgtgcacttccacgtcgtcattgtttctactctagctgccctagtgacgttatcctacttgctcacctctctaccttctctactctcctgctgtgatgcagcgcacactccgcctgacctacgtgtgcctctccagtgcttccatccatctnctnttcgatactttattctttcgctcggttccaccgtgcatgcggcgacccgcccagcctccgatctgctgacgcagtgcctatctattgctattctttttagggatgcgctttcgtntcgcggtctgcggagtcgcgcggcgtggtggttgtgtggttngggctggttcacttgctggcgaggcatgtgaggtcggcggtactctaggttggtcgtggcgtggatcactctgtttgcgtancggntcttttgtgttactgtctccactatactatgtttatgtccgcgcttcttcgtcccgtccttgcttgtttccttttcatatttttccttttttttaactattcactattatatacctttttcatatactctcgcttcttcattctgcttctttttgacctcatcactactctcctctcttctctcccgccactaccaccaactgttcgtgagtttattgctgtatactgatcgttagaactataggcgattacaaatctcgaatatctatgatatacctacagtctatttcttctttctactccttccttataccccatattccataacctccaattatcacacccacaaaccccacccaactaacttttattatcattaaatacagaataacgtatgggcccttcgccggatcctacagtcggtggtagntgttttcgccttctaaggtttntttttcctcctctttctcccttctccccttncccccctcttcttttctttcctcnncatccccttctaacccacc

SEQ ID NO: 9967 - DNA, 1595 bp, Homo sapiens
  misc_feature (1)...(1595): n = A,T,C or G
cgcgtatctcactcacacattcgtnccgcatccctatctaactcacnctgtcgtgtggtggagagtgcgttgatcgtagtgtagtcgagttgatgtacngtgagtgttcggcgtgtagcatggtgtgcgtgcgcgagtgtagatcgcggtgacatatacaatactcatacctagctgactgtagtgagatgaatgcgagacatganagcgtcacganagacgctacacgagcagtattacaccgtgagctcgacacaagtacngtagtatacagagagtgcgatgctactgaccgtgagtatgttcgtcgtgtngcactaacacgttcngaggtgcggatacttataagccgagtcgagtcgtgtgacatagagagtggtgtgagtcgtcagagtgctggtcgtgtggcgngagcgtgtcgcttggcgggcgtagagacgggtgaaggagagtggtgangagtgatgtgagatggagntcagttactgtntgcgacgtgntcgtgtcgtcgtatcgtgagctcttgcatctcgtgtgccgtgttgtgcttcatgtacctgatggtntgtgactgttagatgtctatgtcgttatgtctcaatacatgcttgtgtcactatanaatctnacgatcactantgttatgatgtatgtcacgtgantaaccatctcgtactanagcttcttgtntgttagcgtatgagtagtattgatattgactctgtggtacgtgctagtagcngtgatgtatcntcgtatgatgtatgaacatatataacgtatctctacttataaagtatattacgtagtggtatanctatctctccgtctgtcaacancatatatacatactntttgattacactctgtatagtcgacaacaccgtgaanncgcagaccatcacgttctaagatttcttgtcgtcattatctacgctcgtcactctagtacgcactaggtcgcgcaatacggtatcgtgtgttgtaatnatctggtgaggtactgattggtagtagtgcggtatatgtgtggatgngtatgannttttgtgcgcgtaatgtcgtgtctctttgggtctgtagagatnatttnttcttcgtgcgtgtagtgttagatcttacnaactgtactacntntntnttactctctactagctgaatagntcgactctcacgataagactcctcttctgctgacgcaaacgacctactctactgtcatgtcctcctaacactctaatnacnccgcagtcacatacaatacaatacaccgcttccaattatttgacggtaaacgcaggtgcgtctgacgcgatcctaataaaaggttgaggccggcaacctactgcatagtgtggtgatgtgtctcggcgccttgtcgagtggtgcggcggcgtgcggagatcgtgtgggtgtctgcggcactggaggagataaacatagtcatgagaggtgggtgtgtgactctactctgattcgactggcacacctattcgctgtgtttctcccattgttctattgacaagtaaaagacaagcgagaacacactcagaatactagaggcgatgcgacaccgaatgtgttggtggcgggag

SEQ ID NO: 9968 - DNA, 935 bp, Homo sapiens
cgagaaccggccgaatgaggagaaggtggaaggggaaggagggggggggctttaggtgcagatcgcaggcagcagttgcaagggagaacgctgcgccctaggaagagatacatgaccaaggcagacagccatcggcaagatgcgtactcggaagcccagctctgacccgccatgcactgtgtggtcaggctggagagcctgtgtatcaactcaggattgctgatgggctagggagagaaacaatggcactgacatgattaggtttcatggcctgcatggagtttttttttgcagtgaaagaaaaaggccggctagagtgatacggggacaaaggggatgaggcgcagaaaaatcacatttatgatgatgctatctgaagacaaggtactcatggcctggttagggttcaggcgtagagctataggctatagtgcccttgacggaggtgagaataaatcaaccgttgagtactgagtttggtcgtactcgggcgggaagagtgggtattagcaggtgtgtgatcggactgtgagtgccgctgattacggtttgatagtacatcaaaagcgtggaacatttaatgagagtaaactctgtggtcactgaaggcgtaagggggaaaggatggatgagtgttgtgtcaagacgcgggtgcgctggtttgcgcgaggtcggttgtaagttaaacgtatgttgtaaccggtaatgtataataggaaatatgtagagaagatagtgagggacgggggtattaaggatgaggagagattgagtgagagaggggaggaagtgggtgtcgagtcgagagcgtggtgcagtattatttgcagtaagtgttaatgtgaatcgagagtgaaggaaatgattagtaaggtggagagttacgtataagaaatggtagggtagatggtgtccggatggagtatcattattat

SEQ ID NO: 9969 - DNA, 1353 bp, Homo sapiens
  misc_feature (1)...(1353): n = A,T,C or G
ctgttgtatcatgtgagtgttgaccttaggagatgtgttactctatacggtganagagcaattacagaagcagagtcatctgtgtgtaacagtgttgttcgtgntatagttgtgatgacgtgatgtggtgagtggcatagagagggatgatgttgtctgncgtcctacacgcgtggtgatagtgcgaggaggagagataaccgcagatgcagcacgagttgacgagatcaagagtgcggactagagtgntggatatcatattatagtcaacacgtaatattgtcaatacacacgcgcgtcaggtgtacgccgtctgggactgtcatctgattatgcatgtgtgggagtagatgtgtagacttgctagtcgtgtcaatactaatataaatcatgaaggaagaagatttatacagttcttaccttactcgatttactagtcgctgtattgcttatatcgtcgctgttatcagatagtcggctactcgatgtcagagtcatgacgctggaatnagtcacattaagaagtggaagaataagacaggagcacatcgtgcaactcggtgattatcagatcgagtatacgagtgtgacaagatatgacacatattactggtatgcttctcatttgtatgcgaggttctttagtacctngaggacgagaaaagaaaagagaagagaggagaatcacgctgtgttgatgatgagtagttgtagttcgtagatttgtgtcgatcatgagattgtgtgtggagttgaggagtgattgtagagagaggagtaatggagggacgatagatggggtgtgatgagacggagagagacatgagaagtggagctgaggatagtagaagtggagacgacgggatgagatggatgtaagatgttngacggaaagagcgagtcagtatangagtatcgtgaagcgacgacgcaacgacgcacgcatgaagagcacagaagtcgcacatctctcggacgtctatactgtcgtgtcgcttgctagttgaatgcagaacttctataactctcgtgtagaactgacctaagcgcggagatcagtaggcgtggaaacttatatgtctagcattctgcctaccacctgtatctggttggagatttgtcacattngcgactcttaacttgtgtatgctctaacgactgcgcgtctcagaagagcacgcggactttgtaatcatgaatagatagtatatatgcacaattaagcagtagctagcgtacagttgcggcgaccaatgagggttatcgttttggagtgggtgggattgtattataggttagtggtgatattaggagacgtagctgcgacgattgtctcactctccagtgtccgat

SEQ ID NO: 9970 - DNA, 222 bp, Homo sapiens
  misc_feature (1)...(222): n = A,T,C or G
taaaaaataaaaagattcaaataattaaaaaaaaaaagaagcgaggtgtctaccaccttggnatattanagtataattaaaactgcaattagcaagtagataatcaggagcggtgaaaatacaaaagaagaaactgagaagagctattatgttaaatcagagtctaaatatagttttctgtagtctaaaaataaaggaagcattctattaaaaaaaaaaaaa

SEQ ID NO: 9971 - DNA, 1090 bp, Homo sapiens
  misc_feature (1)...(1090): n = A,T,C or G
cttaaattaagtatcccatcaattaaacaacaaagatgttacagggacacagagacgcctccttctgcgaacaagattataggaactacaaagctaatcccatttgatcctgctgaaaacatgtcgagggcttacctttttgcatacactgtattaagtctgctttacttccacgtgtatgaggtttgttcgaacattggcacaaacaaaagtctatataacaagattaattccgcacgagctactactcctgttagagtctcaagcactctggcgtgtaatgctccattatcttgctctgcanggatnctttgtgcttctgcacttcatactactagtcgtcttgatcattgccgcacgtctgctaaatataactcatacatactagacgaacaacacatgtccgagactctgtttcaaagtgtgagaattaagatttcgtatatctgaataacatttagaacatacacgacaatacccacaatgcgagcgcgtccgtctagcccttccaagcaggctgagaccatactgacgcgcccgctctttccttctatgtggaggggtgaaaatctactgattcctacgctccacctgaacctcggtgaagactcaagtcctcactagtctgccagcaaagtcggtcatcatatctcacttcgaaatggccgtgtaatcaccggcttatctcacaaagaatacacggagaaataacgtaacgtgaaacaaacatgtagtgatcccaaattgctctacctaaaatagcgcaaaaacacctaaaaaacggacccgggatcttctgcacattaaataaataaaagctccaacgcccccctgccgaagccacataataatataacatattcttaacttcattacgccgtctataacccgaccaagacctatatataacacccaccggatcatccccatggaaagtcacctacaatatcaccccctagtactaaaaccctcaccctttaacagtgtaatcatgctacttctcttcctctttgtggtaatccccccttcttttactcaaattaacccatactacgaacctaaagttaggcgctgtatctccacctcaatt

SEQ ID NO: 9972 - DNA, 755 bp, Homo sapiens
  misc_feature (1)...(755): n = A,T,C or G
aggggcaatcttgcctcaccgcaacatttgcctcccaggttcaagcanattctcttgcctcagcctcccaagtagctgggattacaggtctttaatccatctggaattcatatttatggatggtgtgaagatttttcataggaaaagccaattgtcacaacacatgttactgaagtctattctttctcactgagttgcagtgccgccactatcataaatcacattcccacatacacttggatctgtttctgggcactctattctattgattcctttgtctagcccggcaccgataccacattgttttaattactatcgctttcaaaaaagtcttggtatttgttagggccaggtctctttccttattctttttcagaacggtctacttttttcttgggtctttgctcttctctatgaattttagaatcagtttgcctagccctgtgaaaaatcctgttggaatatttattggacctgcaatgaatcaacagattaacgtggagagaatcgtcttcataacatggaggcatctcatacttaacctaatacttctctatggctctccatttattactattgtagcctatgttttacttcctaaatatcttgcaagtgttttgtaatttttttctgggttttgtacaattttaattttattgtgaatgatttctttttgaaagatactacaatttctaataaactattgctagtgcgtagaaaaaaaaaaaaaaaaagaaacaaaaaaaaaaaaaaaa

SEQ ID NO: 9973 - DNA, 1164 bp, Homo sapiens
  misc_feature (1)...(1164): n = A,T,C or G
catatatagtattaattctctgtaaactagcttatgtagttatgtgctgtataaactgactcgtttaccagtgctaccacctaaaagaactcgttttcctcacatgctcgaccaatatcaactatgcagcaatcgtgcaagcaatacaggtatctcctctctagatgcatgctcatcatcggcatagcgggtcgaatcagtacaatattctctgatgagctgtcatgcatgtcttgagtaactatcttgttgcatgaggtgtgttcttactatgcactaaatactcggtttatctcttgagtcactcgccgacggactactacgctcttgacagatggttctcgccatcttgcatgtattgctcattatatttattctagtgaaatcgtccttatgcattctatactcctccgtctcgactatggtccaactcttcctaagtctcaagaacaacaaactcttgaccattcgcctcagcgatactgttcaaggcgtctaaacttagaaccatatattagttcctaacgggaataacataaatagtgatattgtagcttcctgagcttgtatataattcctcttcacttatgtctattccttttcttcgctcttcgcagtgatttgtaatttatagactctcaactctctcactcttagttatttaaaatgttctccccagtcactttcgtgctttacatttaattttactcagcatccgcacctccacctactcttccacgtattcaccacgcacaccataatccatatctttacccggactcctcgtacttggtctacatctctagtggtttttgcnatcgccaacctgccatgcccaatccaaagagatcacacgattctgctcttccccattatctagtcaactatttatgttgtgctctatttagttgtctgtattagttgagagtcgcttacgcgaacacgtacacttctttagtagagctcggagcgatanatttatcacactatatggtgcgttgttatataactcaactacacaagtattatatagactatcntcttctgtcgatttcgtctctcactctacaattctcaatctatactactttcattcttacttcatctaatacgctaatcatatctatactatcttcttgcatctatactgctactctataatat

SEQ ID NO: 9974 - DNA, 778 bp, Homo sapiens
  misc_feature (1)...(778): n = A,T,C or G
gtccactctttatttaagtgaaggactaataaccaatatagggtaggagagaacagaacactangggattgaccttttttgtgccgacagagtgtgacactacacataagtagtgggatcacagacagaaaacccactacaggaggcacagtgnnacggcgctgccgcaaanaagcggggncatcgcgcgtgagggatctgggtagatgggacagacaccacactagggccatcgacctctcccacanactcaattcgattgtatgcaacctactttctcaattgccccccaataactaacaccaatatcgctaaataaatactatcatcnaacacacacaggacaaccatcacagcccaaaaaaaacctattacgggagcctagggcgtgccggttttcttatgcaatngtcccacaagggcgagtgcggacggtgtggacggatcccgggatagttggtttgacagcctattcgcgagccatggaggacctctccatacactaaggaaatggaacaatatacgcttccgattatttataagatatttaaataacaacatataaaaaaaaaaacgnccttccccctcgaaacaaacaccacgcttcacaccgccagtcacaccaccgactgctccgcactccctntaaatagatatatcacttaattttatgccctttcacttcttttccccccaacctccctcctccccccccccgcttncctccttctnncctcactnnnccccacancaatcccagtccntnnncctntctcta

SEQ ID NO: 9975 - DNA, 887 bp, Homo sapiens
aattaattaaaattcccaaacaaacaacacaaaggaaaaagaagctgacaggtagacactggaacaagcttttctctagtaaacaagattatatacaactacatagctaatcccatatcatcactgatgaaaacagcgagcgggcttactttttacatacctgaattaagctctctattccactgttgagtttatcaaagtgtcaaacaaatcttaaaaaattaatcccaggctatactttctgagctaaaatccggttatttgttagtcattaggactttctttgcatctctctttcttcttctctgatgttgtacaataccatattcataaaaaaaccatcttgacccttatcaaggaaatacaatcgtaattaaattcttaaaaccttgatacatgcactccctgtcctcaacaatgtcactcctcagtcacttccctattttaggctaacataatcaatctctattactcaattatttcaattttacaccattgactgaataaagcaccataacctcactcaaatgccggacatatttgatatccacattctctttgcgataactgtataaaaataacctcgtaaacatatactccacaaatactgccaccgcccccccaaaaaggccactcacgcagttccataccccatacagtctagtcctgctcggcagcgttcccctaatcccgacactcagccgaaactccgccaaactccccaggaacactaatatatcattttttatccaaattgtacctaacaatatacataatatctccatcaatccttatacgataacgagtaacaattgataacatttatctctcacacacactatgacactatttataaaacacctattccagctcccatacataggatg

SEQ ID NO: 9976 - DNA, 1420 bp, Homo sapiens
  misc_feature (1)...(1420): n = A,T,C or G
tactattctgatgcatatatcgactcagtgcaacaccacatatcatctatctcgaacagcgatagactagatgatgtttcgtcgcacgtatgaataaccgantaggatagagaattctttcaatcttgctgaccaacgcattacctcggcagtacagatcggataataggactgcactcatcatcgattctcgagaaggagcanagctatntgctaatatacatggatctaatacgcgcagactatagttgttgacgatagttgagactgatcactntatctctcaagtatcgtatacatgtatgnatcgcnacatctcatagacgtcntcacgaatacnctgatctctatatgctatcagacgcacacatcgactgctaacactaanactnactagctcattatctcgcgagagacatagttnaccttacacgatctcgtgtcgatactatcgtggcacaactgaaacatgatgcgtacattccgactcacacatacatccataccntatgtcgacatgtgtacgcgcatacccggctctaacactgatagataagcgcatnctctcacccttntctgtcctcaaagttaaacaaatanacatatatcatatcaaactcgagcatcttatctatctggcacttctattcaagaatgtgagatcttctcgctacgacccgcctttacccttcgtagtctgacgtcgtatgaatgtcacatcgattccctagctcctacacctcgaatcactactgctcacctcacgatcatctatcctgttagatatgtggaagcgcgtaatacatctctcaacccacaacacggcatggttcattacggcctatcctcaccacacatactccgagcgtccactaactctcttattgacacactacacattgcttctcgtcaataactagccctatatcaacacgtcgctccgagtacactcgtatatataactgacctaatacgtgtcctcaggtagtgattcgtacatatcagctcctctagtccgctctcccttgttcgatgtcatttacacatccatctctcgcacacattacacactatatcagagttggtatctatatcatctcactctacgataccatatataatacaacgcaccactacacgcgtcgatcacgcacccactattangctctatacccattaanatccgcctatatgacttctgtatactcgagtctatacgncccgtctcataacaccgcgcatcctacttantatncttcgttctcactctcatcatctcatctaagaactgtactctctgcctccactcacttatcacatcaatctatcagtaatataacgatacacatgatacagtcttcgcagaacaagatatcgatatatgatactcgtcgctttcttagcaccactctcacacctt

SEQ ID NO: 9977 - DNA, 1447 bp, Homo sapiens
  misc_feature (1)...(1447): n = A,T,C or G
cagagtgtacacgcatcgtatagtcgacgagtctgcgtctcgatatctacgactctgtggagagcatataaagctaacgcatatcttcaacaacacatatgagacataccggcaacgatgcgcgcgtagtgagacgngcgttgtcatcgaggncgaagtagttcagtnacagtgtactgtcacgttnttcagtattgtggtgntagcggagatggtgctaggtgtggttgtatctatggtcgatagctactatcttnaagcactgcagtatagtgantcacgctcagagagtacgctcgataagtgtggtactaggatgagatgcttgtgtgatgtcgatcgtcggngctcgctctcgattgctgtatgctagagctataactgcacgtacatatatgtatatccgcgtcgcatgcagcaagacgtcaagttgtgagacacagtctgcgcgcggactcactgatatatctatataataggtattactgcgtggtganggtggtgtctttgtagctccgagtggcattatcttctgttgttcactgcgactgcgtcgcacacgcgcaanagtcgcatcaagtgcatgacgcacgatgatcgctctacctactaatttacctantataggtcattttacatagaacagtgtacatcatgattagacacgatactncaaaacatcaagataattcatatagtattgtgtagtatagtgtgctttctacgtatacatagagataaacacatgatgattggatcaagacgacaagtaaaaggctcagcccagtatctaagaaatagtcaataattaacgcgcaagtacggtgcatcattgttatttggttctactattcgtagcacttagtatatagtaagtagtgtatagatataatatgtggatatcatatagtagagtagtaggnggtgtgtagagaatatatagtnacttagtagcaaatgaaataatagaataaactgacacatgagtgggttatacatgttgaatagatgatacgaccacagctatttttgtgatgntgttttcgctccatcaacttgaatattataaactgtatgtcgacaacctcgcagaaaagtaatatatgaacaaaaaaaaacgataatccgtatatatcatatacatgcaccgcctctgcggcgttctcgtcggttgacgttatcaccgtagtatgtcgcgaggctgatttgtaggggagtgaagaggccttgctgtcgagggtatgcgacgcgtcgtgtcacgctcgggtcgggggcgcccggcgtgcggatgcagacgattgacactgcgcggggtccaatacgacggcgctcaggagaaagggaaacgttgggtctgcggaattccttcaaccattgagtcgttgctctatcgatcagtaactcctgttctctgtcgaggttggttgtacagtgtcgaggagaggcg

SEQ ID NO: 9978 - DNA, 894 bp, Homo sapiens
atagggtgatgaggatgtgagcagcgggagtgggtcgaaagaatgagtgcgggtgtacaagagggtgtgcagcggctgagtcccattccgctcagaagctatgggatccattgtcggtaagcaagggcgggaatctggggtgatgtgggcaattgacacagtgggggtccaggaatggtgaagtaaaaagcgccgagatgaggcaaaacgggcggcggggtttcggttagagcggctgtgaaaagagaggcaggtgagtcactctaagactgaaccgggtcctgagtaatgacggtccaagggagccactctggagtgcacaagcgctcttagtatggtagggaagaagaaggccatggggagagtatatgcgccgagtggggttatatctacattgatttttttttgggtatataaaggggccttccgagcagtccctgtcttatgttgacaggcggtggggagttcccatgcggttgatacgagggaagatggtaaaattgtctgacggtgtcatgcgaggctgtcccggggagccagtcaagtagctatgggttcgaggtaatacgagctcaaatatagagacggacagaataaaatggaatgactggtgtcaggaatttctggccccgggttcgggtatacgatcgaagtaagctaacactctgtttcgaggaatagcagttgttgcagtccataggaacaaaagagcaattgcgtaggtttttaggtgagagagaaaaattaaagctaaaattagctgcaagaatatattaataatcacctctgcaaaaattataagttgccaactggcaaagaaagtctaatgttaaaaacaactttgcctttgacacgttaatgaatggatttactttgctaagaaaaaaaaaaaaa

SEQ ID NO: 9979 - DNA, 906 bp, Homo sapiens
  misc_feature (1)...(906): n = A,T,C or G
cggaactatgagcaacagagcaggagatgggcttaataatacgagacgagggcgggggcggcggaaacatccattccatgggtcatcaccatactatcaacacccctacggcacggagggggggccagacgagangcgacgcgatgaggttagaccatagaagcgcggcgcggggaggagaggggaccggagggaacgctggggactgagaaagcgtacgacggcggggtgggggacacagtctccgggagggcggagggtgcaactctcgagggggaccgggacaacgaacggacctcatctagcagggctgggctcgccgacgacattgcgcggcgacatataggaggagtggacggcagcggggggacccacgaatcggacaagaacggcgagggacggcaggggaggaaagacggggggccgagcggacagaggagacaacggcgcgggccgagnagagacgaaacgacggtggccccgcgcgccgtgngcgccacgggaggcgcagcgagagcacatctccgggaagaagaggcggcacaccaaagtgcaatgtaactggagcaagcaaaaaaaactccgagcgacaagcggcatcanaactaaaaagatgtctttcaaacataaattctttcatttaccacattggccaaacccaagaatcatatacacagcgagataattaatatttcaatgcaagtcatataaacacgaatactctctctcatctgataacagatcaaatgcacaatgctcctttcacttaaactctgcactcttaaaacagaggtnagctatttcactgtatccanaacacgtggtacaaaaaagaatccatcattcattctaaaaattatcatnncctataccannnccccactaattnnnaactccnnncccctt

SEQ ID NO: 9980 - DNA, 1302 bp, Homo sapiens
  misc_feature (1)...(1302): n = A,T,C or G
aacatcaagacaaccatctatatcagcacccacacatcattatcaccaccacaaacttatatcttccttgannctcaggaaacannanagcaancaaatatttcgcaagcgcagtgcaagcactataagcaagngcatagtagngcaaacatacatcgaatngcacactatatccgtgaaatgaacgtatctcacaacaactgtctatcataatgatatgtcgtcacttcttgaacatatacctggcatctattcccaacaaatagtcgcactctctcgactttagcatctgcaatactacattgcaaacctcttccgcaaacaaactgtcatctcgatacattcgatcactcacgatccacatgatcactcgctgtatgtaataaactgaacatctagtcaacaacacatctcctcttctcaacactaacacaataaatatatacatcgcgaacatcatacctaggcactccaatcccggcccgcaaccgctactcaccgcacactgactcattcacttctattacgcatcgattaagaattacgatcgaataccctcctcctcatctgcaactaagcattacaactacctaacattctaccacactaacatcagatcacttctatacatcctacaacttcatcagcgcacgtaaattacccagtctctctccatcagcattccatctctcataatactaatacgaaatttaacaatgatttacaacttaattgcccccctacctactccccaacatatttccgccacaatatacactcaacatagctcgtctcttaaactaacaataagtctcctccaaccacaccaccgcccatatatatcatcacaaactacacactcacgcacctcactccctacactaatgcacacaccacacacacacaacaccactncactgcattctataaactactacaattatgctancataacccgcctcccaaccgaatcactgttgtatcaacgtctccttacattacctcncactcacaccccagcacacacactcacaccatatcaccaccnactacgcaacactatccacatactctcnactgtatactatacgatgcaccacttactacctctaccaaataaccccanacctacacttctantcctctgtatatcacctacacgctacatcttacctaacacatatcaccgtctcttattctatataacacgacatcncatacanttacacacatcaatagcagtatcacaacagatatatctataacaattactacacctcaatcactatacatcattcagtg

SEQ ID NO: 9981 - DNA, 913 bp, Homo sapiens
  misc_feature (1)...(913): n = A,T,C or G
cgtgtctggtgggcggagggtgtggtacgtgtatagagaatagcaggcagcagcgtaatactcaacaggggggcgtagagtganctcggcacatgtgtgtggcgagtctgtgngcggtttctgcttgaactgtggaatttgagcgtgagtggagtcggacggcatcatttgagaatgtggaggctcggagcgcgcggagtgggaagagaacagagtaagtacacagatcaacgggaacacgtgatactcttctccttncgctcggtgcccgccgttcggtcaccgatcatgagagtaacgaatatattttaaactgagntggtgagggtggatgtgaggcgaataagttgaggaggagcgggcgacggtggnactgggaagaggcagttgcgggcccggggcgcggggggnggccaggacgcgtcggtgtcgtggctaggctgatgcgagcgcgggccgtngagggggggggggggctggggcgtagggagtggggcactatggggggtcgtagtttgtgngctttgtattgttaattagtggggttttgaacatatctatccaaggaatagtnctcatgtggcctctgtgttgccgtttggtttaatntatataaataacattcagaaattcatcaaatnccttacagaattnnaaaacttataaatatttaacttatattttatagtttcgttacaatactaatcctacacataaatgagccaccatactccctactcacaaanatccaattctcatttcctcnaacattncctcatcttcttcctnctttatcttcccttccttcctncctcctttnntcttttcctcacaaacttttnctncnagttcccttaaccctcctnncatactccnnnctcactctcctcncctcctnnnncctttccccttt

SEQ ID NO: 9982 - DNA, 999 bp, Homo sapiens
  misc_feature (1)...(999): n = A,T,C or G
cgcgtattatcatccttcgcaccagtgataccaccacacaaggattttgggggaaccgcaaaggacccttgtccggttgccgctattacatcttgaacttacgtctaggttccatgggagcaacaacagattcaactgtactagaggctaatgcagtttctcctgggaatccacgacagttaagactcacgatcgcaagaagaacatctatgaaaatacatgaccctttgcttaagtggattgactcctttcgctgaacccagatattcatcaagaatgcaattaagactacctgtgaattaaatgattgaactgatgactttcctgacgaaagctttactcactcgatacctgttactgatgaatttcgctttaccattattatgccccccccctctcccatgcattcgcccctaatcgcccagaccctttcgcaggcggaccgccctacacctggtactgcataacattcgtgccttcctccaaatatccatgtcccgctgtgcttgatccaataacacataccttacccttttagctccgccctcactcagccctctaaacaatgttgtgtagagacagatcacagttaattcatcgtactatctgtagtttactcatagctggttgtgctggccccgccccgatcctgtccccggctaccctcctcttacatctacagccccccacatctcctaccccctatgtttgtcttaccccatttcccgttgtgattatattaatntatagataccccacactcagcgcctctcatcccctcatgttgcccccctcctcaatctcacgactgctgcctctgtaagtaatgtactcatactcccgtttgatatttcgatagtcagaatgtaggtcgtcgtccggtggaccgcttatgtggaagtccgaactccctgatgatcgccccactaatcttcgcacctctgttcgctcttgcctgagagtgtctaccaggcgcgctctgttcgttattctctcgtg

SEQ ID NO: 9983 - DNA, 1881 bp, Homo sapiens
  misc_feature (1)...(1881): n = A,T,C or G
catacgcaccaataactgcgtggatgtagatgatgagtgtgaggagcatgangaggagtagatagatcgaacaggagatcatgcatcgtacggtggagcgtgagatatgacgtgtgtaatgcttanggtgcgcgtagatggtacagaggcgagatatcgagagacgggagagcgagagtgtgaaggacaatagatggagtgtnggctagactgacataggtggagacgtgtgagagacgagacggtagtgcgtgacgngtacacgcttagtgcgagcgtgagatgagagagcgtagtagcacacgtcacgtcgcgtgtgctatgacacgcgcgagagatagtggagtatgcagagcgatatgtgtggcgtgcgtgtgtagatgatttttgaatgtgtcgtacgagtagatggatgagagctgatacgatgntgatcctcgacgtaaagtgtctatactatatgtgcttagangatgacagtgatgactagactatatagatgacagtgacgaagagcgagcgtctgcgagctagcgcacactgaccgcaacggcgctagcagtanaagtntacaccagntgtgtgtgncatgagtgacagtcatacatgagtgcgacgtgtgntcgatagcactctgctantagctcatatattactntctctctcgtcattcagtaacntgcgaccacacactcatgctatctactataataaatatctattataatagtangtagatnactcatanntcactaatatatngtacacatcacatagcgcactnacgtctctagtcagntcagcgctacntcananactgccgtatagtanttatagataatanagtctccgtatntntcanacatatagctcgcggtatctctgcgtctgantctaggggatntacgtncactcantnanctatactgananaccgatactcanaggtatatccagctaagatcagatncgagatgntagcgatatcgcattactaaccgatcagttataatgtttcaatatactagtntagcgtatactatatacgtagntactgagcatgcgtgtacangaanataatattggancgacagtcatagatgacgatntgagtacgtacaatcaggagcatnctctacatacatagctgataggatagggatatcgagnagaagtgantagtgatacagagatntgtanctatgtagacgaacaatgtgagtagnataatctatatagntnaagagcggtgtatgtgtatntanttatgcaactcagagtatatagtcacacgtagagacaacataatgtaatgctatatagatatgcgatgagagagttaaagctgtactnttactacagaatcgaatcacncgaacaactacacgcctcacatataccantntactaatactgatanagtcatatacagaatacnccctcgacctcacatatacanantacacttagtgatncgtcattatcgtnatncagtgtctcgcgtagtatccacatcacagacgtcgagtcttgtcgagctttcgttacgcatctgntcatatcntgtgacgcgcctactcgaggtacagggtgntgtggcgacgctgtcagggcagtctgtgccgggtcgctcggtgcgctcggcgatgtacgcgtatatagtatagccatctcgagagacgctgctgcgaggtgctgtgatgcgtcctgtggttgtggtggtgaagtctgccgatgcgagtgagagggtagctgagttggtggtgagcgactcaggtggtcggatgtgacgagagagtatcgtcacggagccacgacgaatcggagtcgagcggatggagcagcgagccgatanttgctatgggcacaagcgagtgcatt

SEQ ID NO: 9984 - DNA, 1214 bp, Homo sapiens
  misc_feature (1)...(1214): n = A,T,C or G
cgtgaggctgttgcgcgcatcctctcttgccgcgcgcgtctttgccactctctccgcccggcgcagatgcggtcgagtatgtatttctattagtgctcgcgtgatttatggctacaggtgggtcgccgactgtatacgcgcagacggggacagcgcggaccgcgcgctggcgccgagcggcggcggcgcccaagccgtcgtcggctagcgtgacttcgcggcacacatcgttgactttgatattatccggtcgcgtctgcgctccacgatatctactggctgcctgacgccgacgtcgccgtgcgttgtccttccgcttccctctcttgntctgtccgtgttgttcgcttgctagcccgtgtgtcgagcgcgctaccggcgggcgtgtcttggtttacagcttttcttctccacatcatattgatctggcgtcgcgttgtgcggcggcgggttcgttcgtgtgttgctttctctccgtctgtgtgggcggtcgctcactcctagtggtgtcgccgtgactctacgaccgtccgcggcttcctcgttacgctcggcgccttacagctcgcgctcngctctctgtgtcatcttcaggggtcgtcggtcgtgtgnttacagctggttgctcgtgcgtgggtgtatcgtggcggtcgacctcggtcttcgtgcagtcgctggagcgtagtcgctgngtnnatatcaacgcgccgcagatacgtcttgaatgtccgagctgtcgcgttaatagatgactgcagagncagcgtgccggtgcngtgagacgagatagggatgttgttgtcactgtgttgccgctccgcgcttcttgtgtgtagaagaagatagcagtgcttcgggggcggccgggcactcactgcgcacactctgcgtggttttcgacatgtggcgtgtagtgtggcacgccgtacctgtggcctgttcgcgctgccgacgcacgcgtgttttgttatgagccgtcttctctgttgatagtattatcatctctcatccactcgcacattcactttcatcgtttctgtgcgtatggcggctgacgttgtctgnagttcgtaaggtctgcgtgtgccgcttgttttgttgcatttttgatgtttatggttctcttcccgcttaggnntgcgtgttttagttntcctgttacgacttttttctcttttcgtttcgtcattttgctcacagcctctcctactctt

SEQ ID NO: 9985 - DNA, 1003 bp, Homo sapiens
  misc_feature (1)...(1003): n = A,T,C or G
tttgtgctttcttttggttgtggtggtctccgggccccgccggggcgggcgcgggngcggccccctcggncggggcccccctgccctggggtctctcgcgcgccgcggccggcgcgcgggcggggcctgttcttttgnccgnccccggcccgggcggccgccgcgcgggccggcgccggccggccttgcngcgctgggngctggccctcctggccgccgcgccctctggggccggcccgccgcccncgcgcgcccgccccnccccccccgccggcgcctcgcccgcggngtgggcgggcggccccccgcgcccgggggcttccggggcgccgcccggccgcgcgcgggctgggcggcctcgccccgccggcgccccccgcccgcggcctctgcgcggccgccggccccggcgcggcgggcgcggggggcggggccccgcgcggnccccgcgcgngcccgccncgccnnccgccggggggcgggcgcggcggccggcgcgcgcccgccccgccgcgggcggcgcggggggcgcgcgggcgcggggcgngccgggggcccgggcgcccgccctgnngctcgccgccccggccgcgcccgcgccnggccgggggnccgcccgggggcgcgcgccgggcgccgcgcccggggcggcggcnccccggacaaaaaaaacgttccttttctctttctttttgtgctccccctnnngccccgcgcccgcccccccnncgncgcgcgggccccggccggcgcccggncgggcccgcgcgcgccccccgccccgngcgggggngccgccgccgcccgggcccgcngggggccccgnnnncccncccccnnnggggttccccccccccccaaaaaaccncccccnnnnnnnccncnnnnnnnncncggcggnnnnngtnnnnnncnnaaaaggnnttggcggggnagtnnnccancaaacnnntttttttttttattttaaacgccccccccnncccnccnnncccccnttacc

SEQ ID NO: 9986 - DNA, 2251 bp, Homo sapiens
  misc_feature (1)...(2251): n = A,T,C or G
acaagagacatcngctaggatcagggatgntgtnggtttcgtcgggcgcngcagtgcncgngtctcnncatctggagcaagtcnganggtagcagaggagcgnnagganagagtctgcaggatagggaagtcgcgcgntcgngcagcgagncaggtgagnatcngtgtgtntantagngncatgnctttcngnacnctcgctcagcgtcgcgcgtacnctnactacanatgcactctgngcgaccntcgacacatcctgtctgctangatcagaacggcgctgcgccnacgctgcgcaccctgcgtgtgncggnttntatatgatcgattgtgtgtntcagntntagtgcgtggagcggtgtgtcggttcgccgactncgtcgagtagcacgcaagctcgtgttnatgctgactcaagcgctntcggctacaatacgcatnacanatactactagcgcgcacgtacntaggnatggacatacgtgtgctatgcagtagcgagacgtgtgantcgntctggagcagaacgatagccggagagcgtgcgtgcagacgncgctacagacggtgtgctggctggcacgggatcgagctgcacgacgagcgagcagcgacacgancatttgtagcgctataccaatngtcccntcgtcgtcgccgacgctgcctactatcgatnctagtngtattantatcgagacgacangcgcgangngacaggtacgtcgtngantnatatgaacgnatgctgtgcatctgcgatagtcgatcagctgctgtcgacgctgaanactagtatatcnacagctagtcggcangcgcatcaggcggagtatgctttagtagtcgagtcanctggtagcagatactcnatntaggtaggtatgtcgnagtatgntnctgagtnatagtacacntcagnctgctgcttgtnatnctacgcgggatttcgatacagcnccncgcgtcgtagttgngtgctgtaccatgtntggtgctntcgtnntcgcagatcngcgaancgagcgagcncacagcncagcgtcgcganancaatcagagagtacttgacgcgngcagcgagtngccgncngcgcgtcgtcacnaagttgtcnctngctatcatcgtatgtcgacgcaaccnatagactcgtgctcntagtgcgatgatggtagatcgtgtgcgcgtcaactgcgcgnacnacncnntagtcacngacggcgaagtngaactgattganacgatcgganacgtgcggctgatcgtcaganntatnactgtatatcagcgccagctgagtgttagcgnccgnagatanagatatanagagactcgcancgtgcgnacggncgacgagcagagnatnattagtcttcacatgngnatctatcctgcgcacggttatactgcgtcgtatcgctacgcgctctatgcgccagtcgcgtcctgntcgatatggcgcgnattntcagatgaggagcnagtnagcgagtnacgcanagctcnagacncatntanatganagcgtacngngtacgcgcancggctgatgctgcgngcgacnagagctacgtcgcgtgtgcactcgcgtttacagacacatctgagtagtcggtcgacatnctgtctacgtcgcgctgcgcggtntcgtgctacanagcgtctgtnatcatctgaatatgatgagagnctgaatnctatgaccntagancactcgncggtcgagcgcggtacgncgtcaggctcgagtgngcggacgngcgacgagatctcgcatctgnagtcngcgctacgtcgctatgcgantagcgttcatcagctagtgtacggtatgcttgtatcgtcggcacatactgcgtgcgagcgtaccncttcagtatatgtgacgtnacgtgtatccgtgtggctgcgtctgtgtctctacgtgtgtgacatgagcagtgctgcattgtggttgataggcngcgtggcgacgatactctgtcgtccatggagagagcggacgcagtggcgatcagtgtgctaccgcggtacgtcgcggtgctatgtatgttggcggtacgatcgcatattatgttttcgtcgcgcncncgctncgagtgntagagatcagttgttgatgcntgtntgatgtcgtgtgagtcgcgagacgagtaggcgtgacattcgcatatcgcgccgtcganatgtgacattcgttgctgtgacagcggtctgtgcgcncacgtatatgtagtgatncgtgcggcg

SEQ ID NO: 9987 - DNA, 1042 bp, Homo sapiens
  misc_feature (1)...(1042): n = A,T,C or G
gggggaacagagggggccgcgcgcgggggaggggccgagaaaggagaaaggaatcggtagaaacaaggctttttggganaaccnaggggagaaggaccctaganggganangaccngggggcgagnngnggcgcgggcagccgcgcgcccgcggaggtcgggaggcgcgggaggagcagagaacgcaaagcgccgccgccccccgagagagaagaagaaggcaaggccgcgaggaaggcgcggccgggngagaaaccagcaccgaagcaacgccgcgccgagccaggcngcgaggaaagagcgaggacccgcgcccgcggacgcgcgcaaacaaagacaagagagcagagaaagagaagacaaatctttttaaagaaaaggagagagaaangggcgcgcgagaggaggacccagacgccccagcccgcaagaggacacgcccgggaaacgcgagaccggcccgccgacaacagaccgccaacacagcgaaaccgcgaaagaaggaacgcggacgacgcggaaagaagagaaggacgagaaggggacaagaaacagacagacagcgcgaaagcggagaangaagaggcagcggcgggaggagagggaaagaagaaaaggcgaaaggaaaggagcggacgaagacaagcgcggccacagaaagagacgggaggcgaacgagagagaaaaggcgaggggggcgcgaaagagacacggagaggggcgaaagaaaaggaaaagggcgaagcgagcgcaggggcgggaaaacacaaggaaaggaaggagcgcagagagaggaaggcggccggcgaagagagcgcggggaccgcgggacgggaagaagagaagagaggcgaaagcgggaaggacggggacagaagcgcgcggcgcaggagaaacgacagaggcgaaaccgacgcgggacagaacgcaaaaggaacgggacggcggagaagccaaaaaacgcgcgagaaaaagcggggaacaaagcaacgaaagaagcggagaagaagcagaaggacgcaagcaggacaacgagagaaaa

SEQ ID NO: 9988 - DNA, 615 bp, Homo sapiens
gtagtcctggcactatgccctatgtagcattcagtgggaagaaacagaagaactgaaatctcagcagaagaattaaaaacaaagcaatcaatctctgcactgtcttttaccacttctgtagagcttaaagatttttatccgactaaaactttgagatatttgaaaagtttatttcaaccaaggtctgcaaagtttgcctcatcataaataggtttcttacatttccctatccccttgaataactaaaaatatattttaacagtgtatctcaagtttttcttctttcattgtgcacaatcagtcattgttgagggacctgtacttttgtggtaacacatggggtgttatttggaataaaatacaaagagaatataatcaagaaacaatcttgtttcttgattatcttgtttcttgatatattatgtgaaactaatatgtgtataagagatatacacatattagttgcttaagagaatgtagttttatctacccctcaccccaacctcaaaaatagcaacatggaatccaattctggatacttgcctttgctcaacattttgtatttatttttaaggacaaaataaaatttacttgcagccttgaaaaaaaaaaaaa

SEQ ID NO: 9989 - DNA, 850 bp, Homo sapiens
aaaaatacaaaatgaaaaaataaaataaccaaaaacaggtttcagactgcatggtagtgcctctatgcttaatgtatggaagaaattctgcctctgcccatatacaactaaagaggtccttgtatcaagaggagcatgactgggctgaatgatgatagtcagctactaaacatacttatattactatatgtatacagacagacatatatgtcattagtcctgcactgtgagggtagacattttgttaagaaacaattaaaacatgtctatgggtatagataataattactcactccgctcccacctacctgtcattcagcttctacagctgggaacatatgatccaaatgagttaatctataactgttacatgaccatccgccatgttatttaaaataaaaacttggatgtacatacgaattaatatataactatgccggtgcacatttcttaaataggaacttttttaaaaaagatgtgtaatagacaggatcggatagtcatattacgtccaatatgctgttttaaaaaaattaactacttcattcaattatctcaatttcaattattaaaatatcttattaagccaaaatgggtgccccactggcaccatatatatttaacaaaactttggtgaaacgcatactccatttaacccttgcctattgcaacacattttaaggtaactgaaatttatttaccttaaataacataaaaaatacaggggtcatttctccttaatcattgtacctttttcacccatttacttttaatgcgggttacaatagtactacgttactaatcctcgacttcgcttgtatgagttctgtaagcggcttctactcctccg

SEQ ID NO: 9990 - DNA, 813 bp, Homo sapiens
  misc_feature (1)...(813): n = A,T,C or G
ttttctttctttctaagtaggtagctcatattgttgatagtggggagaacgatgtagatcaattaggagtatcagctgtttcgatacctctctacactatccgcacgnatgtccgtgcggattggggctctaattnatctgtcttggctgtccatcgtgacctgtcgcgcattcgtgtcctgannngagtcatacctgtatcttaacgtatggggactgttccctctctctttgcctccacgacggacggctaggggaagcgcattggaagacgaccgccagcactacgaancttctggaagcattggggctcattgtggcggtgnctggcctcccgggacactgtcgtgccgcattgtctttcgcgcgggggggcctgagtgggcgggtgcggggcgtctgcccgcgtgcgttcggggaggccgtagggctacatgcttttgataggagggctgctaggcagtgagggcgggcctattgtttaaccctcgggaaagcctcgggcctgcccatctccagcgatattgaaaccgaccccattttttttgtattnggataaaaaaaatgttttttaaatattatnactttattttgaaacaaacactcaactcaaaactcttacctaatttatatgattcatcctgtctcttgtaggnntccccaccggcgtttncgtctgttcaggccattccagtagctttaaaaggccgttctttttctncttttcccccgccgnnggttcccccaaaatctgccttaggtctccaaantccttttttttttattttccncccnnccncttttttttttctt

SEQ ID NO: 9991 - DNA, 947 bp, Homo sapiens
  misc_feature (1)...(947): n = A,T,C or G
gctggtgcatgaagcactactggtcatctggcagatgaaactgagctcaaatgaagaaaatcatgatcaagctgagaaaagctatgattagatctgcaggaagctgcaacacagaaattcgaattcggagttctgacagacactgagctctgggtgcgctgcggattgctgggcgccctggctcctcccctcgtcgacatctctcggggagcgccgggcgggcacccgccccgcccaccgccggcggagccccgggcccgccagcgatcccagccgcagccccccgcccgcacgtcgttacgcccccgcggccgcccgcccccctgtccattcccccgcaaacgccttcgaatctccgcacccccctcgccgggcgcggccgcgcgtcgcgcgggcgcccctatggcccaccgcgctcccgctgagcgagggaggccagcggaggcgggcgtctctccgagcaggccccgaccgccgtcgagcgcgcgcgcagctgcgccggagcccatagctggccacggcacggcgccgtgggggggcgcgccgctcccccgtcaaacgagcccgcgcgtagcgctggggcgcggcgcgggcccaccccccctgggtgggtcgcccgggggccctgccgtgtggctgtccggcggcaccacgaggaggccccggcgggcctcaacgcagcccacggtccagcgcgcggccgctcccccgccggccgacggcagcagccccacccgggcaccggaggtagcgcgcgccgcgcgaggcggaataccgacggcgctcctgacctcgtccgcgccgggctcgcattcgcagtcgatcaaccgcggcnggggggcgcgcgccccctggcaccgcggagtattccaatcccaacccggctctcggcccggcggcggtgccgcgctgcgtcactcgcagccttctccctcccgccgcgtccc

SEQ ID NO: 9992 - DNA, 970 bp, Homo sapiens
  misc_feature (1)...(970): n = A,T,C or G
tgttttttgtaccgctttgacgctgtgtgagggggaggagaggggggtacttgtgggagtggtgtggcggggagaaggcctgtatagtcgaggactcgaatgggcaaccttgcgcctttgtaggtgacatgtcttagttctgttgtggactctggatgtcgtagtgagcattagtgtggaagatagtntgtattggttgcgacaatgggtaggacaaaccaaggggctatgctgttatggtgtgnatgggtgaaattcgtacggccgtcggagtggattacatggatcggccatcatntaatgaggtgnagggtagactcaaggccgtgcctggtgcggtgtgntacttgaacgtggcgcgcgtacgcgcttggagggacaagtctagtgaatggtggctgcaatggctgtgtgtcacgggggaggttgccgggctcgtgtttggcctatgggtcgatcggcgtgggggctggggcttgcttgcaatctgtaaagaataattctttgagttctatataccttctatttgtactgcgaatcctaccccctgctgcccccttaacttaaattcttaattgggagcctatctgcgactgtatatgttgtattaaaataaaaattcctcagtcccagactaactactgaagaggtagatatttaataatgcgtgacaaaaaggcataaaattatttgattttcttcttactttacgggattattataatattaaatagaacttatgnatctagcatntccttgacagtngatgttgaaaaagaacgcataaatccttgttnccacccttattcttnctcttcctccttctttnttaccaaaccnncctcattttcctctccnncattctncttggctctcccctcnaaaacggctttntttgttcctttntaaaattntnnnnattntaaatataataaaaaanttttattttatatatataaaatagcttgca

SEQ ID NO: 9993 - DNA, 165 bp, Homo sapiens
ctgaacatcaaatagcaaatgaatagcatcataagaagtcaagagaaagaccatggaagaaagaagaaactttaacagcgctgttttgagtgatctttgaacaaggagctctaaattatcattttgcactggctctgtcccagctcatgtttgttgagtgaataa

SEQ ID NO: 9994 - DNA, 919 bp, Homo sapiens
  misc_feature (1)...(919): n = A,T,C or G
aaaagggttgccgaggngnnnnnnnngnnnnnnttccgcaaacattttccctttggagctggggggggctccttacacatattcaaaccacctttccgggttgggcgtgtcatataaacccctactaatccactaaattttttctcctttaaaattacttcttcaaaaataaaaccttgccctcttgggcttaggggggggctttgcggccgttccttttaggggggggggaattcataatccccggggggggggctcccttcccctgggggcccttcaaaataaaaaaaaagctggtttcanccttcccttcaggagggcgggtaattgccgggttatccccacaaaaattcgggggggatttacccgaagggaaaaaaacccttggtgagcccacaaaggggccctgccaaagagggggccatgaagccctctggaaaaggggggcgcggtgttgtggggcgttgttttccctaagggcctccccgccccccttggacgaggcttaagaaaaagattcgagccctcaagtggaaagggggggcgagaagccccgggggggggtttaaagagtccccgggcggttcccccctgagaacctcccttcgggggcctttctgggtgcacaccctctggggttaccgggagaccttgcgcgggtgtgttgctttagggggggcggggggggctttgtatatagcccgccctgggggtggttccaggctggggaaggaggtcgttcctcacaagcgggagtgtgggccgccgacccccgcggagggcgccgagcggtggtcccctgaaagaggggatctttgtggtggaggggccgggccggggggagaccgccgtgggtgggccgttgccgcgggcgcgtttgggcgacggcagaatgtgatggcggtgtgtggggcgcggg

SEQ ID NO: 9995 - DNA, 140 bp, Homo sapiens
gttcagacataccatgagaaacttccagacttaaaggagaaactctgaagcataaacctggtgtgatttctgtggctaatagcgggggtgtaattttatggaaaagttgtaaaaataaaagagtggcctcgttggcctca

SEQ ID NO: 9996 - DNA, 247 bp, Homo sapiens
tagagaaatgcatgcccctgctaccctggctgggagcctctttcctacctaactgtgcacccgcagcacctgttacactgccttgggcaacagcagcccaagaaagctatggcaatgacaccaaggatgttctacataaaaaggcactggcctaaccctacctgctcatggtagaaaaagagaaaattatgtatgcttccctttagaaaatctatgtaataataaactagtggcctggttggcctca

SEQ ID NO: 9997 - DNA, 163 bp, Homo sapiens
agaatctatgtacagtgattgatttactgcatatgagcagaatgaacctggacctggccagtatcattaaggtcagcagaaccgggtcagctagcagtagagttaggagttctcttaaagaaagagctcatggctctgatagaattaatcttctaatgaacta

SEQ ID NO: 9998 - DNA, 241 bp, Homo sapiens
  misc_feature (1)...(241): n = A,T,C or G
taaatagactaaagaagcggtaaatagggaggaagggagaggggcttattagaaaccaggatcatgttatngagaagaactgaacacaaagaagaggaggagggaaatgggaacaacaacagagaaaggggggaattaaaaaatcaaactattaaaattgtaacgtacaacattaatacacaaaaatctattgtttttgtatatatcatccagcaattaataattggaatttaaaataaaa

SEQ ID NO: 9999 - DNA, 270 bp, Homo sapiens
cctaggtcctcttttctgaaacatctttcttcagtaaaaggagcagagttccttggagaagcagttgattccagggcaggggcgggagagctaccaggtattggctccaagagcacttcctaataaacaccctatatgctgatctccatctcagagtctcatccctggtggcctcacaccgtgacagtcatctttagttctgatgttagtctaacatttgatctgttctgatctcaagtgctgaataaagcaatggcctcgttggcctca

SEQ ID NO: 10000 - DNA, 439 bp, Homo sapiens
  misc_feature (1)...(439): n = A,T,C or G
atcacaatcttcttgcttttactacgggaaaggacaaaagattctaagatacacactaggcactgttggatgagaaccgtgggggaatgcctgtaatgatgaaaacctgaatggctcaaaagaagtgccatctagtgatgatgaggcttctgctgactcgcancattctgactcatgcaaataagaacatataggttttaacaccgcatggtctgaacttggagaactgctggttaacttgagtacatactgggaaaacaaatagaattttcgctagaaaagctatttacacgcatttaggagaaaataaagctgtggtacataagagacatgcggaggatcttttgtgcccgtatcctttagctgagggagaattaatgataccttgctcactgactctttcttctacgatgcttagatggtttgattgtactacctt

SEQ ID NO: 10001 - DNA, 1514 bp, Homo sapiens
  misc_feature (1)...(1514): n = A,T,C or G
agtagaagagagagaggagaggtgggtgggggtggnggtgtaaggggtgagggagcgtgagagagcgaggaggggtataggtggaggtgnatgcagagatggataggatagaagaggatgagttttgaagagaagagggagtagaggaacgaagaaaagagatttgacaaagggagtgaagaaaagcgaaggaggtgtgaagagagttggtaaggtgaggatgagtgaggagagaaagaagagaattttaagagagaggaggagcggggagacaaatatacganagtatagacgatgccacagtgacgcaagccgacgagagcagcaggcagcagcggcggacagacaggaacgcggcggaccgacgcacacaaagncgacgagcgagaggacagacgcgacgacgcngctagnaccagagcggcgcggcgaacgccagcacaatagaatacaagaangacagccagcaatgagagcgtgggctgcnaggtcagtagcnggagcagggagagatncgcgcanggtagcgcgagcgcangacgccaganagacatagagagtagacagagtgcagcgacatcagtaggcgccgactaccgcgcgcacgagcgaacggacncagcgcaagcggcgccccagagagaagcagcgcgagccgcatgcagaacgagcngcgcgggcgagcagccgcgaacggcggcgangcacgcagncgcgccagcacgacgncgacagccncacgcggcggtgcagacgcgcgcgccaccgccgccgaggacacaccaaggcgcacgccacacgcgcgcaccgaaccacacacctcaacagcgcgcctccccgcaccgcccacgacacctaacgacacgaccaacacgacgccccaccagcagaccatcacncgcgccgagcacacatgcagagacgcgcgacagcgcggcacgaagcacttatcgaggggggcggagcgcaccgagtccgcgcaagagcctgcggaccggccggcgcgactgacngagaatancgcagtgcgagcagagtcncgcagaagaggcgaacgcgggaccgcgatcacacctgcggaagccgcgcgcgcgtcgcgcgacgcgacggagtcgacggtgctgacacacacagcgatgnacgtntacactgcgcagtagcgacacgcggcaccacgacgngncgagcggcgagagcgacgcggcagcgccgcggccagcccaacagtcgcaaagcttgcagcgcacgacgaccgctcgcgcacgacgacgcacggcgcgaggcgcagatagcacggaactagagaagctaatgccctcgagcagnactagaagagtgaanacgtgcgtgtaaacgacaagacgacgagaatggagtaggagagacgcgcatgacacgcacactggcggctacacgacaacgcgcatcgacactacgcgagagcgtgtcatgcgcccagcangagcgatgacgcagcaagcgcgaggagtgaaggcagagaaagtaggagatgt

SEQ ID NO: 10002 - DNA, 1169 bp, Homo sapiens
  misc_feature (1)...(1169): n = A,T,C or G
gcggggtgtgggtgggcgggcgtgtgtggcgtggtggtgntgtgcgcgtagcgtgttgatgttgtggtggtgcgttgcgagttggtgtgggtgcggggtctgggtgagtgtgtgggggggggggatggagtgcgcctgtttctcccgtgctatgtctggccgtgcgtttccgccgcttttatctctctgcttagccggtgtgagggccgcgtacgcgtcgtggctgtgttggctgtgtgttctgcttcgtggtgctttgcngncgtgtccgctgcgcgtttcgttgctaccctcgttcgtgcttggtggggggatctgtgtgtattcttgaccttctggggttggtggtggggcgtgggagctgcggcgtgcgggtggggtgggtgcgcggggggggtgctgcgtcgcggccttgtgtgcgccggtgggcgtggggtggcttccgtgtgggggttgttggtggtgtgcgggtggggtgctattggggggtctgggttctttccgttggcggtncttctgcgggtctgggttgcgggttgtggccgatcctcgtgtgtgtgtncttctctgctgtctcttctctgtcttctgtatcttaccactctccgtctctctcaccctgtctntttctaggcgttctggtgtcggcgttcgtgcctttgttgtntgtttggtctctgtgcgggtgtggtggtggnngcctgctggcggggcgttcgggttcgggtttcgctgtttggggggctctctctctctctaaacctttttgttnctctctggctgtgctantcttttcattctccgctccttctttnttctattttgttcgtttcttngtcttcctcttccttcttcttctcctacnccctctctcctttctttcttccgttccttnccttccattaatctttatttanctctttccttccccctcttnntcttcctttctttttnttnnncttttcctctcccttctctttctaaaattctttctncctttcttttttttttttcttctntccccctncgttttctccccttatcaacttcttcttttctttttttttctctttttaaannttttttttttttttttgtttgaaataaaattattagtatantttttgtttatttttattannttttggtcttctatcttctttttctcc

SEQ ID NO: 10003 - DNA, 894 bp, Homo sapiens
  misc_feature (1)...(894): n = A,T,C or G
cataagcgaatcgagtgttctgttatatgacaaaacaacaaaaaaaggattttgattaggcacctgatgggactgttatnaatgggaacacggtggaatgcctttagtgaggaaaacctgtattgctcataagaaatgccatctagagaagatgaggctactgctgactctcaacattctactcctccaaaaaagaagagagaggtagaagaccctatggactttccttcagaaccgctaagacatttgagacatgctgagtttagtaatgaaactcttgcttgctttgctattaacaccacaaaggagaaagctgctctgctatacaagaaacttatggaaagatattctgtaaactttataagcaggcctaacagtaataaaaataacatactgggtacgtcttactacacataggcatataatgtactgctaataagttattacgctcgaaaaatagggaacctgtaatttttttaaatataacaacgggcataatatggaataatataacgaataacatattagaatataagaaaaaatatagccaaacaaattatgttaatggtttatatattattaaaacaactgaaagacacattaccggtgataacatttataaaaataaaaaaaagtatagcaaagtggctgattggtttatttgcgaatcgtttctcgtatgcgtgatgacacgagtatgttataaaaatcagaaattattgaatgtgatgttcgataaacatcatcttgataagtatgatatacatatgagccagctttagtcaactgtagctttaaactatacagaacttctaaataacatataaatatctctgagtaatagccacgatcacatatacatacactaattgctaggaataatacgaccgaaat

SEQ ID NO: 10004 - DNA, 862 bp, Homo sapiens
  misc_feature (1)...(862): n = A,T,C or G
gtggaaggagaagggaagggaagggagggaaggagggngggggagagaggaggtgggagggnnggagagtgacgaggatctttgagagcacggcttgagctccatcactaccgactatcgggagggacagactttctactatggaggaagagtaccaccaggagtacctgagcaggaacccaattggctactgaggcctnagggggctccggcgtgtgctgctnagtgggtattaaaaaatgattgctcccgacatggttggggttttgaggttacagtaaaaatgcttnttacattttgtggtaatggttgtgtgatctgacaatcgcatggattgnntgtgcacaaagtnctaaacgaatttatactcatccggattacccatatatancctatgtaagtgtccacgcgctagtttaatacattgggacttttctactatttaatcgctagcgttcaatagacctgtaccaggtttgtcaatttatcggcccggcctgagagaaagntcgaggtttgtattttgtatgttattatggttaaattgtattntatgttgttntaagagctctttgtgaaggtataggaaatatagatgngcaatgatgcatgtagtcacctcaattactacgctcattcattctattcttcactctattttctattcatcagcgcgatcggatattcgnnnccgaaccncctgaccccattaatatgtgaccagtcccaacttccaatacgnacagataactccgcnacaattatcaagttagatttgncccccatgccgcttgatatttgcccccatctagtncccccagctctttatacgttacatcttctgtttccttcccctttctag

SEQ ID NO: 10005 - DNA, 352 bp, Homo sapiens
gtgataaattttattatttactgtggaaaagggaaagagaatcagagcaacgtgttcttccttttaattggtaaaaggagagagatgaagagtgaaagtttgctctggattacctgcttgggtgaacccataatctaagataaattcctctcaactctttgtgttaggtgccaaaaggaataagagcaattcagaggaggaccagtaatagcagaatctagacaaagatccatcattaaattataagctaatctgtatatagagatgatatattccttttattttaatcattgatatggactaacatttaatttcttaaacattaaacattcaagaatatgttcatttgaat

SEQ ID NO: 10006 - DNA, 296 bp, Homo sapiens
ctagatctcacccagtacaagaaattactagcctcagactatttccgaagaccctgatattcaagtcgcatgcacaaagtcgcaccgtgcgagatctgcgatgtgctcatctcgctctcatcagtttgcgctgaaacatcctgccagatagcaactgtggtatccaattagccataagttttccactcgtatattgacatcactaatcaaatctcttaaactgaactgtatcctttgaattataaagacagataaactctacatgaataaatgcatggcctcgctgacctaataga

SEQ ID NO: 10007 - DNA, 886 bp, Homo sapiens
  misc_feature (1)...(886): n = A,T,C or G
agggnaaaaaagggaaagnnagganaggnagaggaagnnagaannaanagaggnnggaaggagnnnggttggagtcgaggcagccgtggcgctaactctgctggcacagccacatggcagagactgtttggaaaaaccacagggagagggtgaagccttgagatcacatggtaagagaactgaggaattgagctgacaatgagaattgacgtcccagcctatggtcccagttgagtgatacacacagtatacacatgtttgaactgtctttataataaaagtcaagtggtggattaacaggtgtaaatggagatatgtggaaaactagtcagtcgatggctagccgcgggctgtaaaaactatggacagtcatggccaagaattacaacatattgcttcccatgctgtgttccccgcctgtgtaagtccaccccgccttcaagccgctaatgaggatgggggtgtaccctttcccattctcaccaggttgcacgccccagcttcactctcttcttgctcggggcggtgtgggggtagggcatttcnttgagtgtagcttactatctntaagctagtcccagaggcgatgcaaagatgcaatagcgctagattcagaccccacccgtggcactattagtccatcgcggtagacggccgcgtgggggtgagtccctccccgcagtcgttttgcagctacgtttcttcatgtagcngcatgcttctatattacccacttttatacttcatatcccgaagtaatggaggtaagagcggggaggncaataggaagtggtttaagataccccacgttgtcggcctacaaatgaggcggagaactatttaccaatgctatgttgncntcttagtcatttatttacgatagtcg

SEQ ID NO: 10008 - DNA, 211 bp, Homo sapiens
aaaaaggggtctccctatgttgcccaggctggacgtgaaaccctgggctcaaacaattttcctgccttagccccctgaggatttggggctacaggggcacccaactgccccagctcagggccgtagtttattagacccatgaaagatcccagggttattttttaaaagcaaagggtaatttaacgaaagaccattggaaaaatttaaaaaa

SEQ ID NO: 10009 - DNA, 1067 bp, Homo sapiens
  misc_feature (1)...(1067): n = A,T,C or G
ctgncgagnattaaccaaatnncttgctttcagaccttnaggaagtggatattccttccagaaggaaattacagaccactctctgtttctactcaactgcttttcactccaggatgcttcacctcttggggccttccccagcagaggcccaggatcacctgcaaaaggcttccccagggtggggccagaagcagggctgcagatatgtgtcacgaacctcccatggaccctgctggctcccttcaaaggcttcgggcatagcgacttgcctttccgtcttgttcagtcatcaccagtcagccgtccgcagacttctctccctcacgttgtggcagaggagttgtacattctctagattttaaaaatatataagttactttttctttaaaataaaaattgtctctgaaaaaaaaaaaactggccctcgttgggcctcagcgggtgggagcttttgcggcccgcttccccttttagtggaggggtttaaattcattgatcccttcggcttcacttgacctcgccttggcgcctcggggtccgtttccgggcctgccgggccgaaagccggttattcaaagcctccaactttcaaaaggggccggttaaattaaaccggttttaattcccaccaggaaattccagggggggaattaaaccgcccaaggggaaaaaggaaacccattggtggaaaccccaaaaaaaaggggcccccatgtccaaaaaaaggggggccccaaggcgaaaaacccccccttaaaaaaaaaaggggcccccccgccggtttttgggcctttggggccgcgtttttttttttccccatataaagggggctttcccccggatccccccccccccttgggaacccaaaaccccttttcaaccaaaaaaaaaatttcggaaacggcctttcaaaaactcttcccaacaaggggttgggcccccaaaaaaaccccccccaaacacgggggaaacttatttgaaaagaggaatcccccccaagggccccgttttttccccccccccctttgggaaaaaagcctttcccccttatcgattggcacgccctt

SEQ ID NO: 10010 - DNA, 1931 bp, Homo sapiens
  misc_feature (1)...(1931): n = A,T,C or G
tgtaggagttagaagataaanatanataattaaatnnaaatgtatagncacgaaaactttttttcggtgagannnacaacagganancnngacagtggcagtgtatgtgagggacgagagacggcgagtgcagatagaggcgttcgtctgtcgtatatacttcatattacaaaaacacaacatccgagagctcggctagagtcgtcacgcgagcagctatagctataacgtcaatcagcatatcacggtcgatacagcgtacgtcgacagatcgacacgtgaactcacacgcgcgttcagcgcgcatgatgctatcaattcgagatgtcgtagtagacaacatcatagacgagatggggtacatnagatgtggcctgtgttgacgacggaggcgcggatagacgagtgtcaggccgntcgttnnttccggcagcactgcncgcggttnccgccgcctaccagccgtacacgtcagcgtacgtcgtcacgcttgccacgctcctctgttattccgtcactcgtagcacgtgtcgctatgtgaccaagcgncggcgcgcgcgcgcggctgcggcccgcacgcgtcgtcgccgcgcgctcgccactctccgatgacgctcttacgacacacacgccagctctatcactntgagcgccacccctctaccgcatatcnaccacttgcgcacctctccacagagagtgtgtgggacgcggagtgtgattggtgttgngtgtgtantggacacacggcaaggaggcgagaggagatgccaggaggagatagtaagtaagaaccgcacgagntctctcaccgtcacgtattcgcagcacgcgtacacttttcagctcaccgagatttacccgaagcngcgcagaccgagatcttctcgcnagtgcgaccccgcgcgtcgtagttcatgtacgaagatgacacggtccaacgatgccgcacatcgctgacacacgtatcacgttcacgtataccgtantacccacattatgttcacagcgcgccaccgcctgagtaacaatatctcacacctcgccacatatatccgcgtacgcgagattaatcggtacagcatatcccactcgacgcgtcgtacgtcgccagagcccactccatcgtcatataccgcgatatgccagaaaattacgaacgtccggtcgtcgggtcgcgtgtcgtcgtattgtccgcgctcgacgagcgcgcgaccgcagcgtgacagccagtantgggtatatcgtgttatacgagttgcgcgcgtgcgagtgagtccgcgccgcggcaccggcggccgtggggtcgcacactcatcaaagacctcatatcatttcaccacgcgtcgctcgtttctgcgtcttattatacgaccgtcgccgcgcccaaccgcgcgctcgacacaaatatatcgcgcgtcgtcgccgccgtctgtnattccacccacgtcgcgcgtttgttgcgatgcgacgatttcgcctcaaccgacgacgtgcggcggantataaccggcgtgtgtgtggttattggccagccgatttgtgtcgcccgcgtgacactcaactccctgcggtttagtgcgagcctcagcagttactcttagcacccgccagatatacctcgtccgangacaccaccgtaagcgccggtgtgcacctcatactcctaagacagcgatcgcacccgcacgtattacacggatancgccgganttttaaacgaaggatgattgaccagtccgcgacaggatgtctacgacgcggtcgcgccgcggtattctgctcgagttgacccgccactgagacttatcacgacgttatttactcaatacgcaccgctntaccgtaccgcgtgatatgcaacggcggcgctcctaccgncgccngactagtgcgcgaccgcgagctgcgtgtcgcactnatnatatatg

SEQ ID NO: 10011 - DNA, 847 bp, Homo sapiens
  misc_feature (1)...(847): n = A,T,C or G
tacgatttgctttcgtctgcgtacgaagataaaacacacggcccgnctcttcagctgtacgggaagctggctttatctgctcaccttctggggaggcctcaggaaaactacaatcatggtcggaaggtgaggggggagccagcacttcacatggccaggagcagcaggaagtggaagaggtgctacacacttttaaacagccacatctcatgagaactcactatctccacaacagcaccaagagggatggtgttaaaccatgagaaaccagccccatgatccaatcacctcctaccaagctccatcttcaacaatgggaattacagttcaacgtgaaatttgagcaaagacacagattgaaaccataccagccatatatgggtgctgcacagccagggctttccgtttggagctgcccattaaatacccagtttctgtgcccattcactgtcaagccaattaatactttataatataatttaatgaaacccttaacctctgtgaggtggtcaatggctactactacttcatgttcaagactaagttgcaatatgcagataaaggtttgaaagaatggagaaaactgttatattatgtttcttttgtaaaggtaaaactgtcaggttaatcattaaagggacttgttgactggattacctataaatgctatttgtaacatctcacaatattaaaagcatatgtttataaacggcattttagaaatttacagaaattggggatgaccgttttttttatctttgagttatataattacctattatgtattagtcagaagttcccataggtcttgataaacaagcgttgaaaatcaattaatgggtggtga

SEQ ID NO: 10012 - DNA, 981 bp, Homo sapiens
  misc_feature (1)...(981): n = A,T,C or G
acacatcatcggactaccacaagaaatggaaacctccggccccgaccgttgtacgcaagatgtacattatcacttaactctattagagaacagtcttccgggggcgccgccgggagnncacctccagcgtcccacttacangtatacgctagatgacatggagtngccaccagtaagcctataggaatgtatagacacgganacaatagccgctgntttctgttggcatagatgggggtattacagtcgatgtgtataaggcctaagcctaccacactcaggaagtcggtccatgttgctttgatctcactagtgtggtgatctattccagctggtggctgggtctaaacgctggcactcacacctgtgaaanaaacattcttataaatgtctctcaagccctgggacctcgaatcctcggctcatgngcctcctttcgtgctatgccactcccctaatgtactatatctgttatagccctaagcttactcgctaggtgtatattacaaccacaggatcggtggccgtggaaccggtcccccaaggcctgcaactgtagctgataggttaggagaagaggcctgggaactacgtcaacgaactcacgtcggtgggnagtctgtgacggtcctgcgcagagagttctcggattatgtgactagcctactatcatgcgtcttctggcctaggagggctgaaacattggttcgcggcggtatgtcatagcggcgtttgaaaacacaggcctctgtacctagcatgccagntactcctatgttttgttggacaaggtcnactaatttttttcctcttaagtagttggctcacctctcctcatgtcatcgcctgtcctcatntcctncaccatgntctttctctnccctctacgccctcgtggctccctcgggctattntncttctgttttatttttaatttacattttataannaaatgagcgaannnnccccacccgcccccac

SEQ ID NO: 10013 - DNA, 810 bp, Homo sapiens
  misc_feature (1)...(810): n = A,T,C or G
ctcatgttaaggacccacgaaaaagagaaaaaccnnangagttcatggcccctactgatatacgatgactatacggttagactctcctgcttgttaggccttgggactcaaactgaactacagcattagctcttctattgtccagcttgccaacagcggctcctggaaaccgtcagaccccatactcatgtgggccagtatgttataataaacctatctccttatgtatctgtctatccatttatcatctatgaatgacctattggtgctgctgctcaggagaacccaaactaatacatctgcattggctaatagtataaaggctaccccagcattctttagattagtggtagcatggtatatctttacttactctagagatatgcatatatataacataaggtatcttgagaacagcatatagataacacttttttttaaacagctcttgaaagacactgtaatgggggtatttacaccataacaataaataaagaccgatatggaccatacttggaactcgtgtctattaattgccattggtgtatacaagacttgtacctggttctgaattactctaacttaataattttggataagagattttttatcacgaattcttgttataaatattctgaatagataagatagatgtacgaaaacacagtgatggtattactgtttctgaaacgtaggactcctaataaaacctttacctataaaaatttgggatactcggacttaaaagaagaacacacaggaacttcgtcttttctgaggccaaatagtaaggcatattgaacaatacat

SEQ ID NO: 10014 - DNA, 1335 bp, Homo sapiens
  misc_feature (1)...(1335): n = A,T,C or G
agggggaggaaggtgggaaggggnagggaaggaaaaaggatgggnggagnagtatatggttggatatgnaggnnaagtaggagtgnnnaaggagatatgnaaaagtggnaagaaataggnnnggtggnnngtgtgaaagatggtaagtagataaaaaagggatttatagagagaaggnaggttagagtgaagtaaagttatggagtaagtggaagtgaggagaattatnnaaggtataataaattgataggtnacgacggtagagggnnnagtacgngagtggnncgcgaagatgagagagaggnagacggatgagcagaggcgaatgnncaagaggaggaagtaatatgaaggtatgnaagagtggctagttgttgtgttagatctatgttngtatgnnatatgagatgttgatgtggtagcggtnaaggtgatagtgtntaaggaaatantatgatatatnagattcagacagtgaagtgcgctcagctcagagtagtattggagtcnnctcctcgttccgttgtgtgactggttcattatggcgatgattgtttccacacgagatcacgtctcacacagtttctcctgtatacgagaataatctcacccgcgccttaatgttcttctctttcccgccgaatgcttcgatgtgtgcttcctcttatcgtaccagcgggtctctcagcgtgccgttnctcacctaatactatatgcancaccaatccccagtagtagcgagaagtagtgggtgtagtgatgaattcnntagcagtagcgtcgtctctagaggaaatagagagtcggcnaagcgatggatccgtacggattgatgagttngtgatgngcnncaggtgttgtcgttgagaggtgtaatgtagtgnatntatagtctaggtgnncgatgtgaggaagaggtctactgatagtgntnatanatcgntatcaagtgtaagtggggtnccagacgcgctgagggnnngattagcgatcactcatagatgcttactacccgcatcacgcagcagccaccgagcgcacgacgaagtccgtatgtcacgcaggccttgccccagcgaccagaggttaataatgtcncagcgcacggtctcccgagcgcgacccctcgtgatatatgagatgcctcagcccccgcgctcntcaataggagtnacgaaaaagcagtgagcncacccagagatagcgcgtggtgactatctcncctcggcgcgtnactcgctgcattgtctcgtacaccatgccaggcgnncgcgacggagacggagagcgagagggcncccgcgacagagtcgtagaacgtacgccggaaagacg

SEQ ID NO: 10015 - DNA, 767 bp, Homo sapiens
ctctatctccagtactggagtgcagtgacacaataacggctcactgcagccctgacctccacaggctcagagatggggtgtttcccgggcttgtctcgaacttctggactcaagcaatctgcccaccttggcctcccaaagtgctgggattacaggctagatgcggtggctcatgcctataattccagtactttgggcggccgaggagggcagatcacaaagtcaggagatcaagaccatcctggtcaacacggtgcgtgtcttcaaaacaagagatgggttaaaaaaattgctgtagatttgatgagtttcatctttggtgatctgactgagactccaagatgtctcatcatgggaattccacagatcagcagtttcactgtttaggttttcgaggcatgatgcagatgcttctgagtttactataaacctacaagtttgtcaagtcatgcaaagaaataagtgcaagctaatgagcatccaaggactctaccatggaataatactggaagaagcgatgagatattttgcaacaatgcctttgaaaattaagtctactgctgtataacgattatatttttgcaaatgagtgacaatcaagtgacaatatttaagaatttaactttcatcaaaattttaggctaaaattcacatgcatttttcagcaagtatgtgaaggttttttattttgaaaaattgaattatagcgtatagtatatttaattatagcatatagtgtatttaatttttaattgaaacatttatac

SEQ ID NO: 10016 - DNA, 747 bp, Homo sapiens
cttaactggaagaacaaatacattcaaaagacgtcttcaccatacaaggaattctttgttcagactggctactgacattccaaacaaacctacactcaagataaagttatcctctcggaacactcagacattttttttttcttccctatcatcaacttgccaacattaaaggcagttctcacttttagacacaacgtgtttgatgcaaatgcaacttaaagaagattactgtaaggtctcgcctggctggtcttgtattacatgctgattatgcatgtgctgtcatatgagagtggaagccaccaaataagtagctatggtcggtgaaaagtgaaatacaagtctttattattaagtgtccatgaagaggtgtggcgaaaagcatgactcccaaattgaactggtgaaaaatatgaactatatgcaccttacaagaaaataagcaaaaaccttacttctggacatatttatgaagttttattttttttttctttattttatagttcatggatgtaatctgttataaaagagcttttaaccactggttgatattttaagcataggcgctatgtccctttttaaggtattgtacttttaaagtcatgatttttagtttatatcttctttagattgcaacgtcgagatctttgaatgagtaaagcatgcgcttctcatttcatctatatttagactgtacctaatgtatagatgtttatctcctagaagcacatatgtatatctcaaact

SEQ ID NO: 10017 - DNA, 1097 bp, Homo sapiens
  misc_feature (1)...(1097): n = A,T,C or G
atagttggtagtngtactacataactatgaagaggaaatgtcggcgagagaatggtggaggtatagagggtagtgttaagttactatgggtatatgagagtgtattatggagttcttgatagtacgtgcgtctgtgagtcatctggagcgctgggtgtatgtatnagtgtgtggtggacatgtgaggagagtatgtggttaatatgtggacggaggagnaagtgtctccgtgagccatcaagggcgcgtggaggtagaggagtctggtgtcgtatgattgcagatgctctattccacgtgacgggtgaatctaggtgngtctgatataggntaatagtgtaacagtggtgtgactagcggagaccgcgggtggagtnggggatgtaacagtttggagttgaatttcttgatgggtgatcatcagggtagagttggntagatgcgcaggctgttgagaagtggtggtgcggggttgtgatatatagggngatcgagtgtggtgagatgtggggtggtctctagggtgtggtgcgagcatatgtggtattgtcttgtggtcgtggtgtctgtgtttttactcctcatattcgtatncanactcatcgagtcattccggncatgtggggctggcattgggagggagtggtagtatatactcatttgatatattaagtggggctgtcagggtatttaatttgaagatagggcattaatataagagagagaggagttgaatagcatttgggattaagagttcgtgtcatgatgcatggctactccaattcttcatgtatctctagtcgtattctagtgggtatgccgaactagtannnattaataatatagttccaaagtcattgatctgttacttcgnagtcataagacacatagttaatgctctgttagttataagttattatgttcatgnctccacttctttcctttccctatgtctacgccctctcattatccccctatatancacttnctggtcctcgttggctacaagcgggtagtctctncgttataaannaattntttntttatatttaagaaaaaaaaangggggagtatgtnatattaaaagttattattat

SEQ ID NO: 10018 - DNA, 248 bp, Homo sapiens
ctttgatgacctccattagtccttgtaaaggaagatttattctgtgaagatttttggattcatattacaaagaaagaaacccacaaacttcaaactcttttaatatctgttctaagctgttttgtttattttggaagatgggaattggccacttctattttccagtggctgtttagaagctgggtcactacaggttaacttcttaaagaaatgaaaaacaagttgccttttccagaaaaaaaaaaaaa

SEQ ID NO: 10019 - DNA, 860 bp, Homo sapiens
  misc_feature (1)...(860): n = A,T,C or G
gggtggctggagcgccgggggggtgggagggaagagggggggggggctgactagcacattcagtgtgtgtatgaagatgaacctcgattccttgaagaagttgattacagtgcacaaagtaatnataagtgaggggttgggcaaaacaaaaaatctannaaattatnaaccttctggtcaagaagaagtactttctgactctgaattatcaagaacatacctaccttgagcccgctggcatctcttggtaactggaaagaataaatgaaatatctttgtttttatggggcaggaagcttgagagaaatgagtttatacagagctgactcaagaagacaaaaagtaacttggggccattttggtttcaagataataaatggggtattaattaatgataaaattggccgcttggtttattttcgatattcaatgcactttatggtgcattggatgatcaaatgtgggggtttacctttgaaaaaaagcctgggtatcattgcgtgaatttttatgtcccgtatgggatatgctgcgtgaagggggtaattggaaagtgggggcgaaatataaagtgggattttggaagtggggaagatccttgctttgttaaaagctaagtatatttgtgcctgggtttgtatggaatgtggtggggtgaaaagggggtggaatattgcaaaagaggactgggcttgtaaaatctgggtaagctattgggggttggtgcctgagaggggggctcggggggtgggctgtggagcccgaggctgtcggcgtgtgacgcgaattgagacagacggaagagctgggccccgggaggccgtaaggcggagaggcttgggagggggggagccttgagg

SEQ ID NO: 10020 - DNA, 1139 bp, Homo sapiens
  misc_feature (1)...(1139): n = A,T,C or G
gtgaaagaagagggnaaaggnnaagnaaggaaagtgggtgnatagatnaagggtaggtgtaatggaaggnngtaaagagnnaaatgagtagtnaggaaacnacttggacgtgaaagtgnnaaaggagagtgttataggtaaattgatgaggtaagagatgaagaaagtaaaagtgtatcagtgatagtggaagcgatagatacggtccccagtctctttttgtttctctttatggcnaactttgttagtttagtcaatagtacaggttcatttgagagggagagctattgaagagagaggctgctaggaattgtgttttagtgtatttttgttaggtagtattgctgtttctgtgtgtgtttgggttataggtcgaaggccttcgccagcgacgaattcaagttgagcttgngattctcctgcgcgtttngcatttgttttatcttagtggtaggcaagggggaatcatttgatagacgatgtacctgtatcgctccctcactggagagtatataagctacgccacccacatacatttcttgcggcgtgagagacgacggatccgcgagaggaaggcgcgccacacgttaacccgcgctgcctccagttccttcctcctggaggtgcctcacagtcttttttctcgttgttttcgcctatgctntttggatagataggtaagttcanatagtgtgaggttgccatcgggagggtgttgcggtgatgncatatcgatatgtgtcccagaancagtgggttgtggtcgataatgatccgtttcccttatcagcgaatacccgagcaaagagcggagtttccaggcggcgagtgctagcggcgccgtcgcgctcaggcgatgtctacgtcagtnccaacgtagacgcccacgtggccgcgccccacgttatatatgttgctgnacgtgcgcatgcccgcgcanaagtcagagaccnncctaagcgcaggacacgccgcnnnatgcgagtgtgaagtcagttagtacttgtggagcncaccctctcgtgtccgtgcgcgncgtcttagggcnagcggtctcacggccannncctattcgcgctcgtgatnttcttatgcgactccacgctcntcgtgatgtttagagttattgagtatgntgt

SEQ ID NO: 10021 - DNA, 1056 bp, Homo sapiens
  misc_feature (1)...(1056): n = A,T,C or G
ggttgtgggagggtgttgtggggtgtgggtggtgctggatgtcgcatcgaatggtgtgtggcggttgtaggtggcggtgacgttgtctttggacgggtgtggttcttgtcgatgtggtctgtcgttcgcttggcgngagcgtccgcgcttcatttggttctgtactgtctcttctgggcttggtcgcctttgggngggcgggggtcgggctctccgtcgcgtctggggtggcggcggtctggccgggcttggtgggttggtcggcggctgtggcgcgctgccgcctttgtgcggggcgctggggtgggggtgcgccctgcgcgacggttgtcctgggaccttacgtgggggacggctcttgggcgggcggcttgggttgcgggcggcgtgtgtcgggtggctgcggcggttgtgcgtgggtctgctcttgtggcgtggggctcgtcgcgcgggtgagtgctgtgccgttggcggggcctttgngtctgtttgcttggctggcgttctgtgtccttttcctctgtctgttntnttcactttaccgcgtcgggggcgggggtggtgtttggtgggggtgggccgtttattaagttccnntcgtttcttcttcgcgttctaacnttanatcttcggggtcctctgtggctgtgctggggggaggggggtttntttctgctcttaaaaatctttnctttttcttggcgttgccttttgcnnccagaccatagtgccttaagcctgggcttgcgccctttatnanncctctctctttttctcctccttcctttccctcttnctntattnncctctcgttccttccttccccctcttctttcctttcgcgnnnnntctctccttgtttnnncctttccttgttttttttnccctctacctccttttttttttttctcttttnctccccttgtnttggtttttcccctttaaaagngtntctttttcttgtttcccttttaaaatcattttnntnagtttttgtggntttatttggttnattttgtattttnnntnnngnnnaaatatgttttaaatcccggc

SEQ ID NO: 10022 - DNA, 262 bp, Homo sapiens
  misc_feature (1)...(262): n = A,T,C or G
ggtatgggtgatgtggggggagcgcgaaatggggggggggggggggggggcttgtaggaacacctgaagagctgnagagctcagcgtctgtgcagatcacggctttcgtgggacaccctccacacaggtgagcagggaaaagtgtgaagttcacaacactcttagaacaaccctacagtgatcagaaaatttgaattgtcaacttataatgagcctaaacaatattgtaatgtgaaataaaacagtggcctcgttggcctca

SEQ ID NO: 10023 - DNA, 1816 bp, Homo sapiens
  misc_feature (1)...(1816): n = A,T,C or G
catgctgacgttanctgaccagctctgcgcgncgtcncgctctgtgcancgatattacactagtntctgattgtngatgtcgatggtcgtaantcactctccgtcgcgcgacntncgcattnagtacttctgcctgtcagtctgtgtgtcactcgatgnaccgacgacgcgcgcgccgttgtgtctcgcgctcgtgagntcactcatggatngcgacagctgtgagnggtcagngtgctagtgatcatantacnccagcgcacacatatgggaactcgtaactatctcagtgcacnatcacgctgcgcgcgatgtnagcananacgctgtagagagagagcgtatatgtngntgtgtcgtagnacatcatatnantgtgtgagcgcggatagcgatnngntcgatcgtgtggtgagtccgcagtccgacgncgacgtcgttgcgccggttgagtacacgcatgacgcgnaacgtcttatgctnccctatatagtgctgcggangacgcgtccgcactgtaatatctgtanacaccatctccgtgctccactcgcgtctgananacgttgcgncactcggtcggcaatctcggcgacagtactcgatatgngcagcgtgcgagcgccgctgacgcgtgcgagagagagagngagtgagacctantngaggatccgcngtgangctcgatcacgctcgtgcgcgcgagcgctcggtgtgtcgactcagantaggtngtgngngagtgacgactcgggagcgcagcgacatcgtggagacgacaggngcgcacgtcatacatcgtcgtgagagtaatgtacctctcactanggacttccgcacacatatgaatatggagatgtagagaagcgagcgcatataacagtagagagacagcagtccgccgaccgcngagaggngnacgngtncgtcactagttanaacatatcacagatcgatntgtgctacatcgtgtacntncacntttctntcncatcacncttaccttgcgcgtcattgctcgggatatatntataactgtancgtcnncnncactgcaatattgcacactcgcnttntacgagcgtctatgantataacaacancnnnnacacgctcgctctcctacgcacatactctattcattncaactctactagcgntactacaatgnagcacagtgggancgcaacgannnancantatacancctatancaactatatgatctctantnacagctggagagagtgggaataggtcntgacctctattgtgtccntngtcgctgtgtaacacatgacagncatctaatgntcactgcgcgtacgcactcntgtacaccctaattctctcnnncncactcttcgcaccccattctctcnntntcactctcgtacactcttcatatctctcctntacatcntgacanngtntctctattctatanaactctatnacagcatagaatgtacttcatactcgcgctcacctctcatcatnnnaccctctctcctcattctgtntnnnnnacatttctccttacgctnttcncatttnnntctccccttnnntnccctnnncgtctcccctcgctcctttcttttttntnnnntnnnnttctgncctcctcctctctctctcgntncccccttctcntntcctttnntctatantnctctctnnnnctctctncttanannnntaattttcttnnnnnacattttntaattannctatnattatntatattanaaatatttagatangnggantttatannnnnannnntaagctatgatataactttataacagct

SEQ ID NO: 10024 - DNA, 1296 bp, Homo sapiens
  misc_feature (1)...(1296): n = A,T,C or G
ctctcacggaaggcactactgatgtgcgtcgccatgaggcgcgcacgaaacgtaatgggtgtggcgctgggggaagtgacacaatgcgatggcgcgcaagaggaagtgagagggtagggtgtcgagtatatagtgttaccataggttggatgtcggatgttggctcgattctgtgttaagtatggggtctttgttgggtactgcgggacgccgatgagactctccgtcagaatggcgcacatgcacaagatcgttatgcgataatgacatctcactatccacagatcgctatgaagcgtcgtagccctgcggtggacaattatggacttaatactatgattcgcactcaatagttaagcagtggtattcgtgcggtagaggcgtgcagtgttccacactgctttggttcatttattggtgtcttcatactatggcagatcaatgacatctcacgctaatggataatggagttagtgtattagccgttagatcttcatacgaggacacccgcgcaccgccatacaacgcgcatatgagtantacacatatctgcggcctcttgaggtgcttttcgttctgaagtatgtgggcgtctgtttgagatagtgggtgcgctgcgcgggagtggtctgcggtgcaagctgagtgaggagacgaggtgaagctaaagtgccgatggaggtgcatacagacgnttataagagatctacgcgcgatcccatgcaacactggtactccaggtaggtaaagganaatggtgttctcgagtgtcatataagataaatacgagatagagagcaacttaaaatananaaatataataagattataattttaatatcanctctatcgcaccattacactctcaaacaacacttaaagataagatncaaatataacttggcttgtgcttacctatctctctanaacatattcacttatttctatnatatcataccttctcaattttcatacatcatcattntgctgtgctgtaaacatgtatgttgcgttctattgttttgggtctgcctgtgcgtccgctcgtccctctnttnnnccttctctcctcctttnncttcttntcgctnnnttcttctnccctccccttntttnnntttatntnnnnttcgtnccctctcgccctcnnnnctcatcctaacgtcttgtntttnnncttggttnnnnccctcncnaaaannactttntnnnnnnntttttttgttcnttnntnngctnttttnnttatttattattgttttatntnaanntanaatttataaataataattataa

SEQ ID NO: 10025 - DNA, 234 bp, Homo sapiens
ctaggtacacttttatggaaaagtgatgaatgagtggtggagatggaataaaagcttcttcccaaggattttatcaagacagtggaagactgaggagagactgaagggagtggaaggaaatattgtgtcttctaatatccatcttgctcaaacaaagttggctgaattaaggctctgcttgttaactgtcaatcacaatctagtatgaaatataagaaaaatgactagcaataa

SEQ ID NO: 10026 - DNA, 339 bp, Homo sapiens
agaaaagaagtggaggactatcaccctgcactccatccataccacaaagctcctagagctgaactgtggactgtgcatttctttggccaatcagagtgtttcttaaagaaagcaccacaccagggtatgccgcgggttagtgttgcccaggaacaaaggtctacgtgctgcttcttccagagccactgatctctagcagggcttcctccttgagggtcctaaagcttcttccagtctccagaagccagcagaattatgctcttctcaccagaaggattatttccaattaacgttacattagaattaatgcacaataaaatactggcctcgttggcctca

SEQ ID NO: 10027 - DNA, 826 bp, Homo sapiens
  misc_feature (1)...(826): n = A,T,C or G
ggataagcagtataataaaatagattttcaacaattcgattttcaacagtgatgccaagacacttccatgggaaaacaaccgtcttttaacaaatggtcctgggacaactggatattaacattcatatggatgaatttgggctcctaatttacagtatatacagaagttaggtcaaaagtataccataaaccttaatgtaagagacaaaactataaaactcagaagaaaacataggagtaaatcttcatgaacttgaattaagcaaggtgtcctacgtcaaagaacatcatcataaaggtagattgacaactcacaaaatggaagaaaatctttgcaagtagatcaataagggatttgaatctgtaatatacaaaaagttcttacagtgcaacaataaatagatgattaagagttacnagaacaaaaccaaaataaagtacctatgaaatacatatcttcatattctgaataaaacatacacaatcttttttattgttttatctagatgaacataaccttcccaaactgtccttgcatagtgataacatctcatgattacccactatactttgattaactatagtattggaaatttacatttatttcttcagtactcctctgctttacataatttaaaaaaagcatctccctgacaccttacgaactaatctaactaaatcacatataactattaagtttttacgtgacatatgttgcttacaacctcagatatctaaattagatgtgttaggtgtttaatgtatgctgttgtgcgttttttgctcatttcttcggcgaattatagcatttacaaaaaatttatat

SEQ ID NO: 10028 - DNA, 1388 bp, Homo sapiens
  misc_feature (1)...(1388): n = A,T,C or G
atctctgtctgtgtgtcgtaactattatgctngtttntcgatagtgtgtgtatanatngcatcacgctacctacgccgtccgcgagaacgacgacttgagtatgcgcctataggagagaangcttganggagcgtgcgtattatgtggtgcatgcacgtcgctgcgcgatggtccgcnaggatgagacatgtctaagaccnancagtcgacagtgcatanacacaattcgtatgtgactgcgcggtgctagtgacgacntagcgtgcangcgcactgntgagngacgtacgcacangacactgcnggtanctccaatatgtgctatgcgcatacgcacncatgtcacagccgcgtctctagtgtgttgcgccagttgtagtactgcgtcgtgcnantgagtatnagctcgatccgttatcggctgtgctctcagntgnnggtcgtacggtggcgactgtgcgagtntntagtgcagcactagatgattgaatacgagctcgacgggacgtcgcgcccgcgcgacgacgcgcgcgcccngcggactacagtcacgactggatgtncacagcactncccttcggtgagcgtgagcggtntcgtatccgagngnatggacggagagagacacgaggactgcgagactagagtcgcgctgcgtgacgtcgtatgtgancgtgtggcgcccttacgtaggtggantgcgccgatgagcgcgatacgactgtgtggatcatgtggtactgcggtgtaagtaggtctatatgactagtcgcgngcgacgtatagagtagttgatgtgntgtagtgtgttgttgactcaacgantgcgctgttggctggatgnagatcactgtctgtcccctgcgtgctgtagctgatgagggacttgtggnctgtcatgttgagttcacatagaatatatttaagtgaatagataatctgatccagaaggagctgtaggaaacantataaatagagtaaatcatacacacagatcaattgaaaccacacatctaaatctttattctgancatctacatcgtaacatatatacatgaactattatttgactacttcctcattctcatgatacaagttattaaatttatacttgtcattatacactatgtttncctctttccaaccagtngattaccactagcgcctgaccatatncctttatttgctccccccaatattacgagcatatctgttcctctgcactctctgtctcttatttcttttcttccttagttttaccttcattttctccttctgcccgtcgtcctgtttcctttaaagttttcttttttttttctttaaattctttttnctttattttttnttttttnttaatanaatattnattttatattttaattatact

SEQ ID NO: 10029 - DNA, 389 bp, Homo sapiens
ccctaggagagactaagactgttaataagaccgaagcatgtattaatgctgtggctatgagaggcctcctgctgcagaaacacacttccctacatcaagaaggagtaacttcaggttggatcctgtgtggatgatcttggtgctaagcagaaaagaaatttggaccttgaaaccagcagttcaacatatatactttttgcaaaatttccttgatttaaaatatttgttattttaaatatacaaaacattttagaaaatcttagagtaaattttagtcttaaagccagaaaataagtttatagccatctagatattttgcatattgctcttacagcaataatggtttggttcactttatgaaaaataaaatgttggcctcgttggcctca

SEQ ID NO: 10030 - DNA, 136 bp, Homo sapiens
  misc_feature (1)...(136): n = A,T,C or G
gctcntnngaaccatcacattccttattcagagtgggacagcattggctgagttctactagcaaatgccagagatgtggttcctgttggccttttaactgatgtgatgaaataaagtcatggcctcgttggcctca

SEQ ID NO: 10031 - DNA, 158 bp, Homo sapiens
cctagttggcatcttggaagtttactttctgcactattcttagctctcgcagctggagaatcccggggagtcctcaatgccaaattccaggacatgaagctaataccactgtttcaaacttctctttttaaaataaatgtatggcctcgttggcctca

SEQ ID NO: 10032 - DNA, 1508 bp, Homo sapiens
  misc_feature (1)...(1508): n = A,T,C or G
ctctgcgcgcgcgttcgcatatcgtgtgcaagatagtgtatcgctcgtgcagcgcgcgtcgccggtgntgaccgcgctgacacgagactcgcagtctcgtggtgcgctcgacggaccatacacntacgtatangcgatcatcgccacgtgctcacttcgatcgncggctgtcagtcgcatgacgacgacacttcgcgcggccttcgtgtacgttctcgtcgttggnagtgctgcgcttgcgtaccgatcgacgtgctctaagctacgtgttggattcgccgctngcctgtaccgtgtcgtgcgcgaagctactccgcgcacctgtcgagcggacgtcgcacggcgcgactcgtgtctgcgatgtccttcgntagcgacggagccgtgtatgtgcatcgtatctatcgtagcgtgcttatatgcgaggtcccgatccttatgtgttcgcgtatgcgcacgacacagctgccagcgctcgcgcgcngagtctccacttcacgccgggatgcaggaggtcttgaccgcgtgatgcgactcgataacatgcgacgtngaccgcgcaagtaagtgcggctgctgtgcgctgagctgcatgtcatgagcgagcctgtgatccgcgcgcgtcggcggcctgatccagcgcgtgagcgtaacaggccacgctgatcgagctntngtgcacctagcacgcgtccggcgcgctcgttcgatanttctagcatgcgtctntatctagactcatatcatcngcggccgatacgcgtcgatcgtgtgtgcgacgtgcagtcgtgcgagcgcagacgtgttctntagcgctcgcgcttcgtgtcagttcgcgcagcgcgcgctcgctgtatctgacgctctctctcatcgntgctntcgtactcgttcttacctttgccggcgtcatgatatctcgacccgtgcctgcgctacgatcagcgcgctcactgcattancacgaggtctcggacattactcgctgcggcgatcctcctgctcgctgcgtcgctgccttttgcgtcgacgcactgcttcgctggtccggantcgctgtgaggtaatcgttcgcggatcgaccactcctctgtatcacgttgcatgttcggagctttctccatgcgtgcgcgctgcagttcacactatccatctccgtcgtcgctgtgtgacntctccgcctcgcctgtcgtgttnggtgttgtgcgctgttacctcatcgagaacgtcgcgcgctgtgtgcgcacctcatgcgcgtcgtcgctgcgcgtcnccgcggttgcagtagcagctaccgtcgcctggtcgtgctcacgcgtgtgtccaggttcgtgtgtgcgtcgtcgctcgtgctcgcgccatgtatccgcggcgtncgcgcatacgcgtcacgcctccccgctaaacagctcttcttcctttgtttgctcccgttgaacgccctttcatcgtgctgcgtcgccgctctgcgcgtcgtgcgtcgcggcgcgtcctgcctgaggcaactc

SEQ ID NO: 10033 - DNA, 290 bp, Homo sapiens
ctagaaaagctagcctaagacagaaaacaccatctgacagaaaaaagagattgcactcttctctgtatctgccatagtcgaagcttggatacattgcttttgtgtcttctgcagaagaaatcatccgatttgattattgcttttctctgcaatatgtgaaaagtatatgtcggccgtgtctagttaatgctaaaaaaaatactgcattactcaatgcagatggaaggtctttgattcaaataacattggacattataactgagatcaacctctggcctcgatggcctcaa

SEQ ID NO: 10034 - DNA, 298 bp, Homo sapiens
  misc_feature (1)...(298): n = A,T,C or G
atgattaaaaaanttagagaattattttttctccatgcccttgtgagaataaacaacaacaacaataacaacaagaaacagaactcagaagatgcaagatgaacctcgaacctaactaaactcttggaacccatctgacatctataactcaatggtgtgagagaagtacaactaaaaaagaattacaatgatgaggaggataacagcaaaaaaaattacaaatgaaaacaatgaagccaactgcctgggtttaaatcttggctctgccattaataaacaagtggcctcgttggcctca

SEQ ID NO: 10035 - DNA, 319 bp, Homo sapiens
ataggccttcatggaaactgctctggtgtcacagaaatatatccaaggatggagtgtgtacgtgtacaagctcgtctgaaaagagttggcttgtaaatgggagaagctgtccaagaagtattctcacaatgaaataatcattttattttgtccataccgacaaacaaccagtcaattcagctggaggaaaaaacaaacaaacaaacaaacattttattttccaaatttgtaatgagttcgcttaattatttttggtttattgtgttatctacatagttgaatcttaaatctgaattttcataacctaaaaaaaaaaaaa

SEQ ID NO: 10036 - DNA, 1064 bp, Homo sapiens
  misc_feature (1)...(1064): n = A,T,C or G
ctatacttcctctcaatattaacacaaaactctttctcttctcatctatatgtgccacgtactacttgctcgacagtccatgcgtcagactgttgcaaaaaccaagggagagggagaagccttgagatcacatgcgacagacctgatgaattgagctgacactgagaatcgacgtcccagttctatggttccacatgtatgtttcaccctacttcactgtctgaaatgcctctatacttgtaacccattccttccttataaccccataccctcactaactaccctcacattcctaccttcattacacactatctcaactcagtgcaaataacaactccctcactctacacgacatatgataataacaaatcacttaattgtatgccccatcataaccccaccttcactatctgtgcccacacctttcattgccacccttttcacctaatatcacgaatgccccactatacatagatcccccctccataaacttaactttcatctactcctccctactcattatcgtccacatagtttaatccgctcttacatcctcactaactatcaccaataacaactctctcctcactcatactccaccgttattattatccacacctccaacctccctaccttacttcctctcaatattcaccgtaccctcaaacttaataaaaccacatccccttctctcttgacccccatccccctcatcaatctctacacactaatctcacgttgaacgccacccaatatctataactcataattcactatacatatatccaacccatactcacttaatttcgaatcacaattccatatagtccctatatntaatatcatctcctgtctcactctctttctcatagccataacttcgtcttagtttatatattntcctaccttcttattcgattatcactcatctcatttataccacacatcctacaccccctattactcactcttcctctctactagtcactcctcaagcagttccttcctactcctcntgcagctatacatacactcctcttttcctaactccaaccttacagtcg

SEQ ID NO: 10037 - DNA, 1325 bp, Homo sapiens
  misc_feature (1)...(1325): n = A,T,C or G
gtgaaannngaagaaagaaagagnaaagngaaggtaaagagagaaaggaaaaganggaaagaaggaagagggaaagaannaaatagaaagntttaggaagaaggnnaaaaaaggaaagaagagttttaaagagnnnaagagnaagaaagagagagaaaagaagagagagggaagaaggaaaaggaaattataagnaagaagaagtgaggaaagaaggggaggngaaagagatagnacaaataacgaaatagtaatagtaattcagtatggnacagagcggatantcaaaacgttaagattgtacatgntaagaaagtgaatggtaaagatattaacgagaggaagtgtggagtaaagtgaattagagtgnattatgattaaatgatgnnacacagacaantgcgataaagagngataggatagagnnttagagagatgtatggttgtgtaatgataatttgcgcgaatganacacctcacgcaactcacactgaccacaaacaccacacatagaatcagccaatacgcgacgagctacgagaaaatagactcactncaaacagcacancgcacgagcgctatgcacnccacgacggcacagaggtaacagtcctgccgccacgcaagtctatctcttcncacgcacgtcacactgcacacatgtcaccagcacgtcacacccacaatagcagagtagtctnttatacgcacgcgtccacaacagtagtgcacatagcctacagttcacaccattacgcagacacnccagcgacaggcgcatntaaatgagtgataaagcgaaatagnatactatcttnnctgtatatagttaatggtcttatgagagacaagaaatgagagtcnnacacgacaaacaagtccaatgacgagacnaaagccatgacagatacactagagatncactgagcatgaggtnacagcatactgccctcgagcaagtccgacgactcgcaacagagataaagattagattctcacncacagtcgcgaggcctnaacgcccacgccgacgcactctactggtttcgctggtttccncnacgcgcgaggcnccacttatcacgtcacacgtataatatcaagacttctgcggctctcgagcggtctcagcagacagtnncagaccgcgtagagagatgannncaaaanagaatatatcnacaatagagatttcgactcccaccacattgnccgacacgcccactcagtcaggncccgccaatagattgtnnanctctaagagncaacgtctcatcgtatgtnatacagtgtagtcagagtacttaccgacacggcacatagag

SEQ ID NO: 10038 - DNA, 936 bp, Homo sapiens
taaaaaaacgactatctgtgtgggagtggagaaaattataggcaccgaggaacgttatgggacaccggggatgcctttaagaggaaaacctgtttgctcaaaagaggggccggctagtgatgatgaggctactgctgactctcaacattctactcctccaaagaagaagagagggggagaagaccccactgactttccttcagaattgctaagtttttttgagtcatgctgtggctaataattgaactcttaccttgctctggcgggggagaccacaagaggaaaaagctcgcgctgcgtatgcaacgacatgttgggacgagtctctgtgggacctttatacagtagtggtagacagacactcaagcatagacatacctcgtcgttttctttactaccgcacgaggcatgagcaggggttttcttttcaatctcctaattgcccaagacataccgggcacctgtttgcgtccgacaatctgctcgcccgtgggtgacctcgcgagaattctttttgcggtatacccaaccttttgattatcaggatctcgaagggtgcgactatcaccattgttgttctatggtgtgtacttggatgttggagagacacctagcatccggctgaccttcttgatccatcgcacctacgaactgagaatagaccacaggttctcggttcaactggatgttacttggtgaggcgagtgagatgtgcgcaatagtagtgatatgttgcttacattgaccctctaagctcagccagtctttgatagattgatcagctagtcaggtagagcgttacagaacgggtgcgctcccggatgacggataccgtagagtctgaattatccgcgcgtgcgatagagagcgcatcctcctccggcatgcgctctgcgaggggcacgtgcatataatgacgcctccgctctgaatcgc

SEQ ID NO: 10039 - DNA, 867 bp, Homo sapiens
aattatcacactcccctacaccataattctcaccccccccccaccccactatgagtatccactctatgggacttttgaatgggagcaccggtggaatgcctttaatgaggaaaacctgttattgctcaacacgaaatgccatctagtgatgatgaggctactgctgcactctcaacattctactcctccaaaagagaatagaaaggtcgacgaccccaaggactttccttcacaatagctaacgttcttgagtcatgctgtgtttacccatagaactcttgtttgctttgctatttacaccacaaaggaaaaagctgcactgctatacaacaaaattatggacaaatattctcgccacctctataatcatggcataaccagtcataactctaacacgcttgttctctctcaccccacacatgccctccagcgcattgctattaaataccaatcaccacctcattgcgaccctttaccctctcaatccccacgtggttaaatcaaccaccacttctttccaagtgcttcccactacaacatcaaactcgcccataccacctctttcccccgacaccctcgcacctaaaaaacctctccaacactattactgattctttaatcaccttatgccagtactctccccacatacaccttacccctataaacatcaatccctcctctcacaccctccaaccctccctctctaccttctcaccacactacgtcacttccctaccatcactctctcacggtctcaccccttttcagcccccttcctcttccccatgcgcatctccgatcaacccctccccccaccacccccaatccaccctacaacatcaccacccacaccccacaacatacact

SEQ ID NO: 10040 - DNA, 949 bp, Homo sapiens
  misc_feature (1)...(949): n = A,T,C or G
aggaaaaaaagaaaaggnaagaagagaaaagaacgacaagaaaagcataaagattacganaatttacccaatgactaaccaaccaatggaaactgtttgaatgggagcagaaggtggagatgcctataaatagaagaaaacactggtttgacacaaaaaaaatgccatattaagagatcgatgacgactactagatgactctcaccattcctactccgtcccacctacgaagacaagaggtggaacgaaccccatttgacgatttactctgccaaccagctcctcctcttccccacctcctgccccatccccaaccccactacaacataataatatgctcaaccatatacatactcacccgcatggaaagtnaaatgatcctgcacatcccaaagactaatacctacatcacaaaaataaacaaaccatcttctaggacaaagccaggtcaccatccccccgctcacaggagccaacacaccaacataacactcgtccccgcctcccagttcaccaaccaacccaatcacacgtaaacccaacaattacaacacacacccccactaaacccccccacgtactatcctatctcctactacccagacctacctcccatgccccatccccagccctctcgcaccgcaacgaaagcacgcacgcaaaaatcaaataantaaaaacgactcatcaacattacacgactatagacacataattcaagcagatccaccaccaaaagacaccaaccgtccacaacgaaccaccaataatncccaaccgcncccacgcacccccgtatagaatcccgcgcccccgccccccgtttgaaagacacacaagaccacacatgacccgtagagaggggaccgaaggcccaccgactcaacgcccacgacacgccacacccacaccatccgccctctccgtacaaccgaagttagataattag

SEQ ID NO: 10041 - DNA, 892 bp, Homo sapiens
  misc_feature (1)...(892): n = A,T,C or G
tatgattcctaaaggacaaatacaatataangagagagaggggggggggcttgtagtcgacngggcggggggttggaaagaancacaagcaacncnccnanncaagaacaaaaaggagccttaaagcaggggaggcaaccagcaacaacaacagcacaaaagggcaaggagcagcaaaggaacgaacagggcagagacgagacaagaaggcgggcaaagaagaagagagccgagaagacaagggacaaagcaggcaggccaaggcgaagcgaacattttttttttgagagcgggaacggaaggacgacccaccaacagcgacacaagaaaagagcaagaaccaccgaaacaacagccaccaacaaaaacagaaaggaaaggccaaaaacacaccaaaagcagggaggagcgcacaacgacgaccccaccagacgcgcaagaacgcacacacggccgcgacaaaacaaacacacccgcgagaaccaccccccgcccagggaacccaacaccgcagaagacaggagcacaccacgcaaccacagagcgagaagaggacagcgaaagacccggaccccaacacgaaaaacgaaaggaacaaaaaagaaaccacagaaccgggaagcgaaaagaggacaaaaaaacacaaacaccaacacaccaaaagaagaaaaaacgaaaagagacgggacgagccacacaaccaaccagacagcaaaagcacagcggcaaacaaacgcgacgcgccagcaagcgccagacgacgaccagaacacaccgaagaaaaggaaaaggacgaggaaaacgagcaaaccggaaaatgaagaagacaagaaccaaaaaccccaacacgaaacgacagagacagaagccaacacacacgaacagcacaaac

SEQ ID NO: 10042 - DNA, 689 bp, Homo sapiens
  misc_feature (1)...(689): n = A,T,C or G
tgggtcntaaatgcggccggagacaacgtcagaacatcaacaacacatttggcccaggaactgctaatgaacagacagcgcagcggtggttcaataagttttgcaaaggagaggagagccttgaagatgagaagcgtactggccggcgatcagaagttgacaatgaccaattgagagcaatcattgaagctgatccttttacaactacatgagaagatgccgaagaactcaacgtcgaccattctacgttcattcagcatttgaagcaaattggaagggtgaaaaagctcgataagtgggtgcctcatgagctgaccggaaatcaaaaaaattgtttgaaatgtgatcttctcttattctatgcaacaacaacaaaccatttcttgatcagattgagatgtgcgatgaaaagtggattgtatacaacaactgatgaggagcaatttaaagggtggactgaggacaagtttgagagcactttccaaggtcaaacttgtaccataaaaaggttatgggtcatgtatggtgctccgctgacggtcagacccacttttggtttctgaactatgatgaaacttcatagtttttatanttttgtttttgtttttgtgagacctgatccaaactttttgtataatagtgtttcggagggtgaagaggctcccatctatgacgtgatcctgaagttg

SEQ ID NO: 10043 - DNA, 781 bp, Homo sapiens
  misc_feature (1)...(781): n = A,T,C or G
ctagagtgatacctgggtggattctcaccctgctgacaatgtgaggtgggacgactttgaagatgtgtggagacagcatggaagaagagctagatcactagccagataattccagattcaagttccagctctactgccacgtgcacttggacaagatgctctgtatcaccgatcttcagtctctgaatctgcaaaatgggtggattagtccactttcatgctgctaataaagacatacgagatactgggtaatttataaaagaaagcggtttaatggactcacagttccacatgggtggggaggcctcacaattatggcggaaggcaagagagagcaaagcgacgtcttacgtggtggcaggcaaagagagagagcttgtataggggaactcccctttataaaaccggcagatctcgtgagactcattcgctatcatgagaacagcccgagaaagacctgccaccatgattcaattacctcccattgggtccctccccatgacacatgggaattatgggagctacaattcaagatgagatttgagtggagacaccgtcaaccatatcaatggggtaaaaggatgccctatgttgaaattcattgggcaaactaaatgatatgatatatgcccaggctttggaatggtgccctgggatacaggagacaagcctgatcatggtcttgcctctaccagaatgtagccctagcacccagaacagctccctggtcccttgctggagctgacgcgggtgctgttaaaggatacaggggtaccatngt

SEQ ID NO: 10044 - DNA, 468 bp, Homo sapiens
acgccatgaactcatagatgggaaagaaagatatttattttcaacccctacagaagcaaaagtctactgccatcaaacctaacactggaattgatatgattccaatgcagccctggctttgatgtaatgcttccttttgtcgttgttgttattattgtgttgtttgcttgcttattttggtcttgttggttttataatttttgcaaacatatcaatgactcaaaatatatattttataatgtttcacatatctaggtaaatttcatcagtagatttcacaaattttttatgttattgtagtagacaagagaaggcattgtttaattagcctgaatatgctttttataagatatatctaatttagtgacatccctatttcctatgagcttatttttagtgcaggaatacaaggggaaaaaagtttccacgggagtacaggaaaataaaggcctggcctcgttggcctca

SEQ ID NO: 10045 - DNA, 1826 bp, Homo sapiens
  misc_feature (1)...(1826): n = A,T,C or G
tcatactgtgggaggaacttctcancnatnatatatatataatattccctcccacacactcaccatatccccccgacgcgtcatcccagatagctgcntagtgtgngcnctagcaccaggacacagcacagnagacagattcagtgtctgtcgggcagatacggctacnccnanaccgngcgcgacgagatcagngtgtgtcgctaggtagagacgtgtgagtatgacctagatatgtgtcatatggcgcaaatagcacagcatgcgcatccctatagcacngcccatatatgctgtgtgtacgatgtgtgatgtgtggcacacctgacacacaatctcagagccacctccgtgcgatgtgtngatgtgtgtgaccttggacatgtgtcgcagtgtgtgtctngagagcgagctagagacacacagagtggtagtcgcagcatcgagcactcgcgcggatagcaacatcgtctgtgtgtggcaagtctgaagcagcgacagtggcgcagagactganagctgacatgtgcgtgtgctacttggacggcgcagacagatcagtgatagagcagtgtggaggatgtgtacgtcagagcgtgcnccgtttgtgtgtgcagacgtagctcgcgagggtgtgacagagagtgtgtgggcgtgtgtgtgatcgcagagtcantggaanagtcaccacggacggcagtgtgtgagcgtgtggatgaagagagacagagaatgctgagcgactggcaataagtactttctngnaggacgtgtgtaagaactagcagaggtacgagagcgtgagacacgtgtggaagctgtcccacgagtcgtgggagcggcgtgctgcctccgacgtatgcgggcgttatggtaggcagcgcctcgcgcatgcgtatgtcagctgtgcgccgcgntacgatggtgcgcagcgactcctgcgctccaggancgaccgcgccgcgacgccagccgatgcacgcgcataacagtgacgcccgtcgattataaggttcatcagncgcagcggcgtggaccaacttacagagaaacgagactagaacccttctcgaacagagggcgcggacaggtgtctcgtgggagcgcagcgcgataaacctcagcgctcgacgtgaggggcatcagagatacaccacgcgccagggcgcccgccgctgcgtacactcacagcacaccacctactccagaacgcagagccgagactcgtcacccgcgnacgcatctattagcgcgcgccgggctcgaatgatgtatctacattaacagataatctagcacgccgccacggatgcnctaaaagcgccacccacatagagatcgtacccaccgcgcgcacacgagcataggcaccgcaatctgaggtcactcntcactacagtcggccacgcaaagcggccgacgcccgtcagaagtagtcataagcagtatcgcgcgctcaccgtatatcaaatacacaggcgcnacaagtaagaaatcaactcacgacacacccgacgcgcgcgcagatagtcactatattcacncacaagtagcgactntccagcgcagaatagcttctgcgcactcagncgcagcgcgcagacgngcgtatatatacgacancncgatgcgcgcatattntaatatatagtcgagacatactctcgtgcgcccgcagcacnaaccacncgcaccgacatgtctctcgtatgcagcacacgcactcgcgtcnacgccccactctcactntttanacacgtagtntnacagccgtcactcacgaccctgcgagcgctgccgcgcacctaccagtcataccacgagtt

SEQ ID NO: 10046 - DNA, 164 bp, Homo sapiens
cctgtacaaacatgctgaccccttttccagctggatttacattcatggattgtggacatgtggacacaaaacacagactgccttgcatcctgatgaagctggaaccagtattattttctgcttttatctttagcagtaataaaacactggcctcgttggcctca

SEQ ID NO: 10047 - DNA, 192 bp, Homo sapiens
  misc_feature (1)...(192): n = A,T,C or G
ctagtngcctaggaatgcagtagatattcaacagatgtcggcctaaaagaatgaatggatttcctgtcttctgcaggtttctgtgatctagagaaatcagagatatcagagactgtattatgaattagcatattatacatacacaatgtattgctcatttagaaaaataaatgcttggcctcgttggcctca

SEQ ID NO: 10048 - DNA, 1305 bp, Homo sapiens
  misc_feature (1)...(1305): n = A,T,C or G
ctctacctcttctcctcttactttctctcgtcttaatcctaatatccatacacccctaaacttacccctctcatcagncncgtcgtaccgcgnctctaaaagactcattctactncgactcgtataccccatcgctgagactagaatngcaaatattattctggaacacggcttgatcgatgtcactcatagcgagcttctggtctgctcacgccagagtcggttgttcggtaaaaggtatcggtgaattatagcttgttcgtgaaccttaaagcctgctcctagcgaaagtctaatccgcattagtctcaacaccattctaacataatacaacactaacaaagatcggtcctacctactgcgcctacatactttttagtatcatcatgtcggctcgtatatccactcgctagttgagggtcactaatttccatcgcatccttctgcttctacctagaactccgcctagctgcatataggtactgattccgcgttcgtcatgacgtaagctcgctntccccacactttcatcctccaacacggcctcccttactcacccttctctcatctccacctattaattctatcggtcgaatatatcgtgctaagcgacacacgacacttancgtagcaacccatacacagtgctcatcacctaccaatcgtcccaacatatacctctccacatattggcccgcgtcgttttcattatgctctttctatctacccatattcgccttgctccaacttccctctcgacccgacgccttccaccacataaacgcacattctctcttctacctcgctccgcagtgtcccgcctcacactctccacgatcatcgtactctattctacacatccccctaactactccaattctccctcctctcgtcagaccctcactttcccatatcttcatcgtcccatcgatgctctgaatatctctanaccctactccacgaccgaatcacacttgtcatacacttctctctctttaacgcctcagtggacgaattcggagcgcacttgactactttaantcatcagcactctcactatcccctncacctcacacatacatcactcacatcctaatcttatagactactgacatcactgatcactcctataacctacgtgtactttctatatattatctcacgtcactctccatatctataatacctatcacgtacgatatctcccacgcacatcctactctatctctctctctcatatcttccatacgcctctctctcccactctcatncacctctcactcancatgtnatcttcacactcct

SEQ ID NO: 10049 - DNA, 771 bp, Homo sapiens
ttcttagaccctacttattcttttccttagatttggagataacctatttttgagtactgcgctttgtatcatctataattgctgctggaattttagttataaaagcagggactggccgggcacagtggctcatgcctgtaatcctagcactttgggaggccaaggtgggtggattgtctgagctcaggagttcgtgaccagcctggacaacacggtgaaaccccgtctctactaaaatacaaaaaatcagcccggcgtggcagtgtgcacctgtagtcccagctactcaggaggctgaggcaggagaattgcttgaacttgggaggcagaggttgcagtgagctgagatcgcaccacggcactccagcctggacgacagagcaagactctgtctccaaaaaaacccaaataaaataaaaaaagccaggactgtgtctgttcatttttactacattatctggatcagaaagtttcagttcttgtttatacaggaactcagtaaatatttatcaaaaaatttttacaccaaatgttttccacaatctaaatatataatcgaccattattccacatcacaggttatcttcacagtttatttttttctctatgaggaaaaaatatttgtatctctttcatctctcagaattttaatatttcaatacatatattcagcatgtattgactttctttgctatcagaacttagtgtttgggtataattaaaagcaaacatagcacaatgtgaatatttacattaaatatgttttgtatt

SEQ ID NO: 10050 - DNA, 255 bp, Homo sapiens
cctgtctagctctgtggtccagctggagtgcagtggtgggatctcggctcacttcaacctccacctcctgagttcaagcaaatctcctgcctcagcctcatgagtagctgggattacaggaatccaccaccacagacggctaattatttctttgtatacttttatttaattcggcttaggttacttgttttttagtagcagttttgcatatatgggattgctgtaaaaaataaatggttggcctcgttggcctca

SEQ ID NO: 10051 - DNA, 778 bp, Homo sapiens
ctacgaggtctgagcctcggctttcctggagccaaccagtgcctggaacatggacactttgcgtttcatccatattagtgcctggaacatggacacgaggttcaaggttcatgaggtatggaaaccagcttgcaataatgataacatatttcataccctaaggatagcaaagcagaatggtagagaaagtatgggtctctaatagcattgtggaggccaaactatgccatccttggattacttatctttggacttcttggtagtgagtgtatcagttagcaattgcctcaacagtgctgcgggacaaatcatccccaaagtcaatggtttaaaataacaatgacttattcccactcttgcatctgaggatcagctggtgttggctccaagctgcaggctgagtctgccccatgtgtctctcatcctcctaggactagcatttacccagagcgtgttcttcccataatgagagtagaatcctgagaggtcaagcttaacagtgcaagcacatttcaagtacctgcttgcatcacatctgctggcatcccttttgccaaagcaagtcacatagatgagcccacggagttgtgggttagcaaagtatactccacctctaatagcaggaacgaaaaattcacatggcaaagaccacagatgtagagaggagtgaagaattgcggccagaaattaggaaatgcaggctgaatgaataaatgctgagtgaccattatgtaccaggaaccattttaggtgctttgtgcttattagttatctcatt

SEQ ID NO: 10052 - DNA, 773 bp, Homo sapiens
cctgatgagaatgaaaggttggttctgcagagaacagatgacttccctaagattgatggtcagtgcgtggtgacctgggactagaagacacatcaccgtacccacaggtgacagggagaagtatttatcaagaacacccattctcttagccctcagaaaatatcacaaatgcaccaccactgaaaggtgacagcttttatagattcatagtgacttacaaccttctacttggctgcaggaaggcaaaaataatcaattttcatatatcatggagcagaggagaagggaaaatgagaagcaacctgagaaatgcctctgctaaaatatgtgaagaccccagctaataccccatcaattccatggtcaaaaagtacaaaggttctagagaaataggcttgaacaaagcaacccaatcaaggtgagaggacacagagaaacaaggtcttcaggctagcttagctattgaaatgatctaattaaataaaacaattagagattggcttctgtcctacgagtggtacccccctccccatgaaatcacaaggaatggcaagaatccaagattgcttaagtgatttcttatttaactcagtcctttaagtggcttagcaagtgttaaatctaaatgtgtgtaaagatcattaccccccacacccaaaaaaaaatcaggtgaaaattgtgactatgcatacccagggccacacatataggtcaagagaaaaaatggcttcggggatattcagagattaaactattagcaaagtcatttttcc

SEQ ID NO: 10053 - DNA, 766 bp, Homo sapiens
gcctaggaagcgctgaactgagattcaaaatcctgccactttactaacaatgtgacttcaggaaatttatttaatccgagctaatttaggaccttctcattgctctgacctgggccagctactgaaatgaaaagcaaatggaccaagggtgtggacacagtagatatgagaagtaacagaatttatcagcatgattgtcataatacgatctaatgatcacaacattaaaactaagttgtatgtgtcatgtctttctactccattttaaatctcattttgtgtatgactgcatgggaggtaaagtggggacgtgtcgtaagttctattttagttgttatataccgtgattatcaaatgctcctataatgtgcttattgaataaatggtccaagattgttgggctagctaatttgcaatttgaaaaaaaatgattaaaggtgacaaaagtgcagtttacaaataattccctttttagaggacacaggaaaaggaattcttttctttctttcccttctctctttttctttcttttttattaatgttaacaggctttgtttaagccaaaatcatctttttgacttcccataaagtgtctggtttcagaaaaagtatgcaaagaatatttctctagaatgtgatgcctaaacttttcctgaaaaaacacaactaaaccacaccaaaacttaacttgaagcaaattatccacttgctattgttgaagacatcttttagaatcggtgcagtcccaccccaataatgggagttg

SEQ ID NO: 10054 - DNA, 810 bp, Homo sapiens
  misc_feature (1)...(810): n = A,T,C or G
cctgtgagaaacaccaaagtccattgaggctaagaatgtcccatgaagccacaaagtatgctcaaatttccccagaatttaatgacttttttccttgtatgatttccatcgcttgaatgtgggaagaatctgtatgtatgacaaaatatcacttccgtggtcatgtcatattgcatgacaaaaggaattttgtagacacaattaagattccaaatcagctggtattaacataaggagatcatcaactgagactgacctaatgacatcagatctttaaatctggatctagcagtcagagaaggagagggtcaaagattcaaagcatgagaaagattaaacatatcattgctggcttcaagtttgagcagtgctgtgtggcaagataaatacatggcctaggagctgaaaatagcctttggccattttccagcaatgaaatgggaatctcaatcctgcaaccacaatgaactgaattttgccaacaagaatgaacaccgaagtggatgcttccccagtgcttccagacaaaaatcccacctgactgacattttgatttttggcccttcttaggaccatcaggtaaagaacctagttgcatggtcccagcttttccatagaaactggtaacaaatgactttcggnattggtttcaagttaataaggtgtggtgggaatttggtatgccacgcttaaaaaacgaacaccagggcttntgaacattttatatgggattaattggctggctttttaaccttggcgaagaattgggaaattggttaattgctttaaaactttgtgtcggaggggtta

SEQ ID NO: 10055 - DNA, 132 bp, Homo sapiens
aagacttaatcacagatgtgtgctgcagggagaaatggtaaacaagagctttcattaaatcagagatgtcccacagctgtcaaaaggaaaaacaaatttctttgcaataaaatactggcctcgttggcctca

SEQ ID NO: 10056 - DNA, 862 bp, Homo sapiens
  misc_feature (1)...(862): n = A,T,C or G
gtaatcagataatatagtcatttatgtaagagtaaaggaagagcttattaggtacanaagaaaagactgttatttattagcaggaaaaaaaaactgttttgctactgtttggaaggcagatggaaatgttgggagtatcaatgccagcaaatctcacatgtgttacaccaacgaacttgaaaagtagtgggatgaataggccatttgccaaatgttgggacctgaaatagcattccaagctggacccaggggatccaagaccgaatctatctttcgagcttctacggattgctcaggaacactatggatctctcctatacaactctactattaactagagtagagccatcatccaggaaatttcaaagccaatgaattcaccattgataattagaataatacttggggtatatttatattattgcctttacataattggatatggaattacgacttaacctatatttccctatacaattgagctaaaaacaggttttagatctatagttgattatactttttgatataattcgcaatcagtaaatctttattaaatgttatattttatggatgggttacccgacaatttgatttaatatctaaaaaactgttatgaatacacattttatttctttttaatcgtatcttcttatataatgcaactttcgacatgtctatagtgaattttgcggttctacttgattgatatgtaatacgaatttaataatcggagctgattatgtattatcattgattgtatttttatcacgctctataatgatttgatgtaaatctttattttttatttaccaattaaaattcaatcgctaatgatacatgcgaaataatcatgtattattat

SEQ ID NO: 10057 - DNA, 199 bp, Homo sapiens
ttaatatagaattatattgttttattttatttaataattgagtagtactttgcactgaatcgatgagatgatcctgggccagtcctaaatacaggagagggcaaccctcaaaatttcaaaagcagcacgtttgtgccgtttcagttggagcaatgtttctaataggacgaatacaaagcagaaaggctatttttaacaa

SEQ ID NO: 10058 - DNA, 848 bp, Homo sapiens
  misc_feature (1)...(848): n = A,T,C or G
agagtgagtataaaaaataacaaataaagaaggggggggatttatagtgaagggggaaccttgaggggacacaggaggaagccgcnaagaggaaaacctgngttgctcagaagaaatgccatctagcgatgaagaggctactgctgactctcaacattctactcctccaaaaaagaagagaaaggcagaagaccccaaggactttccttaagaattgctaagatctcagaggcaagctgtgaacagaaaaagaacccttttttgctttgctatatacaccacaaaggagaaagctgaactgatatacaaaaaaataatggacaaacacaccaaaacctcaatagagaaggaataaccgataaaatcaagccagactgaataatactgaatccacacactgccaaaagaaggcggcagttaataacggaggcatcataaaggaaaacactataggaaagccaaaaacacaagggcggaatagaggcaaatgaaaacgaaaaaaagactcaaccccaaatacagaacgaaaacgacaacaaaacgaataaagaaaaataccctcaaaataaaaggagacaaactccccccatgaaacctgactcataaaaaagaatagcctaagaatgaaccacatatacaacactaccaatcacacacgccaaaactcgataaaagaggtgtatacaaatacaacaaaaaatgagagaacactgaaaacacaaagaagaaaaagaaagtaaaatgtagataaaccatgatcctcaagggtcgtaaatgataatgacacaaccctacaaatctagtagagaaagcgcgaagacgctagaagataatgaaggaaataaaag

SEQ ID NO: 10059 - DNA, 1196 bp, Homo sapiens
  misc_feature (1)...(1196): n = A,T,C or G
agggaaggggagagggggaggaaaggaaaggggggggggagggggggatgggagagacgggggagaaggaggaggttagggaggggagggagggaaaaggttttggagaggaggggcgcgtggattggaaaaggaagggggagtagagagtgcaagtttataagaggaggggggggaaagtgagaaggaaaacgtgagcagggggaccctgggtgcgggcgtgacgaacaccactgcggctagtagggcggggggcggggttcggaaggtcgagaagaaggagacttcgtggcgcgcgtcgggccgctgcggatgaaggcaacgtttaccaggcgtgtggcagggncccgaggaggagaggaaggtgggggtacgcgttatggggtgggngagcagagagagagaggcgggagggggaggggaggggcgacacggaggcggtaggcggaaggcggagcacgtggggggtggagctggtggcgcccgggtgcccgtgggtagatgaccagacggcgcgcggcgccggcccccgcacctcgccgccccgagcgaccgccagcccgtcagaaggtgcgcgtaccctccgccctcctcactgtttattgccctcgggctacagcgccacgcgggctaaggacagagtcggtctctctgtggtctatgtcgttatctatctatacgtntcacttggggcggtctgtagtaggaatggagctgcgaagcgatgtctnttgatcgcagtggaagcgcgcggtgncgagcgaggggatgtgtgagggcgggtttccgggccggcgggcanacgtgagtacctcaccacgtattctcgctctctcaacctgacacgcggacgcggagccccgccgcgaggacgcggnggccaacgacccgtgcgcaccgcgttggagagacagatacgagccnagccgcgtcgtggcgcgcgtcactagcccccagtgtacattatngatgntcgtagctccattgaagttacatggagtgagtnatnactgtgcgtagttgagctctgtcnaggtggaggtgcggcgacgagtgcggcgtgggcgcncaccagatcaggggcgagcgggatcgatgacggctcgctagcaggcgcgcgccncgctgccgcccccggagacgcgtgcagacataccgagctgaacggatgcgaaggagagctaacgagagacgat

SEQ ID NO: 10060 - DNA, 786 bp, Homo sapiens
cacccctgcacatgttcccacccgaggaagagctaagcacactgcagcggttcacactcacccctccaacgcagcccgcttccttccgggcgtgatgtggcagctcatggcttccctgggattcacgaggccctgggaggcagacggagcaggtgggcggagcctggaggaggatggaggagaagaaccggagcccccacggggcagggctgccattcgtctgcctctctggaccagggttgctcctccaggctaaggccggctgccgaggaggctgtgctgggcctggagtcaacaaggatgcacgtgctgggggccatcagctgctgctcccatacaagcatctgctcccaccaaacccacagggcttggctgccaggccttgctgtgtgcccactctgtggctctgttctttgtccctgttgttccatctgcctgctccaccggctgcctggctcaactcctctcggcctttttatttctctcggaatcttcttcctgttcctcatttctccccatccttctccccgtctctgtgcaaccacattcatgccctggtcttcgagaccttctttccttctctgaccttatcagccatgccctttgtgtgctttttttgcgtcctcccccatgttcattcttcctgctctctgtcttggctgcctttcattgctattcaacagcttccttgaaacgccaccttacttattctcgtgtgttaaatgcctagaactgcttcaggcatgaaactttttagccttctactgtaggacgcaacttatatat

SEQ ID NO: 10061 - DNA, 846 bp, Homo sapiens
tgttagatcaatatgcgtagcacagtgttgaatgctaagagatgtatgtaaacactattaggtggattcatttgcaaataactcacacagcatttgaccagtaaaggtatcttagaatcatattaaccatgatgactcagaagaacaccttataggatttctgctcctaagatttgacaaagactctctggcagcttcaggaacgtcctgtttaactgagcagagtttacagaagaggaactggctgggtgggaaatccagatggaagctggcagagatgagcacaaatgcaaacaaaggcttattgggcagattctatgcggagagcatctcgaggtcctgacgctgtgtgtggtggttatactgactgtattccctggcatttgcgataggcataaatcaaagagaaatgtgatgaggtatttctggaaagggggatccataagcgcacttctgcatagggaagataccattcacttgccgaagtagaatagatgctcagacaactccaggattcggtggggaattttcgagaaatgcattctgaattcataattagatttcttagggtccttctataataaatatatggccatatctcgcgtctgtcttggcattgtgttgatttgtaccgtctctgtcgcacttgttaacacttgaagtttctaagatagtaacacggaaatgcagaaagataaaatcggtagacgttctccgtctataacattaccgtcttaccatcgtttaattggattgctcaatctgagtatatagttattatatttatcgtgacgtcattatttatatcgtttttatgtgatatgaagtatgtacgttgatgttatt

SEQ ID NO: 10062 - DNA, 270 bp, Homo sapiens
cctggtcgcatcccatgcaataagttaagaaaaaagaaagtaaaagtctacatctggaaagaaggaaacaaaactgtcattatttgaagaagaaaaaattatcttcatgatatatctttcaaaatctactgaaaattttttagaagacagtttagcagtgtggctgaatgagcagatggacttagaaatctaagaagcagacataaatctctccatttttaagacagagaagaatagagattaaataaaggcatggcctcgttggcctca

SEQ ID NO: 10063 - DNA, 339 bp, Homo sapiens
aaataatattaacacacacaataaacaagcgcccgggctattgcaacaccatagaactttaggccaactggatctccctcatcaaagatatggagggcagacagctgagaggttgggatatgatattagccagaaaggatgcattgagaattcatggacctgtgcaggaaaatatggtgcacttattgaacaataggcaaatatataagtacttctctactcattattctaaagcttcatcagtaaatcactctactttacaggggctaatgaatgctgtactatattttaaaattaaattgtttactttgaaataaaaaactggcctcgttggcctca

SEQ ID NO: 10064 - DNA, 753 bp, Homo sapiens
  misc_feature (1)...(753): n = A,T,C or G
aggcaggctaatgatgctatgaaatacagcaggaaagctggatctacagtcaaaggtgaagaggaccagggtaatgaatgagaaaggacagataccaggagaaacctccattctcatctggtgttgccattcaggatcttcttggtcaagagcaagtcacttcatctcactacaattgaggaaataatgcctaccttgcaggatgattgtcggaactgcctgcaatcatatccctcctcctagtagcagcatccaatcaataactggttgattagatggggctgggtataaacacccaggccccatgtctcagttggagacaatcctgaaggacaactcccacgggatagtgggagcaggtgacgcctttgctgcaacttgcatcacggatcaactcttccctctgccagagcctaccaccttaactccttcagcggttctgattcagaggacatttcctgattggggaatttgctggcagtgtcctacagcttaaactttggtctcactcactaggcttctaggggacttcccccctcaacagaaccatatcaactgctattggggggagagtctatcaagaattctcgtacaaggaaagactctcctagacaagccccccgcattaataccacgatatgtatggcctggtggttcaaaggcgagtctcgattggctctcaacatcgtcacctctactggaaccaaagcataagagggtttctcttatgtgtatcgacccgcncatgttgta

SEQ ID NO: 10065 - DNA, 1172 bp, Homo sapiens
  misc_feature (1)...(1172): n = A,T,C or G
gatgcatataatcccgctcgcatgtgatacccggcaagggagcgggcctatggggtgacttggtgggcgcttaggaagcccaactgctgagcatagaccgagcaagtttttctaatgaaacagccatctctgagcctgccttctctaatagaacaatgagatactgaatagaggagaaaaatctgggggcacgactgagcaatctcatgactcgaatcgttaattaggactatggctgtactactacgcaatgaccaccttaaatatcaggagcggataccgtgacacctcgcgtgattcttgattaagctatagcaaaccgtgaacgagagcgagaaatatgagaataggcccatgaagcgaccttgcatatcagagtctctgatcatacgcacatattagcatgcataccaacaacagacgaggatcgcatatcaagaataggaatatgaatatgctgcactcgagctcgcgattgagcagaaagacatcgctccacagtcacaacaaacaccctctcaaaccaatcgtagacttcaaacacgaagatcgatcgaccatactcactccacactatgagagcttccgggagtaataccgacgcaccccccgcaacgcgaatcatcaacgactgctataaatcactcacgcaacatatactcgcnatcataacgtacatgagatatgatcctcacgacgcgctccgagtcaaagcaaaacactgccacccgacaacacaacgaacatgcaataacatcaatctctcaccgacgactagcgattcaccgcgccgccgctccaccacatacgctcactcaaccactaccaacacaacaatnaattacagctctcacacgagcggcagtactagccgacatcgtctcgacggaccatatcgaacagcgccaaaccacccgttagcaantacaacagagagcctctgctcatcaccacagccactcatgcctgctctagtcgcnacctcactcgccacacatgacagcgacgcttacaacgtanggaacacaaactggctaaggcgagatgagatggatgagacagtaacgcacgagcgcacacacactcacaacacacccgagcagaacccgtgccgacggaacgccacccacgctacccactcgtccatcaagacctcaatcgcggatatcgag

SEQ ID NO: 10066 - DNA, 888 bp, Homo sapiens
  misc_feature (1)...(888): n = A,T,C or G
ggtactgaaatagaaggtgagtcagtaaattataaatcactgtgtnngtgtgtgcggtagatgtcggacgcttgggggtgtgctttgtagagtngtccgttggttgtagtgggaaggtcgatgtgaggtgccatgggcggtatgcacaagcacagtgaaggtggcgcgttgaggactgctccggactcgagtgagagcggggagacgtgacatgccgagagcgtgagggcggggagctcgagagaatccgttagnnacacccgacgccgacgacgcagncgcagattggggatacacttggtttttcagacggggnatcgtgggtgtcgtaggagctcgtatccgtcgattgcgtatcggagggagtaatggaatgtagaagtggaaggggaagcgggangagagggggcctagggtgggcggtgctggaggcgtgctgcagcgctagggcgggatcttgttgaggttggggtaaagtgaggatgtggtgagcgttcttacgcaatccagctaaggcatatccggctacaccttcgagcttattagaaactcctncagtttgaatacaatctactcatcctgcgctnacttatggttattttcatatttactttattctaacactatttcaattcttaaatcaaggtaaatcttattttacaagtcttgcgagtaatacggcataaactgctgtaatacccatatcttgttaatttcacaattcttaaattcatattgtcttatccacccatagttctccccacagtgacaatctcactctctcttctgggcatggactcttaacatttttcacncgactttccctagatncnnnttnnccttcctcccnnncccctctcctcctnncctcctnnnnccctttncccc

SEQ ID NO: 10067 - DNA, 1459 bp, Homo sapiens
  misc_feature (1)...(1459): n = A,T,C or G
ctgttggtatattctgcgtgaacatgtcccagatgctagaatggctgtgggtattcggaaaccaggaacagcgcaacatggatgaatattgcggcgttcatgtctgcttgggaaaaggaatgtgacaggaagcatactccgcgatagatggtgtggatgtaggtatgtacacaaaagctgtctacacaccaatggtgatcacagtgcctacccacaggcaagttacagtggagtgcgctggaggattgagaggcacggagagggttgtatgtgcgtgatatgtatggcgtgaggatgcgggattgggtatggtggatgtgatttgcgagaagtgaatgaccgggctgcgtgacgtggagtgggagatgggtgacgtgtatggtgtagcgtatatgagagagggtggtgccgtgcggcgtcgcatgtccatgcttgcctcacgcanacatcgnctatgcgtccctccgccggtcggtctacatcgggcgtagtgaggcgtcgtcgcaggcatcggtctactcacctttttacgccgagcagcgtgtgagatcgctattgattgcgccgcgggttcgacgttgcaactacatactcgactactatcggctcccgagtgcgtcgcttcctctgctgcacgtcgcgctattcaacgctataatcgtcggacaaggaacggcgttcgtggagcggttatcaatcgtaccagcaatattataccgccagcatagataccgctgaaagctcacatcacacgagtgaccgccacgaccaatacgcgatgctcacgtcgtgcagtggantccgcgctcaaatccggcgggcagcacgcgctcgcgcgctcagtgctcggtgtgcatatatattcaattacagactcttgccacgactcccgccgcgcagcatatgtcccgctctcagcgaatagtgtcgacaggcagttctatgaacccgacagggcggcgcgcgatatatacttagccgacgacgatnttatctggtagtaggcgcgccggcgcaatttagcgcgacatacaagagcaacgtaaccgcccgcctgcgcgatctgtcgcgccatcntacaggatatacgcagtcgcgcggtgcgcgtacaagatacccccagtctcacttatattccgcgctcccggcctctcgcgcgcgaccgtatcgcgtantgtgcgtatctatatcactaccncacgtagagcacctgctcatggcgtcnagcgtgcacgcgtagttgtatctggcgnacctgntccggttctatgtntatatgtacgagcangcctgcgccgncgctcgacgcgcgnacatnantcacgcanccatagtattaatcagtgancgccgacgatcgcgnactgtcgncgactcagcaataatgctctggagtatctcccttgcgatatcngcgcgcacgntctacgcgtatgcacatctntatagcaactangtt

SEQ ID NO: 10068 - DNA, 841 bp, Homo sapiens
tttctcctattagtccccattattccttcctcgcctcgccgcgatagaggcacaccgctagagtctaacacactgtgcagctgtttatttcaagcaaacaaaaaaaatagaataaacacaagattcttctccactatcccaagtctgacacagacacacttggctggaatgcaatggtgatctcggctcaccgcaacctccacctcctggattcaagagattcttctgccccagcctcctgagtagctggtattacaggcaagcgccaccacgcctggctaattttgtatttttagtacaaatggggtttctccatgttggtcaggctggtctcaaactcccgacctcaggtgatccacccgcctcagcctttcaaagtgctggcattaatagacaagaccaatcatctgcaaaataacctctcattagtgggtttatagatgtggtactacggacactatggtacttcctgagtttctataaatcaaaaactatactgatttctcacacaaatcatatgcactaaaaatattctgagtgatcaactatcatataaacaaaattttaaccttagctacctgctatcagaaggcaaaatgtgcgggagcctatattccaaaacaataattcaggacaatagctcctttctcatgccaccgtctccaatagctattatttatcgcttgcaaagaactctccctaacactgtccaaaaattttaggcatcatccatagcaattctgatcccactgatttgaaatgggtatctacaaacccacgcactctgcggctacaggaacacattctccaactccgaatgaaccccgtcaacctaaaccgt

SEQ ID NO: 10069 - DNA, 825 bp, Homo sapiens
  misc_feature (1)...(825): n = A,T,C or G
ctagaacagtatataaaaatacaaataaaaaccaaaacggcgggcttggtgtgtacgganggactttaagtgtggagaccgagagaatagataaactggggaacagcaagacaagaaaagctggagcccacaaacaaactgtgaggtccactagaacagaatgaaaccatgttagtactagttgcttctgaccttgatggtgccagtgtccggcagaagttgaggtccttcatcactaaactgtgcacccacatctagccccgcattttattaagctgaagggaaaggtgaagcaggtggccagccagccatggccaaggagataaatcaaaaggaagtcagggaccccaaatggagggaccggctgaagccatggcagaagaacatggattgtgaagatttcatacaccttgattagttccccaaaataatacttttataatttcttacgcctgtctttactgcaatatctaaacataaattgtgaggactccatggacacttgtaaatttcgcgagtaataccctagtgattgactatgcccgtacttactttagccttttaatccaatcattttagcatacagaagaggatgtttgtcccctaaagacccttggtatattgcctatacatgcacaaattgtccacaatgttgtgctcagcaatatgttatattggcatctttgaaatagatcaggatatcttgtcttttcctgaaatcaccaaaaatttactcataacttatactgctggtgatacaatcctaaaatatactatctatctatctacaaatcccaagggtgagatatgttctcagttttgtta

SEQ ID NO: 10070 - DNA, 883 bp, Homo sapiens
  misc_feature (1)...(883): n = A,T,C or G
cacctacaaactccaaaggaatacaatcaccacaaacaccccacaccctagaagccaacaagcaccagactaaatcgcacaacggctctagccagatccaggtgaacaccccatcccgggccatcaaggagcttccatgcctccactaaacagagcagagtgagagccccatgatccccaatcggcacgggctccgcctaaagaccagcatgaagctgtcccacaacaccagaccatcaattacctctcactcccatggcgaccccataattcccaacggacaaaaggcataaaatctccagaccggcagacacaaccaaccggctccactccaccccacctaaacatacgacacgtcaacgcattaccgcacccaagcaacatcatcgacactaccccttcaaatatcccacacccaacagaacaccacacaaacacaacaccccacccccacaacacccccacatacctctccctcacgccccacagaccatatcgaccaccacctctcgaactcccccgaccacgtgcggagggtcccactcatttccctccaaccccagacacacttcgcccctcagcaacacaaaataaaccacaccacttcccgtccacccctgctgccntccaatcgacccgtcgctcccatcacatccgacccgcaataaaacgacagcgtccgcccacacatcatccatttgccacatccatccacaagtcacactcacaaccaaccgaccgcctataacaaataccaacccccaacaaaacacatcgtcgcagacaagtcctcaaacaagatacacccctcccacaacagagtcccgacagcaaacaatcaccacacacccaccccgacacacccacccgcccaacgtgatct

SEQ ID NO: 10071 - DNA, 745 bp, Homo sapiens
tcttcgctttttctgtccgggtacttaacgctgcgcagatggggaaaaccaaaactggtccaactttctaagtacccacatccggttgagggctccggacgggtgtaggccgccgttgcattccgccccaaagtccatcccaggtccttgtgggcacaggggatggtctttgcaaaggatggtgaggccctgccccaggtcagagtcacgcctctccaccggggctcccagaggtcctcggtcagggagaaagcctcagtctgtcacccagactattatgcgattccctgcgaaaggagtggctatgggggtccggaaagtgggggatcgagagcagccacactgagaagagaatgcagcgaaaaagtaaatggagtggagctccatgtgaccagatcttcgtagacaaagcagaatggagtggagctcaacgtggccagatcttcatagacaaagcagaaaggagtccgctgtacaaggggcccggcctgaggaggtccctgtgccagagtactaaagatgggcccctgactggcagcacctccatccagcagcagaggggctgaggaagctcctggcttcagagttcctcaggcctcaacttcctctgcctgtgactcccccacacccacatccgggcctctgctggttcctgggtccatccatcccagcgcagccggcagggaggctccgagcagtgtgagagcgttccaacagccagctggttcatttgtttccgtcaagg

SEQ ID NO: 10072 - DNA, 747 bp, Homo sapiens
catacatttttcctaaagaagacatacagatggccaacgggtataataaaagctgtcaacatcattaaacatcagtaagataccaaccattttggcaccagagactgttttattagaagacaatttttccacagacagcagaaaaaaaacagcaatctgagacacagagaaggaaacacaagaccagctttggcaggtgcatctatttttcttctattgagtactttccattcgatcttttctccaggacaattgcatgtcggccagcttgagaaataaagggacagagtacaaaagagagaaatttaaagctgggcatccggggaagacatcacatgtcgatgtattcccatggataaactagaaatggtagttaaaaggggaaaagaaccacggaattgaagccttgtccttggcttttcattgcttaactgggagaaaagagctaccagagagggacaatctgcaaccttcttgttggaagtgaggtgttttgtttaattttaaagctgccagcaatagttgtctttttgggccttgcaatcactgaaagctaggtttgggtctggacctgggccatgacagagtcacagagaagcaaaatggatccttccactccgaatggcaatcatcctgactgaatgagaaattgcacaggaatgcttattaaaaatcaaaactcctaaagttttctcacttaattcaacgttaaaaaataatgataaaagtgaaccttttccttgtttt

SEQ ID NO: 10073 - DNA, 874 bp, Homo sapiens
gaggcggttatacaaccccgcatcagctttgaacgcgagactggaaaagccactcttccacctcattcttgaatgacctggaaggttgattagcacatcctaattcactccagactatggagacgatgcagcactccatcatcatcacggacatcgcacacccatgggattcataagttacatcggaaataattaaatccttcccagtggccttcttgaaaatagttgtgatatggaaataaaactaacctcatagataagcaccatgtaatacattgggggggcgctcaaaccgagaaaaattgataacaataatactgtaacacgacagtatcgaagaatgatgagcgcgcgcagtcggaggcaaaccaacatggggaggtggggcgccgatgatgtggagatgggagctacataaccccccccgtttttggtggccgcccccttctaactgtctcccacccaaccccgcggccaaataaaatgttcctccctgcccgcccgcccgacgcaatggtctcgcctgggggagcgcggaggtggggtcaagtgcggcgagtgtgtgatcccgaggcggactgttgatgcggagccgttcacagctcagcaaggggtgaaatggaggactccgcgggcggcgtcgatgcctgttgaacgatgcctaggtacggttctcctccacacacctagcacactaccctaatcaggtctacgctaaacaatagctagtacttgatgtttattagaggatgatatatcacaatatactaccagcctaagccgaaagtagtctgaaggacttgcttatctactccagagccaagatccggcacgtggacctctccgattgtgcggtagcggattgcctggcgtg

SEQ ID NO: 10074 - DNA, 277 bp, Homo sapiens
gctgactgagagagcgagaaaatgaacaaagcctccaagaaacatgggactatgtgaaaagaccaaatctacgtttgattggtgtacctgaaagggacggggagaatggaaccaagttggaaaacactctgcaggatatcatccagttgtatggtactgaattttggttgtcatcaatttgaattagatttttataaacgtatgattttaaatacaatgtcaacaaaaatctaaaaatatacataaaggaaataaaaaactggcctcgttggcctca

SEQ ID NO: 10075 - DNA, 825 bp, Homo sapiens
tgaccaccgcacgtaacctgctcccaagaatcaagctcaggctttttggccactcaggttccaagaaaagcagccttatggactctctcaagtgtgggctgctgaggagctttctcaaaagcctttggtgacaagctgaagaacccactccaagttgttctgctggcttccatgcggacatcatgaatgttcctgaaccagctggaggcgagtttggatatgacagagatacatcattgcctgaaagggatccaggagtaggtgagggccagcgtgctgcgccctccaacccacgggggagaatgtgttcgccagggaacttgcttccacctctctaagcgttctgcacaggcaacatctgcgacgccggcggacaaccctaggttgccccactttcccctcgactaaacttggtacgccaggggctctgtgccggcgaaaaaaatacgtcttctgtccggacccctcgtctgcggccctcgagatcgcctagttctaccggtcgtacggttgtgcgtcacaatcttgctctcagcagggtcccgtcagaaccaatcaacctttcccacctttcgatatcgagtcgttacacctgagtgtcatgtcactctgcgccctgagcctccagcttcacagcactcacgatcgaccctatggagtcgcgtcctaacagaaggttgagtgtgtactgacgctattcggccggtgaataacttggtttcggcgaaggatggcgcccgggccgtctctggtggttcggcgtacccgcagtgtgggagcacgagacggtcgggataagtgctcttctcgacttcccctgctctg

SEQ ID NO: 10076 - DNA, 914 bp, Homo sapiens
ttatgtgctactgctgggaacttcataatgctccgctgatttcagatataaactgtgaagccaacatcgggtgtctgtgatttaggccagggctatattcaaagcatagcctgtagaccagcatcatcatcatcatgtggaaccatattacagatccagatgctgtcggctccatcacgagacctactcgaatcggcaccctgccgcgaggcggggctccacgaacgttgtgctcaaccctcgcctcccccatgcacacgtcagcgctctcacccgcgtcttcgccgcgacccgctcacgcaccgcatttcccaccgagactaattccggctcgggaagggcgccgcggcccccaacgcagccatcgaatccgctctcggctgccacacacaatgcgtcccgcgggcgcggaccgccggcgccgcccggagccccgctgccccaccccgcgtccgactcgaaccgcccccccctggcttccccccgcaccaacatgtcaccgtctagcagctccacccggtatgagacacccgtcccactcccgccgccccacctccccctcgtctcctcgccatccccacgcccgctgcacccctccccgcgcgacgcgtcgcgccgcaacctaccacgttagctcccctcgcgccgccagtgtcacatcgtcaccgaccaagccccggcagcaccatccgcactcctcaccagccctcttcgccaccaccgcctcccaccctagcgacgacttctaccctatgacgcaggaagctgccgcgcgtccgtgcacccgtatgacagacggtcacccgcacggaaccacaccactccatcggctacgctcagcgacacacacgcatacatcgcctctgtcgtcctactttccctagctcgtcttagccccctgcgcccatgtgacg

SEQ ID NO: 10077 - DNA, 1351 bp, Homo sapiens
  misc_feature (1)...(1351): n = A,T,C or G
aaaaacgaacaaagcaacaccccccgtaagaaaagagaagcaagaaaaaacgcttaggaggaaaatgcaccacaacaccgtcaaaaagggcgaaacggnaggagggagaccacacacacccaaagcaaacagcggcagagagcaagaaaacagaacgacatagcgacaagagagagcggacaagcgtaacganggcacgcgagcatagcaacacgaaccggcgcgaacaaaccgaagacacaagaacaaggaaaggaccangagacgcgaaagcctagccacagcacaaaacagaagcagcacacacacnacacgagggcgcgacggaagcgcacaggacatgcacagcgaaaacgagctgttctgtatccgaaacaagcgcacaacgcagaccacaaaacggaacactcgaacacaccaccaaagaccggcaagacagcgaaacacaccacagcagaacgagacagacacaagaacagcgacaggaacagaccacgngaaatacagacaccgcacaacgcgacaaaagccaaagacggcccgacgacaagcaatgtccgacagaccangcaaagctcggacaacagcatacagagaggcacgaaagcgaacagagaacaacaacgcagagacaacagcagaagcgaagcaacgagagccacaccgcaccacaaccaccgccaccagcgacagcgacgcacagacaccacacacgacacaacaccacaacgccgacagcgaacaacgagaaccgccacaagcaacgcagcaccaagcgcggcacgagaacacaacggaacacacagagaaaacacgatcaagacacaacagcacgccagangcgcgcaccagagcaggacacccantacaggagagaagacgtgagcggagccacaacaccagagcgcacgagcagcacgacacggagaaccaagaggaaccgacacgcgccaggagcgagcacaaaagaaggcgagacggaacaaagcgacacagcaaaacgacacacacgaaacgagataggagaacagcgaacacaagacacacacacagagcaacacaccacaaacanacagcgaaaacaacagagagngaagaagagaccacggnagacacgagcatcaacacacagaagagataagacgagacaacagaccgataccccanaagagaacacagaacacgaaagagagagacgaaagacagacacagcaacgnccaaccagatcaaagaatcaanaagagcacaacaacgcagcatagcatgacagacgcagcaggctcacgagcacaacactangcagagcgcgcgcagacacgactatcgagacacgagtacgacacgagacgc

SEQ ID NO: 10078 - DNA, 767 bp, Homo sapiens
cggtttgtaggtggtatgtgtgtggacacttggatctcctataggtttaggtctccaaaaatttggggtctcacttttatatataatttgaatcaggttcgtaggtgtatttgtgatagggggcttgagaatagtatgttgcagacaaagtcatactttgttctggttaaatgtctgggttcattacaaccaagttcgtggtctgtgtttattaagagccgtcaagcccatattatatagaaaatgtcgagtgtcagaaactttcaagcctatataattaatgttctaatttaatgaagtatattacagttaattttaagtaacattcttcgaattcaattttgttaaaatattaaaatcaggtgttaggtttaagtctttgatccatcttgagttgatttttgtataaggtgagaaatgaggatccagtttcattcttctacatgtggcttgccaattatcccagcaccatttgttgaatagggtgtcctttccccactttatgtttttgtttgctttgttgaagatcagttggctgtaagtatttggctttatttctgggttctctgttctattccattggtttatgtgcctatttttataccagtagcatgctgttttggtgactatggccttatagcatagtttgaaatcaggtaatgtgatgcctccagatttgttctttttgcttagtcttgccttggctatgcgggctcgttggtggttctcatatgaattataggattgttctttgcaagcatgaggag

SEQ ID NO: 10079 - DNA, 805 bp, Homo sapiens
  misc_feature (1)...(805): n = A,T,C or G
cctgatgctcactctataatgacagtggtgtgcccatcatttcctggaagattgccatggctgcttgggtccacagtgagttctgaatcttggaattctacaggcattgaggctgagagacagcaaattcagagtctcgctctgtcacccaggctgaagttcagtggtgtgatcatcagcctcaacctcctgggcccaagcaatgctctcacctcagccccccaagtagctgggattaaagatgcacaccaccatacccggacagaccaccttgcaaaggacagctgcatactcaacctgccgctgtttctcctggaggccaacctggtgaccttcctcttccctctggaccgcctgagaagggcggcagaaaaggagatggtgacaagatgcctctgcacaacctcgccatggttttggccccatgatgctctggctntctagtcttcattgctttgtctccaactcaagcatagtttttgtttggttgtttgtttggttactcattcttgagaggaagccattagctttctttggatgctntggatttatcctatgtgactacaccagttatcaaaggatcacttgctgttctttttcactaaaacacccccacttatgctcattgtttaagtggggggcatatttgaactccaatactaattgggggatcccaggtttatatgggggaaagacgaactcccctcacttgtccctgagaagggtatagggaatggaaaggacaaggcgcatgtggctctcccaattgccaaggggttgctcctatgaggaactccgtgaattt

SEQ ID NO: 10080 - DNA, 552 bp, Homo sapiens
ctagactcctcgagagatgaggatgtgtgcgctcaagtaacagtgctgtctgaaagacttagagcaacaaggtggatctgacaagcagttgaccatgaacaaagaagttttgcaacctccttggacccctgatgacagccagatgtctgtggcctccagtcacctccagaccttcaccccctgcatggtccctcttcctctaatatgaaagaagcctaaaaaaatctatcaatctaagttggttctggctgggcacggtggctcatgcccgtaatcccatcactttgggaggcttaggcaggaggatcacgaggtcaggagttcgagaccagcctggccaagagaccagcctgtggtgaaaccccatctctactaaaaatacaaaaattagctgggagtggtggcgggcacctgtaatcccagctactcgggaggcctaggcaggagaattgcttgaacccaggaggtggaggttgcagcgagctgaagattgtgccattgcacttcagcctgaacaaccgagtgagactccgactcacaaaaaaaaaaaaa

SEQ ID NO: 10081 - DNA, 399 bp, Homo sapiens
  misc_feature (1)...(399): n = A,T,C or G
gtgctccacgcgtgtgaattacctgtcaccaagacgcgagananccttgacttgccatccccgccaagcgcttctggagctgcccctggagcaggtgcccccaccgagagtgatggaaaagcccgtcctcgccacctccaggcatggccagcagcgagcggctggctctgcaggagaagtgctgggtctgagctccgtcacggccgctcccgagagcccgaggtccaagcccaacacgacttggaataaatgatcaagttatgaattaaacacaagagaaatgtaattaccacaggagccagctgagaataaaatggattacgcacatcacagtcattaaacggtgatcacatgcgcctttctaatgtgctgccgattaaaatcaatagaagtgcaaaa

SEQ ID NO: 10082 - DNA, 837 bp, Homo sapiens
cctaggtgaatcgtgcagcagtgatttatacctcaattagctgttaaaagaacagcagctatggctctgagtggggagagtgaagatccaacacctctctagcactgaagaggaaatacatgaaacagtgaaaaatgaaacctggcatctcaaaaagcgaggtgttgtgaaagctgattcctttacattcttactaccaggaggacatcaacttttctcttttagttcacttggttttttctttctctttcttaagtaacatgtaagaaacaatagatttccattctttcccagcactgacactgcctacatctttcgttatgaaaaaaattctcccaacttctccaagtgtacccgtctgcaaagcgaaagtattaattaataactgttctaagagactcacaacactgctggaaaaatccaattagaaaatgcacacaactagctgaggtaatggtacaattctaaagaccggggaaggcccaagctcccttcgccaaatctctggcttgaccaccactgaggagaatggcaccccttcctacggtgaaaggcccaccaatcgtccgaccacaaatccactcacgcaaaaggaaaatctcaatcccgcacacccgctagtgcatccctacctgcctttttcaatcctcaactactgccttgccaactcttcctcagaccactctcccctccctccactcccgccccgtcggaatctactcctacaacactatcataaccacctcctacctttccctttcctccctcacatcattctcacagttcaccgtgcctctggaatgcccaatgctattcacacatcgctcctctctcctc

SEQ ID NO: 10083 - DNA, 257 bp, Homo sapiens
cctagggcaaactcttgctatgtctcccaggctggacttcaactcctgggctcaagtgatcctcctgtctcggcctcccaagtacctgggactacagatgtgcaccgcttagtcaatttttctttatttttattaaagtataattggcttatattaaattgcatatattaacatgtaatatttaataaatcttgatatttatgcacccattaatctatcacactattaaatatatgtgcaatgtaaaaaaaaaaaaa

SEQ ID NO: 10084 - DNA, 845 bp, Homo sapiens
  misc_feature (1)...(845): n = A,T,C or G
gaagacacaagacaaaagcacgaagaaaaccggaaaaaagcttgaggaaacgnaccccanngcttgggggncngacgggccagngcngcccaagccgaggggccaccaccgcacacggcngcgaacaccggcaagccaccaccggaacccggaacagccaccacgagccggaggcgcccccagaagaacccaaaaaacaagggggagcccgggcgccaagaaaaacagcccaacccagccgcacagccgggagcccccaacgcacccttttaaaacgccagcaccaacgggagcgcgacccgccacgcaaaagccacaaccaaggaacagaccgccaccaccgccgcggaaccggacacgcacaaccgaaccgcccgggccgaaacccccaagaccagcgaaaaaaaaaccgcaaccgaaaacccgacacagacgaccacaaacacaaagaacaccacaccaagacacaaaagcagacaacccgacgaacacgacacccacagagaccagaacgcaaagagccgcggaaaaccggcggcgcaaaggcagacggccggggccaaaaggcccgagaagcgaggcggacaacgaacaaaacccagagcgcaaaaccacggccacgaacaaaggaagagcgaaaacaaaagagacaacccacgccgaccaaaaaccaccccacacacaacagccgacaccgcaacaaccacaaagaaagcggacagagaaccaaagcccccaaaccccccagagacccaaacgcgaaagcggaccacacaacccagaacccccgncgacggcgcaccacaccccccgaccgccacgccacccacgcccgaaacgacccg

SEQ ID NO: 10085 - DNA, 192 bp, Homo sapiens
tgaggccaaagaggccattttttttttttttagtttgtaaataaaggccatttttatttttggtctgttatgtgctgtaggcagagcattcatataggaatttttattgcggatttctatgactgcatccccaacaagctcaatgtacatctgtggccaaagcttctgcaaagcctcatgatgtaatgttat

SEQ ID NO: 10086 - DNA, 716 bp, Homo sapiens
aacaattctggaggcatacattacctgatttcaaactatgctataaggccatagtcaccaaaacagcatgctactggtataaaaataggcacataaaccaatggaatagaacagagaacccagaaataaagccaaatacttacagcctactgatcttcaacaaagcaaacaaaaacataaagtggggaaaggacaccctattcaacaaatggtgctgggataattggcaagccacatgtagaagaatgaaactggatcctcatttctcaccttatacaaaaatcaactcaagatggatcaaagacttaaacctaagacctgattttaatattttaacaaaattgaatttgaagaatgttacttaaaattaactgtaatatacttcattaaattcgaacattaattatataggcttgaaagttcatgacacctcgcatttctatatcatttgggtttgagggcacttaataacagagtcaaggaacttgggttgaatgaactcaaaagttttaatagtaagtttttgacttttccaagccaaacttatttcaaattccttatgaaaataagtattcagtcttgatttaaacatttataaaatatggtgttgatcattccatgggtttattagataacttcaagattgtgattttaatttcaatttgaaagcgaatatttttgagagacatctactttgattctcaacacaccttgaa

SEQ ID NO: 10087 - DNA, 537 bp, Homo sapiens
  misc_feature (1)...(537): n = A,T,C or G
ctttatggatagtaacgtgtgttctgcgggagggggggtcgtatccaccttagaactgattatgggagcactgctggatgcctttaatgaggatagctgttatggcttcaaaaacaggccgcttattgtagagaaggctctggtgtactcttgcaatnctaatccctcccagaatgaaaaacaacggtttaaaaccccaaggcctttctttgacagtggctaagttatctgagtattgctgggctactgatcgaacgcttgtttgcttggatatttacaccacaaaggaaaaggctgcgctgctatacaagaaaattatggaaaaatattgtgcaacctttataacaacgattaacagctatattaataacatactgctttttcttactccaacctggctaacagcgctggttattaatatcattgctcaaaaattgcggaccttaaattttttaattggtaacggggtaagaagggattattcgatgcttaaggccttgactagagatcttactctgccgtacccaattgtgggac

SEQ ID NO: 10088 - DNA, 1188 bp, Homo sapiens
  misc_feature (1)...(1188): n = A,T,C or G
cttccctcctccactcctttcttctcactctctcaccgcaaggtctaccgccgtgtggtcggacgtggtctcgtctgcgtactgnacattgaccagtcacgcatccctgtccggtcttccgtcgacctctcacctgccagtgccctctattgtctcataaacttggtttacttctatgttgactgtaagcgcctagttctggtgatagtgtcgagcattcgacttctggtatctcgcttctgtgcgtcttatcgcttatcgtangtaaggtatatatatgtactaaggtacgtagttatctagatggtgaatctatcctaactgactacantcacagtcgttacgacaccgcccgagaattgctgtacactgagcggcgtctcgacggccgagcgcgcttacccacgagccttcgacgtcgtccgaaggaagnagtctcgtcgcgagtaattgtacttgacctgatcctaactacttcagcttgtctatcttgtgcagcctantggtgtggaatgtgggcctgcggttgctcgggtagtcgccgtaacgctccgtcaccggtcctcgtcgatcttatctcgcgtgtcgtgggatgtttagagaatcacttaaangctcaacgctgtgcttctgtcgtctacattagtcgggcgacgtaggagtatgagatatcccactctgtgaagacaaatatatccattattcaacgatatatcagcgaccacccacccatgnattcttctctttgtgcacctacccatcctcttctaatacccatcttatattaacattacctcacaaaaaaaaccntntccttcttccccctcctccacttctctcttccctttctgtctctctctctttcttcgtcgccctcgnnccccncctcgncgctctcttctcttttgtntctttttcttcnncttctttntttcctttccctccttcctcctgcccttnnntttccctcgccagtgctctnttcttttgcttctcttncctcccttttcctgtgtcttctnttcccctttcccnntcgtttcnnttctgttcctnttcttcgtcagtttctctccgcctntaggcttcctttcgtnttcttcttcccaggtttttttttttttttttcttcttnttgattttttttgattttaanttntntnnantanaataatatatattttttgg

SEQ ID NO: 10089 - DNA, 141 bp, Homo sapiens
atggagacaagagagccaagattcaaacacaggaagcacaacagagcccatgcacttaatcttcacactgtgttgcctcatccagcctgaatggttagggtcaatctaattatatatgtcattccaataaatgacttttgt

SEQ ID NO: 10090 - DNA, 576 bp, Homo sapiens
  misc_feature (1)...(576): n = A,T,C or G
tactttctggacccacttaacaatcagaaaaatagcaaaagaagcagcatcctctttgacttcctctaccggatgtccgctattttaaaaacagacatgtagcagagattcaaggctgcaaaacaagatgaattgagcagaagaagatcattagaaagaacaatgtggcactcatcattttgtgctgtcacagcaccatctgtgttgcaccagaccagagtaactttgacatgacaaataaacctcttaggggaaatggggattctattaattgttccgctgtctggccaaacactagtgatatactctcccctaatgcagccccatacacaattgttattattgaattaacaatagcaatgagttatgatttttaaaataacatttatttcccctggatgaaaaataagacttaaagtatcatagtctcaccagggtggtatanatatatttatgcagtctcgtaattatatttatacctcacctgggggactgactgactccagaaataaatattgttttcttccccttgctaataaatatttttcaataaaaactgtggcctcgttggcctca

SEQ ID NO: 10091 - DNA, 1079 bp, Homo sapiens
  misc_feature (1)...(1079): n = A,T,C or G
tagtcgtaggggctactggggggtgttacgcgggccgttaancggcggaggccccctcgctctctccaccactctgccattcccagggcgcatcgcgcgcagtcatggaggagcacgcaacaccgcgtgtgganggcctccttaaaacgcgtgggagtactcagcggattcggtcggacgctataaatcacaggacacgctgtcttcggctcggctatccatatgagtgtaagcttcttgcgcgcggggcggggtgccgccgtcgggttcacggtgggacccacgagcaataacctacttnaaccgctcgttagtgctatgcctcctcctccctcgcgggcggacggctatacacctcggccactaaacgtcaggtatgcacctcagccgccgggatggacttcaagtcgaaattccgcactcacagcccgagnccccaccggcgccctgcgggcccaccccggggccggccgcactgctggctcgggcggcgggcggggagaagcagtgaggtggatagtatgcctgtggctcgggggtatgagctgccgcgccgcggccggcgaggacgagatgtagccccgtgacgttccccactctcaaatgaaagactatcatccggcgtctttcagctggnacgtgcgcctccaccgcgcccaccgccacccatgactcaaacctcnacntatcttctacccacctcctccacctccgtctcctcattaactctcatactccttctttccatccctacaatgaagcactcgtggcctatcttttaccttttcttatcttttctgttccttactctaataaacaaatatgatatctgtatctcgtacctatactaccacgtttcctcagttnttcatctgctctcttttnnccttctccctccttnttatnnnntnncccccccnccctcccctancactttttnnnnnctgnnnnnangnccctnnccctctnaccngtnnccccncctcnnnncccttacnaaannccnntnnnncgttttntntttnntggntntnnnttaatatnntttannnnnantaaaaataccatttaaaatacac

SEQ ID NO: 10092 - DNA, 600 bp, Homo sapiens
  misc_feature (1)...(600): n = A,T,C or G
tatgtattacttgactctttagagagggtcnagtcatacgcgaggttgtactgcgtaggcaacctttccgtagctttactcatgtggagcagcaggacaggtaggcaatggcagttatatgagtagcgattagcctgcatctggctccataaagaaatatgtccatngctacttgtangaggaggacgctatcttgcttgactcttaagaaatcctatctcgcttcgaacaaaatactatagccgtgcaaagagacctcatagggactactgtcgttagagagcaagcgtcatgatcgttcccaggtcagcgctacagttaccataggttcaactcttactagtcactatagggcaccacataggaacctgctgcactgatatacgggaaaattatggaaaagcattctgtgacctttataagtaggcataacagtaatagccatatcatactggttatgcttactccgcacatgcatatagtgcccgctcttaataactatgctcagaaattgtctaccttgtagctttttaataagtaaaagggttaataaggaatatcttgatgtatagtgccttgactaggagatctactcagccc

SEQ ID NO: 10093 - DNA, 742 bp, Homo sapiens
agcatccacctttcgtgcttaccatggggagcagacgaggaatgcacttttggagcgatagctgctctgccctaggaaatgccatgccttattgggaaacgatattgcttgctctaagaaaaccatttgctggaacaaaactataccgtgcaaaaaacccatgggacttctcctagagagcaaggcatgacgttccaggcatcgcgacaggaccatggttcaacgtattgctagtcactatatggacaccacaaaggaaaaagctgcactgctatacaagaaaattatggaaaaatattttgtgaactttatgagttggtgtgagcaggatgatcataacatgctgattattcttactcatcactgagtgtgatgtttgttatgtaatgctgtatttagagatggaaaccaaatacttttttttatatttattagattaagtaaagagattagattaagggagttaaaattcagctagtggtttattcgttgtttgtccctaatttttattcttctcctcgtattctcatttctcttctttgtttcttgttgttgttatctagtctatattaatttttcacctcttgtgcaagtggccatttttattgttttacttccggcccgctcagcataccgacacccaccatcgtcccctataaagatcgcccattcagctccctatgtcctaggagagcgtgctgccccctccacacgccaacacacacagattaaggacgataat

SEQ ID NO: 10094 - DNA, 1422 bp, Homo sapiens
  misc_feature (1)...(1422): n = A,T,C or G
actgtagaatacagagcagcngtgataatgacgctgagtgggtacgagggctagaggggtgggtagagcaagagtgaggatagtgttcataggcatatcgcgactatagcacgccttggtaatcagtgccatgcgcgatagtgctcatgcagcgtcgacgcgctgactgcactgagtgatggtatgattatcgctgtgtgctctcatgccgcacatcgaatcatgatactgtaggacgtcagcaatgtacggacacgtgaacactcagcacacactaagacataggaaatgcactacttagactgattgcatctcatagccggcggatagcgnaggagtctcgtccgctgcgacgatatagcangaactaatcagatatcatgacacacgagtgacactcagcaagtatcgcacgaaggcacgctagacagcgcagtgggtgcgccatggtcaggtacanacgacagctaaacatacgtacagaggcaaacggcgcgcacgatcgccgaacaggaacgacgagatacgagagtgcggcacacatagaggggacagtgtggagcagtgagggctagtttcgtcgctgtgttcatttgcggtgtgatatatatatggtgtagttggtggctcgagatcacacagcaccagaggaactgagacgacggatatgtaacatagtgcgntctattaatcgtccacacaacaactcacgtacgctcaacgctcgactgcancgnatccctgcgtcctcactacgccgagttgcttgtgttagcctgtgacacctggttcgattgttccacagataactatcttatctgagttttcaatctattgtntctccgcgtcgtctgagtttnnntatgcgtgtttcccgccctacattgnactattctactccttcacactcgtttctctcttanttaaataattcanatcaacactcaccaatcaatatctcatgtatcacataataaaacacaactataatntacttntagactatcaactactgcgaccattcangncattataananaaagtcatataacaccacgacactcaaacaacattaatcatcacatatatccgagtcatatcacatatacaatcataatccaatacagaactgggaattttgtgcgctccaaccatgtntctgtgtttgntantncttcccctctcgtcccctatccctnggcctcgtccttgtccgcttgtgcttttttgttctttttattcnctttcccnctatattatatttcactcgcacaggagcggaacactcattctattattntntttctnttttataaatataaaatattttttntattattttnnttttattntttattatttaattnttatatatgtagaatttnnaantaanannttatataatatattaaaaatattatg

SEQ ID NO: 10095 - DNA, 106 bp, Homo sapiens
taaccactgggcccccactgatttaacattttaatttaacaaggtttttgggggagaaaacaggaaggaaatgccgaaaaaaggattaggggacccggaattgtaa

SEQ ID NO: 10096 - DNA, 1325 bp, Homo sapiens
  misc_feature (1)...(1325): n = A,T,C or G
gagggagaaagtttggggccgtggaggcgttaaaagtcttttaaaaaagaaccctcaagttttnannannccaaaatttttgggaannnngnnncnnnccccacacccccacgaaaccccaaaccgcctccccgccgcgggagcggcggaaggggcgggccggcggagcaagggggccgcgcgcngcggggcccgccgcccgcacccgcgccgggacacgccacngggcaaccggccgggagcgcggaggccgggcggcccgcgcggcggaacaggggcagcgcgaaagaacccggcccccggcgagncccagcagagcaaaccgagcccgacacggaccncccgcgccgagggaaagacggaacaacaacgcaagaacgggggatggaagacccagaccccgnagcccacgcggactcgcaccagacgcgggaccganacacccgagagcagaagaggtgtaacgccggcgaccgcacaacccgtacagcatgcacgccgcgcgnccccaaggccacagccagactgggagttacaataaacgacttctctctctcgcgcggtagacctatctagttggagcggcggcctcaagtgaagaaataacgataagattcatgtacaaaacaacaatatgtacgtcgccagtcagctgtctgcacaatcacgtgctcaatcaatatttatacgtcgcatcatccaagcgaattacacctctccacaatcaccaaccatatattctagagaactaaatttgttcagacaggttataacatacaaacgagcgcctgttgcgacgcaagtgataacaagnatcatcgtgtacaacgtgtcacggcgctcgtcgcaagaacagcatacacgacagcacagagccgataaacacaagctctnctcgcgtgctagagactacttcgcataacacanattaatacgcaagcctgaaagtctgnctattacgttacgcacacacacgcaagatgataataaccaacccaatcatagaatagccctgaatcctctaggcgattggtcattcaacagacgagttttaaacaagtacgaagagtcttaagagaaagacgagacccaagcgaatcagaatatgcacacgaatatgcaacatgtatccaacacacaatgagnagtagagaaccaagcacaaacgacatccatcactgagaagatggaaacacgatgagatccgaagggacagtatggatcaaacatcaccagatcagaagaagactagaagatatacaacaccaagagatgtgcaacacacatcatgagtaacaacacaacgatataactatagatatatt

SEQ ID NO: 10097 - DNA, 1219 bp, Homo sapiens
  misc_feature (1)...(1219): n = A,T,C or G
tcgctatttcatatcacagaaggagactgtgggctggtcgcattttcgaattcgggtatgcgcaggttcgtgtagcagtgggtcgtggccgattaggcaagaagcagactcataaagtagggatcaaacgcaggcggatgtaatacccaatgtctaaacccatgccatctcggcggtcgccgtacgcacaagacgggcgttgtcgagcagaagccacatcccccatcgcgataacattcgtacacgcattcggtgatgattttcataattagtacatggtgttcgctctcccgcaatgtgttgagcctgggatcagctaccaggcgtgtgtcagacgtgaagcgcaacacaacttcgcgctctcgccaacgccccaagatatttttcacgccatcctgctatgcgttgccgttcgcacatccagccagcacattcgtcctcgactcttgtcgtcggagcgcgtcggtgaaaaccccagatgcctgcttgttgcccctctgtctcttttgtccctgtcccccacttgacgcccatgttctccacgatggcaccaaccattagcggaatgcccccgccgccacagaccactgaatcgtagcgaagtagcgacggcaagagtggcgtgcatagccntctcctcgcctcgtatatgagatatctatatgacctaaatnatatattgcatcgcgatctgctatgcaatagctatacatctcncggatcatatcatactacgtctcagtcagactcgcgagtcgctccgtccataagccctggagtacacacagacagcgcgtcttgcgtcatccagcgatatagcccattaccattctcatgtgttctcacaacatacgcacgaccctagtatcactcccccgtgacaccatacgcccgatgtttgacacaccaagacgtcattgtataccacgatgctgttcacgccctctaccaacatggtcgctacgagtcgcgatacatcgtagatagtggacgatcgcaccgcgacgcagtgcttctgcacgtaactcgtcactgccgcactgactgacctgttgtgcgcctcaccgtagtcgcgtacatgatatgcgccgccncaatgtgtgtcatgattcgtnatacgattgtcatctagccatacgtcacctacgctaatantntatatngctgtcacgcgtcctacaatngccgatctataggttacatttgtatgtactnctgt

SEQ ID NO: 10098 - DNA, 1461 bp, Homo sapiens
  misc_feature (1)...(1461): n = A,T,C or G
gcgtgctatagcgtgagtcttagtgtgacgagatctccagggtatctagacagattgagagattagttgcgcgtattacgtagagcacggagtagcgaagtatgtgggcggatgagcaacggtacggcgaccgcccttcttgactatctgcgatcggaacgttcaagcgtgtcgttatttacagcattattcgatagagtggtgtatcttatagcgaatataaagacgaagacgcataataataggaggcagaggcgaccgagtacgcgcgcgtctccctattgccgatatataatattgcgagaccgcgcatcgagatgattctantctgccatgcatatagtctcttatcctgtattattaaattcagacaacacgtgaaactgcggtcgcggagttgtgtcccgtcaactcattgtcgcgtctccacataatttattgtttctgcgtttctcgcgacctctccgtgcgtgcgtagtgtgtgtttactatgttatcatagagtcgaatgtgtatcaatgtgcctctatggtgttgtgcgattgtaagtngttgcnatattcactatctatgatatctagaagactcgtgagtaagtgttgcggaggtgtccgcactggcgttgcncactctctgttgctcacgcttatctgcgcctccattgcctgctttatcccactgtacgctcaacagtatcgttctcgatattaccacanaccatcgccgcacgcgcattacgcggtatgcctcagcgcgccctctagttatatgcgtatataagcatgtgtcgaccatatgagtgcgttcaatgagcattgcagtcatcagtttcgtacgtccatagttgtcaagctcacttgaataatgtgttcagttancgtaagtgtagtgtgtctgatccagcaatcttatgcagtataatctcctcactgcctaccgttcgtcgctacgcgatggcgtgccatccaatttggtatagtagtccacagcagactaaccgtgcggctcgtctctcatgaattaatgtgccagtacattatccatgtgagtatacatcatatctctcaacacatacatgttacatnacacacctagtgttattataagccatatgtatgtacctactaccccatattcgccagtcacagcgatcataagtgcctcactccncactgagtattgttacnttatcgtcttattatatcctgatgtattcgntgatatattgtganaccatgtgcgtattacgntgatcgncgtcacgtgcgtcncgcgcngtactcagacatagtagttgcaccgacgcgtggncgcncacataattgngacacccgccatatgtnttctttgtctgcactttatcgctcgccttgaaggcanatnctactcactagtttgtattctagtgaccccacgcccactcatcgcggtttattgtttctcngttgtttgttccacttg

SEQ ID NO: 10099 - DNA, 2701 bp, Homo sapiens
  misc_feature (1)...(2701): n = A,T,C or G
ggaattttggggttnntctgggggtgnnagnnagtnntntnggntnnnntnnntntgntnnnnnnnntntnntnatntagagttgngtngtaanntgtgtgatagtgatgggnnnnnnnanagnannngaangatccgtngagnanatatgagngaaganatagtagagtgtnatnnanactgttgnagtatatnnannannaacgaattgnnttcanntgatnntgntgnnntgnngagagagatacccanntanangnantatgtnatnagnnnagnatcnntagtnatgtttangnntnagnagtagtcgtanagagtagtagnagagagataagccccagtcagcatnganannnacnattgncatgtgtactagtgtagcagtcgaggagtatggctgnatnatnttgnntntngtnatagattgtatactgatcatgtatatagcttgtactatngtgctgancngnctcntagcgtntctnccngagntcatntgctgtcgtcnncngntgcgatntnagattgtcgntcagttangtgtngagngnnnnngcnctgctgnncncnnncncgtatacacctggcttgctgctacntcancagatgcnangtacttncngacgtcgcntcgcnncnctgtcnctgngttgatgggtatcganncngcggctgcgccanctctntnncgtcgncnagcctancntcncncngccntcngccgccagcatanatactatnacgnatncancncaccgtgtngantacgaccactactacacacatngtagtacgngancgatcgctgcagtgaccgcngcatngtcgatgngacgnctagcanncagatgtatacgtntccggacgatatgctagtcgtcgntcacanngtacntcaatcantgctaacttntncntcnatcnnttnnctcttntactactgtattgactaatcgtnctacagtngagtatctgttngtgctgagcgatagtgtcgtcatcgtgcgntagatatgagcnctgacgntgtcgatacnngtatntagtatatgattgatgactacgatacgtcganactcnagattcganatnagcaacgngnaanatagaacacgcgacnnnagatngtgtntgatatgattgggntgangaggangtcagacgnngagatcgtcntgacgacgangntnatngangtatacttganattnttagtantatncgtacgttatntgacgtncgagaggtgtntngcgnagtnaggatagagctgagtntgantgatcngaanctgctcancacacatcctgacatcgtgancngcgacgcgttgtcgnngcncgcngtctgacgctcacgttgatgcgtacngtatatagcatgctactactatnctncaacngtatagacgagtaccgactnatatgtannatactctgagtgatncaccacnatgccacncgnncnnncacnagggancacacagcgcaggacgagcggcgagctgcngacgcancntcatctagcgacgtangtcangatatnacgntgcntcntatgtgtngacgtagtcgagatgcattannnnannncngtcgagtngnagagtngtntcganntcnatngctacgtgntanatacttaggagagtntnncacnagatcncgacgacgtagcggagagcngatgantgtncatnagctnanatcacgttnatcagtnnctnantacgactccacgtaatgaccaacgntcacncntctgtagtgaactngcnctnagncagtantantcgtcatgcgtgattgcaggacaacnatgagtgatngtagtgtnnnncnatnacgttagaccagcgacgaagcancncgagtaccgcngncgaatgtcgaccatagcgctgnganngtgtangtagtagtagtagntatgatgcttgcntnnnntnntangtcgtaaatttacgacattnngcatngaagcngnngannganngaggtaagncagcaaggcatcgancganagtagcttngtatcagnacgnatnagtagcagtancgngcnntcacngacgatngctgntacntgccantcgacgatgtaggctncanctcanctncactcgccangtctcgtcgctngtngatatgacgnacatctagctngccagacgacnncgnangnagcaacgttcagnatnatgcagcgcannctgnctttaaattcgacnaantacgtagcatnaccatanaannacatgcctnacagtatnacntgataatnntngtganatntgcnatacgcgtagatcgttcntcacgacgatgangcnanatgcatcncanctgcacantcagagaggnngagtgntangaagtgntcgaccatagcgtcgaangncgncgagngnacntngtcgtcgtcatntcgacacagcngacacgacgaggtncggtacgancagatcngatngatgcgtgatgatagtcngtagcatgncgcactgctaagaacgtattataaaggtattgtggagtcaacaatgacagcgtgcgtagtgtagtgcgtgacancgaactgagggatgatgtacgcgacgtgcgctcgatgtnacgacgcactatcagtcatnanatcacgatctngacgcaggatgttatcnacgagactgtgacgctcgtgatcgcgtacgacacgc

SEQ ID NO: 10100 - DNA, 1049 bp, Homo sapiens
  misc_feature (1)...(1049): n = A,T,C or G
aggggggagaagaggaggagaagggnnnggaggaggggnaggagnnnnagaagagnntggaacgcacggnttcgcaccactaagcaaagggaacaaatgaaaaanaacttaaaggagnaaaaaaaagagnaaagaaggnacaggagaaagaagaagaatttaaagaggggaggggcaaggagaaagaagaataaacaaaagancaaagacgagccccccaccgcccccccccgggaaaagacagagaaagacacggtgcagagaagggggggaaggaagaagcgggccgcgccagtctgtcgcaagccaccccacccccccctcactccctccatcccaaacgagagaaaagttcagagtagcgacgcaggaaaacgcacgcgcttgacaaggtaacggcgcctggccagaccacaaacgtccacacccccaggcccgcaaggaaagccgttgatcgggagcagggcaagggcaggccagaacggacagacggcaaagttaggagagagatgcgcgcttgttagtaggggccgtaggannccctcgggcccaaaagagaacaccaagaagatgaagaccaaagncgcagagggnncagcggggggcagaaggcngaaaaggtaacacaaccacaacacgnntaagaaggccaaaggagnncgaccgagcccaaacacaagcctgcagaaagccacccccagcgagaactnccagaaccgcgcgtccccacccccagagacgagcacaaagcgtccacagtaagagnnccacgaagagaaaacggcacanccaccgaatacccagaggcacgagcccccgcgccacgagcacaggaaagagccccacaaacacgcccaaagcaagcagacggaggggcaccgaagcnncagacgaggcacacgaaagaggccncccgaaaggaagagaaggaggnctagacggtgaactcttcactactggaggtcacgaccgaccccggcaccacaggcgcccagcagccaacggcaggntaggcggagaggaggccagggaccacgccaccgcatcgg

SEQ ID NO: 10101 - DNA, 1349 bp, Homo sapiens
  misc_feature (1)...(1349): n = A,T,C or G
cagtgcacccaagttcccaccgcgcaataagacaaganaccagaggagccgaggaggccttaggggggggaagaccaccgcgngggacagagtcttccccgcgaggaggcagcccacacatgggatnctacgcgagcgcgagcgcaaacacaccccgcgagttatcccaatgacgcgccgcggaggccgctccgataagatacacgaagggtaagagtgcccaacgggaacggtgtctgacacacgcacaactacgcccacacaccatattgcctcccacggagaagatccgccacacatctatagacgcctccggtnattattatcaacggcgatgtggcgacgactgatgagaaggactgcggtgtgtagtgtgagggcaaaatcacaatcgagcgtgaacagagtgacggcgagacgatctggtagaggtgaggaggtgacgtagtagtcccaccagaagcctcgcccaataccaaggagaacgaaaatatctcgcccgagaataagcggcgggagagtagngcgcgctcgcaccgtggtggggcggacgagaagggtgaagtaccgtcgataaggtgacccaaccagactgcgtcggccccccatcacggtgtttggtgttgtgcaaccccagaacacataccgaaggagtaagtacagtgaggcgagagtntagcccgccgtgctaaatctgcgacccgacggatgatgaaggtgagcgagagaggcgcggggcagacgacgagacaagccgccangcccggaggaccggaagcacggggttgatctaggtgatgatgcggcaccgcaagtgcggcagagttgtagagacatgatacacagcagagtggacgtgagagcgtcgtgagtgatgtcgcgtaggaacacgatgatctccactccacacaccaccgcacagagtgagtggagagacacacacgtacgtacgccgcgcaccncgaccgggtggtgcgatactacacaccacggtacgcgtaaggacgtacgacgacataggacacagtacggacgctggacatgtggggcgtattcgcgatctcgtagcgagccaatccaggcagaattgacaccaagtcgccacctcaggtagcagattcacatacaaatacaggaccaggtaactagacctagtgcaatgaccggacggcgcgacgaagatatccaaacagccngaganctcagtggtgagaccatgaacgagatcgcacgcgaagcgacgcctctataactccaaagcgacaccaggcgcgctgtagacacacgtaccgatagataatcgccatcctaaagatccacgtccgatatcatagtcatccgccacatac

SEQ ID NO: 10102 - DNA, 1000 bp, Homo sapiens
  misc_feature (1)...(1000): n = A,T,C or G
ggacgagtacgagacgtgaacccccgcgnnttnccccnngntttcctcttgtacgggtaacacacttcaccttggctgttctcacccgggaatctgggcaccgccccaaaatccagtgatcccccccaggggggggggggctcggagtctttaagaaatccccacaaacaaaccccgggagatctcgacgccccccccgcggtttttaattcttaatatttgtcggagaaacctcatataaaaaagcgaaaaggcaccgcccgtcgccgagattttttcgaatctgcagaagggcatctcaaatacccccgggtctcccaccccgcggggggggcggccaatacggaagaacgcctcaaatccgagttctccctcgccgtcttccgctaattgaacaaacaagcgagggcgatgatatatcaagaattttctttcccaaagataccatgagtctagcgcggcgtccaagagacgcgaaaaaaagagagtatcctgcactttttagaacgaaaaagccctcacctccccgtccgataagagcattgtaaaacggaattcttaatatcatatccatagacgtttttctggcgtgcgcgtggagagttagcgccagggaaacgcgcagttgtttcttcgcccgctggcagaacgacatagaatccacgaggtcattctcttcacacggagcgtgagagtcgacgactatgagatggggacagcaaggtaggaaggagaaatgaggcgcacgtagcccgacctagaggatgggtagtgagaacgcgaaagactctttactcatatcaggtcgcgagacatcaatgcacaccacaggtagcacacatacagcgagcagactaatctgacgagggcgaacgttcccgcgcaccatacgcgtgccaatagtctatcgtacatttgtcggataaacaccgttgttacatgctagtgtagtcacagtacagcgttatgacgcgtagagcacgagcaggcgccagccggg

SEQ ID NO: 10103 - DNA, 781 bp, Homo sapiens
  misc_feature (1)...(781): n = A,T,C or G
tggcgcgttcggtattctncttttccnnnnnnnntgcgtcctaaaaagaaaacatcctttcttgaaagttcagggatacgtgaaaatgaagcaaatgaggaaagacccattcacattcctccaaaagatctgtggctcactggaatcatgttactggctcctggtagtccctgactttacctgtttgttccaggaacttgctttatggccatttgttctaatgatcagtttggacaaccaacctttattcctccacctcagacaatattcaacatcctgtaatcatcatagcggccacatgtacagtaaggaacagaaaacgtagtgctgccaagtggaaagcccatttgcataataagattagggtgggggtgtccagcccttcccacacgctatgtaaacgttccacctggtccagccaatctctgggccctatgtaactcagacccccgctcctcaaccctgcctattaaatccggtccccctctgctcaagccccgaattcccaattccgccgtccctctctatcgcaagaaagagggcccccccgcttttgctcttgcctttggacttaaattatatctcgcgccaaaacccactcgcctgcgttgtgctcctttccatatctttactagcggccaagactgcggacccttgctcaatgttaggcctgggaccgccgggcccgctccgctacgtgactttataatgcgcgccgcgcgcgtccgcgccgtgcagccgcgacgcacacttgctgtactggcccgttgaggtaagggtg

SEQ ID NO: 10104 - DNA, 1106 bp, Homo sapiens
  misc_feature (1)...(1106): n = A,T,C or G
atcctcggcgcgtatcccctcgcgttcgcgggcctcgtgcctggtngcgtccctcggcgtggtgctcgtggcggctgcggtctgggtgtgggcggttaccgccctccccgtcgctgcccctcgctcccacggcgcctctccgtgccgtcgcgtcggtcctgcgtcgtcgggttcgggcgggggcgtgtccgggtctgctgcgtggtcgtgtggcgtcgcggtgggtgttgcgctcgcgttcactcgcgcctggcgtgccggctcgctctgctcgccgcggctggggtgcgcgcttctgcggctgctcgggcgcgtccgtcgtcctccttcgcggtcgcccgggggcggcgcgggcgccgcgggccggcgtgtggtgtgtcgcgggcggggttccgcgcggcctccggtctgggggctcgcgctgcggccgtgggggcctcggtgtgtgcgtgctctttgcgtggcgcggcgtggccctctgcttgtcctgtggcgcgtgcccggcgtctgtccggtgttgctgggcggtggcgcggcgcggcgcgcggcggcctgctcggctgtgtctgtgtctcgccgggcgtgttggtgtnggagcgtgctgcctcctggtgggctcgcccggcgctctccgggggggtgggctgcgcgcgccctccctctgctgctccttctgggcgccgcttccgcttgtcccgccgcgcgccgcgcgggcttgcgctccctctggtgtttcggttntttttcctcttctcctcttccttccttctgctggttcctcccctctcgctgcgcncttagcggcgtgttgtcttgggccctggtggcttttcccccctgccgtcccttctcccccgccccgccgccgcgcctcncgcgcgggctcgcgcgcccgccttgttctggctggcggtcgtctggcctgcccgtgcgctccgcgtggcgnnncccgtcccccgccccgtcgcccgcggcggggtcgtagcttcttttttttgcttttgtttcgtggttgttcccccggctccccccccgcttagctttttttctttgtttttctttttaggccccctttccctctccccccccgcccccctacggccncg

SEQ ID NO: 10105 - DNA, 690 bp, Homo sapiens
ttcccgggttcttccaattccgggcaaccttttccggggtaaggttcaagcctttcaaactaaaaaccaaattggtaggggtataagggggccaaatcttttcggcttctcttaagcacgtcaccgaaaacctctaagggaccagacaaccagattctacgggtcctgtgaaggaataatttacactagcaggtgaccttcttcagaaaaatcaaacaagagactttccagagtaggtgaaatcactggcctatcccacccatctggtgaacattgtctgcaaaaattacaaactgaaggtattggttgggccttttacccaaacaccatcacacaacccaacactaaggatttttttgggcccaacaacactatgaaaaagctgctaagggtctttataataaaaaacatggccattcctggtttattgtgcaaaaatatttacctccagcgggtactggcaaagaattttcgaccaaaaaatattctaccttcctgaaccccaaatattccaaaaaaagtccggaacgccaatggaaggattctccccttttttttaattgagaaacaacgcgcggtgaaaggcctcctgcctttaagcacaaccttgtaaacaaagaactcgctaaaaccttttctcttgaattttaaaggggtaacgtgtggccccatggtgtcacctcacctatt

SEQ ID NO: 10106 - DNA, 543 bp, Homo sapiens
agattcagatactagtccttcgctggaagcatagcttgtgaatattttctctgactctagaatctacttatggaaatggcacagcagacattaaagatgccattaaaccgacatctgctcccagacacgtgaaccttaaatggtccaaaatcatataatgtgccatgccaacttaagagaaataaaaagacagaggcaataaagaagaaacaaagtaaaaatacacttaaatgaaatttttatttaaatgtgtgcagatgtgcatgtgcatgtacacacacattaatatgctcaacttgttttagattcatggcattgtatcacaattagaatactataagctcaattctgataatggcatatattttacattattgttaaagaactaatcattatactcttaacaaagtgttatattatcattgatgccatttacatctctgcaacctttgatcatacagagaaaggttcttttctggttattttaaaataagccaaaacaaatgtatctgataaaataaagatatggcctcgttggcctca

SEQ ID NO: 10107 - DNA, 1218 bp, Homo sapiens
  misc_feature (1)...(1218): n = A,T,C or G
aatagtcccgcgacaccaccctacttgtaagctaccaaaactactacctattgttgagtgaagncaaacatgtgggatatatagatcgacacagtagacgtaacctaatcgtcatactgacctcgacgtctgaccatcgcgagccgatcaatccacaagctctcgcagggtctgacacctgcagttataaaagtgtagggcgcacggcaagtgcgcctcgcggaccacgcgggcgcataccgacacataggacacaagcaaaagtagcagctaacaggcgtcgacaatctcccagcacagcaaggggggacggacgagggcatgctgggatgaacgacgcggacaccgccacgtcagcgcgtcagacacaagcccgccgccgccgcacacggaggcagcgggcaccatccccgcgccacaccaactantgcgcgcaacagacggggcgacgggacacatacccgatggcccgcacccaacatgccgggacacacacccgagcacaccgggacgatagaacctgggatatgaagaagcataagatgaagctaggaccgagtagtgtgtcagcgtagaccgagcgcgcagcgtnaccgacgcctcctcggcccgcccggtgtttgccctctgccgcctcggctggtcgccgccgtacctaatagcgcgggactggtgtagcacataaattttatgttatatctcaatcggctcctcccgctggtacccgcttctccccgtccgtgacgcataatataataaaattaagcaacaatagntatctatnatctaccacaactnaaccccacaccacaataacgactgactaacaaacctaccttcattctcttcatccccnncactctctcacactcgtacctgcgcgccgaaacgtcaatncaaacaccacaactccgcgccccctctctccaatactctaaactctacagaccctcatgtgtgattagtttgaactcctacctatgcgtcgcggcgccgcacccggacgngctcttcttctcctctcttgtgtcttccttggactcttacccgccacaggtccttccataattntngttctagtatangttatctttgattctgtgtgtgtaacgcctttccttttttctctttcttaatttagttttttttctttattttngnnctnnnnganannaaatattgaattgnaatnnannttataaaatacataaaattgta

SEQ ID NO: 10108 - DNA, 783 bp, Homo sapiens
  misc_feature (1)...(783): n = A,T,C or G
ctagagcattcccagtggctaaatatgagtgcttcaacggatcatccgaagaggttctgcagggctagagggactccaaacacaagaattgggcaaacactgaactggatgtggttgctgaattgtttctgtccttatcttgttgagatgttttacatctttcatcagaaatttctccactgtccttgagctagtgttttccaaatgccagtcgatagagcagtgctgatctgtgacaacattttcactgatctgtagtcatatcaaagaataaaaaaataggctggacaaagtggctcatgcctgtaattccagcactttgggaggccaagacatgcagatcacttgaggtcgggagttcaagaccagcctgaccaacatggagaaaccccatctctactaaaaatacaaaattagccggccgtggtggcacgtgcctgtaatctcagctactcaggaggctgagacaggagaattgtttgaaccctggaggtggaggttgcggggagccgagattgcgccattgcactccagcctgggcaacaggagagaaactccgtctcaaaaaaaaaataaaaataaaaaataaaaaataaacagaaaaataaaaattcatatttctcaagtgaggttttcatanaattaaactcctcaatttgaagggttttcttttattctaaaattatgtccttcttcattctgggctctctttcagattgtataaaccttttggtttttactcaaattatgttctcatacatgttgaagttaaatattcttatt

SEQ ID NO: 10109 - DNA, 1028 bp, Homo sapiens
  misc_feature (1)...(1028): n = A,T,C or G
catttataactacctcgctagcgctacgaactatccctaatcatactcttgcatattcgccggtgcttttctggcctggagttgtaattcttgtgtgccggccaactaacaccttctctccttagggaggcacctatttccagatatgactgaccgacatcaccgatgaccctaagccacgtcagccacaatttcagccagctctttgtgagagatgagtcgacttgggcgctagtgtccatgcgtttccgggacgtctgatgcatcggcgcgggtatcgaaatctcttacaccgtcactccctctctcactaatgagcaaggaaccgtcgtccgacgcaatttatggcccgtcgccccacccgggtggacctcggcagtcgagtacggaaggcaaacacggggatcgccggcgcaccgcccaccatccactcgtgtcattacttgctcactggcgcggaggagctatcggcagtcggacagaataagtatacctgctcgtctggacgtagtgaggtggcggaccgcccgcgggcgtgggccttttgtgcgtctcgcacactgtaaacgaccaagccaccaccacagcgcacccaagaccacagggcgactccggccccgcgtggctaactgccatataatgattacgttatatacctacatgttcagctcattaaaaaccccggtgcgcctcataccctcatcagagcaaggcgcgtcacgaccccggccccggcgtctccctgtacttttgtgtctctataacatcatacatttacttccgcaaccgggcccaccgagcaagcggtacgtttctgcttgcttgcgggggcgtctgccgtgcgtgcctttagcttcggcggcctgtgggcgcccgcgcgcccactcgtggttgttggtngccgcccggcgattgggccggcgtngggcggggagnnnannnnngtnncccccccaacccccccgcgcgnnnccccccccgccctanccatgtggggcgnnnnnnangatattattttgtaaataata

SEQ ID NO: 10110 - DNA, 928 bp, Homo sapiens
  misc_feature (1)...(928): n = A,T,C or G
gtttcaggtacaacacttttcattggttctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactggagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattntattttagaaaaaggttgttacataaaacaccctggccagttcatttcagcatgctctttcaaccagaagttcttattatntatgatggcactagaaagggatttggcatttatgtccttctgtgccctcatgtatctgatcaatgaagacctgtaaccctagtacttgagagtacagtctgaataatgaagtcggaccaactgaatagcccagcttgcagattagtaagtttcagtctgcatggtgctagcattcccttgcaaagggcttgactgcttgcggaaactttgaattttgaagcggcaactttgtctctggaatgcttaaagttatggctggaacctatccccccaatttaatgatgagattataaagggaaaaaaaaaacattggccctcgttgccccagcgtgggagcctctgcgccctttcctttaagagaggaaatcatgaatccgctactacccccggcctaggactcggatgggaacg

SEQ ID NO: 10111 - DNA, 245 bp, Homo sapiens
ctaggctttgctgatggaagaaggggtcacgaactaaggagtgtgggcggcgtctagaagccagcaaaagcaaggacacagaatatctcctacagcctccaacaacctggttttagcccggtgagacccacttcagacttctgacctctatgacagtaagataatacatttgtgttgtatgacgccaataatctacagtaatttgttaaaacagcaaaaataaaccgatggcctcgttggcctca

SEQ ID NO: 10112 - DNA, 171 bp, Homo sapiens
cctaggaaagaacgtggctcagatggatgtgccagaggaaatgcaccaggaaatcccgagcagggtgcaatcagtcaccattaatgctcacaagtatcaaagctacttgaagaaatacagctacttatggatggatgataaaattgaattcacgaagcaaaaaaaaaaaaa

SEQ ID NO: 10113 - DNA, 249 bp, Homo sapiens
  misc_feature (1)...(249): n = A,T,C or G
tatagagctgatgtttatgagttaggaggtaggggcgaacggggggcgctcgntacagctttcttaagaagttctacaaagtcgaagatggttcagaaacacacagtgtagaaatttgagagttttggtccagacatattttgtgaagagactgtccaacagtaattacacttacaaattcagtgatggggtttggtgcgcagtgaagacaggaagaacgaaggaaggagcaaatacaggaaaaataaa

SEQ ID NO: 10114 - DNA, 774 bp, Homo sapiens
gtgtactcatgagaaaagcatcaagcaaatcccaatggaagaaaattgtcaacgtcttcaaaaccaagaaaagcgtgagaaaccatcacaaccaagaagagtctatggagacatggcaatgaaacataatgtggcatcctcaatgggatcctggaataagaaaatgatattaggtaaaaatgaaggaaatctgaataaactgtgaacaatagtataccagtattggcttacgaactgtaacaaacatactatgcaaatatacatattaataatagaggaaaccgtgtgtgtggggggggagataaatgtatagaaaatttctgtactatccactcagtttttctgtaaacctaaaactgtcttaaaaataaagtttatcaagaaaaatttaaaaataaagatgaagtaaagacatattaaggaatacacatggtaaaagaaattatcactctagacctgcaccatcagaaataataaaggacgttctcaggcagaaaaataatgataccagacaggaacatggatctataaaagaaataaaatacctgggaaggaataaaagttgtgagtagtatatcaggatgaataaaaaaaatatgaacaaaacacgaacacaaaacaaaagatagaagattcttgggccttgttggcctcaaccggagaagctcttgcgccgtttccctttaaagagggtaacctcatgatcctccgtcattgacttcgttgactggtgcgtcgggttcgcgcgaccggatacacctgactacaggggag

SEQ ID NO: 10115 - DNA, 1429 bp, Homo sapiens
  misc_feature (1)...(1429): n = A,T,C or G
cacanagtcatgaaacggacaacacatctaacagcgaccaacgactactaacatgcgttgatnacatgactatgatcnatagagtntanntacctaccagacaagcgtgcacactgcgagacatatcanatcgtcatgtgagcgtcatgntncaganagtntacaagcacngagccgcagctcacnactctangtnacgntgcgacacactatcacgcgacagaacacttgcgaanattgacgaanatacgtacganactactcacactacaataactcactcactctcttacgtactctatatgcaccaccatcangagcctaatctgagcgatcatcagaacactactcacacgacaacacgaagcatacactacgacgagagcacacatactcactaccagacgagacatatgtgaatntcacgtccgtcgactagnctgcacgtagtgctatncatactaagacaaaccttcaaccaagcgaagacacctaagaggtactgaactaactccacacgcacgtctagcggtgagtcaacgtacacataaataagtataggactattatcaagaacagttaagaccgtagagccatgcgcagagactgagagagctccacgcccgagacgcgataaaatgaccactgacatacgctaganacatcaccgcgcttaagacacgacgacatgtagcaaagcgacgcgacangactgtaagaaacaggaaagagatacctacatatgacattagactaacagacgactgctagacatcaaatgcgtctgcacggcgttgattcggtgtctgtctctgcncggcgcacaggatccccagcatcgcgagatcacgggcgcacgccgaccaccgcatccctagcggtgacccccaaccttaaagcaaaagctccaccaacatcagcctccactagtaacatttactcatccatcaattatgacacattagaaatataaatatataaataatatntcttaattataccttaaatctactttgtcccactaacataatacctatcgatactaatccatctttaatcattaacgtagacctttcttgacactctataatatatattatcaataattaaaaaccacgcaacaagaacaatatctagtaatgtgaaacgcagtataatggagatgccagcactcactgacagtagtgtaaggngacgagttcgctgtatgatattgtttgagtccctcgacgccgactctgcctgctcggctccggtcgtttaatggtattaacgtattctacccttggttaacatgaaaggggtaccaacgggcgagaagtatgttgtctctcggggatcctcatcaaaagccttctttacttttccatttacattctttgtttataatcggaaagannnannnnnncaaanatatttaaaaaaaaag

SEQ ID NO: 10116 - DNA, 536 bp, Homo sapiens
  misc_feature (1)...(536): n = A,T,C or G
agtttcgtatagcgtggtgtctgactggtgctaatcctatcccctcactcgcgactccccctctcgctgctgcctccgttgcttcttacctgcccatctcacgacgcgccaccacgccccgtatcctaatagttgacccgtcncctccggccncccagtcagggctgacgctgctccttcatcgtatgtggtatcagataggactaggtaactnatgaatccaagttcgctcatcttaagtgtccactccttattcgtgctctccatagagcccctacaaccgattgctcatcctgatcacccgtctcccaccgtcaagactagtgaagtatgctcaatcaacctgtccaggtcacctctgcgcaaatggctgtccaggcaccgcgtacgcgacctgctactctcatgtctctacacgcatagatgatcatgtatcgccctgcctatgtgcgccgncttgcgagtaaagccgatgcgctacaccgtcctgtttcacggatactatctgtcgcgcctcacgccatcgacacacccag

SEQ ID NO: 10117 - DNA, 913 bp, Homo sapiens
ctcgtaggacgctaaaatccctttgacttcacacggatgaaacattggcttgcctctgcatcagtccatcagtgaaccagttggaagatcaaagacccaactttaattttttgaggtcaaggttcttattgcccaccttggtaccagcaagccagaacaaaaccacatgcaacacaagctcctgtctcaccactgcctgctactggagctgagcacagtaaggaatatttactggatggatggaaaacaaattctgccttgtagtgcaactttggtgataaaaaaaagttgattgaaaacatgattactattcaatgcctaaggattgcaagtttttgaagaacagcaatcatgattccctttagaatctgccccagaagttgccaatctaatttggcttttattttacattcaatgaatgttatagaactaaaagttattttatattctagcaatacaataatctaatctaggtcaaagaactacccaatttttataattattatttaaataaaaggctccttacaatggatcgcttcccacaacatggaggattatacttttatattatcgagcccaccacttaccatggtaataagatttcgactttagaaattcgacattgtgatcctttcacacctaaagcgaacctgtgaaaaaacaataaatgggcctaatcgccttagaggcggacgcttgaggtcggttccctctcgggcggataattcatgatcccactcactactcaggtgcgtatgaagacagcccatgccacgcaattagatactccaaggggaaaaacgaagacacataatccggacaatctccgaatcaacttgaactacgcgcagatcacggtacaacccataccagcgcgcccggagatatacactagcaaacatcatcaaaacct

SEQ ID NO: 10118 - DNA, 1299 bp, Homo sapiens
  misc_feature (1)...(1299): n = A,T,C or G
aagagatatggaaggaatatttgagagggagganagaggnnggaagaaggagaanagagngaaggaagggnagagagagagagagaannnaagagagaggnnnnagangnnngggagaagggngnngttagagagagaagaggnaaggagggaggaaagagagnnnntgttagngagaaggagnaaaaaagaacagaaggnanaagaaaagaggaaacagcgaggnaagccgtcatgattggattttgcagntaaaggtagtatcacaatccttaaaatataggagagccatatataaaatnnaatattataatatactctctcccagagggcnnttcaatagaggaagaccatagacaggccctagcaacacncgacgcccgcgccagtagaacactccgcagcacttaacaactcgactcnacaaggaagagggcgagaggagaagtgaggagannaagaagaccgagtccaaccgctcaagcacaaggttaaagtaaagtnacacaacacaaaaactngaacagagagggacacagcncaagagaaaaagactgagccncatcaccaggccccataatagcaataacaacanccccgggcacagaagatattatttccgcctcccgaatgagccggcggncccacgaaagacncgcgatacacccccaaagtacaatcaacacccacgcgacncttaccgactccacaccccacgtttgcgaagagacctaaaacgatctccttagatactacgttccctaaataaaatatatagaaagaatntaataagtaananctaaataatagagcaaagaggccaccaggcgccaactaacgccatgagacgctncataaaaagagcaaagaatagcnnaaaacagagttcatataatgcaccacaagtagtaggcaaataaaataaacaaagnccagagtgtaacacataaccacaatgacacagatttatagagacacgacgtcaagcaaaagaatcncataaagaaatcgccgacaagtnaaccaaacacacactcaccaagacgaagcnncctcgtagaaaccgcaaagcgacactnccagtgacgtagtncataacacgctaccacaatagtaagtataaggtncacacaaagtactctgagagaacgcancacctaaggaaatgcgaagagtnntaatngatacgcacctcgcaacactgagtgcgcaacagatccatacatgctggcgagcacgagaaggccgaacaggagtncacatagagtataagntaagaagaaatantaatatagaaga

SEQ ID NO: 10119 - DNA, 615 bp, Homo sapiens
ctaggaacagcttatcaccccacgacttgtaaaatacgtactctagaaaacgggtgagatgagagaccttccaaagctatggcgtgagagcggagtgaatacatcaccatgtcttccagtttgttccctgggtgttatataactcagaggcaatgaaaggattcacgcttggatcgcaaattctatcacacaaagagtaatctactagtgaagacaccaatcttgcatatgctccaagtttccagccgacataaagaaaaaccctttggatatgcaaattataacatctacgttagttctgatggacatcaatttagaaaagattcaatttagtcaaggacattggctttgtctgatatatctcattccagaaatgtgattatgctctattggctgaaaacagcaactcttaaaaagtttctaaaaaacttcaaaaatatttgttcgaagaactggaacatagacttttttttctaaattgaaaacaaatgtccacttagaaagacttaatgtacttaagaatcaattgtattctgcaaacaatttaaccccaataagggactggatttttacttaacaaaatggttcaataaaggcctggcctccgtggcctca

SEQ ID NO: 10120 - DNA, 2035 bp, Homo sapiens
  misc_feature (1)...(2035): n = A,T,C or G
ttttggggnnnnnnnnnnnnnnnnnnnnnnnnnnnnnaaaannnnnnnnnnnnnnnnnnnnnnnnnnnnnnnnaaggtcnnnggnnnnnnnnnnnnnnnngnnnnnnnnnnnnnccnnannngnnnnnnnnnnnngnnnnnnnnnnnnnnnnnnnnnaaataacattttntagngnnnnnnnnannnanncaccagcnangatnnnnnnnncnnnannacgtcctatattctctntatacanagncnnnnnnncacacagatncnnnatcnnnangtcccnctactaaagntaannnaatatagatctgtnnanatagacaatgatgntaanagantnnantacncagatgacntacactnactgnnanatnatntnnnacgcagagaaatatagagtacntctcgcgtnntatcnnannncnatatatatatagatcagtanancacaaanacaagcaggtaccncncatcagatagtacgtcgcngcncntgctatcagntgcactccngctgtcgtctagcatctgagaccanctnctnnacatgnctacctagcnctgcacacnacagctcgtctacntcgatncactctgctcctgcgncccgtgcgncgnatctatnactgctatanacacgactgatctatacaanccangactgattactntanatctcagatctacngtacgtctagctaggnacngtggatacgncacagcacnanttcganatntnatagtcatganctacgtattagtagatcgaacnaccaccacgagcgtcnatcagacatcgtgatcgctcatcgatgtnnntactnacatattntgtactgatacanatgtgaatatntnaannagtacgcantanctnacgatgtcctgcagacacncgcacaagacagacagcacaagnagcaccgacacgcatcacgncgtgcgagcacancanncnccncccgctacagntgagtacgacgtgggagncncactaagcatagacgtagataagagnntgacgcangncangagnaggcangangcgannagcaagtgacgagagncacacatgaagacggtgatgtacgaggagnnnactgtgagagagcgtcatcgatagtgtatatgncgcacnancacacagcatgcgtgcacacgagcgcttgatatctacancgtccgacgatacagtagctagacagtaaatcgttnctatactacattcagtcgtantatctatncatgcanctaactatttnatgctgacttnatattcattacatctctcatatccancactcatacatacgtcgcactangncacactcgtgatatacacncagaccactcacacgcgtcgcgctgcnctcgatcaaagcaagcgtacaancnactgtgcgagagtcnattcgagtngacgncngtggagtacgcatttagaatatcatcgaagtgagcgcagacgtanacgatgactcgtctgncntanantgcatgcgagattagtgtcgcatcagagacactatagtgtagaacagcatatcattctcaagatagagagtgctattgaacaggtgtggatcgccgacgctcgtgatcaagcanctccgcgccattatcgccacagcatcaagatccgtatatactctgcgcctacggcgagccatnaaagccagagagcacgcagcacatactactacatatatagagaatacgactncctncacttcactcgcgacgtantagcagaatcgtcgccacgcagacacactccttcgtgcgagtcagtccgcacgcagtactgtgagtttgtgacctctcgcagcatcttatgccgcgacagtagagcggagccgcgtcgtatgacgaggaccntcaccatatacgagcgcagcgccagttcgtatgatgacgccacaccactgaggccccatagtccaatctaacctcagcctcaggaatgaagtcgctggcgttcaggccacatacaggtctatgtcactcgcgccagcgaagctcccgccgtctgccgct

SEQ ID NO: 10121 - DNA, 263 bp, Homo sapiens
aaatgtcctgcaatgcaattggaaattcaaggctgctcatcagtggagtagcaagtctgaaaacatttgtcaactctgcttgatctttccacatacctcatcggagaatcagagaagatggaaggagtgaaagaagacactgaaaaacagaatactaaagaagcccattacagcaacttcctaaagcactttgtaaaaggcacaaatatgtctagaatatttttcctaatatttatgggaaattaaaaaaaatattacttagg

SEQ ID NO: 10122 - DNA, 188 bp, Homo sapiens
ccagaaccgaagtggaatattagttcctcattaaaatctctcctcagtaccattgggaacaacgatcatcccacattgattacaagagtgatacgatgtcatacaaagtgatgctttttttaaacaaatatcattcattcaagaaaaaaaaacaaaataaaacatctgtttttataaaaaaaaaaaaa

SEQ ID NO: 10123 - DNA, 338 bp, Homo sapiens
ctagtgcataccaatgactaggtagagttgtgtaagaagacatggtacaaaaagtgctatacttccacctggtggagagaagaaagagcgtgggccattgaacaaagcagtctttaaaaacaataacaggccaggcacagtggctcaagcctgtaatcccagaactttggaaggccaagattcagtaacgactgattcctcagactaatatttagatctcataatcacatcaaccaaactgctaaatacaataaaataaagctccaggaaatagtaaaacaaaaaaaaataaaaaaaattcaaaagcaaaaaaggaaatttctataaaaaaaaaaaaa

SEQ ID NO: 10124 - DNA, 495 bp, Homo sapiens
tgctactgataaactactgacgtcagctgttctgaaggacccagcaaggagctgactcatggaagattgcaggttctacctaatgatctcatcctccttaccctgaccaatcaatgaccccaattttccagcccctcatcatccatgatccacttaaaaacctttccccagaactccttggagagatggatttgagacttgaggattccatctttctcctcactcaggggccttgggattactaagctccttctctgctgcaaaccccactgtctcagtgtattggtttattgctatacacaggcaaacaagtctgccaatcctataagacttaggagtctccaaaagtctcttagactcagatttgggattttacctgggtggaggtagatctctttgtctctcttactgatactctgtgaataattaaaagtgggagagggtgtgaattttaaaatctttgaaaacaataaaaagctggcctcgttggcctca

SEQ ID NO: 10125 - DNA, 180 bp, Homo sapiens
  misc_feature (1)...(180): n = A,T,C or G
ttcagagcngaagtcaatcacactgtaagctgacaacctagtaaccagtagagggcagtaacagcacaatcagacacacccactcaaaataagcaatttacaggaatacttctcacatctgatttgactacaacatctaagcaaaataaagcttctgtcaaactcttaaaaaaaaaaaaa

SEQ ID NO: 10126 - DNA, 1557 bp, Homo sapiens
  misc_feature (1)...(1557): n = A,T,C or G
acacaatgtctagataatctagttcnaatcagatatcnaccgaacagcacagcggnggggctccatagtgtggaacggaaaacacaacatcgttggacatcgaccgttaccatttccaagcagatgtaggtggtactgtcgggtgacgactcgaagtatactaaacaatggggggagaggagaattgtgacgaaaaatcgaccagctaatcattaacagggatgtgtgtacgtctacaaaccaaatcaaataactaacatacaaaacgactggcgatgttgaaattatttgtacaacaacgccaaacttacctcatacgcatcacatacgtccatgcgcgtgcagccatcgcgaaacgaccacacacgacgccccacctacaaccactctttccacgcggtggggggttgggagccanatacaccataagaatacactctccagctccgatcactaatagtcagcccgccacgcgagagtgtgatccctcactgctcgcggcttgctccatcacctgcgctctntcgacactcgtctgcatctacacacctgcgtcgtcattgtgactataagcatggatactctcagctctatattctctgcagatacgtgcgtgagatatcattctgtcaantctattatccgctgactgcactaccgtaagantagaactacgcgcggacataggatctcgncatctacacacactcnatgcacactcgtggagcgacgagctcntctacgcagcgcnctcgcgcactctgacacctacacacacatctgaagatcctggtgtgtcntgtctcgcgcatctaggacgtacngtatctcagcacgtcgtaacacagttgctctctcgatcgcacncaccgctagagcancatagtacgntgtctgtgcggacgacggcgctactagcagcacgtccgactaccgagctacgcataactgaccacntntgacagngccatgcgcgtgcgcacgaaagccacgtgggacagtcgaagncacagagaagacgacgcagacagaaggntgacacgcggctcgntgtcgagcacagantngngcaatctanctcataccttctcgaccncccgctagtgcgagtttgcctacagcgacgtcaggcgcgcgtcacgtgctctgactgcggcacgtgtgngcgcgacatcgcgcacactaccgccatgacacacacgccacgaccagcccgagatacagtcgacantcatactcatgaacgcgctacgnctgcacgacgcacgcgtactcatctcctgcgaccgcntctactcancacgtatantacaacnatagatagaagtcactactncgcgatacagtatgcctgagatcactgcgtgcatctatgntgcgcgagagcgatcgntggccacgtgtatgngngtgtgcagtcgaccacatctgtggccactagtgattctccacgtgtgtctctatntgtacttcnnacagcaaggtgacgancatgagcngacaacagcagtgagccccgctcggcgcagcgcatgccacatacctgcangnacgacg

SEQ ID NO: 10127 - DNA, 241 bp, Homo sapiens
  misc_feature (1)...(241): n = A,T,C or G
gaagatgatataggaggaatccagaatcgggaagagggggggggcgttgggagtaaaaggcaggcactttatggcgnaaacggcagcgtagatcaaacagtaaaagtgtgggagtgccgttgattgggtctccttcggcccctcctccctcttttcctctggatgcactctgatgataccatggttaccccattgagctctgtttaaataaatattgacctttcatgtaaaaaaaaaaaaa

SEQ ID NO: 10128 - DNA, 434 bp, Homo sapiens
ttaggtgtacaaatggagactcttagagttaagtcaattgcctaagatcagataaagagcaagggataacggtggactcaaacccaggtcgtctagtgccaaacccctgctctttcactatgccacagaaggctcctcctcctccactcatggcattttatctttctaacatggttgacaagtccacaatcactgtgcccagttcaatgggggatttttatcctcacccctcatcctgtctcttcaccaaccatggattaccaagcatgtctcaagaccatcaaagaaaaatgccagaccactctgaagcaggccaaggaaaagagatacattacacaacacacctttccttcaccttgtgtgatcaaaattgctttttcactgaacattttcgtaccaattggtctaataaacggctggcctcgttggcctca

SEQ ID NO: 10129 - DNA, 845 bp, Homo sapiens
aattacaaaaatacatatatcgtaacatcaaaaaagaagaaaatccttaggggagactttacatcctgttggctgtgatcacttcctaaagcaaaggcatctgcagcctaatgacacatcagcgaattggatggagccccatctggacaagcttctagtgaggagattatggactctctagaagagacaccatgaggcgctggccacactagagaaaaagatcatcgtggggacaacagtgaaaaggcagccatcataagccacagagagaggactcagaatatttcttctctgctgacaccttgatgttgaacttctagcctctagaactgtgacaaaacaaatttctgttggtaagacacccggcctgtgggattctgtttagactggcctagcaaactgacacatttgttagcactatttaacccccaattgaattttagctctcttagaagctcgtacctataactcaatcatagacttagccgtgtactttcgattagtatcccatcgtctccccactctcgccactgctcaaattgccgagtctattatttctttccgtcccctttcaaccccagacgaccgccttcctctttgcgttcaccctggctcgcccccccagcaagtctttgacgtcgcttcgctagcacctgacgcgctgccccccaatacctcctcacctttcgtgcgacgtctactgaccaccctcccttttgtattcttaaacgcgctaccataatcgaactgcctcgccaaccgcgccatacccacccagaggttaccgtgacttgtcctacccaaaccgatctctctgtccctctctccactttaacttaattaat

SEQ ID NO: 10130 - DNA, 923 bp, Homo sapiens
taatgaatatttatcattaaattaaaaaaggagcaaaagaaaaagttcagggccacaacatctgccttttaacattcaagcagcatctttttaaaaaatctcagtaagcaacgctaaagaagagagaccacaagctctagacgttttcctgtataattaagaggaatctgttcaacaaacccccatgacataagcttatctatataacaaacctgcacatgtgcccctgaacctaaaataaaagcttgacctatatggcctaagcaatgtttttttacagccagttacattaagagaggagttatccatgatcctcgctgactgactcgattgggtcagaccttaggttgcggagatcgtaaactaataactaaaacgaacgtagttaaagtgattctacacgagtgcggtgaagaccgcaagtaacaacctcaagatgcgcagtgattatatataggtcagcaactccaaaaaacgccacagttgaaggcagcttatatgataaataaatacaacttataaaagtgtcacagataatcgtatactatatgtattatggtacagatagcacagactagattgctacaacagacgaaaagtagtcaacctacttaaaaacttatcaacacagctacataagagtaacactcttaactaaagtgatttaactgcactcacttagtcccatcaactaacgacataacgcttgtatccacagtactagatatagagaggaagcagacatatacaatagatagttatataaaaatatttacgtgcataaatcgagatacgacagagagacaactcgcacaaacacacacatacaccagacggacaaaatattttctaggacaagttgggataatcttcaaaaaacaagtcattaaatgtgatagattggttattgatttatactatct

SEQ ID NO: 10131 - DNA, 291 bp, Homo sapiens
agagatagggtcttgctatgttgcataggctgatctcttgaactcctctgcctctcaaagtgctgagattacagatgctggggctgggcaacacttccatcaaagggcaagcagagagagatacaccattccttttaaaggctcctagttatgccaatgaggaagaaagtattctacttactctggtctaacagtgttggagacaaaccaacaagttattaacaaataattaaattgggagtcctttttaaattataaaaaaaaaataaacacctggcctcgttggcctca

SEQ ID NO: 10132 - DNA, 312 bp, Homo sapiens
ttttattttgttgaacatattccagtcgcttgacatcagattagatgcgtatttaataggcactattgcagtctctagccctactattccttttaccaggcatcgcatcactggtaagctggtcacctggaagcaacgcatcagttagccactgaaaaggggtgtgcagagctcttacagaaaattgagaaaatcattatattgatatattgattatattaagaaaatcattatattgctatctacttttatataagtaggggaaagggaggactggacaaaaacaataaaaggatggcctcgttggcctca

SEQ ID NO: 10133 - DNA, 727 bp, Homo sapiens
taagcaaaggaatctgcagcctaatgacacataggaattggtggagcgccagcggacagcttctatgaggagattaggactctcagaagagacaccagaggcgtggccacacagagaaaaagatcatgtggggacacagtgaaaaggcagccatcataagccacagagagaggactcagaagaaaccaactctgggggaggccttcatcttgaacttctagcctctagaactgtgaaaaaacaaatttctgttgttaagacaccccggtctgtggtattttgttaagacagccctagcaaactaacacaattttgtacactaaataaagtccaatgcagttttaattttatagaaactgagacaaataatttaacgattgatttagtaaatcacttcagattgggggacagaggtgtacatgaattatgaaagtgtcagagatggatatttaactcaggggtccgcaacataagagagacgcaacatggagggaacgtgggagcctgggcgcggtggccccaggggggggggctttgcgggacgctgcccttgtgggagggatgatggcatggacgcaggtcctctgactccgtgggctcggtggtggaggcgcggaaagcgaactcgccgatgtgggggcgtgattccgcggccccgacgggagcgggataggacagaggaagatttggcggattggctggaaggtgccggaggcgataatagggg

SEQ ID NO: 10134 - DNA, 913 bp, Homo sapiens
tgaagatcgggcaacggacgcggggggccacgggcgggggagggaagctagggagaaaccagcctgtctttttctgactcaaaaacatgctggtaatttgcatatgagatatattttattaacatggggttatgtgggaaagctatgtcatctccgtattgtctaagaaatacagttcaccatttatggaaaccagcaccgccaccggggggggggcgagacacgcggcgcggcagggggccacggcggccgggccccgccgccggcgcgtcggtgggctgctaccgggggggggcggccaccggggaccggactccgcaagaaagagcgcgggaccgccggcggtgagggggtgcagctcgagacgcggcgtaaagcgcgcagccagggccgggcatgagccggaaacctggcgagctcaggcgccggcgaagggggcgcggcgcggcgccggcgggcgcaccaccgacccggcgagaggagacgcgcggcggtcttcgcgcccgcgtcggtgagccgcgcggggcggccgagacggccgggcgggcgccggacgcgggccacggcacgctcgcggcgccccccgcgtacaccccgcccggacggcgggatcgtacgccgtcggcgaagggcgggatccccgcgacacactgcatagcgtgttggccggggggcagcggtgcagactagaagggcgcgcgctggggcgggcgccagcgcggcagagaaccggggcggcatgtgccaagcgcccccctcgatcgcaaggagtggtgccgcgcgcgcggggccgccgtgacgcacgcccgcgggagcggcgcccggcggtgcgcgaggacgcgcgcggcgagcggggcggagagcgccgcgacggcaccctcgtgcggccgcccgaccgcgcgggctctgcggg

SEQ ID NO: 10135 - DNA, 1635 bp, Homo sapiens
  misc_feature (1)...(1635): n = A,T,C or G
gaagaagtaaatggngtataagacagacacagcgacgaggttcgtgantcgtccaatcgttgcagcatacaagtgntcgacacgagacgtgatacacacagataagacgcgcagtgtcgttctacactctanagcactctgtacctctataaacaagacattctgctacangagcgcgtgtagatcagtggagtganacccgccgtgtgtgtgtgtgaccatcgaactcaacacggctanaatggctacgcgttccatagcacaactagccntctcaataaagtgtatatcgaagacctcacagagatacttacgatgtgaacggtggcaactagccgcgtgtggtcgagtgcgcgggtagatggggtaagatgggtagaatgcaacgtgacgatcaaatacatcaacggcactagcgcacaaatccagtagtactaatcgcgcattcagacggtggaggaacgtgtcgtcgaacaatattaatgaggctcatcgactatgaatgtatatgnatgcaagatacnaacgtactatcacgattgcntacccacacgacagacacagctactatacatcacacagatacagcatgacggaacaacacaacataacgagcactcgagatataatcgcaacaagagcgcgaggcaaccacaccggaanactatccatcaatgagtacagatggatgtatatctcatacataccatanacgactcatatcatcatantcacacagtatcncgtgtgcgcgctgttgcgtgatgtgcgtggttgatcgtcgatctntctacncgctcagcgtgctcgacacgngactncaccttgaataagggagtgcgaaaccgcntggctatngtgtgcttcatatgtctcactacgtgcgcttgtgactgtcnccgtctgatccgctnatgtgggtcacatctagtatannaagacaagtaaagnctattgatatactatagagaactaataattaaatattatgaagagattaataaaatcagtcnctntataatctacntacctatanactcatctaccatcaatntntcatctnttactatccgactactctctcnataaatctcatctctacatancttactnttaacacntntacgcncttattatattatctgtctcttactgtgctcctcacatctctcgtattatatnctatctcaaatcaacattgatacnanttaaatcgaatanatncacacancaacctcacagagcncacacagaggagacagtctatccatctgtacatatatgtacatttanaanaaanagatgtactctcagcacttctaagtngnattnagctcatcgccgactccgnncgccnntcctcnnncncccacaccgccccgcagcacgctccgcacnctcnnnnnnnncanagnnnnnnctcccatccgtcncacacaacacnacnntncnnaccnccacgcgnnctcntacnccctnccacancncancgcangacgnnngngncggaggatngcacctncncnncancccnntcacnnncannnnannnanngaaannnannnnnnncccctngnaacnnactnncaacggatnnaggcannnaanannaanancaccacgcaacnccnnnt

SEQ ID NO: 10136 - DNA, 519 bp, Homo sapiens
  misc_feature (1)...(519): n = A,T,C or G
acaaggagaatatgaccacctgctgaaaagaaagccggtcttcaccagacgctggatctgctggtcgcgtgatcttggactgtctagcctccagaactgtgtttgttacttaagtcatccagcgatatggtttggctctgggttccaatcaaaatctcatttagaattgtaatccctacatgttgaaggagggtccttgtgggaggtgattggctcatgggagtgggggtggttcccccatgctttgctcatgatagtgagtgagttcttacaaaatctgattgtttcataagttgtttgactgtccctccttcacacgttgtgtcttgcctgctgccatgtaagatgcgcctgcttctccttccgccatgattgtaagtttcctgaggcctccccaggcatgtggaactgtgaatcgattaaacctctttactttatagattagaagaggaaaaaaagagaggagaacgaaatagtcggagagggggatagttttnggccttggcctcgttggcacta

SEQ ID NO: 10137 - DNA, 540 bp, Homo sapiens
actcctcacttggacactgctctggttatgatggctgacaagaagatcctggtggttgctggcttgtcttcctctaataaggagcctgaatttagaaggtgatgatatgagaaaacaccaaatattcagaagccatccaggcctgctttggatgtcttttgggacaagagagcatgtgagggtatatccaggctgcaaatagcaccgaagatgtcatctctgtggctgttctacgttctacttcactcccaaagaccatgaattacttcaaaatatgcctgatctgatttttttctaaagtactgggcagctgtgcaaacaatattaaaacagaaaaaatattttgtgccatgcactgccttgattgtacacgcccttaaaataggaaacatagactctttctaaaaaatacagctatattcaagacctgctttttaaatatccgtaatgtattattaccttttgtgttgctgttcagcaggtatcacattcactgagagtgatttgaccagcaatacaaccatggcctcgttggcctaa

SEQ ID NO: 10138 - DNA, 292 bp, Homo sapiens
tagtggctgagatggattggtttggaggaacccagagccattaccaggctgacccaagagacccaacattctagcaacagagcccatgtcttggagctggcaatacacagcctctatggattttacataatgaaatgatgaaagctatttagtactgcagtatatttcatgcattaatctaatagcatttttaaagccagttccctactcttgtctccctgggatagaaaagccatctgcaccaacccagaataatttattaaagacttatgaaaaaacaaaaaaaaaaaaa

SEQ ID NO: 10139 - DNA, 764 bp, Homo sapiens
tgagcccaatggaagctataggttcttcaccgtgagacaagataaggttcctggaggtcaggaattccaaagagcttggctgggcagttcttactttggagcctttaacatccctcactacctagcagttgatgctgatcaccagctgagagctcatctgtggttctctgccggagacctgcacatgactctccaggacagtgatttcagtcttcacaggctggctttctctggaggagccctgcagcagacacaattctgtcatatgtcagaagtacagagcagctgtggccggtatggtgttccagaagcctaggccttgctatgagagaatctctctccacactgcactgcctcagattgtggaggggtgatacaggtaatgtaaaaatactcttcttaccttcttcagtgtgtcttttcttactgttatgcaacaaccaggtactatggtctctgacctggtttcttcaggtcttgtgaatgtattcttgtgcatggacacttcttctaattgatgtttctgtggggggatgattgcaggcgagtcctattctgctgccttgctccccacctctatattttaattggcagtacatcacaccttgcttggacacaattgagaattttatgtttcccataaccaaattcaaatacatggtggccagcagaattcttaatttagtgaaaatggaatattggttttgctatgatctccaccccttgaaacatgttttataaaactctaagcagaaaaaaaaaag

SEQ ID NO: 10140 - DNA, 1383 bp, Homo sapiens
  misc_feature (1)...(1383): n = A,T,C or G
cggatgctagttgtncataatattgatcctgacgctgtctagcgttgacggattgttcagcttcgttcgcagttgctccggctgaggggaagcgtcggcgtcgagtgcgcgcgaggaggcggtctccatggtgtggtgtgcgtgtggagggtgtgatagtcgcgtagtgtgatccgtgatttcggtgantggtagatgtgagtctgagcgtctgatttagtagcgtcccatccgactgcgccggcgcgagcgcgtacacgtgtggcggntgagtgagaagaggtggcacgcaggagcgtggaacgtagcagatgagtgagtcgatcaacgcttcgaggtatgtatgaganatacatgcgcggtgaactaagggantgcaagtagagattgtaccgtaagtatatatcagagcactacgtatcgacgcaaacccttggtagcgcctcgtatgtgccgtgtcgtatagatgagcgcatattagatgtacattggcttggtatcgcgtgtggtctgggcggtccaccttccttgctggatataatgtataatgggatgatggtggtggattagtgtacacaantagtgagtagctttagtatgtatcgtcgnccgcgaaggagcggcggacgcggctgccacaggttagtaataagggangtttgtgtggtcttgtaggcgctgtctgcgcggtgcggggcagtggctcgcgcaccgcgctatgggccgcgcgcaaattaatgacgtgccggatgaaatgtgttcactctcctgctgtgttattgttatttctgcggtcgccacgaggtagtggcntggggggggtggaagtcagttatcgactcaaacatccgttatacttaactatctcactatatctctccacttcatacactccctacccgattcctcgtccagttccctctgttagtttgtgactatctctctataacataatttgccctctctcatccctcttcgcatctcctgctaccatcctactcagacgctctcacccatacatcctatatagctgtgacaaccgcgcggcggcgggctagatatggtatgcgtgacaccggccagctgccgcactcgctaccgcgtctcgggattcgttttatgtattttgttctttctttacgctgcgttngatttaggtatctgatgttnantatcctcacccaaccggtgcagactaatattatgggtatgcctcttgtgtggtgcgaggctatgtattatactctngtgtattcnccctcctcttaaaaacacntccccagctctccacttanccaactccaccacaaatatataacattgtacatacatatntattttttatatattnttaaaaatatattttttnaattntttttataa

SEQ ID NO: 10141 - DNA, 183 bp, Homo sapiens
ataggacctaggaagttctgagcactgactggtttgactggtcccctaaccacatttttcatctacgaatttcaatctttcaggaaactagaacttgctcctctactcctacaccccatgtttatgtctttctataaatgacttaactaatataatcttggagaaactctaaaaaaaaaaaaa

SEQ ID NO: 10142 - DNA, 238 bp, Homo sapiens
tataaagcagaagggatgctagtcggggaaggtgagagaaagggcctagagtgagcagaccagtgattaggtggccatctacaagccaagaagagagccttcaccagaaatggaattggctggcatgttagggtgggacttcccagccttcaaagctgagagaaaataaatgttgtttaagccaaaaaaaacaaaaaaaaaagtagaagaatggcctcgtgtggcctcagcggatgga

SEQ ID NO: 10143 - DNA, 478 bp, Homo sapiens
tgttgctgctccatctaattatcgtctggcggccagcataagaaatggtgggtcctgaagcggtggtgatacaacccctgcattatcttcaagccgtcaagccagggaggaataataaccccggacagagaggaatctgagtttgcaagccgtcaagtgcattgacctctttgtcctcaaccaaatctgaggtcaccaatcctttcggggctcagccatgatgttggcagaacagatttgccaggttcttctcgggggccccactacccttatatttaaatccttagtctaattctcatcttttcctgcccccctgctgcaggaaatgagagcccctctgtatgctgcaaagggggagccctgctttcacactttgcctaaattaatgatgatgtttaccgtcttactgcaaagcatagattgtactcatcaggaaccagcctgggtgacagctagaccctgtctaaaaaaaaaaaaa

SEQ ID NO: 10144 - DNA, 853 bp, Homo sapiens
tatttttagagcttacacagctttcttcataaccaggttcggggctcacgcgctgattcatttagcgagagtatatcccacgtgcgctacattatgaatatgcatcttaaaattcttatatttatatatactgatatgattggaatctatataagaaactatgaaacaaatctgtagtagaaagtttgaattaggaatgtgtctcgcgataaactcgtgtgagaaaggcggcaatttcaatagctgtaacgaatacatagtatatgtccatggtagaggatgaaaaactagctacagcggaagagtgactcaggaacctgataaacgaatcaattatggagaaaagaaagaaacgtgcgacccagcgctaattagaattgttatataaagctaataattatgatgaaagcaaaacaggactagaaagaaaagtcgtagcaggatactgtaccgctccgccgcttgatgtgctgcggtggcgccgtatatatacgattcaacctagtaagggcttcaattttacaaaggtaaagttattaatacaaaataacaagcattttttacacacagtatgccatcatctcatatcactcagctgatatcaatactcctttacccgccaatgtggctcttaggaactgatgggcatgcacatcaggatatacccaaaagatttcccagcagcactgtttgtaatagccttgagctagaaacaataaatgtccaccaagagtaaaatgtataaaatatacaatggaataccagcacatcaatgcccaagcaatcatttagttacgtcagatatctatattaaccctcatttttttatagctcaattttattttttaattaa

SEQ ID NO: 10145 - DNA, 228 bp, Homo sapiens
  misc_feature (1)...(228): n = A,T,C or G
atctggaggnttggtggggagattgttgcagacggaccgagaattgggngacngatcncccaccaaanngcatgacaaanngcaaagacatttaacccacaacctaatcttctggaaaatacaatttaaataaaataatggtaagtgattttcacctgttttcaaagtacatgatacagtttataagtattaaatttaaaaaaagactaaaatgtaaaaaaaaaaaaa

SEQ ID NO: 10146 - DNA, 744 bp, Homo sapiens
tttttggtggtggtctctgggctcgcagggtggccgcccgtggtccgggatgagcccggcggagcgtgttttttctgcgcgctcgcggttgcgggggggggggctttccccgcgggggcgggaggtcggaaaaggggggcggagacccccgggcgctgttttttttcccggggggtttaaaaagggggggaattccaccgcagcgggggggtggtgggggcccatgggcccccgctcggaaggcccccaaaatttttttttggcgcccggggggggatacccggggggggtaaccccgagtttttttgggccaaaggggcccccccaagaggttttttgtgtgccccattggttttccccccctttccgccccggggttttttttttcccgctttccgcaaggggcccggggggggacaaaccccgggggggggggttagggccccccttagggggggggggccaaagggccccggggccccctgggggggtccccccccccaatgggggggccaattggaaaggggggttcccccccccccttttttttgggggaaacaaattttttaaaaaaatttttgggggttttcccccgtttttcaggggccggggccgggtttttgggttttttttttaaaaaagggttttagggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10147 - DNA, 854 bp, Homo sapiens
  misc_feature (1)...(854): n = A,T,C or G
gtcaggttcacccccttggttcataccccctaggtccatgcaggctacaagtggcacttgaacaggcaacagtccgaacacagggactatgaggacatgaacgaagaaggtctgccggagcagaggaactgaaattgaaaggcgaacagggatgccgggccgggtctgccagcagcggatataagtctgtaaaatcagatggactgccaattggagaatgagagctgcccatcctggccctacgttctttcaattaattcataaacagaaagggggatatgcagggagncgaaggcccgtacgatttgggattccactggaggctatgtgatcaaacagacaactgcttatcatgaatgcacaatgtgggcaaccccacacctgctcctcgccacagaaggtttgctggaggcaatcactccctgcctcctgaggtatctcctgccaccccacacactgngtcccacgaatgttcccctgaagcctgcttctgactgatagctcccatctcctacccacccttttaacatttcttagcccacccttctatcggcccccctacgtcacgattcttgttcctcacctcagtgtcccccctccccctccccaccttaactcaccccaccgcctccagcaacttcgtggttggtcacgcccttatcaatgcccgcggcccaccccccctacctaccgccccattctacccctctcccccccccaagtaattacctctgcgcgccctcgccgtcttcatctacctgccatctcccctctactccccccctcctctccttgcaccccacccccatgccaccattcccgcccctcttgatatccgctggtatcccacaccc

SEQ ID NO: 10148 - DNA, 724 bp, Homo sapiens
cttttcaagtgcagccccctttgcaggaacagtgcggattcccacatttacagcacagcacacactgcaggaacagtgcagtttcccttgcgtcgcccagcatatgcaatccccactgcacggaagtcacccgcacaacgctggagttgccaacggtatgtgtttctaagttccacttgggagttagatctcatctttaataataatagttaaatccttgtttcgttcaagtttaaatgtgtataaactctgaaattctatttttacagatagctacaaaagctcacaaaatatatcacttcaaatccctacatgttatgtctcctgggcatacaaactacattgatggtaatgaactaccagagtttaaatcttatgtttcttctaaataatgaactcctgtttgtcaacctgtattttcacttttttctatactcctgtgcagtgtatttaaagaaagaaatatggaaaatagtgaaagacatagaaaagagtggtctatcaccaaccctcccccttcctctcttgtatattggaaatctccatctatgtagcccaattacatctcttcattagtctgatttggtgttactcacttttaaaatatagttgtttgcaaagtctgaaaattatcttgaaaaatgcaaattttttaatgtgtacaattctatttgtgctaaataaatttagacctttcttatattcaaaaaaaaaaaaaaaaaaa

SEQ ID NO: 10149 - DNA, 777 bp, Homo sapiens
ataaattcatagcggtccgacttcatatgcatctcaactataagtgcgttccttcccttgccaaggagaaacattaatagtgctaggattgctctcctagaacagcccagaagttgacttattaaacctattggaaggaaagggactcagaaaaaatattaaagaacattaataaggggcgaaacctttttctgggaaaagaatggctttcaccctgcaaggtaccaaaaaataagttgggcattgccaataagccaaagactggattgacctttaattccttatttaaaattcaattaattaaaattaaacccttaggaaaaaatggataaaaaaaaataagaaaaacgcagaacaagacatctcaaaaaaacggagaaaaggagagtttgtccccctggccctctatggcctaaagaggggagacattctagggcccttttcctttaagagaggggtaaattattgaacccttgtttcttgaaatctgttgaccccggaacctcaccctgcgagccagcggtttttactaccttataaggcggtatacacggtactccacaaaattcggggggttctcccagaaaaaaactcgcgggcccaaagggcctatcaacgggccctaaccctgataagccccgcttcctaggcactccactaaaagccaacaaccctctgaacagcacggagacaaattctggcgccagattagagtgcggaacccccccggggttaaaaaaccccagccgtgtccccagtaatcaaccgagtcgctat

SEQ ID NO: 10150 - DNA, 1389 bp, Homo sapiens
  misc_feature (1)...(1389): n = A,T,C or G
gacgggngaagggaagggnagggaggagagggagcaggcgcggcggcagggagggcnccgcggagaaaacctgagaagaacaagaaaacagaactgaaacacaaaagccaacccggagaaacaggacgaaaaacagcgggcaacgacgtggaagcgaaggcaggcgaggcccggcgcagagggcgcgagaacacaccccgaaaacaagaccgcggccgcgccgccaacgcacggcagccaaccgcgaacgcgggacccgcgaccaggcgcggagaggagaaaggcagagggggcaagagaacgaggaggaacgtgaaaacaagacgacacacacgcgcacaaatacacacagagcgcgccgggcaccgcgcagcgaagcggcacaggacggggagaacaagaccgagcaccggccgctacgtccaaaaacaggaggacaaccagagacagggagaagcgaaggaaaggaccagaggacgacggggnagacgaacggaagaagcgacaggcagagaggggaggtcgagagaggacngngacggacgagacaaggcagagaggcgccagggaagcgactacaccgcaccgaagaggagaagaaacacaaacagaacacaacaagaacctacgacagagcacccggaacctcgcaagcatagcgtcgtagtgccgagaagcaagacgacggacaggatgcacggaagcgccacgagcggagacgcggccgcgccgacacaaagcgcctcncaaaccggaacacacacacacagacaaacaacacagacaacncagcacgagacggaacgcgggaggagaggccggnagaactcacgcagagaagcccgacaaccaatccagacacnacgacggcaggtcgcaaagcacagagatagaggaagagacagcgacgcccacagaacagcaaaaggacgttaagagcacagcgcncncgaacgccacgacacagcacaagacgcacgtangtacgagcgtcaacgaggagggcgagcgcgcagccgccangtacgacacggcgcacagcaacgacacacgccacgcgcggcgcagacaggcgagntagcgacagcgagcgntccagagacgaagagacccagcagaataaagagaagataatgaacagaagagcncacacgatcactacagagacacagggtcgcgccgacgcgnggagcagcgngccacggagcggagagaggcgggatgaagccgagcaagncgcgcncgcacagacaacacacgcgagncaanagaacgacacagtcgcgacagcgcagacgcgaccaatgaggcacaccgcaaccgcngcaccacacgtcgcaccacagacacgcacgacacagcggaaagngacgagaacacaggagagag

SEQ ID NO: 10151 - DNA, 128 bp, Homo sapiens
atggagagtcttttgacaaagatgtgaattatctacaagcaactgagagaaaggcctattgtcctcagtgtgctggtgataaatttccaaatgatgaataaaagatttcctgtggaaaaaaaaaaaaa

SEQ ID NO: 10152 - DNA, 429 bp, Homo sapiens
ctttctgcaatggacaaataagtgatcaaaatggggttgtgataaaaatcacaatatctgcaccttccaagtctctgatggcttcagtgatatcccctggagacaaggtgtctgagttttaaattctcagtggaatgagtctctgcaagaggaatctcagacctgtgatgaagatgatgatggtaactaccacgtcatgcacacagaatctgtgccatgtaccaagccctttccaggcattgtctcacagaatcctcatgttaagccagagctttgcagctgctgaatggagaatgaacagccgtctcggtgtctggaggatgtttttaattgaagagcttgttttatcaaaaggagaagattcaagaatgggagaccagggccatcaatgagtacccaaacaataaacagctggcctcgttggcctca

SEQ ID NO: 10153 - DNA, 1432 bp, Homo sapiens
  misc_feature (1)...(1432): n = A,T,C or G
aaggttggntnnnnnnnnanggnannnnngnnnnatgnnnnnggngnnngnnnnnnnnnnnnnnnnnnantannannnngtntttttnnnnnnnnnnnnncnnangnnnnncttgtctcctnnnnacctgtacgncnnattanannnttggtccgtaggaacgtgcaaccgacgtgcgncntaggcgcgcgcagcgcgatattgacgaggncgcgcgcctggccgcggcatgagagtctatcataacctactatcccttgtgtgcgtgttcctctccgcgccttcttgtcgtcgttcctatgccgtcttaccgttcaccgcgctttgcgtgtgtatgtccccgctctcctnctggatgacaggtgacagttcatgactcgccctctcgcctatgcacactcaaccgcgcctctgcgcatgcgcgtctccgctcctctagtcgcagctgcgcacaccgggctatgggttgcgcgtcttgtagagtaggatcgttgatgtgtgtgtgatgtggacaccacgtatgtgacatgaantaagtggtagatggagcaatatcatatactacatgatatagaatgaggtagtgtttgattgtggtactagtatgagacctcacataatgttatatggttacgtatagtgaagccgcgatgtgtgagttgttatagtgggacgtatagtggcgtaanggctcgacgcgcgcttcctgaagacagacgagagagtncnagagtgagtgtggcgcgcgaaggagacacgagtaggtctctcattcgtagattagtatgtatcatctgctcacagtcacagtatcacagtatgcaattgtgtcgcgcgtcaccgctgccacatatggcgtagttatagtgttgcgacggcctgctcgtatgcgcttcatatccagctcacatactagtgatgtccacgcgtggtgatctcgcctccgtgtcgctcacgtcgagnctacgtcacgcttgagcagaacacagggcgtgatcggcggagggatatagtctcgcgtgcnctcctacccanatgtactaagagacatatcagtaggtgtgtatcntcactccgtagtagagtcacgtggacatagtggttgnacactantcatctcactggtaantcgtgtatacgtgcactataatggcacgtcgctgtgtgtttatatacatgtgacantcacagatattttatgagactgtgttcataantgtaatgtacagntcgctcatcagagcgtccgcatgtagatatggtcncgtgagttgcatcgcgacgcgagtctacctagtgtatatggtcgtctctgtgtctcgtcatcgctcatcttcnatgatgnacctctctcgtgtctaccagttatttgtagcactcgcactagtactgtctcgacgtgtgtgagatactgattatgtatgagtggagt

SEQ ID NO: 10154 - DNA, 866 bp, Homo sapiens
  misc_feature (1)...(866): n = A,T,C or G
gggcgcggaacctggtctaaacgagagggagaggnaaacnnaagctagttttatacttggtctgaatttatttcaaaataagaagatgaaaaacaaaagaccacttaggcttctggtggacagctgattgcagggattgggggaggaaggacgcctgaggaggctcttgcaggagtctaggtgacttggactagggggaagatggaagagagaggtcattcccaggtcatatttaaggaagttgtgtttgttttgtattgctcctataacaagttaccacaaacatggtggttatcaaaaacaaaacaaaaaaacaaaaataaaaaaaaaataatacactcctcagaaactcactaccctaaaagcaaaagaaaatatctcaaaaacttgggcctcgttggccctcaagggggggacctttgggggccgtttccttttagggggggtaaatccaggaccctggctcacggactcgctggcctcggcgtttgggttgcggggagcgggattgttctcttcaaggggggtaatccggttatccccagaattaggggataacccccgaaaaacctttggaccaaaaggtcctccaggggccccaacctgtaaaaagggccggtggtgggcgtttttcctaaggctcccgccccttacgagcttcccaaattcgctccctaatcaaaaggtggggaaccccgccgggattttatagtaccagggcgttctccccttgaaactccctctggccctccncttgtcccccctctgccgtatccgggaccctgtcgccctttttctcgttgagaaagcgcgggtctttctttaacgtcacccttatgggttcttcactcgatggtgtggtgccc

SEQ ID NO: 10155 - DNA, 158 bp, Homo sapiens
gcgggacgggggccgcgtggcgcgcagccgcggggccggggggcctgtgggaccctagccgcagtatagtgagaagctgacagaaaaatgaaaatagcaacaacaaataaattcctctcattaaaacgcttagtaatttcataataaaaaaaaaaaaa

SEQ ID NO: 10156 - DNA, 148 bp, Homo sapiens
tggtcctgaattccactccttgacgctgcctttcaactcagaggaacaaatggttagaaagctatccaaaaccaacctgttagaacatgtgacttcagtgactcattttcctcattaaaataatccttgtaaatgaaaaaaaaaaaaa

SEQ ID NO: 10157 - DNA, 374 bp, Homo sapiens
  misc_feature (1)...(374): n = A,T,C or G
agattacattgatcatccctatgttccagatactacatgatactaacaagacaacagggaaaatatataggaagaagatgagagacctttttaatagaataaagaaaaatgatagtgctcctatacctcaagctgcatggttctgaatttgattcagtaaatgcctcaaaatagaagtacattaaacttcaaggcaatcagagcacaactactggattgtcacaatgtggtaaaagaagaggtatccaaagctggcaaagacacctataggacctatgatgcatcnagatctttttagagccatttgacagcctctatgaagatgcatattgaattaaacatgttgccatccttctttcnnaaaaaaaaaaaaa

SEQ ID NO: 10158 - DNA, 1200 bp, Homo sapiens
  misc_feature (1)...(1200): n = A,T,C or G
caaggaaagaggtgncacgaccatgatacactacttgatagtgacgagtttctgtgatacgtgtgggattgtgtcactggcattattatctaactattgttgcgatatgagtgagcgtacttcggattgatccattgttagaatgtactgtgttatttataatctanagtcatatttatacgtttacatagcagacacttgccaaccacagttgcactcgcatatcacacgttagagacttgaagtcggcatactgggtggggtgctgtgcagcgctctactctcttagcaacactacggacgtgcgtattggcgaggtaggaagagttggggctctagaaatcatggactctgtgagtacgcaattcttcatagtcgagtggcggaccctctcaggttagtagtattgttgggttgcgacgatcgtcatttgtatgcctaccgttgtgagtcggtcgcatcttctgttagactcatttcgtacatgatacgctgttttcgaacgttttgtaacgcgtgatcctatatacgaggagagtcgagaggatcgacagcacactcggcttttagtgatataatgtggtttaggatgttattattgttcttcttcctgtcttggttggtcgtatctagcttctattctctttgctgtgtatcntagtatattggtgtgtttgttagattatgattatcatctttcatcatataccctgttcccactcgctccttcaatctctcttctcccgttctctgtcctttctctcttcttcctattcttttatcnctttttacatcnatatccatctctttttttttttcacttcttctttgtatttttcattttattcttgtcatttctttcttgcctctcctgttctttccntcccctctctctattatttctaaatctatccctatacttattatagngtttccgctcccctccacatactatcggcaggtgcgactagtntagttctatccatctccggtnnntttcgcttctctcgcgcganncnnngggggtttcancctctggcgtatnctaattantacccagtgacaccatatactcgcgattgctgtgagtcggccgtacccttanaaccccccccacaataaacncnncccctcnctangcctccaccgcgaccgaancaaaatggaggaagggnnnnnnnnaaaaaaaannnnnnaaaa

SEQ ID NO: 10159 - DNA, 223 bp, Homo sapiens
ggactgagagctggagaacgagaataggacctgagacagcatattgggctaaggaggagaggacaagaatcgagagagaaaaattcttcctcaatttaccacatcaaaaaatgatccacacatatatgttctcgaaatagtaattgctactgtctgccttccctcaatacagcagatgaaatgttaaattaaagaagcttttgttactggaaaaaaaaaaaaa

SEQ ID NO: 10160 - DNA, 244 bp, Homo sapiens
ttaatccagctataacgtacatacatcgatataattgcaaaaaatttaatactagtatgtactgaaggacttcatgctgcaactggtgctgagcaaaggagagctgtatcccctgtgggacccacttaaagatattgaaatacttcataaccacaagtggaatattatttgatttataagaattaaaaaccttaccgggtattgaataaagggttaaaaaccttttattttccttaaattttac

SEQ ID NO: 10161 - DNA, 702 bp, Homo sapiens
  misc_feature (1)...(702): n = A,T,C or G
aatacctacaccattcacaccgacacacgcccactagaacgaggaaggactctagttataaatagaattggcaaaattaattagaccgcgtcggcgatattccagcacgaacccgggtggcccgtcccccgctactgcgaacttccaaactgtccactgaaccagccatacagagagcgagccattacccaccacacgcccacccaccacatgcataaagacacgccatacgggtccgcacacagcaccacacacggnacacacacaccgccccctgagaggagaagaatgggcccccacactgaggcggcaagggggggagacgatgcccgtagacgtgacaccgtccgccgcctccgctagacaaacatatgccgacggacctccggctagcccatccgacacgcgtttggagtgtcaaccaacgacccacctcccccaccccacccctacacagctcccctagctcacaggcagacacgcggacgccatttccaaattagccaaagagagtaaaagcccgatagacctatatagtatgtcctaacagttgggaagagtaccaaaaacccccccgcaagaagcaatcttttttctatcaagggtagcaatacagtgaatattatctcatgtatgacagtgacaatgtgagagaacaggtgcaccggattatgagatttctgaaccaacaacatgaccatt

SEQ ID NO: 10162 - DNA, 152 bp, Homo sapiens
aagccacttggaagtggatcctccatccccaagttatcgagcaggtaccatgtggatcaggaaagaagctcccatacaaatcctttccaacttcctgacttacaaaaacatagataaaataaaatggttatttaaacccaaaaaaaaaaaaa

SEQ ID NO: 10163 - DNA, 1390 bp, Homo sapiens
  misc_feature (1)...(1390): n = A,T,C or G
atctnagtgactatcagagacatagtnacagtaaattgatcagacggtgacatagcgagtaagtcacgaagtcgcgcgccgatgtgcatcgctatctcgctctattgcgcatcgtacatacatagccaacatccaatgcatgactcaatataactcgagtgatagttatagaatactgaagnacgtangcgtgagttgctgcnctgtcgcgagcacgttggcngcggctacgtcagtgacgcgcatatactagtgcgatgagttcgcgtcctgatacataacattaactgtaatgatgacatacgtaacatagtagggcatggtcagtatgtagtgaggatatactgagctgngacactatgtatgctctgctatcgtatatatgctggtgagtgtgtatcaatgactacagttgacatgtggatgtgggtgcacatagagtaccagacataatcgtgacgtagagctaggtgtgtgaatgtcacgcgtggagcgaatcgaatacggttaaagtattcagtatgagagttgtgcatatacgtccaatacaagacgcattgagtatacaggtagcgtgagatgtagtgagcgttgtctgtgtaaancagtatacgtactgaatctactgattgcatttataattgttatccgactactgatggctatggtgaggagactatacgtgtgttctcatacgagggaatgcagatctattagataacgtgctactatgtcgtcagtcactnagtcacacattcgtctagaagagaagtgcgtgaagagagtgagtagaaggtagtcacgtcgaacgacgcaggacgcgatgagaggcgcacttatcagtgatgtagtatagataacagtgtgtagcttgtagcgatgntacgagaatgatttcantggatgaatgtaagtgttgcagagttacagtcagagggatcatatatagagggattgtcggataatatctgtgtcagtatatattgcagtaagatacacggacaatgggagaagttggcgtgcgaatacgaccagagagcgaaatnagcgctcaacaccaatgctcagatagcatatcatcacccgcatagtgtataatagtaataatatcaaatctagtttagaacaagatcgtacaggatgaagtaataatataatgtagtacgaggtcagctaggtctatatcgtgtcgtagagtgttaggcagggggtggagagcttgccttagatcgcccttcgcctcaccgggcacaccacggacgaacgatgggcggaggtatatatatttagagaatgtagcgcccgacgtgtggtctactacggactcggacgatggaactaggtaccaaaagattgaattaaacctagagtgagtctgtgtgggggcgtg

SEQ ID NO: 10164 - DNA, 1652 bp, Homo sapiens
  misc_feature (1)...(1652): n = A,T,C or G
tcagntgtgtctatntgtgttagtcagcgcgtactctcattatggtntcgcgtcantgttncgtgntgatgagtncncnctgtacgcacanatctgatgtatacgtggccgtgtacgtcagcgtgttgctgcgctgctctnttgcagacgtgctggcgcgtcgacatatccnctcagagtgcactcntgactatcagtggccgctacgtgtgaggagctgctctctgntacgacaccgcatgcgagangnttgcgatgtgangngatgtgagacgtgtagtgacgtcnagtgttccatacacacgaccgccgtccactacgcgcagcggcgcgatcgtcgtcttcacaatacatcgtcgcnancgcaagtgttcttaatgagccgtgatgncngtgacaccgcgagagagacgtctagcgagcanagtgagacacaaagtctngtgtccagctaganatgaatntgctgacgcgtgcgccctatataaaggacgcaggactccaggcttctctctctagggcgccacnccatagtgtgctatagttgagctcttgncctagtgtgacaggtaggagggagcgcttctgngacctagctatcagtggatggacgcatatatataggtcaaatgagtgatacgactagttatgtaggcggagtagtgtgttgttggtgtgcactgtagtgtcattgtagcagagctgcagtcacgagtcgcgcgcgatggagaagtctcatacgctgactgtacatcttctctcctcttacgttgtgtgacatatggcaatacccctnagaaagtgtgtggttctatgagtgtatgacttctagtgtgatgtcatatcttgtctgctctctcgaagcgtgctagagcgtgacganaagcgaaggtgagaggcattgatgacatgatgttgtccgccgcgatttaatgcagactatgcttgtagcgatatgaatgacggtgtgcgccgnaggatcacntgatcgcagttctatgtgctaatcgtaagatagngcgaatgatctttcgacgcagtngcctgggtgtcgagtggatgctcttgcgagacgcggattgcgagcctagtagtggatgcgcgcttgttctccgtaggagggtagaggatgaaaaatcaagtaggaggtacccgagaatgcttagtctaactatcctgcaccaagtgcgtcgtgatgtttgtangtcatcgttgttgcacagtacagtagtcgcagtgagatacgttctnanataggctactactagtcgtgctgctacantgantgtnatgtagtgtcatatctgcacactgatacagtcttagtcaggtcgnactggtcattagactaantacgattatagcctatggtgactgtcgttcctggctatagtactgtagggcagtgatagtcagtggatgagtgtccgagtctgaaacagattgagagtcgncntggtganagagatatatnanatatanatatanananatacagcgatggggtctcttctgctctgcgntcntaacgngnnctgtgtggnttagtntnagttnntntctagattaacgaaaacctttccccctttccattattnatctgtgctgtagatgtctcgcctattaaccgttcatcttcgtgtctctctctt

SEQ ID NO: 10165 - DNA, 172 bp, Homo sapiens
attgttaattattcattatatattattaagataaaagatctaggggggaaacacttttttgttgactctatgaacgggcattttggatcacatgaggcctaatatgaaaaactgaacattgtgttatcaaaactagaaataaactgtatgtgaaactgcaaaaaaaaaaaaa

SEQ ID NO: 10166 - DNA, 1658 bp, Homo sapiens
  misc_feature (1)...(1658): n = A,T,C or G
aagatggagaaccacagccacccaagccgaggcagaccccacatgtttacctncgtcaggttatatccataccgaagatttcaatatcacaaaaacaagacgaccagaatcaaatgtacgcctctcacacagcaaaatatgagacataggtataaaaaagaaaataacatagtagacgagacatactcacaggcacgtgcacatngatgagagaagcatgtcgatgggctaggaggacaacaacctgacactgtatatgacatccggtaactgcactatgacaccagctactgggacacaggtcggcagcgcatctcactcgtgaacgctcgacgtcatgagtgtgaccgtagcgtatatatcaccagtaccacgacgatcgactgcaatggacctgtacacaacccatctcagttatcccactcctcatacgatatnctggaagtgattcaccagattcatcaggtcaataaatatacaccaagataaagcccgttgagagcacacanacatactaacaccaccaccatgaaacgagatcgccccgaacacaccatcaccgctactgatctcatgacagtaacgcgctgctgatagcgcgcgcgaaccacaggtcttggtcaactcagcacgttgcccgggttttgttccgccacgctccgtgtacgcaccagccaccatcacagtacgagttacacccttgacccgcgagcatgtatgtacacgcgatcactttgcaacaccgccacacaccagagtgtgacattaagacatgtggacaacatggaacacaatatttgtttcgtcctaatgcgcgtttttgctagacaactggcactagaaacatagacattacataactatnacaacacgattattcgatgtcagggctcgcgacccgctattcaacgtaacataactaaattaatagacacagtacacgtaaaactgtcaaaaaagcaaacccaagatttgttaaacaccgttcattttctctccaccaacaaaagaggttatagcacaccgaccgggctatcgtcgttttacccacacgtaatattctaggcctatatcatggtgcaccattgtagtaatcacctgccccacgaatgttacgccgcacatcgcgccgttaacacaaccatcggacacaaggtggggagataaaaccacacgagaagtcgtcgaccgtcgaccacctctgaccaccgacgatcgcaccctcacaacacctagagcaccaacatgtcgcacatgctatcaacaangcacgccacactagtccacccactcgcggnggtattaacaacaacgccgccactacantgnanctacagacgacgcgcaatngnacacagatctctcgctggtaaganaatatacgagtacgantnatacgngataccacgccgtttnanttaanactcgcatcgagtgctcactgacacatcagcgtgatgatctcatgtcacnnatcacactcgaccaccccccgtatattatatagcgtagcnttgcagcgaccccatgtcnctgtctctcattntanttgactcacagctacgactgncgtnctcgtatggtctgtgcgagcgctcgtacgcnttacccgacacacgccatacgtagacacagagcgtaaancacgacaacgagat

SEQ ID NO: 10167 - DNA, 1175 bp, Homo sapiens
  misc_feature (1)...(1175): n = A,T,C or G
cacgaaagcagaaaatggagatcatcgtctagtccgagtagtgtgtctcgctcagtacacgtacgcgtacacacgtgaggaaaggaagcggggtaggtagtgtagttttgataatatgtagagagtggatagcgtgtgtgcaggtcggatagttaactaagtgtggatcaaataaatagttattagaggatgtgagtggctaggtgtgtaataacagagtaatatatggagtattgtcgtgtaaattgaagatgcgtaaggtgtttgaagcgagtaatagagagtgtgagagtcaatcgtgtgtgcgtgtgttggtgatgagttatttgtatgtgagtcgtccgtggttaggagcaaagtatgatgtgaaaatgacagattggtgaagatggaacgtgaggagagataagaaattagaaatgagaaaggagacgantaaagaggaaaataagtacaaacatgaacaatagatcgattaagataaaaatcatcggatacataaggttttatgataacaattattagtatggattataatatacttatatatatataagatgataagttattaagaggagaacaaacatgatgcctaacacatccacgaacatactattatttgtttcgtctttatctcgaaccgtagtgatctgtcaacatggagaggcgtaatatggattgcagtatatgttaatagtgttggagatcattgtgaagtggtctataatacgttgttcgtcgagagtatgcatatgtgttagaatgtgagtttgtgtctgagatagatatagtaaagatgaggagcatataaggacgcgtgtacaatatagtattggaaaacactcacatcagacttatctatttcgtatagatttaataggttctgataagaagagagtgagggcggcgtaagcgatgatgggctagtgcaatagtgttcgtgagatgagcgncacggccaactgggtgtcgacgaccggcctgagcgctcganataggagcacaacgataagtggtaatgttatacgacatatgatgagggagtcatgatcgattatgggaacggtgtcgatgtgggattgaatgtataaacaagatggttggtcgtcggctggttagatgaatcgacgtaatctgtgatggcgggtcgggacgctgtgacgttagcgacgagc

SEQ ID NO: 10168 - DNA, 147 bp, Homo sapiens
cctaggaaacaacgagaggactgctgtctacaaagaaggaagagtgccctcatcagacaccaaatttgctggcactttgattttggacttgctagtctccagaaccgtgtggaataaagtttgttgtttaagccaaaaaaaaaaaaa

SEQ ID NO: 10169 - DNA, 1207 bp, Homo sapiens
  misc_feature (1)...(1207): n = A,T,C or G
cactgnggaaagtagtgacagcggaagaaagcgtanagaagcagatctggcgagtgagacgcggcagcgagacgagtgcacgtggagacggcgtnatgggagaacacagacaccagtgtcactagtgcaccctgcactccaaccagcgcacacgtatagcagatacagtggagcagaggtgcagtggatagngggcggagatacgacgtggcagaacgagagngagagcagagcagtgtaatacacagcggagacgaggagaganatgaggctgctcacgacaatcgccagtagtcgcgcggnagcagagtagactgagacgcganggcgacacatagcacgacgacaaggcnacacgcaagagatctgcgcgcagatctgagtcggagcacatcgacgcggcgagtgagtatgtgagcgtcatacaganagagaacgatgacatagtattgacgcgctggcagtagcgcgcgnagagaacgagggaggntgcagcgatagactcagcggtgacggaagtcgactgcaagcagactctacgcgctactgttcacataccagcgcaacacgtccggcaccaagcaccacagatgactaaatatactgtcagaacttagactaactaacatgagcgaacacgaaatagaagagacacttcgacaatataattgatcacagaccgaacatacaagaacaaaccaacccgacgagagaaaagaaacaacaagaacagccgagcagtacatgtcctgccagccgcagcacacgagcaggggcaaagcaccgcaagccagtagagagaggggcagacaagaccagaaaggcaaagcgcgcaggtacgagcaagcacgcatcagagaaaaaacataaaatagacgcaaaggtacaaaataaaggaagagtggataatagaaaagacaagatacaatgaagacgactgcaaaatcagcaagataagaacgagctagtgcataggacataactggcaccgtacgcacagaggggagagaaggggagccgcagggggggggagcgcagtagagcgagagcgcgagcagagagaggaagccggccgcggagggacgaggtgcgaaggaatgagccatagacgacagagaccagtgcacgaatggaacgaaaactacgcaaaggaaaggagcaatggtggaacgagggaaggatggaactagctagagcggacgcagtg

SEQ ID NO: 10170 - DNA, 187 bp, Homo sapiens
  misc_feature (1)...(187): n = A,T,C or G
taattgacaccccatgaattttatctctgaccacactcnaccctttatagtgactctagncgnggttgcaagaagaaagcagccatatactactaccccttacattacctcttctcttctggagttaagctgccggacatggtcagagttctcatgttaaaactttcaaacttgaaaaaaaaaaaaa

SEQ ID NO: 10171 - DNA, 288 bp, Homo sapiens
ttttttttctctcgcgatacattttatttattatgtggtgtggtggcctagctgctgactgtgggtaacattttcagcaaagactttgacctcaagcaagatgaactccaaataacgcataaagtaacatcaacatgatgcagtgtgtgtgaaacagatctcggtcccgtaagagcaaaagagaaggacaaatcagatcatcacacgggatgtcttttttgtgcgattttgcattttcccattcaaaacaaaaaataaataataaatttgaagctaaaaaaaaaaaaa

SEQ ID NO: 10172 - DNA, 149 bp, Homo sapiens
  misc_feature (1)...(149): n = A,T,C or G
ctctttacnaaactttagtcactagctgcggctagacagnncacagcgaagccaacggagcagaagaccaccggttgagacctgcccaaattcctgacctcncagattgtgagaattaataaatcattattgttttaaaaaaaaaaaaa

SEQ ID NO: 10173 - DNA, 1384 bp, Homo sapiens
  misc_feature (1)...(1384): n = A,T,C or G
gtgtgatagatgttgttgatgttttggatgatcgtagttagacatttanttattattaagctatactgtacactgagaggtgacggttcgtatgtgtngcgtngtaatagctggtgtaccatattgtctgtcaacatgagtgtactggtaggtatcgctacgatactntatctgacgaatatcttattaacgagccggagtggagtagaagtgtgtagtactacagagatagcagagcgtctgcgcggacgcgcgccagtcagcacacgctggactatcaggatataacatgaagacatcgtcgaaagtgcgttgtggtcgtgtcggnggtgtagttgagtcatatgtagcagtatcggactgggatatagataggtgcgatacgagagctgagagacgtttatcgtagccgatcattataggcctatctataatgacattgagccacgcgataagtgatttgaaaagtcggctgggtatgagtgtggatgtgtcaggtaacagagtacctgtagatcgcttagatcagagtgcggactgtgtcgtgtcgacaagacacgatacgataccacatcagtaatactcatagtcagtgaatagtancataatacagctaagcacaacaagtatagttcagagactacatcaaatacatacgagatcatgcattagatataatatgtataatatatgcatgagcatcgcagacacacaacacttcacaaggatatgcatgcaacttacccagctcttctagccatcagttactctatgccgcccgacggcacacacgacggcacaaccgtgcgatagtgaatagccggggatactcgtcgcctgcgagtaccgctctcgtaagtctatacttaatgctatcaatattcgtttatggaggtactatatgggctcatcatgggacaaccatacgatatctagaccacgactaaatactactgatagataaagcgacaactgtaaacagatacgagatatgaaataagtaaagttacaaaaacacagatactcgcatacacagtagcaatcatcaagtcgttagttacaaggtggatnttatcaacgggagtatgatggggggtgtatcgccataggtctggagtagaggggaaggtaggtgggaggaggaggtaaacgactccgcttagtgatgcatgctgctggaagatgaaacggagcaaatcgatagatcggagcatgtgacacgcggtggcgatgtcataattactcttcggtctattcggtatgcgtcgcgcgtgatgttagtacacgatcggccgactctattaaggtgtcagacgtcgagacagacccacaagaactgaggacgagtgacaaatcaactgataactcatcggctacgcgtatc

SEQ ID NO: 10174 - DNA, 2043 bp, Homo sapiens
  misc_feature (1)...(2043): n = A,T,C or G
ataatattataatatatgaagcgatncgcgcttgggatcgggngtctctgggngtgcaactaatatttttaatntccgngcgnntgtgtctcgatactgtgtcgcgatgcccngtgcatcgaccgcngtctntacgtgtcactctntacatatatagcncgagatcatctacttatatagagacaacatatacaagtagtaacgcatatgagatatnacaatatgtacatgatgtatncgagagngtcaccgtgatgcatgtatgtctagtatatcacactaaatataacatatagagagttgttgatatgtattagngtggtgtagtagtacgtggtaagcggcgatattcacacgtgagccgtgtaccacagttatactcgntccgacagcgtattcccatcggtgtgctatgcgttatcctcaccgacacgncagtatcacatcgtcactatatcacagctattcacgacattcccacacttgtcntcacaacacttcactcgacctgctatatgtacacacggtgacaacgcatcgcatgtcgtgcgatgtanttgatactacgaataccacaaccacgcnatatctatatagcgatcatacatcgcgtanttntattgttctattattgtttgataacacngatgactgtatcgatttcccatataatatactccacatatcagtattacgcgcngtaagtaacgcaccatcacgattggacagttagtgcgttgtagcaagtgttatgtgtcgtttgagaattgtcggcaggtagtgtggatattcatacacgtgttgtcacngttgtgttgatagacacagcgacacacaacgtttgatgtttctgtcgcctcncacnnttagaccgtcatttggttcgangactcacacgcgcgtcgcncgcaccacctacagcaacatctacaagacgatattatcgccgtgtcggagtgagtgantgtgatgataacgatagcaacatgagtgtactaacagagagctcncagatgacatgtgggtgccgntagtgcagcattcatgtcgnagtatgtacaagtagattgtttactctagtgacganatggtggtctgcgtgangtctatatcgtcgcagttgtacgtcgacgtgtgagatgagacgctgttcgcagacgtctggttgtatgtgacacgcgctgagcgactacgagatacatacactaatgtgttatgactggtttatatctataactgtgtgactgcgctacagtgtgcactagcatgacgaacgcgcgatgtattctgtatatcacacgactatttgtgtgctctgacagcgcaacnggttctgcttctatcttgcacgcagacgatatgtatataggcgagcagttatgtgcgaacaccgttattcgtatatacgtgcgagcgtgagacgtatcgcaancttctctgtgtatacgacgctcgacaccacgcnnagataacacacactcagnttccgcagtgtgatacaccgactttgagttgacgactgacgtattgacgttatttcgacacgatcgtttanacgagaggtgtcataaccacgcgaataatacgcattctgcgtcgtgctgttgtgtcataagtggcgaccacatctnctattcgcgcgtcgtatataatacatcagcngcgacaacnnnttgccgcacgtatgtgcgtngtcgancacgcataacagcgcaanacgaantntgtcagatagcgagctattgtgataacagactgtgagcgtgtgtgttgacaagctggcggcgntgcggtgtgacgtagagagtgagtgtgaagtgcgtcgggngagntagatactacggacgcgtgctgggactgtcgacanttccccacatgcctacgtggtttgnantntacacagaattcccgagncacgctatgtntgatcatctntatcatatacgccacgctcacgagctgcatgatgnatatactgcgtatgtgacgcgagtgcataagnacacacgtgctgtgatatagaagttagcntactcacagtgt

SEQ ID NO: 10175 - DNA, 266 bp, Homo sapiens
aatacgatatctcatttaccctataatcaaaagaaaaagggaaatttatagacaacagtagtgccttcattataatatgatgcagaagcccagcatctcagctgtaagaagcaacatggacaacgcattacactagaaaaaaactcaaaatctgtccagaagacaagaaaaggagagatggcacatcatgcctgcatggattttacagaatacttttcatgtatgtcaattcatataaataagattttagcgtaaaaaaaaaaaaa

SEQ ID NO: 10176 - DNA, 162 bp, Homo sapiens
attataggaaccccttgcggagtggcaccccagcggcccgggccccgacgcccagagacgattctcagggagggcttctggttttgctttggggaatgtttttaccagttgcttttaaataaaaagtaatagcgcttgctgggtgctggaaaaaaaaaaaaa

SEQ ID NO: 10177 - DNA, 905 bp, Homo sapiens
  misc_feature (1)...(905): n = A,T,C or G
caccaccaatcctcccaacccctcgccgacatcagaccttatctactcttatgagncaccagcagcggcttgatcagtgaccccagcgaaggccaaacggagcagaagaaccaccggctgagacctgcccaaatttctgacctccagaattcgtgagaattaataaatcattatctgctttaagctaccaaaaaaccaaaaaaaaatggcctcccttggcctcaccagtaggagatctgcaggccgcttccctttacttaggagtacttcatcgaccctccctcactgcctcgcttccccctcggcccaatcgcgctcgcccccaccttcccccaccctccccccaagcccagcaatattgcactcccctatacccccgggcatctccacccacccaccatcccgactacccggctcccccccccgcctccttgctctatctgtccgactttatctctacgcacccaaccgttgtcgcccccgtcctatgttattcaccccccacccaccatcctcccccaccgcgnnnggggggggggnnnnnnnnncnnggcccaannnnnnnncccccccctctttccccctagaaaacaaaacttcttgcngcnccaaccgggggtagggggngtacatttngccggnnnncnnnggnnnnnnnnnnnnnnnnngnggggngggngnggnccctctcctcatcgcctcacgcctgctatgtattctcagctctggccgaatggccgctcgcgcccgcgcctggaacttcagtctcaccacccccccccgtttaatccctagtcttcctctctctacttcccgaacacgctctttaccgacaccacctcccacccaacctattcttaattagacctaacaatgtccctgcacccccgctctcatctaaacct

SEQ ID NO: 10178 - DNA, 2052 bp, Homo sapiens
  misc_feature (1)...(2052): n = A,T,C or G
ccgncatgtagtcgancgagtgtgatggtgcgtcnatcgtctgcgtgcgacgagtacttnagangtntgcataccacgtcagtcgcgagtgtgtcgtacgagtagtgtgtcgatggtgacggttctctgacgcggctgtccggngcgagtgactcagtgtcgtcangngcgctgcgatgtcgctgttcagcngantgctgtgntncngccgtcgacacacgngncncagttgatgtgatagcacgcngcgtcgacgcagcagctgtcgatcactatactatgctcgcatccagatatcacatactctgtcgacagttcatctgttatgcagactgcactcgtacaacangagctactataagacgtancgcgactctgatcactttctgatatcgtcgctatctgcgcgctangtgctgctcgtactctagatgtcagtcacgctacatnacgcgcntccgttcgtngntntcatgctcatgcgctcgactgtgaggtatngncangatgtatcacgcttgctatactctatancagacatcgtattagnantgtgcgagtcgctatantccagcatcgcacatgacctcgcgatacgnactgtcaancgcgagctcgtctagctagctctcgtacagacgagtcantctaccacgcgacagtatctgcgctnacgtcgtgaagagcatgtgaangatcatgtgtgtctgcgcggtgcagtgcgntngcgtcgcgacgcgncacgtgcgtatatgnntgtcgacagtcagncnactgcgctcactcagtcagagactactantcgatagcgangntngtanangactcgatagtgtgacgtcgctntngtangctgtgatgatatgcagagntgtcgtncgtctcgctgntnttagtatcatcagtgatngcctgatcgcagagantgtatgtgtcgtgtgacngacgagcatagacgcagtangctagccagcggccatcgtcgctagtccagctgtgtcgttagtgcgtngngcgtanttcgcngnaagntgtgntgnacgtacgcgcggcctgtcgacgagtcncgctcgtccgtgntatgtatgctgatgagcgcanagcgntgcacgtcacgtncacagttcgtcgtgtgcagcagcgttgcgcatacgantgagcagtcgtacagtgtcagtcacgcagactaggctgcacacagcagacnatacacgcgatgcttgcgctagtcantactcagtcagtctcacgacagactntagtatacatctagatctgtatgatgactccgtctatgcnatagtgcatgatctacagtttanttcagtatacttcgtcggcttgatgagntgtgagtttcngagcgcgcgtcattctctgcagtcgtgtgtangcgctgtcgtgatgctggtatagtgagtctgtgagtgcgcatagtgcatagatgatgacgtcggcagctgtgctgtgnangcgtctcatcgagtcgaggtaggangngancgcgtcgngtgctagtagnggcgtgatnaagntgtngtgtctgtnggacgtctcgagatcatcgaaaggactatcaggtcagactcgctangcntctcgtagccgacgncctgtnctgtgcgtcgtcgtatcgatntctgctcgtcgngcgtcgagagtcangagcgctcggctcgtgcgactgtcactancgcagtgtgngnantgngctgactcantagccgttacagtctcgcctgtacgcgtcgcgcagtgctgcatanagatcagtgnantatcatacagtangtgacnatgatgtgtcatgcgtagcagatggacgctagtggtctgagangttgagatgtagtcgcggtagtagtcgatagtngntnntgatacatcgtgctgtcagcatgagcagcgcgtctcaccgatcatcatacggtgtnatgtggcactagagacagcgtgcgacgcgcatgagagangttctacntcgcagctctgcgcgngatnctgtgtgtcacgatgtcgattcgctgtcggtcgaccttagctagagagtgc

SEQ ID NO: 10179 - DNA, 308 bp, Homo sapiens
  misc_feature (1)...(308): n = A,T,C or G
atgccatagttccaagtgacattcgattataaaagaaaaggaggggggggcctaggtgttgaccnnctggnaaaccttatgcggaataaacgttagcaggtggatcaagaaacccacagaacatgtttgtgttgaagaattctcagcaagtgccctgtgagagtgctcccatctggaaaggactgcagctgtcttttggcatgaactagatgggtgtttgtaacaggttcatgtcaactcttttatagaaaatcaactcctaaaatcattgtaaaattatttttttatttttatgaaaaaaaaaaaaa

SEQ ID NO: 10180 - DNA, 1343 bp, Homo sapiens
  misc_feature (1)...(1343): n = A,T,C or G
gacgttacgatacgaagatatatcttataatgttccaaaagaccgngcactagagagtggggcaaaaagagagcacgagtacacgttcgcgcgggcgccaaataagcgagcggcaacattgatgtaaattcggatcgtcggtcaccgcgagtacccacccgacacacgacaccttcccctatcgcgcgacgtcaagagacgagaaaatggcgggagaaacgcacacgccgcgccgcgccggcgccgtatccataacagggccgcgatagcatagtcganggccatctatgggtcatcaggcgcgagaccaacacgaactcgacgcaaagcgacggatggacgacaagtaaacaagtgagtaaaacaaatatgtgtgttaagagaccacgactaactantttggcagcgctcatccatatcgacacgactagttatcttgacaacgaccacaggcgaagagggcataatatagtgcacacacacagttactgcgcaaagcgcacgccgcgcacgtattgcatcgatgcagggtgaatggtcaccacagagtagcacccgtatagatgcactcctgatcgcacattgtgccccagttccgcgacagaaggcacgcgaaagatctcgctccagtgtcacgggtcggaagcgcagtatgcccacccgaacaatggtataagcgaaagaagcgaaggtacgacgagaangtgccgactacgcgcaccggagcatagtagtgtgactcatatatagcgctcaacttaattagttgtcatccgagctatgtgctgcantgcatttgctatgatgcgtccaatatctgactagcggtcagatcgtgtattgcgttgtgagcgagcgcgaagatgcctggagggcgcagtagacatacacgcccgactccaccggtcgaagaatgagcctgcanatgtcccacgagtagtccaaccacttgtctaccgacgcagcataggtcaacactacactgtgtaccggtcatacaatatttgtatcaccctagcccgttgtgctcgccactgtgtccatgtcggctctaccacaagagtgtgtcatntcatgtatgtgtccatcgttagaatcgtgaggtaggcaccggtgaggagtacagtgcctggctacagtcncgcgaccctcggcgctctagtggagcgacccgcagtggcatcncctaacggtgcgacacatctcagacgtgtgcatgagcngagancgagagtgtgcgacaaggtcgccgccacgcacacccatgcgttgatgtcgctcgtcgtgcgcncataccnacgctgtngtagtatatcatatcaccttctggtggcgctcactat

SEQ ID NO: 10181 - DNA, 849 bp, Homo sapiens
attacaacctgatattttgcttaatgatattcacaactactacaacgtctagcagcccctattaagtgtcaatagaaggggccaataaagagtgattcctgaaataaacactccagggtagagatacaactccgagggtggccagtacagttctagctataatacacaaattctaatcgaaatcgggaaccagacaggggggtcatcaagaggaaacccatccaatgggacatacaacacacaccggtgggagagcaccaccatctggggaagggacaccactaagtttccatagtacagccttcgttgtggtctaaaaaaataagaataatgatcaggaatggccagaatgatatttttatgtaccaaattaatttctccaacaagaaatacataagaccgtatattaaactactatcgaatattttatagtaaataaatatagaacacagttctttttgaagaatatttcaaatggatacgcttaaaaatgtttgaaagacaaacacaacattcgcgtgaagattcacttcgcagatgtgcactcttagggactgaattgtgtcctcacctcaacattcatatcttgaaaccctaacccgcaacaggattgtatttctagataggagctttaagaaggtacccaaggttataagaaaagagagacatcagggatgcaatgacatacaggaaaggctacgtgaagacacagcaagaaggcagccatctgtaagccaaggagagaggccttaggagacaccaaacctgcctacacgttgatcttggacttttagcctccacaagccggagaaaataaattcctgttgttttagctaaaaaaaaaaaaaa

SEQ ID NO: 10182 - DNA, 1238 bp, Homo sapiens
  misc_feature (1)...(1238): n = A,T,C or G
ttatactctcgatcaactctgccccgcgccgtccccatggcgcggtatgcggaccggtgaatgcggcattctataatcacatccaaccaaacgtcacctacccgggtcaattacgccgtcctttcgtgggtcctgtccgcacacacaagtagctgaaaagcgcggtccgggcccgatgccggcgtttcccatcgtagataaaatagggtggagggaaaggcaatatatggaaggagcggaacgtgacctcanaggcgagagcgcaatacgcaacaactgcaatggcgcgggtgttggtctcgcatacatgtgctgtcgtcgatctttgtgtctggcggcccggaccctctgtgtgcatcgttgttaccagagatctcnttatttggttgcaccgcggccacggtttattacagtcgctgtgtatctctccacaaggcacttatcctttcacggcccgcccacctattgtcgtcatcgcgcgcgtggagtctccacaccacatctgtgaccgtttcatgcaccctctgcgctccatctgcttctgtacgccacgattgagcacaatgtatcccatccatacaccacgaccgttagtgcgttcgcgccgtcggcacattggtgtaantgaccgatcgtcttgggtcctctcaacaatgcatggcacatcatacatgcatacattatacgtcgtctaantattgtccgtcctactgataataagtagtggtatcggaagttagtggacgntgactncgcacttactgagtcgcgcatatatatatcttcgtctttagttagatgctcggtctaatagngtgctgacgctcttctcgctatgntgtgcctganagtctttcacgttatatctacctcacatctgttgttgtatcaagccgtagctcatacgagtaacaatgtcttgtctccacaacacaatcggcacctacgtccctgattgcatatcagtcatttgggtgttcccacatcttctttgtccaccctcttgtatttgccgcaccaccataatggtcctgtacttgtcagacttgtantgcgcgtagatgcatcagaatgtagcatgtctttccgtatcgatcccatatgacattgtataccctcagtagcgccctatttgagtccaccatgtttattgtacaatatttttgaccgtacctccatcccattgttgtttttactgccccacacctccgtggattactggccatctgagaccagtg

SEQ ID NO: 10183 - DNA, 1066 bp, Homo sapiens; identical to SEQ ID NO: 6336
  misc_feature (1)...(1066): n = A,T,C or G

SEQ ID NO: 10184 - DNA, 1848 bp, Homo sapiens
  misc_feature (1)...(1848): n = A,T,C or G
agtagtaaagggccggtgtgtatgacgtagtagcgcggtgaccatcgacgtacacagcagtcgaacgatgttaagtgatgcatgngacgcagatctggctcgtagtagatctcggctagttcgtctagactgtttgtagctgaagataatcgaatatcatgggacgattgcgagtacatnattgttggatngtcgntagnatacgtgaggtcggttcgcggattgctatcgtatgactcttagtcgtaatcacgtatatcaacanagatagcagaaaggatgcagcagtaatcgcgtcagcaaggggcagaggtgtagccgcgccacatcagtgcgcgtcgggngcgccngccaccactacagcgtagaccgcaccgcgcaccagtgctcgggtgataccgagagtgcactggacgaactctagcaccattgtgctgtcaatggtctcatgtggtatgtgggctcatcatagtctgtngntggtcgctctacgatactgaagtagtattatatggtaggggtaggtgttgacgaattaatgttctgtgttatgtgtttntgtcagtancacactgtttgtgattatattgatgattgctgtggatatatataattgtatgagatagcgcgntatagttgactgacagtacatgaatactagtgtgtctggtgnatgtcncncacgacacanaccggtggagtagtggcggtgcgcanactagtgagtacagtacggtaagttgctcatctgctctctgangtatacacggtggcccgtgattgtaccgttctattactacattgtgaatcgtacccgcacnanaagtaacgancacagagattagtcgacgaccattngtatcccttcgatgtgcactcatatgatncgacgaacgattatgacgcgacgaatgtnatgtnccgatgcgagtcgancatcatntcctgtactagcgtagttggcgcactcgcgcggatatcgatgtgctataattcgatcgatatgttattgttgcggtctgcattttatgcctagtgttcagggnactctcgctcacttagtatttacgccgntctcgatgatgtngatccaancgatagacagtaggttncgtatcggcgatacacagtgtatatgtactangtatcantgccttcatatctgtagcacacaaatatctatatcactagattatcgcgttcgnacattanatgcagatagtgacgcgagatacgcataatggcnatagtgtggtgcctgtntgtgttcatccancgtgtgcgcttgactacagtanatatgtatatgctacatctcatgtntgtgantgtgtatgtcntctactnatactcnataccgaactcaacgatgagacactgtatgatcactagtggtanaatgtactcctcacgtagtttgtgccacacatcgctcagtatgtcgcatcactacacacattacgtantctcgtgccaccacactacatcataatgactgcttgtcctcatatcgcagtnacnancgatagtttagatacatatgcangttccacacancgacgcgtatgtacagtcagtatatacacanattgtgcnacgcgtgtcaatctagactgancgtagagngagggnacgtcacgctgtcgagtcgcctcgtatgnacttcgntccgcagcactacgttgnttatgtcatggntgtgcagttgatgttgcggtgggngactctagnatgcgcagcccgnctcaatccatgtagtgtatgttagtgtatcangttcgcancgcatcgctgtgtcatatgcgagtcgacantgnttnctncgagctnagngtgcgacaatccgag

SEQ ID NO: 10185 - DNA, 1086 bp, Homo sapiens
  misc_feature (1)...(1086): n = A,T,C or G
attttcttctgggttcctcttgtcgccttgtctgtgtccgggctgtgtgtctgcccgttgatgttcgttccgcgcgcgcgccgcgtgcgcgcgcgcttggccccctcctggggtccttctgctttgtgccttctcgtctgggcggcgcgctgtgcctgcgtgggcgttccctcgtgcggtgcgcgctggaggcctgttgttggcgcttctctgagggtcggcggctcggtcggctctgggggtggcggcgctcgcttgctctgttccgttgtcctctcgcggtctgtccgtctcggctctttggtctgcccttcctttcgggctgtcttgtcgttcgtcttgtcggctcctcgtgtctctcgcgctgcgcgttgcgtgtggtctgtccttgctgttgcgtggcgggcctcttccgtggcgggcgtggggggtcctcgctagacttgtcgtccgccgcgtcgtccgtggcagtgttgcgcgccgcctngtgtgcggttcgttcggtgtgtggtcgcctgcctgtggtttccgtttctctgagcgctcgcccgcatgtgtagcgcgctttctgcctcgcttgcttccggtcgcgcgtggggcgctgggtgcgtgcgcgcggctgcgctgggtgtggtcgcggtggnatcagccgtgcgtgccgcgtggggcggngctgcggctggctttggcgtgccttgagcgcggcgcgggttcgttggcgactgcgtcttgttgtcggtgttgctcggcgctccccctggccctataaagaaaactgtgcttctcgctccgcccttggtgtgnncgctgctcctgttggctcttgggctcgtccgtcgtcgtgcgtcgtggcgcgngcgtgtgtgtgtcgccgttggtggttggtctctctgctggtcgctgtgctcgctgtgtcgcggcgtctgtgcctgccgctcgtggcggtcggtttgctttggttgccccgcccccctcccctgtgccggagctgcgcggcggtgcttgggtggtgggggtggtttgccttaacttgggggtgtccccaacacttttccgtggcccgggggtgtgtcgggggctgcggcg

SEQ ID NO: 10186 - DNA, 1094 bp, Homo sapiens
  misc_feature (1)...(1094): n = A,T,C or G
cgcgctccgtctccggtttcgtctccgccttcgtccgcgctcgatgtcccctgccggctgcgtcgcgccggtcgctccgccctcgttcctcctgctgtttccttctcctggtgttctggcgccttcttgctcttgcgtgctgtcctgctctcccgtctttcttgtgcgtttgttcggtcgtttgtcctgttgtggttggttctgttgttgtctgtgtcctcgtgcttggctgtggttcgttcgttggtgctcgtcttcctctttcttcttcgtgtttctgtgtcttgttcgctttggtcttgttcgcttcgtctcctcgtcggttcgggcgtttttgctgtcatcgtgtccttcgggtctgcctgtttgtagtgcttcgctcttggcggtttgtgctgtcttctgtcttctttgtttttcggtttgttggtgtggtgtgtttcttttttcgttttctctttctgcttgtctctctgttcgtttcgcgtgggccgtgtgcgccttgcgttgttgtgcgcgttctctgtgtttcgtctcgctcgtgtcgttttctcggcgggtggggctttgttctctccgtcttttggtgtcctttgttctcctgcctctgcgtcttttgctgtgtgggtatctggttggtcgcctgctggtttgtcgcgtcctgtttgttcgtcttcctttcttggctggtctggtggttgcgcctttggtgggtttcgggctgtggggtcttgcgaagagaccgcggtttgcggcccgccgcgtcgccgtgggggggtttgttccgcgtctggcgctgtctcccgcctgggctggctgtgcctccctccgtgttttggtgtgtgtcgcgtgttcgctgggttccgtgtggctgccctgcccctgtgttctggcgcccctctcggttcctggggggtgcttgcctggccgtgtctctccctttcgttgtcctgctcctttcttttctncnnntntgcntgtgctggcgccccccctcaggctgtgggtggttggttgntcttacgcaccctgtttctctgtcgttcttgttttgggcgttgcggtccgcctgtctgcgtcgcgggctgctcttc

SEQ ID NO: 10187 - DNA, 1840 bp, Homo sapiens
  misc_feature (1)...(1840): n = A,T,C or G
actacgcgatcatantngcggacgnngcggtgaccagcgtanncgacgangangcgacgangngnactcgatcgcacgtagnacngnngnngacacgancccgatcgtagtagtganacgaccgggtgcgtcnganganngncgtcgcacgtcagntgtcgtnngtactgacgacttcacgatcnatcancannnnagcacatcgtctaatgctgannngtaccantnactacagtacttcnntannctgacngcgcggcacgcagtnnncngcngtncggcgtggannannngcccagcncncagcgtntgggctnnctcctgcgatgtagngnngggatgtctgcagagangtngncgcatcgtcagcgtgatccgacgcacntcntgcgatgcangngtacgcgggagtagcgtagannnancanacgtcgtgacgagtagtcggagngggcagcatgcactctganagcngacgcagcagntcagcanctncgacgcagacngcagcgncgacgacgtactggtngnggngctgcgtcgngacgtncgtcgnngcgaccgcgcgctccgctcgcgngcacgacgacgacganagngancggacgcgtacgatcggangagatgcgacgcagngtagnancgtcacatgcggagagnngncgctacgtgctgccgctgacgatgcacngccgnagnnncgaccaccancgcgaccagnnngctcatcgttgctgagcgnnacgcgtcagntgagactcgtgcgcatgcacacagtnggcgactcatacagctngngggaccgactgtctacganntacgacacgactatcntantcactcacgcgtggtgtgnnagcatagttgtgaatagcgtgcgncagcgtgtgngngtgcgagagngcgatcgtgagtcgctggcgacgtctatacgcgagnngngctcggtcagagcagcagagtgactagtgtgtnttgtgctgccgcgtggtgtacgatagtctgagcgcacgtggtcgcgcagactgtggcngcgccgctgtctgacatngncgancatacagttgcgtcgctctcagtcacgtgctacgtcgcacattgtgtgtcgctctatcgtcgctccagacctcangagccgcgcgtngtgtttagttagcggtnggaggggatgcgtcgtcggcggagacgctcgtggcggagcgcaggaggctaccacgaaggacccatcatggacgcagcgtctgtggncagcggaggagggcacacggagacaccgaggcgcacgtgtgaggagcacttatcgtatattcacgtgtagaagggctcgaatcgacnacgtggagcccgcgcgcactcacatatgcgtgccttctgtggctcgttgtgacgaccgctacgacagtcatgaatattgcctcccacgaggcgtcactcgtgcccaaggccgganctcgatctcagnggacacggataaatggatctgtacgtcccctactcagtnnncatccctcggaccatccatgtaanccgtgcgatatcatactccttggcgagcgacaacgtctctcggttcacgcccaacggtggaatgcggnagacggtcctcgaagcaagtcttaaggacgggcagagcggagcctgtgtccgagtagcgatntcacatgaacgtttctcgggccgtgcgggggaaccgagtgacgcatggagcttgacagcgactaggatctgcgtatgttacactccaccacatgtcgggggcgggtgatcgcgcatcgcgctcgcggcgcggcgcgcggagacgcgggcgcgcaggggggcgtgcaggcactggtgttcctca

SEQ ID NO: 10188 - DNA, 1332 bp, Homo sapiens
  misc_feature (1)...(1332): n = A,T,C or G
atcagtatcttaacgtagcctgatgctccgcacgtctctgtgnagcagctagtctnttctactcggcctcttttgactcgacgccgcgcgtctgcgctctctgaacatgactgcatgttcgtctctctacatattccgtatagaactgcatacatggcgtgtagatgcgaggggctgctgtagtagtgtcgccatatatgtcgcgtagatgaacgatgctgaagattatcctcaatcaccactacaaggaattacaatcatagacttactaacaanagaagtggggttgagagagagagatgtgccgtgtggcgtctctgtctacgtggttatggttgtatactcctctgtcgactggaagacatctcagtggctccgtgacactgtcccagaatagactcgaaaagcgaccactgctcaaccacatgtgaatcctccctcatagatcgcaatgtgtatgtgttcttggtgtgatgtgtttcttgtgccgggcgcaaccgcattatgaagtctggtggaatgtcctgtgnatcatgttatgagggtggctggtatatatctcgtgttgctaccataccagcagtatctgcctggggatcgattactgtatatagtctttctgggcttcgtcactacttggtttgtgtccacttttaaaagatcgtggcggcgtgaatgcacttcgcgtacgatgatcaatagaggagataggacagatcggaacaatgggtggtactgactaatatcatggatggatatagtatacattctcacggacgatcagccgctcgtaaattaatcttctgcgggtggacgcgaagcgattgacattaatatagttgtgtcgaggtaggataaacatggagtagtaggancgagtgggcgtctgttatcagtatcggaagcatcaaatacatagatcagtgtatgagtgcagatgatgtccgtggctatgcgatagtggtttctcgacaatcgtaatgtgggtgttgttcgtaggaatatccgtctacccagtaccgacgaacactacttcgcacatatcagcgagtatatgagataaactctagatataatgagtgcatatcagtttggggatagtagggcggagcactaccagtcttacacataatgccaaacacgcaccctcgacttagtgtaatacgtagaggtaacagatggatactatacttaggtcataataacaatatttatcganggcggcgcggaataatagaanttcgtgtgtcgtgttgtgtgagtgtctgtactagtcgctataaggaggataggtgggtagggacatgagagagcgacgctacacgaaagcga

SEQ ID NO: 10189 - DNA, 820 bp, Homo sapiens
cctgaacgtgacctcaggaacacatatctccttttccagccggaagtacctgagagagaccccagaaggtggatatgactgcagagagcagggagcatgaagcaccttgcccaaggtctcaccaggcaagagaagggcggagaagggcggcttcttcatggattgtaaatccccaaagcgtgcaaacatctgcccccatctccctggaggtggcctgttctccacgccaccctcacaggctgcctggcggactctcctcacggcactgtgcttcccggggcccacttgtacaggccccatgcaagaaggacctcgggcaatgtataatcctccaagggcccacaggagcagaagtgacaactgtgttatgaagcacctactatgtgctggggacaagaatggaacaagaagacatgctttgccctcacccctggagggcagatttcaacccaggaggaaaatacctactcccagaattcttaacaagaacccaaactctgcctcttttctttaaaatcctgattaaatgtaacaagctatagcacacctccctgccacccaaatcaaaatggcataaaaccctcaataccaccccctcaacctgattactttgttgaataacaccaaaggattgaacctctgaaaaaggtaaaccataattgcttttttgtgcctttaccatagccaaaattcataggacatacacgcgactttaagaattataggctgcgattacgtagtacgcatataatttctctcgagaattaagattagagataatacagagtctatgaagacattttcgccaaattcccacccc

SEQ ID NO: 10190 - DNA, 1792 bp, Homo sapiens
  misc_feature (1)...(1792): n = A,T,C or G
caggcgacgcagcgcagcgctgtctcgtcangntatcgcagcatcagcggcgacagccgcactcgtgagtcactcatcatatncagcctgattcatcgagagacgagagagtagcgacatgtctgtcgtagcctatgatnggcgcgctcgcatcttgacggctactaggatatcacttaactcctttcgattcgactccaagtngcgtgagtcgcgccagcanatcgcgtcgatagagcaataatgctgtggtgggtggtagtacagacacgctggtgtgtgtctagtgctctcggtcatacttacgtaggttgacgtctgtctcgcgnntggtatcgtcagatagacgactagataggtcggtgtgtnaggtgagtgcgacatctatgtgatgacanatagtagcatcaacgtgacgacactcaccagatcgacagacacgcncgagcatgtgcgcgcgcaagaggtgcagtacatatgataatcactgtggattgtcaatctatgtgtcgcagaaatactgttcgagtaggtggtcgttacaaatatcattnatgtcaatngacatagttaggntgatatctttccgtgctgcatgcgctntcntatatgtacgtactctactcgcgcatgactctactgactgncatcatatcttcatngcntttatcgatacntatgtcatactataatatntatatangtacgtacttngaanctgtactgttatnaatactagcatatctgtcatgtgacgtgnacgtatcaactgtcncgcatatgactgtatataacagatntagagcatgtatactacanggtaagcgatgctacactgcgacncgagctgcaacgctantctcgtagcgcacgcgcgtcgtctnactgctgcgtntgtgtcttgcacgtngcgtgagagatacgtatgagtgangatctactggcagcacttngggtcacgactcagcgctcgtcgctgtcgaccagcgctcggangngcgagcatgccgatcataacgcgtcaactatactnagtcctagcagactgtatctcgtatntacntatatatcagacgagcgagtaggcagnagactagtggcgtagctgtggntcggcgcgctcacccacaacacgtctcgtntcgcgtcagtatgtgtgaggatngttgatgcagtatgnactgacgtcgctgcgacnagactagtaaacagnaatatagcatcagnccctctcatactgncgatcgnttagacngtcagcacatcggcaatcgtgcgcgtnttgcatagcngancgcgtgtggtnnncgatgctactatgcatcacacagtagactgncanaatacagagngaacatcagatgcanangcgctagcgtacgagcacgatcgcagatggagaggngangatactggaatanngatagtaacgcantgtacgcaangatngcgtgtcgacaggttatgtnatcagagttgcncgtcacancncgncgacagagagacgcggcgntcgtcatagcagnacgagtacgacagatgtgcagganagcgctagcagacgngcagcctttatgttgcgatgtagcaacgcgctggtgggatgcggttgagtagtgcggccagtcggngaacaagacggcggtctatagtgtgttgctncagtgcacggtctgtacgacacgaaagagagcttcctggtgtcgtctacaagactagngcacatgacctgtgtacgctatgtccaantactatcaggtagaacatatatcacatctagatcgaatcgtat

SEQ ID NO: 10191 - DNA, 1141 bp, Homo sapiens
  misc_feature (1)...(1141): n = A,T,C or G
cgcgcccgctgcgctctccctttggttcgcgtgtcgtcgcgtgctccccgtctggtcctcctccgtgtccgcgcgcgtggcgtgtgtctttctctttgtctccgttgtgcgggcggtgggtgcctgggtgccggttccgcgtcggtcgctcttttcccggcccggcgcgcgggcgcgccctgtttgtcgcgcgccctgcggctcggcgttgttctgctgctcctggtctcgcggcgtctcttcttttgtccttctggcgccgttcggcgtcgngccgtgcgcccccgtgtgtgggccttctgtctgctcgtttgcggtcccgcgggcccgttggccgtcgggtcgcgctcctctgcttcgcgttggttgttggcggcggtcgtcgcgtcttctcgtcgctgcccgctccgtcctgtctcgctctgggcgtccgtcccgtctctccttgtctgttgcgtgtgcgtgcttcggtctgctcgcctcgcgttggtggccgggtgccgttcttgccgnttcctgtgttcgtgttgtccgcccgcgcttggtggctcctgtcccttcgccgcgttttcgtgccgcggtggtcggcccgcgcgcgccccgcgtgctcgtccggcgtgctccgtgctgctctgttcctggnggccgctctggcgcgcgtccgtgctggccgtgtcccggttcgtggtccgtcgtggcgttnttgctcttcgctctccttgtctcccgtccgttcgtgcttgtctctcttcgagccgtccgcggtcgccgtccgctcgcgcccgcgttccgctgctctcctcgcgtcggctgctcgcgtcgctcggctgccgtcgtggcgcggctctgggtcgggcggtccggcgtttgcttgctcgcgcgctcgtgggcctttgcgggcgcgctcccggtggccgcgcgtgcgtgctggggtcgcttgctttcggtggtggcgccctcgcctttggcgtgtccgtttggcgcgcttgtccgggcggtgcgtggtgctcgggttgtgccttgtgtcgtgggcgtgcggtcttntcccgcctaaggctgtggtttgttggttttgcttttgagggttttctttgtcgtgccgtgcgcggggggtgtgcgtgcgctgggcgttccgtcccgt

SEQ ID NO: 10192 - DNA, 163 bp, Homo sapiens
  misc_feature (1)...(163): n = A,T,C or G
atgatatttattaaacaagatttaaataggcggggggggggcttgtagaggactngaatagccatgtataacttgagctgtccaggagccaggatgaggactcagctccacaaaatccaaatgccttcattatattaaactgcctatatcaaaaaaaaaaaaa

SEQ ID NO: 10193 - DNA, 481 bp, Homo sapiens
catgctatggcagttcatattcccactagtcatgttggaagatgtcaactcctccacactcctgccaagactatccattgttattcaagtttatttctttatagtatgaaaataaggccacatcagtctcggttcttttggcagttccgaagacatcatgattcccagatgcttcaccatcctggcaacacccttctggactgattgctccttgttgatttcctcttaacctgtggtatctgaaatgaatcccacaccccaggtgtgatatgacgattgcagggcacagaatgtcagtcagcttaatttctctgctgtacatctatgaataaggcttaagacagaattcctcacatattcttcatttacatgccatcacccttgggcctctaccatccaattctaattaactgtgcacttgaaattgcagtcatttttattagcaagcttaaataactattgactctgaaaaaaaaaaaaa

SEQ ID NO: 10194 - DNA, 324 bp, Homo sapiens
  misc_feature (1)...(324): n = A,T,C or G
ttgtcttaatcaacaataagtaaaataaaaaaannccgtgggtcttgctctgtcgcgcaggttgagtgcagcggtgccatcttgtctcattgcaacctctggctcctaggatcaaaagatcctcttatctcagccccccaagtagcggggactacaggcacatgccaccacaccccactaatttgtgtgtattttctagagatggggtttagccatgttgcccaaactggtctggaactcctgagctcaagcaatccacccttcttggactcccgaagtgcgggattaagcgcatgagccacaaaggctggaaaaaaaaaaaaa

SEQ ID NO: 10195 - DNA, 343 bp, Homo sapiens
gaacctttaaagcatgaaaagagaggggggagggctgaggcctacttcagctcacctttctttcttctacttgatcaagtctgctattaagatacttgaaggagatgtggactgaggtacccaagagtggcaatggctagaagaagtccacgccactcaagaaagaccactacatctccaagacgttcctgcgtgaggacagatacatcgtggttctgaggaactcgctcatcgccagcaagaaggggccatccctccgtcgacggaactaattgccctgtcctatggaaggccctgcacttggggttgataataataaagcactgcattaaaaaaaaaaaaa

SEQ ID NO: 10196 - DNA, 729 bp, Homo sapiens
  misc_feature (1)...(729): n = A,T,C or G
ctacgagcacacccacttactcaactgggaacctcttttaacttacgtctctataactttaaaactacctctacctctatcgactcctcctcccagtcttcgctcgtctctcaagnaatatgccggaaccccatgaagaatcattcccctgggctgcttccacacaccaataacagccttaaaccaaatgggttgaaacctgacagaatcgtaacactaaacaccttnccacttaanacgacattnccagcaatatggacatcccgtcaatcaccaccaaaaaagctgtaacaccaccttaaataacataaacaatatcacataattaaatacacatccccgccttttaatcacaaaacctgtataatagtgtagaaaagtaaatggtaccccgcatgtctgataaagcaatgtttatattttctcttagaacctttgggcatttcaagttgttatatgccatctccctcncaaagatcatgtatttactgatttttaaaaattaactattcattgttggtgtagaatagactgaatctaggtcaaaataaaaaaagatgtagttaaatagtatagattccacatatatgtttagtaaaatgtggttctattttagaactaaaaagagacaacgtaccagaataatgggacaattcctgtgcctatggatagttaacgatttaacttctcccgctaatttttttaaaaagaagaaaaaaaaaaaaaaaa

SEQ ID NO: 10197 - DNA, 831 bp, Homo sapiens
attggctcttatcaatgaagaactttgtatccaacaataatgaactgtcatattgcaagttgcattgtgtagaagcaaaaaagactggctgtgacgaaataaagaaggacccaggagtcttccaggaacgctggcatatccaggagctgcgagtcccgctcccggcagccttcgcagcctgcggtcccgcccgagctcgcccgggcctcgcggctcccgccccggaggagcgccgcggagcagggcgaaaactttgaggacagaaagccaggccagacccgacacaaaagccccggggctgaacgatgcagacaccccgggccaagccgggaagcccccaccacacccagggcccacactccatgccccttattatattttattgtttataaaaatagtggaagtgtggtctattgcaatacacctgagtggggacctcaggaaggacaactggaagtgccgctgaatgtggacaggacaggatcgcctggagatagttatggaaaagctggacttcgttcctgccttgactgaggggctagggggacaccattacaaccggactgggcgcggcaatgttcgcagaaaagaaatggaaggaacagacagcagtggcataggagggaatcattttacggggcgtaactactgggctaggactatttagatgcctgtcctctatagctgccccagcgcgggatgcaggtggtgacgcattgcaccagcgtgcgaggcgcggcggtagtgagattaggcgggaaagttctaccccgtgtagccagggagtgggaccgtgggtgcgtaactggagggactcgataaggccgcggg

SEQ ID NO: 10198 - DNA, 1448 bp, Homo sapiens
  misc_feature (1)...(1448): n = A,T,C or G
ctggggaaggaagggaatggatagagaagagcgacgggagtgggagagttggagagaagagatgaaggagagagaagtgtaatataacaagcagtagtgtatgaagaaaggatagggagagaggtgatgggagtgagggagggaaagtgtgaggaaaagcgtggagggtggtagagtagtaggaagaggaaaaagagaggtggaatggagtataaagaaaagagaagaagagagaaagggagggatgaatagataggggagagaaaaggtgaaggagagaaaaggttaaatagaagaggtatgttaagtagtaatgagaggagagagtaggagagagaggaggaggaaatgtgagatggtggagctgnaaataagaaggaggaatatatagagaaagngntnagntacagtatagtagatagtgatgacatgaggtacaagagagagagaantatatataagaaatagtagagtacatgcgagagtacatagaatagacagagatgaaaggataggttagaatgttgagtacggtggtagagtgagagagaagtagtgatagtatagagactgggtaggaggagtggaggagngagagttagangacaagtaatagtgatatggagatgaagtatagcgtagtagtgtggtgagagtgaggangaggatacgttaaaggtagtacgagagtcgggaagaagtagtagtagctagattgagtgttatnacgataagaggaacaagaatgtatagtaatagctagtgcantnacatagtagtcgtaanatacgtngagcgagaagagagaattgnatgatggatgagataagaaggaggacgtatagaggaagagagtagtagagagtggagagcacgaggaaaaggatatgatatgagaaagatttatatgatttattattagtgtggagaacgacaagagaagagtgtggangaccaccacccactatgttttgtggagtaaagggagagtggaggaagagaaggaagaaatanaagtaagagagctagatgcgaacagggcagaagtaatggatgtaatgtagtgtgtaggagtaggaaagaatagtgtatagngagtgttgctggtagtagtggtggcgttgccggggtggagatgtggtgcggtggggtgagtgtcgggtgcggcgagtggaagggaaggaggaagnggntgtgggtagtgtgttttgttttttaccggacgcccaccagacgccacagagggaagngagagagaggagagaaggagtgntggtgtntgttaaaagagaaaaaaggaaagaaaaagagggtgtggtcgagtgtggttatcaagnggaagcgaaggaggtgtatggtgtgggcggagtgcagnacttgcngtntcgtgtgttgttgtgggggggtgtgtcgcttgatcctgttcattagaatgagtataagctagg

SEQ ID NO: 10199 - DNA, 950 bp, Homo sapiens
  misc_feature (1)...(950): n = A,T,C or G
cccccacacccaccaccaccctgccattaggtaacaccctttgtaccaatgagatcacaacttagcccgagctggcctgtcttcacaagcactgaacaaaatatctaaccttgaatactgagtctaccagcaatctgaccaatctacgccctcaacaacgctcattctggacatcattttttcccaaagtcttggcaatgactggaaactattgctgtaacacaacgggactggaatgaaggatttcatatactcgaccaatttcattgatggtctcggaacaatcaacttcagcgatgacccatatccaccacaatacagatgtggcggccctctcattaaattacctcctacccttttatccaatcttattctccccttccccacaatgcacacaattacccactgcccttatcacacatccgactttccgcactccataattcctctccataccaacaatgccatcaatggaaactatacgtacccttcccttttattaccttacctaggctcaacataatcaacagaccccccctcttggccgccattccgctttcccctctcctacacccctcacacccgatctccaacaactttctccgccctcaaaaccatatcgacccggcgcggccagacatatcctctttttaatacatatcatagcgcatacaacataccccagctattcccgtccgctcttcccgtcccaccaccgantgtactcttctcaacccgctatcccacccatacgtatcacattcaaaacatctcaccactagaccttgactctcccctcgaacctcgcaatttccccacccaccattgtcccgtgctcatctacacaaattcctctgaaccactagtatattatccgctcgcccaagttgaaacacgcatatccccgaccagacaaagtaatatgtgattacccgcataacccgcccgcc

SEQ ID NO: 10200 - DNA, 1691 bp, Homo sapiens; identical to SEQ ID NO: 6368
  misc_feature (1)...(1691): n = A,T,C or G

SEQ ID NO: 10201 - DNA, 1268 bp, Homo sapiens
  misc_feature (1)...(1268): n = A,T,C or G
cgtttcctctgtcgcttgtttagcgttctgtttgtgttctgcgtcgtgctctgcgtggtctcgtttcctttgctcttctcctcttgctcgtggagttgcgttgttaccgttttctttgtgtttgctggttcgtttcggtcgctgtccgcggctgtgtgtctgttcgcttgttcctctcgtcgcgtcctgccgccgcgtgttgctgttcgtgttgtggtggcgtgttcctctcgctgttggtcnttgtttccttctgtccgcngtcttgcgcggtggcgctcttggttgcgctntgtgtttcgtctctgccttcgcgctgctggctcgcctggtccggtggtcttcgcctgtggtgcctctctctcggtgctggcggtcctctgtgcgttgttctctctcccctctgtgcattcttctgtgttctgcggcgcctctgtcctctcgcctcctcgtctcgtttcgtctagtagtgctcgcggctcgcttcgtgtccgccgtctcgttcgtcttcggttctcttctcgagtgtgttcggttggctctgcgtgtggtgggtgccgtgtgcgttgtctccgtttttctggctcggtttcttggcgtggcatgcgggcggcgtcatctcgtggtgttgtctggtgtgccgctgngctgtctgcgcgtcctgccgcggtgtgcgttgtctgtgctgtcgtcggctcgtcgctcntctcgcgtgcgctgggtcttggctccggtgcgcgcggctgcgctgtcgtcgcgtcgtaggcgcgtggtcgtctttctgcgcgtgtgctcgcctgtctttgccgcgtcgctgtcgtgctgtggcttgcctcgctggtcgtttctctcttatatgcaactgatggtggcgtgcctctncgtctctctggtcgcgccgctccntcgnggtcctgccgtgtctctggtgtccttgctgtctcctgtgcgtctgctctctgccgtctctccctgcttctcgtcngttgggcgcgttctgtccgggtgcttgcctggtcgctgtgtcgcgccttgtgcggcttcttcgtccgtcggctgtgtgtcctttccgccgcgtcccctgttttctgttctctgtggtcgcgcctctgcatccgtcgtggttgcttcgtcgcggtcctgcgttctntgtcttgggctctcgtccgcgcctaaaagcgtgtggttgctcgtctctctccngaaaggtttcttctcttttctgttgtgttggccgggctgcgcgtcggtgtggcgtgtcgccgcac

SEQ ID NO: 10202 - DNA, 710 bp, Homo sapiens
attggagaagacggtccttcgctttgctcatcaccttctgccatgactggaagtttcctgaagcctacccagccatgtcaaactgcttagtgagaagtccaacagaagagagagagagggagagaaagagaatggtatggagtgtgttcctgtaaagtctcaggcatcacttgacatacctttaccagatcgaataattttgtgtataacttaaaccctagttctagctatatgaactacgcgtgataaaagtatatctacaaaaagaaacgctgtgacattgaaacttttctgcctatatgttgatagcccaagttgtgtcacaggagaatgctaacttgcggactattgttacgccattcgtcctttaagaacttgtattttgctgaaaaccacaacaactttgtactgggcacttctgaatcatacatatttggtccacggaacacctatgggctagccagagactttagccacctgggaaactcaaaattgatgaaacttggaacccacactcatcttttaaccagaaactgctcattttcaaaggtaaacttcaaaataagaatggtcgaaaaacaaattggtgataaagtaaattctttttaacaatggctatagcaaatggagtttctatcaattggctaaaaaaagtgattttcattgaaaaaaaatgccagcttaaaatttcctaagtaaaaaaaaaaaaa

SEQ ID NO: 10203 - DNA, 1046 bp, Homo sapiens
  misc_feature (1)...(1046): n = A,T,C or G
tggttggtaagatggagtataatagtaaatgtggtcggttcaagaagaaaagaaaaaaaaagtagatggggacagtggggggcgttgttttgcaaggactggtttttctgatgtcaatgtggcgttgctttgggtacgtgttgaggaagcagtaaacaaaactagggcgtagccacaacgtaggccgcaaacgtccctgaaggcccacccctaactacaatctacagtaaacacaactacaattcatagacgtgtgttgagaatatcactgacccacaaatcacaacaatagaaacagccctcggccgtctctctctgacagtagagagaacgggtgtggtgagagtggaaataccagcaaaaggaagaggcattgacacgacaatcattatatattttattataaatgttgttgcaatagaaaaatgagttagacctaatgcccgccctgctggggcatgtaagcaaagaacaataatatacatttaactcgtacctcaaagaatacacagagcagaagaaggaagaacgaaacacaaaaaaacagacnaaataattcattctcaaattatctgtttacgtaatatatnctatagacctgatagtatatgtcggcgagcgacacgtctcttgctactgtcgtgaaattggttccttggggactcagacttaattaatgaaagaagtagaggatttataagtatgtatatgtctccaaatagagaccataataaaaagtcaacacaagtctctatagatgttgtaattaaatagtgttagtgtgcaccgcacgtaggtttgttctcacgcatccgaccaccggagcgtgcctcaagtccttcccttctgtgacgtgggatatacaaagtgcgaagttagcgcgttggtagtggagggcgtacactcgtatggtcgaaaaatacgataagacgccttgttgttatacattgacctattgatatgggtgagttncaagggatagaatagagcagtgtgaatgactattacttacaaatattaagtcaagagagagcacgcgaaacgct

SEQ ID NO: 10204 - DNA, 1294 bp, Homo sapiens
  misc_feature (1)...(1294): n = A,T,C or G
aggtggtgtggtgctgttgtcttctgttggcgttgttcgtctgggttgttggtgtacttgttcggttcgtttcgtggtcttgtgtgtgtggcgtcgctccgcgttttgctgttgttctcgtgcgcccttctcttcttcgtttcgccgtgtggccctcgttgtcccgtctcttcgtttgttgttgcccgtggtttggtcttgtgcggccttcgctctctcttgctcgctgggttgggttggtctctcgcctggcggcgcgggtgtcccttgtcttttcgtccctgtcggcgtttgtgtcggttcgtgcctacgtttcgctctcgctctcgtttctttgttcgtgtggccgttttgtggggcttcgggtggtgttcgtgctttgctttgcgttcgtgtcgttctggcggggtggcctttcttttgctctttccctgtgttctgttctgttcccgtcccttcttcctcctctctgctctccggcgtcgctttcgttttctctcttcgtctgtggtgcgttgtgtctctctcgcgtggttcctggggcggttggctttttttcgggcgttggcggtgctgcgctttgtttcctgtgtgtgtgcgggcggctgctgtgcgttgttccctctcggtcgcttgtcgttgtgtgctccgtgtccggctgctcggtgctcttctctgtccgctgtgggttctttgcgcgtcgtcgttctcgtttctgtgcgtgttcgccttgctcgtgtcgtgggttggtgcggtgctcgtgtgtgtcagcgcgcgcgcgttggtctggtgttgctcttcgcctcttttcacccagaacagaatccctcgcctcttgtctctgcgtgttcccgttctgcgttttctctctctcctcctttccctttctcgcgngtcgtctgtcntgttctgcgctcctggtcgtgctgtctttctcctcgcgtgtttccgggtgtgcgtgtctgctggctcggcgcggtgtgtcctgcgtccttcgctcgcgccttgctggtctgctcgctcgtcctctgttggcgcgtcgcctctcggctcttcttcgtctttgtctcgtttgtggtctcttcttcggtggcggctcgttgcctgtcgctggcttcgtgtcctgttctgctcgttctctttcccttcgtngcgttnctgntgctctgctgccgccgncctcaacngtcgtcgtggtgtgtntnggttngtccttccctcgagcggcctttttcctctctttgtttcgccgctgttggcttgcggtccgtgctctgtcgtcgtgcgctccgcc

SEQ ID NO: 10205 - DNA, 610 bp, Homo sapiens
catgcacatgccacgaattcgtttcgtggcttggagctcctggcagcctgctatttttaataaaccatccttctgctctcaagaattgacagaaatcgctttccattccaggacaagaaccaaagacaaattcctattggtctcctcttcatgtctgtcactactgaagacaacaaaggataattcactttagtcagtgctgacttgcttggagaacaaatgcacaagcactcaaaggccacgcctggaaggatttggacagtgccaggtgaggagccaaagcataaaattaacattccagctgctagaaattttatttgctcctttgcagaaatccaagggctttggactcggtgattagtgttaatgggtcctaagcatggaattagcggactgcgtaccggaatatgtgagttaccttgagcaaaagacgccagccaagggatgttatatgacccaatgagaggcagacatcaccgtgcccactcgagcgacccgcgacggcgaggctggcagaagcaaagtaaataggagtcgggtcagcgtctgtcatccgcggaggtcaagagtatcaaccgagagaagtagcgcgtgagagattgggaccatg

SEQ ID NO: 10206 - DNA, 1437 bp, Homo sapiens
  misc_feature (1)...(1437): n = A,T,C or G
cagctggcatagcttggccgtcgcagaagacgcagaccacacagaccgtgcgaaagatacgcaaacgagaatgcgatagtgagcccgtctaccaccgtcggacccgccgcccccactatagtttgccggttagcggcggcnattcccgattcgacgcgatcgcagtatatcgattggcgtggtggtctgtttacattaacatgtgtcgcgtcgtccacctgaacgcgacgccacgcgcgcgcggaccagccacccacatgcaccacaccacacatattattcgatagatagtgctgcggagcaagatacgagatacagtacgaccgccactcgagcgaggagtcggggctaatcattgagagtagacaaggcaagaagagagcgggtggaacgaacacgaggaattgagttaggggaagcgtcgtggagaccgtagcaccgttaaactatgcgatcgaccgtactgtgcgtgttgtgaggattgtttatttgtgtgctgctcgccagaggaattatgcgtctgcgatgcgcacgcgatatcttcatcgtcgcctacgataacccaaggcgtcgttatgcggtactccgttgcccgacacggtggcatgtgcgtctctcgcacgcgggacgggcgcagggacactggtgttaaccgcaccctgctacatcgatcgtgcacgcctaaggccgcacaaggaagtcacngtggcgcagccagtcagtacacgcttaacgcgtggcgcgccgataatncgtcaaccgtgcggcgtcgtgcccctcgcagtgcgcacccacgcgcctagagacttacgcgcagcccacatcatatgcccgcgccgtggtgatgagcgcnacgcattngcgtgacgacatcccactcagtgntgntaagacgcattatcaggcgtgacaaggatngggagctcggtcctgagtgtgtgcatgatctaacactctgtgtagatgtagcangtcgttcacgacaccgtcgactacacacagtagtacgaattcatcgacggggctncgaganatnacgtgcacagagggactcacacantgcgagtgcgtctccgacacaaatagtgatccgtgacatgaagacggctatacgaatagttagacagcagttggccaagcgacgtcggatcgcagnanacaaagtgaatcagacagatcgggtgtgtcgatcaggcacgaggtgcgtgatcncacgtacagagagtggatactgatgtcgagccagtgngatgtgtgcgacgtncaataagtgttatgtgcctcggtctcccctcgatcatgtacatatatggatgtgagtgactatggtccacatttgtagatanatgcgngnccaatagaggcgaggctcgctagactagcgtgagcacanacgagtatgtcacacaatacgagtagtaacagacgacgacggag

SEQ ID NO: 10207 - DNA, 1265 bp, Homo sapiens
  misc_feature (1)...(1265): n = A,T,C or G
gggacggagggggcacgtacaagcgcaagcaccggccagagttttttgagaanagggcctcggctgatgtttaggccgagctattatatgcttcaacttgcagagatgccaccagtattaatcagcgtaaacttgtctaaaattacggcaaataagcttcgaggccctgatcccacacctagcagtagccacgaatctgctagggcttgggagtccctcggagccttgctatttttgaataggaccactcccagagcaatcccaataaccttactggctcttcaagcaatgtgacaggaaacacgccttctccatttccaacggaccaagaaacccaaaagtaccaacattacctcatttcgtagctccctctctccatggaatctttcagcccgcaaagggtcctgtcccctacccgggaggaccgccaaagcgataatttccacttctaaggtagaggctgcaacctggcttggcccccaaatatttccccggagccgcccccaatggtttgaaaatatataacagttcccgctgtccggccagagccttttgggacagtaccaaggttgaagggggccacaacgcctaggaatgacaacttcacgctgccgaaaaaagattaataccacggccttttgttctagacgataaaattaaaacgcgccacaaacccaatggcctggggccttgcgtggaaattggcgcatatcgcgcccccccccaccggaatacgcggggagggcgtgcacgacaatagaccgctggcggagtccgtctgccggggcgatggctcgccgaccaattcgtttcgagctctcccggacccatagtatccaacgccgtcaccacacacttcgagggcccaccttcattgcctatccgtttgataagtagaaagaaacaacacataccgtccgtgctcctctccgtttgactggtggctcgtgtggacatacgtattgaccacatataccggaaacgtcggcgattgcgccgccgccgcgcgccctcacgatgtcgctgacgctgcagacgacagtagactcaagggttctatccactacacgaccggacaccaccaacagtctgcgagccgccgacgcaagtgtattgatgtgcgcacgtcaagaggtaatttaagagtgttgcgtacggtgcgtgcgcgtgcctcgtgctttatgaggattcgcctctgtacagcgcgcgctctctctctcgcgtacgtgatgcggtggtgacgcgactgtgttgttcgcgcccgt

SEQ ID NO: 10208 - DNA, 881 bp, Homo sapiens
actccctcctgtagtgttgtagtttaatgaggatcgtgcgcacatgtcttatattcgtcaatgtcattgtacaagaagtatgcgtgcgtataacacgttaggagcgtcttgatatatgtgtttgtgtagtacctctcgacgttcggcaactttgtataacctccgtttctgtccgtttgtctcgatttacgttcttgtggcacttctacaatgggtggataaagtggctttgttgtctcgctttgcacgattacacagatgtatctggtctccccatagcagatgtactcgagatgactgttctacctatgtattgctcatcggtgctactctctcgcctggtcggagtgtctaaattaggtatggaatacaaactgtcattgctccttacaaccccgtacgcgtacggggcggtcaatttgtgatatacacagtatggttcaataggatcaattcttaatttctcatcattacccgtgacagaggtatttagtttatcacttgcatacttttacacggaggtacatacatataaatgtacattggcctaaagggcctactcaagttcgtgcttagatgcatgttccggcttcccgccattatatttgttaagtgtgtcatggtgtgaccgctccatgtaatgtctccctgcgccgaacataacccccccctgtggttaaaaaaattcctactgggggggttggttcgatgaaattttttaattgggtgagacgaaggttaaggtgtgggcctcctaaataaggtctttgaaagggtttttttggagttccattggccaacccaggactaaaataggctcttcctaaaaccccccacccccattgaaaaaaacaaattttaataaaaaaaaaaaaaaaaaa

SEQ ID NO: 10209 - DNA, 1233 bp, Homo sapiens
  misc_feature (1)...(1233): n = A,T,C or G
cgcggtgcgctcgcctcttcgtctgcgcctgcgctcgcgctatcctgtcccgcgctcggtcctctttcctcctctcgcgccggtcgcccgccctgtctctttcgtgtcttctgacttcgccgtgcgggtgtatgttgcgtctgcgtgtcgcttgcgtcgttggctcgtgtccgcgcctgtggtcgttgccgctttcgcgtcgggcggcgcgccgttgtggcgtcggccgcggggcgcgttggcgctgtgcttgccggtcggctcggtgtcgctcctcgccgtggcgcgttgcgtcgcgtctgctcgtccgttgcttgcttctgcctctgcttttctgtgtccggcctctctcctgtctttgtcgtcgttcctctggtctctgatctagttgctctctcgccttcgttctcgtgtgttcgtttcttatttggtgtgtccttgtcgctctgcgggttgctcttccgtctctcttctgctgtcgcatcctccctcgtctgctgtctcgtcgctcgctcgctctgtctcgttgtgttntgggtgctagccttgttatctctgtgttgtcgcttcgtctcttcctcgtctcgtcgtctgtcctctcgtcgctgcgcccccctcgcgccttcctcttgtttcttttgcgttggggcttgctcgcggtctttgtccggtgtgccggttgtgattccgttgtcgtgtgctgcgccgccgccgcgttcgtcggcgcgcgctggctccgcccccggctcgcgcgcccgtctggtgtcttcgcggctccggtgtcgcgtttgtgtccgttttgtctgttgggttgcttctcgtttctctctctcgtgtcgaagaggcgctttccctctctctgctgttcgctctcggctgctcgtggttgcggtccttgggtccgtcttttgtcttgtctctttcctggttcctggcggcgcgctggcggtgtgtcgtgctgtgctggtcgcgccgggttgcgcgtgtcgtcttgcgttcgtgcgggcgcttcggtcgcgctctctctctctttgtccgtgtgtggggttctccttctggcgcctcctccagtgtgcgcggccggtcgncctctcnctttcctcctgtgcctttttgtgcttttcgccgccncntcagngcctgtgggtgcgntggttttccccctcgacgggttttttctcttttcgttttgtccggccggttcggctcgctccctccgctctgcgtttcttc

SEQ ID NO: 10210 - DNA, 1442 bp, Homo sapiens; identical to SEQ ID NO: 6426
  misc_feature (1)...(1442): n = A,T,C or G

SEQ ID NO: 10211 - DNA, 1043 bp, Homo sapiens
  misc_feature (1)...(1043): n = A,T,C or G
aatcgaccgagtaacaacagcactcganacatccaagataccgaacctccacgtgaacacgaagaccgccatcggaatcagacaggcgntnaccgcatctcactataccatcgatggggatctagatcacgaggaattggtccggaagtagcgtggtctcatgtatgannnggcgttgtttctatatagatacattctcgngcagacttctccgtgacggcatngcgtgggtgatggacttcacgacggacgcggatgtgtgctcagtacacgtgaccgttggggtgcggccgcgcactactagaggacagctgtgactcacacttaccactgccnaagannaaacatgctccgtacccttncctctctnaccactnctccgctcgnncccgtctgaccactccaccantaanccactatanncaccacaacataccctacagatangcactcttantacccatgntacacagatcaacgacaccgannagcgtacaacatanacgcctcnnnnacacgcgagaacgccactacattactacaccttctcgtcgtaccttngccgcgtctcgtccgtggngctcgcgctacacgtctgtntattaccgatcaactccgccgtccgcgnaccgcacacgcgatcatnnncacgcccgaacagcaccacgngcacctgacgcnagaagatacacgtgcgcgtgggaccgctatnnacagccccagcgaccaaaattcgggnngactctacatcaccataacgcaatcagacggcaggccactgacacggacaccggatcagangcacacatcgatncactgttnncccctcgatncgcgcnccacgacanacactattaactatnaactcttcaccttcaactcgacacatnacacctaccacactacattatcaacccacncacccttcactaatannnctcctctgcacttcccntcatcactccttntaactnttctttactttatcatctacttcatctctccctcctccactccccaccttccatcatccttctcacttt

SEQ ID NO: 10212 - DNA, 991 bp, Homo sapiens
  misc_feature (1)...(991): n = A,T,C or G
tatttatttctgtactagatcgcaattccattcccattgccagcttgtacagtgcacagctcgcactcacgaaggtaaacccgactacaatcccaccaaccgcgctgcgaggccgcctttccactcacccccgcacaccatcgtccgcaaccgtcgagactaacgactgtgcagtagtagcgcccccgcgtgctatctcgacctccgccccttcgcgcccctcatcctaacgatttacgatatcatctgttaagaggtccgacccctacaggatcgttagtatacgacagtacacttcggggctgtntcccacaaccgttccttcgcagcgaggctcggtcaggccaactccatcctaccctcgcgcgtcactgcgcgcccccacttcactcgatctgcacnacgatccacatagatcttcacaatccacgctccgcgttcgtggccactcatgcgtcccgcgtctacacgcgcttagactactctccaccctacttcagtgtcctgtccgccgtatctcccatctgcacacacataatgcaatacagncagagtccgttcctgcgctggccccacgactcagtgtagcactcaacgccgagctctcatcagccgcgcactactgacgccgagtatcnnaaggtcgcggtgtccctgggagatctctctcaatgctacctggatgcgtcttcactacactctcagccatctaaacatgattcgtcgtgtccactgagccctccgccccctcataanttatgttctgtgtcctcgtccgcatactagcgcgaatacaccatttcaaacacagcgtgaacaaccggccagacancgtcaacatgttagctttatcgcacatgctgtccatatggcntcctcgcgaaggaggtggaacacgatgctnagctccatgcactgcgcccnnncntagcgtcccntctcacctgagtacggcagtacgagcgtaagactgcctctcgacggctcctag

SEQ ID NO: 10213 - DNA, 1465 bp, Homo sapiens
  misc_feature (1)...(1465): n = A,T,C or G
gaaagggcgaggcgaccgcgggcctgcggaagcggacacccgcgagcgaccgacggcgcgcgcgaccgaacgagaccacagaagacgagcggtttaccgccgcgcgagcacggcccaacagcgacagtagtgttttcgagcgaatccacacagacaacgccagaaccgacgcggacaagacgagacgaaacgagcgccgcagcgaggcgacgcgacagagacgactgacagggcggcggaccaagcgacgtatcggcgtcgtgaacggagcacctgccggagcgcacacccgacaacaccgagcacgatcgcgcggcataaggcaacgggtgtcgcggcgtggggaggcacaggcgagtatagagcgtacggatataggaataacgagaagagagagtgggagtaaatgagtgagtagaggaaggacaggaaggaagagggtgagccgcgaacctggaatagaggagcagggggagagagggaacgccgcgaagagaaacagggaggagcgacgcaaggaggccgcaaggcagccacatatcagaggagagacctcacagcggcaagacggggangcggcgaagagtgaccgccacgtgacccagcacacccgccgtcaacaaccggaccttgccgccctcggcacgcccgttcacgccaccgccgaccgccggagcacgcccaagcgaggcgcgcaccaccgaataaagaggagcgcgcactgggcgaaagggagagggatcagcgccgcacagcaacaccacgagaccactagaactgcaccacgcaggagcacctccgtgcacgcgagacactcagacnagtacaaccnacacactgtacgatggatgccgtgccacacgatagtcgcccccgtgagtacgacggcataagcaagcgcaacgcaacaccaatgaaaagagacccgactaagacgcgggaagcaggcgacacagacactagagcgcagagcgactancaacacagcgcagaggacaggacgcaccgcaccacacccagtgaacaagatacgaccccgagtagcgcacacgcagcactcacacaacaagtcagcaacatctagccagcganctaccnagcacacataggcctccaatcgcaagcgnaggtgcacgcgcatacgagcgctcacacgtgtcaggggcgcgccgaggaacaggactagaacgacctcancgaagangcagggtgtggcgccaccccatcagatggagtgggcgcacgcatcaccgggtcgagcccagcggcgcacgacagagagagtgcgcgcgagacacagagagaggangagcgcgcggcgccacaacaagaggtcgtcgtgcgtgagtgatggnctgagagcacacacgatagcccatcgcagcgcgtcactacaggcatgctccacacctacgatggtgtngtacaagacctagcaccacatatgcagaccgcacccagacag

SEQ ID NO: 10214 - DNA, 695 bp, Homo sapiens
aagttttgttgtaagcagcagtgattggttgctgatcgtctactctcaagcgcttcctaccgtggctgttttacagtttaatatctcgtccgctctcgcggtcgcgtgtctcggtaactaccttttatactctggtttttttcttttttggcggacgcgaactggggcaatgagggctgcgtgatagtgaatatatgtattaccaaattactttttttgactgttgtttgagtcgttcgctttaccatgctatatttatctagccccattgtattatttgtttgattattctctctcactccccttgttgtattcatgccccctcgtgggatttactgtggatagagtggtgttccaggtcaatttcatacgcctatcgccttttttctcagcgaagcagttggattctccaggtattcctcttatcgggtgtcgattgtggttcacatttctcccttttttgtagcttgtagggtttggccattttgtcatgtgttatgcttctggactctcacccagctatgtgccggtcttcgttgtttccccccggtttaaaaaaaacttctggcttggtatatgctggttatagtttcctttgggctgggccgataataccccaactatttttcacgtttgttgtgtctgattcttaatagataaataaaaaaaaataaagagaaaaaaccccccccact

SEQ ID NO: 10215 - DNA, 718 bp, Homo sapiens
ccgtttcgtctgtacgggggatcggggtgttgtgtgttgagttgtcctttacttgctctgtcctttggtggtcgtgtacgtcgccgcggcgtcaccgtcaggggttgtgtcgcgccctatgatatgtagttcgttcgcgtgtgtggtgccttcgtggtccgtgcgttgtgtgtgctctagttcgttaggggcggcgttgtttcccctgcggtgtttatgggcataccttcggcgttttccttggtctgccttgatggaccttacgttataggtgtagaggcgtctcgtgggtggtttgttgtgtggtgggggggagttcgtgtgttagatgtgctgggtgcgggataccgggtgttgccctccgcttggttctttgcgcggagggcgggttgcggcactctttggtattgtagcccgctttggtggggggtggattggtccattttcctttttttttgcaacccggggagcgtggccccctaccgctggtggttgcgtcccccattggcccgtgctagggtgtggtcacgatcttgccttggttttctcctttgcaaaaaaaaactttttctcgttgtccctgaacttttgggcaacgccaatcagggtgggcctagaatggttccttggtagggttttcccgtttgggaattcatgtgaggagacagcggaaagaaggtagcagacacagtagtaaaacacgaatattaaagagtat

SEQ ID NO: 10216 - DNA, 470 bp, Homo sapiens
cagtatagtgctgactctcggtgagcagactaggagcagggctcgaggatactagttactatcgggtgacacctcctggattcaagttattctcctgccttagcctgccaagtagatgggattctcctgcctcagcctcctgagtagctggcatgtaccaccacaccatgctaatgttatatttttagtatagacagggtccatccatgttggtgaggctggtcttgaactccctatctcaggtgatccacccaccttggcctcccaaagtgctgggattacaggtgttagcctctgaaccgggccaatagaaattgcatatgcatatccgtgtgtgttcatggatattacatgctctaccaaatttatttgataatatagaacacatttattaatggaggtgaatgataacaagccataatatcttactgggtcttggggaaaataaaagtctcttttttaactacaag

SEQ ID NO: 10217 - DNA, 1512 bp, Homo sapiens
  misc_feature (1)...(1512): n = A,T,C or G
ctgaaaaagaggttaataaaggagagatgaaaagggattaaggagggtggagagggnggtnggatncaggggagcatgaaagagtagcgtggaggggtgagagaaccttgtgaaggtgnnggggaaatacccatgaagtaanagcgacanattcttatttggtatatagaaaaatacagccantcnncnatatntcatagttancagtaatctcnatgcgagagacagagancaagagataaagcatacagaancacggtcgtctngtctcgtanttntcaactacatgtaagttacgcnntctaacaacgcntcacatcgctgaaccgcgctcgaggacantacagcacccacagtctcataaccacgaggacgaaagtccatctgccgctccacgcgactcacgtgtataaagtcctgcgaggtatgtgtacagggagacaaagacggatctagaccacgcccgtgacaagactatctactcatagcttacctctaacgttcgacagcncaacaacacactacgctctcaaaacacccacatcatatcgacatcnccacgaacatcattgccntcgggcattntccacagacgcttgatagtcatggttaggttgagggatntaatatagtaagatgtttaatgatactagatagtataagagagagagatcgatgtgttctatgtattagagtgtgagatcataatatatttatacgtataacatatgtggatcgactctaaatgtgtgtcggcacagatactgtcaggacccgcacacaacatacacacacactaaaagncatctacgatcgaactacctacgtgcgtgcgtaaggccatattgatcggccatcgaancgacagagaagtaactctcaaacagtgaaactagatcgcgcgtacgcacgaggttagcgtgagcggagagagcgagcatgatgagacanncaatcgaaaacgagacagaaacgcgaacgcgattacagaccaagcacgacgagatatgccgacnagatcacgtcagagtataggatgtgacaagagtaggcgagtcagaaatgtcgatagtagcaatgtaattgtagataagagattgtcatacaaatcacatgagaaantagcatggaagattatatgtgtgatagagaatagtccgagtggcgcacataatcagagctcgccgccaaatcagagaacagacttctaccgccacacctgatcacntcatcaagtgacccgacagacacaccagaccaacaccgacgaggagcgcgccctcacatacaataccgaagaacgaagtattcagggctgaatgctaagaaccgaggagtgcggcngaccaggtcattagtgcgattgtggtgctcaaggaggcatgcggtaggataagtcaactctatcgatgcattaatagactctaacatatcaatcgacaaataccgtcacgaagaagacgtcataatgtaatacagtacgatcacaatgtgagaaggcagtcacagagc

SEQ ID NO: 10218 - DNA, 782 bp, Homo sapiens
tgcagaacactagttttattagatcattctcattctgattgctaaaacatcactaatagcaacattggaatgttgaaatatcattactaaaaacatgctgtgattggtgaccctctgaaagaacccttgttcttcaagatggtacattgaaaaggaaacagcacaattatattaaccacgaccaatcagagcagcaaattttgcaaaggagctagcaaacttgtcttaccaaaaaggcttctaggaatcttcatcttaacttccttactctttgacacttaatcacttcttttctttgaaccactggagaaaaagaaagaaaggaaagacggaaggaaggaaggaaggaagaaagaaagaaaagaaagaaagagaagaatgactggaaggaaagaacgaaaggaaggaaaggaaaggaagaatgaaggaaagaaaggaaggaaggaaatgagaaagaacggaaggaaatgagaaagaaaaaagatctttcatctcaaaacaccaccctcctatatcagaaccctcagttactctcaacattgcttccttgacgaggtctgccctcctcttccataacagttggctaaactttcctgggatgagggatgtgttgattactaaactgtctgaaatttggcttaccctcttcaggaattattattagttcattgattacctttttgaagtccatccacaagacccttatagcataactgcaagagaacaatgactcctgtattgtagatctttgccccttaccccctaaaacagagcctgaacat

SEQ ID NO: 10219 - DNA, 816 bp, Homo sapiens
  misc_feature (1)...(816): n = A,T,C or G
agtagatggagtgtactatgttcccaggctggtcttgaaatcctgaactcaagagatcctcccacctctgtctcccaaagtgctgggattacaggcatgagccaccacaccaggccaatgctgaacattttttaaatgcttaccagtcatttgtatttcagcttttgtgaatggacctattcatcttttgactttttattcacttcattgttttttcttttttttgagacagagtcttgctctgtcgcccaggttggagtgcagtggcgcaagctcagctcactgcaacctcgtctcccaggagggagcaattcaagcaattcaagcaattcttctgcctcagcctcccgagtagctgggactacaggcgcctgccagaacacccggctaatttttgtatttttagtagagacggggtttcaccatcttggccaggctggtcttgaactcttgacctcgtgatacaccctcctcggcctcccaaagtgctgggattacaggcgtggtccactgtgcccagcctgcttcaatttttttcttactgatttgtacaatgctttatttattagggacactaatcctttgcctgttatataatgttacatatttttgctagtttagtgtttttctttattntagatatgctggtttcttggcattcaaaagctcttaattttcaaatgtatgtaatttaatctaacacagtttttctttataattcctttgcttttactctcanaacatttcattaaacgaaggaaagagaaataggtctgtctacttcaaaaactcttaatgtatattttgatgaggact

SEQ ID NO: 10220 - DNA, 727 bp, Homo sapiens
  misc_feature (1)...(727): n = A,T,C or G
cgcctacgcgttaggcagtgccccccctangctggtgtaccgctttattttgtttttgtttngaaaagatgccgggagttttcaaaaaggcgaaaaaagggggggggttaccactacanaccagcggccacccgcggggggggaagagattatatggaggcacgccccacaaatactaaaggggaatagacgtgggacgcgcgccccccggataattaggggtattaatagaaaaaagggggttttatgtgggagagggcgggggcaaacatatatcaaagggtgaaaggcccccgggtgcgccgaaagggggtgggggcccagggggggcccccaaaggagagagaattgaggcttttttaaagtggggggggccccttttccccccccccccaaatttgttagccccggccggcgctaaacagaattttttgcaagggggggtaaccagggataccccgtaaaccccggggggtttttttagaaaaatttcccccccggggagtccgcaaactcgtgggggaaaaatttccccgggggcggggtataagggggggggccctttttttttcccctttaaaaaaaccccttgggagggggccccctgaaaaaagattcccccccccttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10221 - DNA, 811 bp, Homo sapiens
  misc_feature (1)...(811): n = A,T,C or G
acagtcctatcatgaaacgctagagacatccaaaccaagaataagaaatagcgaaagaagaacaagaggacacatttgagtggacacagatcttgatttagagtttactctttttctttatttcctatagttcttggcaaaaaaatattaaaagttgcagaatccggaagaaaaaaaaaaagaaaaaatgtaaatacttttaaggcgaaaatattgcaactcaaacaaccattaagtgcccgacgccagcacaataattagtcactctccccacaaagtcactgaccgcggtacacctccacaacaccccataaaagccaaggaaaaagacaaaccgaactcgacaacttataaacccaacgtcgccgactcagaccaagactgactgaaaatctattatgcgtgaacaatatgaaccgccacgcttctcaacatatacctgatattgcagactctatgaaaataaacccaccgtagggccctctaccccaacacaacgctgaagacccgcagactgtaacacacgctcgcgggtntgtgaaaagaaagcaacaaactgcccaccgttccaatagagacgcccacctcctagggaccataagcttgttacctcaacaactccactcactggccaccccacggccccagaacataagcattttcgacacagcgcggactaaggtcctcccttacgttaacgcactaaacagatctaccatacgctaccctaaccttctagtacttactccccatcaatcagacatccaaagaacaggccacatatacacgtaccacacacactacaccacaa

SEQ ID NO: 10222 - DNA, 695 bp, Homo sapiens
aaaacaaagagtaaaactcgatcaaccgagaaaggtcatatgaagcagttagtcgcatagatagggtattgagccacagcgaggggaacgaatatacgggcactagtaggaatagagcatacaggcacatatcgaccggcggaggtgcggtagcggctttgaagcagagcttttccctgtctaatctgttagtctgaacgacaaggtctaccatgtggggaatgtcatgacaacggatacgcaaaacggttatttgaaatcctacgaacggtctgatatcacacaccaattctctctgccagtcgtacacgtcatcaaatgtcctattatctgagcgaaagtatgtgcgtgcgtttggacgaggagagaactcctgtagtagcgatttgggactcgtctgcacggacgagtttacacgttagcgtctgacgtctatagatcgacagagacactaagagctggcgacattcagcgcttcgagagtctaacagtagaccagataccttatgcataagtacgctatgtgcgttcagctaggggggaacacatggtcaataacagcgccggtcgcgactggaatccaggaatcttcacggtctttatacaagcacggtgctacatagatagcaaggtatggaaataggcacagggacgggactgaaatgtaatgccgtcgagaatgaaaaaaaactgac

SEQ ID NO: 10223 - DNA, 570 bp, Homo sapiens
  misc_feature (1)...(570): n = A,T,C or G
gcactaatgacacatccgtgattgagattaagatactactcgtatactatacctctgtgttacctatcgcgatggacaacatcgacgggtacggggggcacgacggcggggccgcccaaaggagcaccggcgagtctatcagcaatgccacaccctaattcttaccgtcacacgccttcccatgccgcgcacatgtctgaacctatatggagtgtggtggtttgtgcgtatgtagttatcgaaaccacgtatggcgcggaagagcctgagctgctatagccgtcttatatacatctgtctacgtcgagagagctgtgcctacgcattacaacaaatatagtacttgatattcatacttcggcttcactcccacncatctctccgctcagactacgtcggatcggcgtgtatcaacacagatcgcgaccacttttagctctatccctctgcgtctcacggtcaatgcatggaccgaagcgaacattgccgatacaagctaccgcaccacgccgttctcagtccggtgagacaagtcccgaattaccccattgcgccagggacctcttgtga

SEQ ID NO: 10224 - DNA, 460 bp, Homo sapiens
agtaggcctcctccacatactctgtcttcaggcttcaacaaagagagcacgcaagacatgactcgtatcatagataggaatctgaaggccgcttggtatctccaggaagaatgacaagctacgcatgtatgtgttcattagccacacatagagagacactgtatcttagaagtgacgacagagtagtcgtaagtgtgtgaagaccctactgtatgtgatctatagtgatctgctaactcgtgataatacctaacataagatcatataatagcttagatgattacctttttgcttagttcagaaaaaattaataaataaataaaaatgttaatcataggaaaaagtgtatggaataagaatataaagaaagaaaatattcttataaaaaaaaatgggcccacaagggggaacctttggggccttttcctttcaaagggggtcttttaaggcctcaccggta

SEQ ID NO: 10225 - DNA, 1366 bp, Homo sapiens
  misc_feature (1)...(1366): n = A,T,C or G
ggggtgttttggtgancggtatttttaggtatgtgaattgtatgatgttatcgggtatgagagcggtgggttgaggagaagatgtcttctatgganaagaccacgaaagaaagaaatgtaanagacggcggggtaggccatactnccacataaagaaacgggaagaaagagtggtgcggcggtatgtatatcgatctacagttatcttgtcggtnncgtggacttgtgtggaatgcagctcctatgatttatacgtccactgcgcgaggnnnncgagtgggtgaggggagagcacgagaccgacgccgggacggtaggctctcttattaaccaccaagcgaaantccgcacagaagaccacactgacgggagcgtggagcgcgtcacgagcagacggccgggaggggaggaaggcgcgggaggccgagcgtatganagtgctactggtccacacaaactccaaaggcaggaaatgcagtgagactgtgtgtggaggatggggagagtaggggagtagaaaaggataaagagacatggtttaatttatttcacaaacaccgcaactagaccatctcaattccaaacgtattcccctaaacangtacccgcaacaacaacaaatcgcctatcaagcgtttcgaggaggagacaatagnacacagagagaatgtcagagtagttatactaagtttttctaattatatatcagtgagaggcgaatgtagtggagaagagaangncgagagaagatgaagattcacatnaagagctgancggacaggaggagcgatagatagaagtacatggantcactagacgcttgcatccgtagncgtcgtcgcagacgagtactactaaaagatagttaattgtgtcggctgacgaggcgggaggagtagagaggaagatatggaggtgtagaggggncgatggaggtggaggaggganacgaggtatnagcgcctgaantgtatagagttggggtgagatgtgcnctgagcggtcgacagtgacgcacatagatacgagaagtgtgatagacgctntgactatacatatgaacataagcataatacgagactaccgcacgacctcgntcgctctctatacagtgccacctaggcaggtcgtctaggaggtgcagcggttgtacggtgtcatcgcgacacgcaaactacaganacgacacgcacagagtatacgtgaaccactcgcatggcgcacgcggcgcgcggtgacgatcctagcaagaacgagggnggtgcgaagacggtcagaggaactgatctgatgctatataagactaatgagatatctcttatcgtcttattgatcatctctgttagagttcgtgtcgtaaggncgt

SEQ ID NO: 10226 - DNA, 865 bp, Homo sapiens
  misc_feature (1)...(865): n = A,T,C or G
tcttgtgtcctccaccgtataatatataatacagtggagagggcatttactttatgactaccgagagaaaatgtgttctatagatntgtttgtccccataatcaagtcagaggtttgtataccgtccccggggttcgtgttgtgttcctagccggagtgcgctgatttctgagttgcccgcctctacactgcgaaatgttgctatttcaaaggagatgggagtccgaaggagccgccaaagattgctgaaagcaagtcttcctggaaaaatccatatactctcgcaggggttctggagagttattagaatacaccaacgtggtgaagttccccttttattacactcacatagccccttctggtcaaggtttagtgcaaaaaatagatctctcaccaaactacagctcttatctttcctcccattccggtaggtaagaagccctggaagagagaaaggaggtttgtgttttaaaaaaacccaaggcatgagcacggagttaataacaacatatgcgtaaaatattgcaccacgtgtaaacctatccacaagctccaggatcaaagcttctcaggagaggccaggcacgatggctcatgcctgttatcccagccctttgggaggctaaagctgggcagatcactcaatgtcaggagttcgagaccagcctggccaacatggcacaccctcgtctttactaagaatacaaaaatcagccagacatggtggcacatacctgtgatcccagctaattgggaagctaaggcaggagaatcgcttgaactcaggaggcagaagttgcagtaaacagagatcaatgccaactgcaccttagcctgggtgacaaccaaagcatgattctttctc

SEQ ID NO: 10227 - DNA, 704 bp, Homo sapiens
gttgcgggctctccttctccgacgcctcctcgcgctcttcaccccactggattctcggcgtgatcttctctccgccggtttacattacccgtgagcgcgccacacgcgggtcgcgttctcccccaccctcccccaccatccccacccccccccttcttcctgccccccccctgcggccatccctcgccgcgggatccccgccccattttttttcccacggcccctcccgcgttccgcttctgcggcttccaccccttttccccccccacaaaggccccctcgtagcttcgcttcgccccgctgttggtccccgccaccatcaaccccttggttgtgttaacccccctcccatttgtccccggaggggttccctctcaattgcttcttaatttcacctttatataggccccggcggccccccccccggattttgcccccccggccctttgttatcagggcgcctccccgcccccccagtgtttgggcccccggcccccccccggtggtcccaaaagtggagggggccctcctttcttttgataggctgattttttccccttaaaaaaacccgctttctgcggccccccggtttttttttttcccccccaaccgctttaaaaggttccctttattccttaataaaagtgtttttcttaggtttcgcgggtgtggcataagcatctaaaaaaagacactttttttat

SEQ ID NO: 10228 - DNA, 111 bp, Homo sapiens
tctgctcttgagctatgcagctcctgacgctaccagatcactttgggattctttatagccgatttttaattaaataaatgtaattgcctgtttccaccaaaaaaaaaaaaa

SEQ ID NO: 10229 - DNA, 816 bp, Homo sapiens
cctgacctggctacggtctgccatataaaactactcctttcaacccacattttctccttaagtgatctcattagtcaatacggttgtgaccctgagagatgaatgaaaatattgttttaaaaatatttagctttctttatctgaaaacaagggcaatagatagtagtttcagtaattctttcctatgataaaacaaaaagtatgcagataggtatggctttttaaatgaaaagagatagatatatgtttatatcaaaataagatcaggaaaaattatagtttgacaggtggtaattgatttagattttttttctagttttctccatatccatgaactgtagtaaacataaccttggcaattgtagggtacagttggaggctttggatgaatatgagatcatcaatttatacttaataataccaacaccaaattcatttttttccaaatgttgtttatttgctctcctttacttgtattttgactactcagatagatgattttaattttcttgatgcaatttgaaatatcatttcagaaaactgttgcattaagtaatatacaaccagggatcagtattgaacaaggatcttttgttcattaacttcttctcacaaatagaattaccaattaaatgaaacctatgacattctaatctttggaaaaaacggaataatagaagaccaaacggtaaaatatttgtttagcaacaaaggaaaataattttttgggctttttggcctaaagggggagcctttgcgccgtttcctttaatgagggggaatttggaccttgctcatgactatttgtctgggggt

SEQ ID NO: 10230 - DNA, 760 bp, Homo sapiens
acgggccgggctcaacacagagggtgtttgaccgctacacgtctgaccgcgctcggtccgccgcccgccaagccatactgtcgcaccgctcgctgtcgccggtaggaccatttctccagcgacccctgggcccgcgtccgacaaaatacgccgtcagatctgttcgcgccgcgagcgtgcgggcgctgggggcgcgtccgcatggcgcgggaggaggagggttcccgagtatcggtaccctgtggggcgcccgcgaggggtatcgctgatgggtatggcgtcttttctatcaacgaacgggtggatatctgggtgtgtggcggtgaagtcgcgcgggcgccatcctcttcttccccccgtggggtggtgacgctcacatttttatagtgaagggtggcgcgaatccccacaacattggtagtcctgtacctgtccccctcctagtgggtcccgttggggcgtccttggggcggaattagtggtgccccgcgtgaatcttggtgaagacccaccccctgtcccacttttgtcccggaggtgggtttggaggtccccccgtaggaggcgcgcggccccccccaaacaaggtttttactttcttctgccctgtccggtgtaaaaaaacgcgtccgtggggccccggcctttcacccccgggcccgggatgaaaaagggttattgctccgcgcttttttttccgcgtgcatggccaataaaggggccctttagttttattttcgggtgaaaaataatacaattg

SEQ ID NO: 10231 - DNA, 169 bp, Homo sapiens
  misc_feature (1)...(169): n = A,T,C or G
ccacaaaactacactaactaagacaggaaaagaaggaccctcgatggtaacacngagatctcttcttaggctatacagctcctgacgctaccagatcactttgggattctttatagccgatttttaattaaataaatgtaattgcctgtttccaccaaaaaaaaaaaaa

SEQ ID NO: 10232 - DNA, 175 bp, Homo sapiens
ctttggagcaacgggaactcccaagctagacagtgaaaatggcaaagccccaggataaaatgatccttgatgtctgaatcaccaccaggaagatagtgacatacaaagaagtaagactgttttggacattatgtgccagagaaataaacttctttaaccattaaaaaaaaaaaaa

SEQ ID NO: 10233 - DNA, 262 bp, Homo sapiens
  misc_feature (1)...(262): n = A,T,C or G
cctccactaacaatagaaaccattaatgaaggaaaaaaaagacctagaagtaacggagcacgggccttggaaggaaaacaaagagacanactatcttgaaagctagagacatcttaaccaagaataagaaatcggaaagaagaaaaagaggacaaatttgatggacacagatcttgattttgagtttatctttttctttatttcctatgttcttgagaaaaaaatattaaaagtttcagaaaccggaataaaaaaaaaaaaa

SEQ ID NO: 10234 - DNA, 868 bp, Homo sapiens
  misc_feature (1)...(868): n = A,T,C or G
tgtaagtttgggagatggtgaggtgatttgtgttttttttactctaaaaacttagagaaaattaaaaaaaaaacacggngagatttgaaagtgtaagctnnttncgctttgggtggtcgggggcggttcggggtctttccattttccactggatgattcatggtaccatactgctctagggaaagtntgtttgggagaacagggtaggcgatttgaaggtgatgtatactaccgctccataacaattatactagtcaccccattcgcttcctttatctgtggcagcgagagacgtatactcgaatgggttgttattgtggtcagtttctcatgctagggacgtgatctttaagggatgttattataacatttgtagtaagctagtataattatttgttgtgacccaacgcgcggagagccgaacgaaaagcattcagtcccctccctcgatacgtggtggcggtgttttgtaaattttatttagacacgtgcgttgcttcgtgaatgccacaacaaaccaaacaaagaggcacctgctgcccttctccacggtctaagtctatatggctgttcgtaaagatttctatatacatggaatgagtctacggtggttagtcccaaagagaacatggatctagtgaagtataggatggtcacgaggggtagggtgatgccctgcgtatgattatgttggtgtttttttgccagagtgaggtgtgttattgtatgttgtgtcaggttatctattcacaaggggaactggagtatgtttaggtgtgcgtaggttgagtactaaaagagtgtagtgttgtcacgaggaggtgaattttttgtgttttctatcttgagcgcaggagaaggtgaagag

SEQ ID NO: 10235 - DNA, 1680 bp, Homo sapiens
  misc_feature (1)...(1680): n = A,T,C or G
acttagtcgtgactgtttgtcgctgttatcagtgctgtcgtagtcgcactcatagtagtccgtcacatnancgtcattgatcctgatgtattcgatgctcgatctgttagctgacgttgncgcaggatgtacactangatgtgtgcatngagtanccacatncncccgntctcgtnncgtcagncagcagatcgtnnctactgctncagactgcatcgcangcgcgncgcatgttnctctngcgagtcatctctagatgtngctcgtcgtntgngcagatgcgatcgctgctgntcgctncgtctatcgctctcgataccgtgcgagnacgtcacatangcactcgtacgtactgatgtagcgtcgtcttcagcgctntgctgcactcncgtgctatcgntgctncgacgtactntgncgcgtacgtctcttgtgcgcatcatcctgtntcgcacgcgcgtatgtacgcgatacacgnagatagtcgtgacagctatgcgcagcgatatgcgagtgcgtcgcgatcgatagcgactataggctntgcctctactcacgtcgntgctgccancctctcactcgttactcaacatgctagcgtgtgctagagacgctcagcgcgtcgatcggaccgctctgcgnagtgtggtggctctaggtgtatacatgttcgagcttatctgcgtcgacantgcgctcatatttatcgtgccgcgctcngccctcgcattgacatcgagattcgtctgctngtcgtgctgctatgtatngtctgtagtacgctgatgtctgactacgatgntcagtgagctaccaggcgcgtgtgtgacgggtcgtcggcatcgtactatcgcatatgattcagcagtctctagtgtactcatacatatctactggactagtgcttcntgacacgtcntcgtgtgtgtgtatgtgggtgtgttagtgtcctcgcgcgtggcctcgaaacggcgtgcgcatcctgcgtgtgttgggctgtggtgnggcaggcgctcatgcgtgtgcactgtggtctgtggctctcattctcgttctctctctcactacttaacttacgtcagcgggctctgtgcgactgcctcgcgttgcgccgcgacgatcnttttcgacgccgaccgtacactcacatctcgagcgtctccgtcgttcgcccacatctctatactccancgcactctngactcgtgacaagacgtgctcatctgtcgtacgtagccggtcgcgacgcgacacggcgccgtcgaacacgctatccgtcctgctccgcttgttggcggaagcgccgtagatgaggtgttgctgnagtcgatgtctgcgcgatgtgctngcgctgtgactcgatcgtatcacgcgcgcgtgagcgtccgactcacacatgagcgtcgtctcagatgctctgagcacngnatcagtcatataccctcgtacgcgcgcactatntcctcggcgtcctctgccctacatgatatcgtacgatgagttcctgcaatatcttatgcgatacgaggtcactcacccacagcgcgtatggctcctcactctcctaaaaatttcggctgctgtcgtgcggtggtctccgctctaatcaaggccgctctcccgccgtccgcgcggcggccgcgccggctgcacgccagactgccgatgctgagaggcctc

SEQ ID NO: 10236 - DNA, 423 bp, Homo sapiens
ccttttttgccactcagacaaagatgatcaatgagataagagcagaagtccttgggtgggacttccaagtgtctggattactgcctggatccagctgccttgatcactgatatgatggctgaaactccagcagtcatttggggaccatgagagaaaagccaggagaattgtagtgactgcagttctgacattcttgaaccactgtaacaaagccaacaactgcctccttccagatgactcattatatgagaaaaaaataataaaccattatatgcttatgctagtcaaactctgttaatagcagccaaacacaattcctaactgacacagatgaaacattttgcaaccatttaaaattatctttctaaaaaatagaatataatattaaatcagaaagaatatgaaactctaaaaaaaaaaaaa

SEQ ID NO: 10237 - DNA, 871 bp, Homo sapiens
  misc_feature (1)...(871): n = A,T,C or G
ggtttgtgatcaactgacgcaaaatggcagcaacactggaaggaagaatcatgaggatatcttagaagataaccacagaatctttgcaagagacacagaagactaccttacacctggtttccacaggagaaatggctcaaaatatgttattagttgaacagtaggaaaaatgtctatggtctcttcagcaccatctgtatgtagtctctgagtctccagtttctcatctatgaaactgggataataatatgcaatgagagttattctgaagatcaaataagatagcatgtgaaagcagttctagattccagacataagagtaagattaaaagaaatgttgttctcaattttcttgtgtcattgctgctgccatctagacttaaacaaatgttactgtaagagccaagtaataaactaacacatctaatcaaaattaaagattcttctttctaagaaaaaaaacacacaccaggatcctttaaccttatcgaactatgatcctcgacttgatattcctttacccactatcccataaatttaaaataggcccccacgtgcccccaagagggggacccccctaccgccgctttcctttttaggaggaggtgtaanttatagaaccctccctcaccgacccctttgtgagtcttggtatcagcgcgttgcggctcgccgtttttacattccctcaggagggggattatacacctatccccaaaaacatgggtgatatacgcgggactacacccgttggtaaataggctccctaaatgcgcacacactcacaagaaggcgcggttggtgatgttttattctagagtcaccccctctccttatttatctacattttcgcgcctcattgtagtgccgg

SEQ ID NO: 10238 - DNA, 112 bp, Homo sapiens
gtctgatcttgaactatgcagctcctgacgctaccagatcactttgggattcttgatagccgatttttaattaaataaatgtaattgcctgtttccaccaaaaaaaaaaaaa

SEQ ID NO: 10239 - DNA, 214 bp, Homo sapiens
  misc_feature (1)...(214): n = A,T,C or G
ctgatctctacnacagaaataaagctgaggacacaggtgtcaccctgggaacaattctgtcaatgagagagtgaaaatggctaatgccagtgacagtcaagtttaatcttatgcaagcagaatttaataggatcaacacactgtgtttcagaagtcatctgtcaggtaaatccttccaattaaaattaaataaagacactgaaaaaaaaaaaaa

SEQ ID NO: 10240 - DNA, 279 bp, Homo sapiens
  misc_feature (1)...(279): n = A,T,C or G
gccatgtgttacctctgncgcgcaccttgagtgcagcaacgccatcttgtctcattgcaacctctggctcctaggatcaaaagatcctcttatctcagccccccaagtagcggggactacaggcacatgccaccacaccccactaatttgtgtgtattttctagagatggggtttagccatgttgcccaaactggtctggaactcctgagctcaagcaatccaccctccttggactcctaagtgcgggattaaacgtatgagccacaaaaaaaaaaaaa

SEQ ID NO: 10241 - DNA, 1013 bp, Homo sapiens
  misc_feature (1)...(1013): n = A,T,C or G
ctgtggcgtggtcgtgtgtctagaggagctggtctctcaccactccgagnggatcggagcgtgtgtccaacgttactgtggtgccttgatctatanagcgcttgtcgcggaacctgtgtggcggtggtactcttgtgtgtgctcgaagacttgtgctcctcgttacggttacggagngcgacgcacttctagactgttgtctgtatttacccggtgagaatgtgcagacctgaacatcacgtacgtgcaacgtctcgctggtctggcgtggcaccttatccgccacctgtgcaccgctcgcttaaccgtgtctcgtgcgttgtgagtacacaactggttcgtcgaaccgtcactcgtttctttgtaggcacgtgtgctcgcacctctttatcgtaccacgacgtgcagtatctgccggggtagaggtgcgtgtcgacgcctccacctgntcgctgactccgggcctgctcctgttgggctgtacattactggcgcctggccgtctcattttttctgtctttcgtgtcttgaggacatanttcaccgagccgttgacctgtactcgggatcatttgccatgtatgtcgtaatagtgggaactttagttcnagcatcaatactcattgctgttcttcttaatgtaagtctactactaggttatacgtcaagtgcctggtataggcctcacgccaatagcgcaccactgatgttcctctttgtgattcgtttctttctgtgtcctctttgttccgtctggtaggtcgtatgactcggcttgtggcgcaactgcctatcgcatcaaaggacttgttccctgttcttcattcatttctcatcattgtggaggctgggatgctatgttgtcagtggatcatgctggccttctttggcctcttggtcctttccttaagcgggtgtgcgcacctgatatatacgtttgccataaatctattgtaaaaacgtataatttgtcatataaaaaaaatcatttcagttaacaaaaaaaaaaaaaa

SEQ ID NO: 10242 - DNA, 1468 bp, Homo sapiens
  misc_feature (1)...(1468): n = A,T,C or G
aaaaatttttttaaattatttagatngtgtaggnngnggaganaganntnnannttnncagaattggataatgtatntagagttagtgaaatactttatttcatggtgggccgcttattntgtatcgaagtgacaaacagcacaggagatgtagtaggcagangcgtctcgccgcgcgctgcatcctctccactaagcagtctgtcactactcctcctcttccaccaatctacatanattacatacatctacntctctcctctctattttattacaaatgaagaatatataagaataacagctgagttaggagaatagtttgaagcacaaatattcaaacaatctaccatctgtcgttcttttcacnaacatctcctatcggacatacagcatatctcatctctctccttcacattctatatagattctcgcctcttgtattttaatcattatatttaaattatgttcttcgctacaactcacccaatcattctttcctgataacatacnattatntactaacatatacgacagatgaggctattcatcgacagtatattttacattatgattcaattaatgangtgtgtgtagtttctgtataagtcgatcattcatatacttttataggtgttctgtagaatctgcactatgtgaacgttgttttgtatatgttaccgttnattcattaagaaagaaagacgctgcgagatacgacgacgtgatactcacaaatccgacantaagcttacagccgcattctatattattatataagataaatcagacactattgaaaggtacacatatactaaataaacgatagttatatataatagtgaagttgggcggaatctactataacctctaccctagatgccgctgagcgacaatcatacacgttccaatgcaactcacatatatctactgtataatacttctcctcctttactcggtctcgtcactgcgtgcatctagtctgtcacacatactatantatatacttgacaacacgatgtcgtanacacactctttcatatntagtcacacatcccgacagtcgacctcactctcnctctaantcctcgcgtgcgatgccgctanctgtatgtcatcatgaatcgtagtatcgacantntatattgtagtatatcaatctatcctgaccatgcggcataactgcaccncgatcgttcgaatagagtcatctngtaatgaatgcgtagaactgagctcgcatactcagtctcacatattgtttgatacatctgttaactaancgatagtcatacaacacatgtaaattagtctccacacactacgtgcgtcgctattgctcacttacgtcgtaaatatanttagtatatacgtgatatgcacaagtatctgaatatgatgcagctatacatacctgcagaatgatatnaggatcagtcacttgtagtgtgagtaangtgtgagtagctat

SEQ ID NO: 10243 - DNA, 1572 bp, Homo sapiens
  misc_feature (1)...(1572): n = A,T,C or G
aaaggttccgggaaggagtgcgggtggctgtgctggnttgaggtattatattccgtttctttgtctcgtctgtgtgctagttcgtatctgctatgactaattgtacgtcgcacntcaccagcttgtctcacgtccgtatttaananatcctcctctctttctcattcatgttattatacacttgtcatcgccacggtgcgccgtgactcgaacggcgacggcgagccgctcgcgtgtcagcggctgtctgttgctgtagtncgctgtcancggnnctgcacgttgcgtagtatgccttcgcgtgtgtggagtagtcgtgcatacgcggagacctacgtacgcgcgcgcacaanacgtcatcggaaggnaggagatctgtgcgcttcgttcgcacacgcgaacctacntaacgaacanatatgtgacagagntggcagagaagagtgagcgagagttagatgctattagtgagcgtaaatgacgacancgaacngcganactacacgacgncgcgtaatcatatatagtacttacacacagccgtggacagtgcatgtgtacaanatatctcacatcacatttatgatgacatcgttctgtagtananaggagaatgcgagagtgcatagttagatcagatctacatactagcgtactcgaatgcgatgtgtagttcggctcgtgtcgttcgtttctctagtcatcacacttacgtacttgcactgtcatgtttgcagacagtgattcctcgtgtgtgtcangtgtaccgcggcgtagtgagtgcgagtcgatagtcgtaggaggatctgtcagtgagcgagtaggaagagagacaggtgagtagtaggactgagtccacgagactcgcgancnagatacgggatactcatagactaantactatactctcgttcactctctactacgatcntcattctctgtnatcctcgtgtgtcaagtgcntgtgactcgatacgtgttctagtgctgcgagcgttnattgtctgacagtcgtgtcgctgtgtatctatatgtaaggttgattcgctcttctgtgtatagatcgcgccgatcgtatcttatttagctcgtacggatatagcggggtcttgctgacgactgtggttcttgattttcatcgatatanttattcattagtattctngctcggtattctggagatgtgtgcgacatcgcgatcctctcacactccagactatactgtcatatatgactttcatcctctggtctgtgcgtactatagtatatagtattttgtattactgatgcccgtgtacagacgccactgatcgtatagtgcgtttcgctcgtgccttctctagattgtacgctcgtcgctcagtcgtgtcgcctctgaggtgtggcgcgatggagatctagctgnacgcggtgtagtcgagatctaactatctcacagtgatgagatgcgtgcgtgtttaaggttatattgtgtgtcntgcgacgcntgcgccgtgntgtatgtgatcgagagttgtgacatagtcagntacgcaatatatcttctgactgttgcgcttgacatctcaatgt

SEQ ID NO: 10244 - DNA, 984 bp, Homo sapiens
gataatataatatataattatccaggagagtgagagagagaagggcatgacgggaacgacagatgctgagtttgttctacaggactaccctgaagcagcatgatgagcacaaagtcgaccaacataagcatgaacttttcaacttcattatctatggccatccagttagtcatgtaggactgagtgttagatttatgatggagggatgatggacagtcacaggacctgattgatctgcagcaagtctgagaaatgagttgagatgagcagaactgtagaaactttatagtgttagacattatgcctccccgatcagagtgggcctgtgttcagcactatctattattatctattagtatgtaactgagctctatacatgttaatattcatcgtacagaagcaaaagatagtgataaaggaaatgtgtacattataaattgtatagtcactgtaagatgcattaacttgtagagatgtttatttgttagtggcaggtgatgttttactggagcctattggtatctttttactagcatacattggcaaattactgctacattagctcctattagtgagatggcggcgaagataagattgtgtgaattacatgtataaaataacggaccgtatctttatgaatatgttattccacatagtgtgtccagcactgtgattcacgggtccatactgtagtattgtcatcagacttaatagatagataatgtgcagacgatttaatcctcccacttatcctaaagagagaatgaaacgtaatagcccgtacacgactagcgtagaagctggtatatcagaaataaacaagtagtaagacattatattgtatagcaacgacatcacacataaagcttgtaaagactacctcagtagccctcccccataccttatcgtgcctcggacagattccgctcgcgctgtgctggtgacattattttagtggtatagggcctctctctttgttgattg

SEQ ID NO: 10245 - DNA, 132 bp, Homo sapiens
  misc_feature (1)...(132): n = A,T,C or G
ctcatgcgtgacagctgagaantcctccttgagctaaccagctcctgacgctaccagatcactttgggattcttgatagccgatttttaattaaataaatgtaattgcctgtttccaccaaaaaaaaaaaaa

SEQ ID NO: 10246 - DNA, 132 bp, Homo sapiens
gcttgccgttacagctgagaatctgctcttgagctaaacagctcctgacgctaccagatcactttgggattcttgatagccgatttttaattaaataaatgtaattgcctgtttccaccaaaaaaaaaaaaa

SEQ ID NO: 10247 - DNA, 111 bp, Homo sapiens
tctccttgaacaagcagctcctgacgctaccagatcactttgggattcttgatagccgatttttaattaaatacaatggtaattgccctgtttccaccaaaaaaaaaaaaa

SEQ ID NO: 10248 - DNA, 824 bp, Homo sapiens
  misc_feature (1)...(824): n = A,T,C or G
cgcgggaggcgggagaggttggtgcgaggtgcacgggggagaaggatggggggggaggcacagaagggtggttgtggagaagagaggggtcgtcggagaaagggggagaggaggagaataaagggatttttggaaaagtaaaaggaccggaggtggaaattggtacaaaggtcggaaggagaatggttcgcggggggaagaaaagcacccaggggttgtgggaaaaaaggggtgccgggaaagagggggagaaaagggccaagagctctcgccgggaaatagaatgggggagaatggaattgaaaaagggggattaaaaaaaaaaaaaggttttggaaaaaattttggaaaaggtttgtgggagggggatttcgggggagggggggatttagaaaatttggaaaatttttaaaaaagggaacaagaaaggggaagaaaaaaaaaaaagcgccttagaagagaaaaagttttaaaacctttaattaaggtttagaaggaaaaggtaataatattccaaaataattgggtcctttacagggaaaaggaacactggggggcgcaataaaatnttagggagaaaatttttttttgtggttccgacnatnagagaaaacccccccatttccgaataatgggaaaataatattttttcaaaaaaaaaaataaatgaggcaatggcagggtagcaaatagaccttaaaaaaganaaggggaacttgggtgaaataaaagggaaaaaggaggncnnnaaanaaatnnttttttaattttgggcgcacatttcannnaataaagaaanaatctcccctaaaaaaaaaaaaaaa

SEQ ID NO: 10249 - DNA, 1706 bp, Homo sapiens
  misc_feature (1)...(1706): n = A,T,C or G
taagtgtgtctgcgttcacctgtatgtgatgcttgttttctagtttacagagcctcagttgtattcatgtcgctatcatcatgtatcngaaacgccgaattatgtcataatatgtcctccatgctccatgtcgcatactgccactacttacaatagttatcatgcgctaagtacatcctacgtcatagctcgttagttcattgtcacagcagggagaatatgagtgtgtaagtaccatagctcacgtcatcacccgtcaacacgctttgagtgatctttcgctcgtactggattcgcttctatgagtcgtcgcagcgatcgtcgctacatcttcgtatagtgacacacttctgatacactgtgttgtacctcccaggctaccactagatattaagtcttcttcacgctctntgctataccttgtgtatcgcgcgtacgtaatgncctactgttctgtagagagtacactcgtcgccgcactacacagtgtacgaattataagccactgntcatcgtatacctcgctacacaggagcttctatacctaccactaacancgatatagtctactttacattatgatgttacagacgcactcgccctacgcacttctctcgacatgtatatctcgtgttagtcggtattagtgcttataatcgtatatgagtctgaacagatctcgtatcggtgtcaccgagagcnacacatgttatactatcagatagattacgcattagagtacagtgtnctgctcgtaggcattgctcctctgtaanatctagtgatggtctgcggtgagcgagcatagtgcactcgtctctaatagttctcggcgcgcgctgatatgatgaagctancgatgtgnagagagattgccacactctcacatacacatgctnctctctgtatgctcacnncctcagcgataacatcactgattctaatatagtncnctctctatatatcatgacagcactcctccgctttatgcacacacgatatagctcacatctcttatacatggtactgatctcttagtagtcattatatcgtacataacatctatgtagtaactagaacttacgtaatatactcngcttcgttctgacttcatatagatacgcannctgtcttccagtgctctctatacgcgccgcgtcgcgcgnccgacggtgaccgacgtgggacgncttcgtgtttacatagctgctgatcatgtcatcgactgatgncgtcagcgacgactngtcatcaagnagatagagtgtatctcgttgancggangtttgtgcacgagtgagtatatgcgtanatgagagagtgacgcgcgacagtagtgatatnactcatgtacngncactgtacgatacgcgaactctcacatgcacgcgtgnctntactccatgtgcacgtatgtatgtcactactcagcgctctgagcgatctgatntntatgagtcatatgactatntcangnatctcgtcactgcgagatgaagaanctgtgctgcaatgtcgatgcttatatacntngtcnagcagcncacgctcggacgtgagctatcaaatgtgactacgtctcgccntgatcagtntcgcgagtaganacactcagntgacttcgtgtgattagcgagtangnagctagaacactaagtaatgtcatgatgagtatgagcgcngagatngaacntcatcatacgagt

SEQ ID NO: 10250 - DNA, 803 bp, Homo sapiens
  misc_feature (1)...(803): n = A,T,C or G
ctggattgatctgaaagtgactacttgattgaatgccatgttgatgtggatgaagagaggagttgaaagcttgtcagttaaccaacagaaaaaaattaaagttcggtggaataagaccaaatggacaatgaactgcccactccctaaacctcccacaggcacataaagtgactgccaaaaagtgcactctcagttgtctgggcacatggaaatatctggcacagtctcttatccattaaaatcctaaatatattaattaagaaccttgtctttggaattgcggaaccaacttcatgtgtttcatgtggctttaaactgcaaaattgtcaatttataagcttgcagttgtgccaatggaatacataaagtacataaagtacaatggagtatataaagtacaatgtacataaagtacataaagtacaatggagtacataaagtactctagtttgaaccagaagttttattaaactattggatagaggaaaatggtccaagataagaacatgcaaaatccagaacatgaaaaatgctcattttacccaggataatttaaaacgtatacaatttgttagatataattgttgatgaaattaataaagaatatcaaaaagcccattaggtagatatttgttaatattaaacacagtcttatgacaggaaatatcaagaacaaggactgcattttattcattntttggttagatgaaacttacataatttaactnttctttattccataactgtcaggaagcttagtgtaagatttgatgctcattcctagtaactggtaactatttgtg

SEQ ID NO: 10251 - DNA, 894 bp, Homo sapiens
tcattgttatgcttagatcgcggaagaacaggcagcggaggcgggggctttgtggggaaccttcgacagatgttagcagacagtaacgtagcagagactgatgtctggctgagcaagcttatttcttccattactcattgacgatggatgcagaaaactacccaagtcatacaggcatcataacaggagagtttatgactagatgtgtgattggaaaggtaaagactgagcttgtcagcatgattaggatgtgctcaagatggctgagcaagcttcctcgagagatttatgcaaggctgattagcactgctacaagaggaagagtatataggacgtaatgacaaatgacgtgatattaactgcgctaagttcagctaggttaagaagttcctcgcaatatgggtctgacagtatcgacttctggatccgctgagtgttagtgtattacgatgaagagcaaggaatctgattccgagaggcgaggattaaggttaccgatggtctggttgtagggaccgttgttagactcaaaatacgaactctcggtagactcataggtttcacagcgaacacggagctgcggactcctgcattgaagacatggcggctccagagaagagacagggtacaacgcgcacaccaaaatgctctagtatcatactgaattgaattcaactctatggatcgagtcggctagcattctgtagcctaccactcgtttatacgtacaagagtctctgagcttcagcgagtttggacttggctggctagcatcttgtgtctgagccaaacagcaatcaccaggttgagtgagcaagagttagcgatactatataagaactgccaggcgagttggctaagacatggtgacttttaatcagtgcacatgtcgag

SEQ ID NO: 10252 - DNA, 388 bp, Homo sapiens
  misc_feature (1)...(388): n = A,T,C or G
ctgtctagaagttgaagagaaaatgtagatctgaagcacgagaaggatttggcacaccactgatgtcttcagaatagaaagtacacatggcaaagaatataggcagcctctagggcctacggacaagccctagctaacagccagcaaggaagcgaggacttcagtcctaaaaatacaaagagctgaattctgccaaaaacaagtataagttcggagacagatttttcccccccagggctacagacaagaactcagcctggacaaccttgattttagcctcatgataccctgaacataaaacctaaccaggctgtgttggatttctgaccttcagacctgtgagccaataaatgggcattgttttaagccactannaaaaaaaaaaaaa

SEQ ID NO: 10253 - DNA, 349 bp, Homo sapiens
  misc_feature (1)...(349): n = A,T,C or G
cctgttctcatgtctaggttgacagtgcccctgggagcttgaagcctcacctgttgaggatttaggagctcagagctctaagacctgctctccttgttgctgttctcagttcctccatctggccccttgcagtctcagaccaagtcccggagccttcctggtcgctcttttgcgctgccctggtgaggcaatgtagagccacagaaacactcctgcccagaacctcgcggtgtcctgtgtcacctcccaggatccgggtggccgatgtctggccgtgctgcttgtatctttatgagggatgggctctttgtccaaaagaattattttttccttcnnaaaaaaaaaaaaa

SEQ ID NO: 10254 - DNA, 822 bp, Homo sapiens
  misc_feature (1)...(822): n = A,T,C or G
aggncnnntagaagaatnanttntgtggnnagggnnggggntanttnntnnngaagggttgnngttggggnnanntttgtgaaagggggaanaattgngagaaggnnnccccngnggngnaaanaannnggnaaaanaacnggatacagaangggatttntnccaggntccaagnagngttccngggntaaatgnnggcccgncngngtaggnaaaanttttnccgaggngngannttgaaaagacgtaacntccgnggaaggggagattattnaanttggaangccccagggnnaaangtggngcagtnagggacnatcttgngaagnttgacaaggtcnttaanntccccngagtcngttttaancccatgnaatggagntaggtntgtntgaccatntanttgaaanattagagnnaanntaagggtccnggcatagttcntggcacatactagtgcttgaaaacnnccaatnancattcatcaatttgggntatnccctgcatgggcacatatttgtcctganactcttcaaaatgnaaaagtacccncagaaaaattgtctcagttcaagcacagtattattaanattnnactgagtnctaagnatggncgntaatagtntaatatgaggaagtcaaaacagtctctggaaaaagtctttgtgcaagctttttgaagcttcagggattgctacnaagactggaaaatcgatcttgaactcagccntttaatttcttttcatgattactgttctcaaatggagnatgcaattataattaatgctgtcttagttcacttgccncaaaataancagcgat

SEQ ID NO: 10255 - DNA, 424 bp, Homo sapiens
ctactcttttctgcaaacaggatagtcacattgggaaagctgaatatcctccaaaagtttaaatttggaaactatggctgtctgtttccactgtgctaaacacctggatgaaggctgctgagagggagtcccttgaacaggccccgtgtcctcatttccccgtagcctggagggtttcacaaccccaaataattctccaccatgaaaaagcaaagcccgcacactggagcctccttttatgaggacagagaactagacaagaataggcttttgtctgccatgaggaaaatgcctgagttttgagagactgaaagaaatattacattgttcttattccacaatttgcaaataattatttccttccaagctcacaaacaagggattaaaataaatactttcccatttcccaataaaaaaaaaaaaa

SEQ ID NO: 10256 - DNA, 187 bp, Homo sapiens
ctgtgcggataacgggcgtggagggggagggggggggagccttagtggaaccaggagcggctttatcagtgaccccagcgaaggccaaacggagcagaagaacctaccggcttgagaccctgggggaaggggggtggacctccagaattgtgagaattaataaatcattattgttttaagctaccaa

SEQ ID NO: 10257 - DNA, 122 bp, Homo sapiens
cccctgccgaaggccaaaccggagcagaagaccaccggctgagacctggcggagtggggtgacctccagaattgtgagaattaataaatcattattgttttaagctaccaaaaaaaaaaaaa

SEQ ID NO: 10258 - DNA, 195 bp, Homo sapiens
gatagttcttatttagtgttggtatgtggcggggtggggggcgcgagctcaggtgaaccaggagcggctgtatcagtgaccccagcgaaggccaaacggagcagaagaccaccggctgaaacctgcgcagagggggtgacctccagaattgtgagaattaataaatcattattgttttaagctaccaaaaaaaga

SEQ ID NO: 10259 - DNA, 308 bp, Homo sapiens
gcttagggggatctacttaagcaacactatgtacatcatggcagaacgtatgggctaggatcttccaggactatgatcagcgaggtgacggtctctgagagctgcaaacccactgggatcactaaggatggagaaactgaggcaaaggaactagcccaaggtcacacagctgggaaccgactcaacttctgtcatctatacatagcgtgaactcactgcatcagtttggatccggagtggggtgtttctcagcatccttgccctcacgtcagcattaaatcacatattgttcagtaaaaaaaaaaaaa

SEQ ID NO: 10260 - DNA, 1464 bp, Homo sapiens
  misc_feature (1)...(1464): n = A,T,C or G
aattatgtgagaangatgtgtntgagatacgagtgtaggatgtgttgtgttatgtctggatagctcgtagatcangcgagaagatatggagtactgcgcgtaggtgngcagacgacgaatgaagcgtgagactgccgatgatagatagagagacgcngngtgaacngcagacatngagaatatgcgtatgagcgtgtacgcgcntcgttgaggtgatcgtgacagagtactgtcgaacggctacaggcgtcgtccgacatatgaagagtatgcgagataaactatagataaatatntacagaatgcaagacaacgangctactananatatgaatatgagatacaagtctacacacaacacgtgctatagacgacacagatgaccgctactagatcacgatgataatgagatatcanacctgtaaaatantcgctgaatctgagagaatgatcgtcgtagcagagaganaaaaataagagttantactcgagntgtatagcgacattctatacgctgtcgttcatctagctgatgtctattgagatgggtgtcttntcgggtatgcggatcgctcgcgnggagatgtcgtactaggcgatacgatgtgagtcgcaagcttgtcgaacgctctgataaataatcacgaggtgattaagctgncgagaggcatgaatagagtatggcgtaagtagtgtatatagaatgtaaagtatagaagtatacgagacgcgcacatcaacacaaacacaaacactagtgcacactggaggggagaagcttgagcaaatagaacaaatacaatagatagtaaacacatacacacataagacgactacacgagaggacgaatatgtggaacgtaagatactagatcatagaaaccatgaaccgcgactcataaagctgagataagacgacaaaagagttacagatatagagaatagatgataaggtaataagaagagatagtagactaggttgtgactagctctctatcatagcgcgctatcagttcgggttaaggaattagataaagtattggaaaaaagcgaagggctttagtgtatattcgtcagcacagactgaatgtatcgtcagaaatgtgtagacaaagaaaagnagaaatatatgtcatgaatagtaaatatacttgtatagtcgagaatgaaaactgtcgcagaagtgctggctgctgctgctgctgcgctatgtcaattatgatgggtgggcggtggacgtgcaagactccaggagcggtgctgagcaacgtgagtataggagagcgaatagcatagagagaagatatccaatagtcgcgaggttagtcaaaggagagtatactgtatataatacgtgtgatagcaaaaataatatgaaacatgagatgttacgaaatctgaatcagaacgattgatacgacttgataatatggtgtgcataatagatctgagctagtgctctaa

SEQ ID NO: 10261 - DNA, 751 bp, Homo sapiens
tctccagtacgtcgctcgctttctctcacacacacataaagtaaatgaaataataagttctccatggccttcatccaacagcctaatctgtcatatgggatgccgtaaacatgtttctggatcaataccatgtagctccgtcccaccactacaataccatgtataagaccgctggcccgaagcatctttaagatcattatataaaggagcggctaaatcccttcaccattaaattgctctcctttatcacactactttcttttctccacaatgcatactggcttcccctgaccttgttactttaaatcctctcccgacaactttgcttgtacaacaaaaaccccacgagggtcccttaaaaaccccctcttccactcctcgataacccaccgtccgcgacccaacttgacgactaacatcactggcaaacacacctttctatccccatccacctgtgcaggcatctacccgtcccacccgatcaacccccacctgtggctacaatccttgacacttcaatcactcccccccacccttcaaaaccgcacgtcccacagacgccctacccaagccccaagctctaattcatttcccctcaaccgtcacccccttctttatgttccaagaccttctctcccagtctctcccaaccccgatccgtctgctgtcgactctagttgccgcctgcttacaacattacaatatacgttgtcatcacacgactacacgtgacctataatcattcacttat

SEQ ID NO: 10262 - DNA, 112 bp, Homo sapiens
cccgcaaggccaacggagcagaagaccaccggctgagacctgcccaaatttctgacctccagaattgtgagaattaataaatcattattgttttaagcgaaaaaaaaaaaaa

SEQ ID NO: 10263 - DNA, 1753 bp, Homo sapiens
  misc_feature (1)...(1753): n = A,T,C or G
ctgtcgtgagtgtgtagtagagtgngtgtgattgatgagatgtatccgcgtactatacanatagacactagtatagagagctcnaggcgctagaattgatcactagtntangagtcatactctagatgagacggtatgtgagctncgagtcgatagtagagtatatagtgtgcagcgatgcaagtcgactggacgcacatacgaagatntgtaatcgatactgtagatnananaagatatagaggagtatgacgtgacggtngcgacgatgatagggtactagcacgtgtagtgggagatgtgcagttgtgcggtgtgtggtgatgcatgagtgaatgacanataacagtcagctagtggcagagaggcgagcgngtaagcatgacgtagagtcgagtcgatgtacggcgagcgctgagtgatgtcgcgngntctctgtggacagtgagaantagatgangtgtggtcgcacacggagatgatgtattagtgatgtgggtacgtgatatgcgnggtctgagaatctcgcatgcgagctcgtcgactgtgatggggcgtgtcagtgtgncatgtcgagtgngnagcgcnctgcgacgcgntctgtatgtganaagtagctgccgaagagagagtgtcgagggntgagtgcacgtgtgcagtgtcgatgagagtatgagatagtagtcagtcngatagatcacgcnaaggacgaganangtgtatatgagaatagtagatagcacgcggaaggagatatagagtgtagataagagtgcgtcagtagaagcgtatancgcgtagtgatgaagctacgatgtctgtatntttaactagatgagagtcgtgaactgtcgtgcatacgtcggtcactcgangangtagtgtgacgtgttcgngtcgctattcgaattgtatgtntgtgcgtgtgcattgtcgagctgccntagcgcagaacgagatagcgctgatagtagtcgagcctagangaagatagtgaatacagatagnagtcgttacgagaggagatgagatgacatctagtctatagaactatagctactatagtatcacgtatactcacgatgatgtgcagcggtcgtnggtatatgatgagagtgtggaggtgtggatggangagtggtgatagtattctcgcgagcggggttgaggacaagagtatcatagaaagagaagtgttgaagtggagtggtagaggggtgtatgtctggactgatgtgatgagtggtttatgcacgacaaggtatgtatgagtgtatgataagatgtaggaatagaatgtgatggagcgaaatgtggtggtgcagcatgacgaagagacacagaggccaaatatagttagatacatgtataagacggtcggtagtgtggattatgtgttattgcagaacgcattagctgaggattgggagggttggtgagtatcgaactagaatcgagtatggaaaggaacatatgattagagatgagataggaacgaatactttgttgggtgtgggcgtctcgttcgtggggtctcgacgacgagacagagagcgtgcgacatgtgggtatttatattgcgcacgatgccgagacgaggcatgagagtgtgtgggatgaggagagagaggagacgggaggtgaggatgctgtggagagggtagtggcgtgagcattggagagaggtgagagagaagtagaaggcgacgagtgcggggagagcatgntagagttacagtgagtagcttggtga

SEQ ID NO: 10264 - DNA, 1600 bp, Homo sapiens
  misc_feature (1)...(1600): n = A,T,C or G
agtagttgttactgattagggtatgagtgtcatgcgtgatttganagattattacgtatacgttcacgaacagaagagtaggacgnaacggcgcgtacgtacactgcanatatgtagatgccgactagaagggcgacgaatacgacacagcagacacacatagattaactcactatactcgagtgcgtatatagacagtaacncgaatgcatcatggagcgcgagcgcgtgtctatnctgcggaatcgacgcgcacacttattgttacgtactctatctctattanctaaatataaataattcattattatatgttgtataatataatattatcagtacaaggatatcttatactagtcaatctccatcaaatcanagtacacagaactacganggggtgagcgcagacatcgcggtggccgagttgtggactagaacacagaggaagcacgatatacgagcncgtgtagatcagagcgtaatagtagagtcaatatccgtcgtgatagatacgttatcataataagagagtcacacacanagacgtcgtaagtatacagacaagtgatacgatacgacgactacagtgagagtagcttcgtcgccagaatgtgacacgagaggcagcagcgcagagcgacacttaccagcgagnctcaccgagagcagaccaacagangngatgtgcagtgatgagcgataggacagacatacacttcgaaatagtagacgtgcgagtcacagactcgtgcatagtattgatagatgcgaacgatcgatacatacgcgcgagatagatatgagtaagancgtggacgatgagagacgatgatcgantgaggtcatngcatgctaataatgagtagtatgtatcatgtgacgacgtgtcgatcaatctactaactctagcaagatgctganatgtatgggactgtcacagacgtcatattntccacattaagaatgtacagtatcnatgctantcgcgccttacgatatcatattactaacgagacactagatncaacactagagcagatacagactagtatcatctaancgatgtcacgttgactcttgtagaatgtcatagtcantgtgtgcggtggtgttttgancgtacgagctgntcgtaacgttcgtcagtgtgccgtgcagtcgtcgtcacgacgcgcttagatgaaggcgcatatgtggctctcgcgagtcagcgtcgagcgcatcgagataccatgtatacatctacgagtcatagcggttgtgtcatgcaattgatgcacgtatattgtacatacggccgatgtatcagcttatatcgatatgagtgattgtacgcgatgtcacgtcatgaatgtgagatgctctatactgtagcgacagatctaagacacgagcaacatcacaaacgataatatatacacgtgatattaactacagtngtctatgattatggttagttgcggagtcatcgacgcaggccggcgatcgacgtctatagtctngagantgtagagagactgcgtcgtagtagagagatatgaatgagagtacatagagacgtaaatagtatcctactaatacgtactatagcatcataaat

SEQ ID NO: 10265 - DNA, 885 bp, Homo sapiens
  misc_feature (1)...(885): n = A,T,C or G
gtccaccaagtgacaggcacctcacattaccgcctgaccacaaacaggcgagtctcgctaccttaacagagttacttgggcctttatttctatagatttcctaatagtgaaatttcgggggataaagttgtcttcatttaaatggattctgtcaaatcactctcaaaaatggctgtaccattttgtacttccaccagtgaagtatctgggttgtcatttcacagttccagaacaaacatgaaatatgctccatctttgacgctctacccaattagataaatcctcatggagactggtaacccactgccccaatatccacttgaccaccaagaaatgagcccgaactcccacacacccacaaaacgtaccgagacccccgccaagaaatacaaaactagcacatactaaacaaccccacaaccaagataagacaagataaacacatcctcccaacataatcagcctgctccactcgtaaaccaaccaccccagagaaagcccactttcttgacatccccccgaccataaactaacccaaacacacccacacaaaataaatgagcccaagccgaaacagcgcaccacatcctacaccaaaggctccgaccccctaccaaatccagcaaacttcaaaatacatcgaaaagagccactatccacacaaacacccactactccacagagtcataacataagagtttactcattcccaaagtaaatatagaggatagtatacgtggaagacggcgttttcgacgtgcagcggctaccaaagatatacacctaacagcaaaaccccaagcaccccaccaaacaagaccacccccacagcanactccccatataccagttcagtcccaacgcgcggactaacctacctcacat

SEQ ID NO: 10266 - DNA, 113 bp, Homo sapiens
gatgctccgcatttgaggagatgaggagtgtggccgattctacatgacctgttcatctcagtagttctagctgaaataaaaactttatgttgactatggcaaaaaaaaaaaaa

SEQ ID NO: 10267 - DNA, 1768 bp, Homo sapiens
  misc_feature (1)...(1768): n = A,T,C or G
cagcngagcgtatntngatgtatcgacgatcgacactatagganggatgagtacgntagagatacgcagagggtcgtnanantgtntactcgagtagatgctatgaatactcacgnagagcgcatcacgcgagactagcgtgtctgagtacaccacgatcagcgngnatatgaactagcagtantcnctctanatacgtcgaaacgtanatgtattctatacaagctgttncgtgtgcgacaagttacgcttntacatcgtcgcgtgtgtacttagatcttgtagatagtgagtgctgagtgatagtaganagtgtatnaagtagagcagatatggagtatactactgatgagagatatatgtacgcgagaaacgatcatacaacacttcttatacatntatatcctcgacgacatcgttatctcacacatagacactacgatgcatgcgtattacgtatanatgatgttcagagaacgatagttaatacatctagatcattcgatctggacatatctagttnacgcagatatangagcggacnagntagcgatatccacactctctatcacgagtcgtagaagataagctgacgntntgagcagagagacacanaggcanagatctnatactatcgtgnanatatacaacgangtnaatacagtatatacgctcggcagtgacgctgttgcgcatagtgtagtctgtgctgatgtagatcgcngatcgtatgctcggacggcatgtatgtaccacgtagaggacgatcgagagacgctgttatgtatagtgagtagtatgacgatcatcacgcgaatgtgtgctgtatatactgantgtctatgagantgacttagataaagattgttatgangattagtatcatctgagctcnancggacgagacgctgacgtatgtgnanatgtagantgtcacacgacgagtganttttatgaagctantatcgncgtcgtgtgcgcatcacagtggagtctatatgttcgtatgtgttaacagcatacgactctacaccgcgatatgcatggtcgagctgagatagatagtgnaacgcgtgcgaacgcagtnctacgangtatanacagtgtctattctaacncgtacntagcactctaatatcaggatctcatncgancagtcatatcgtttactattctgatatgccgtgtacgatacaggacctgctgactgacanagattgtgngctgtggtgtcgcgcctgcgtcgctgacgcgatcgcgacagttacatcgacacgtgtctcatctaatatgttaagtcgagatgnagcgtatgcgcagtagtgcatagtgtatatgaggtaaactaatgantctatatgattgttgagatgcgagcagtatgggagngcagcgactggtgctgcgggtgctcnggagagtctatgtctgtggtgaggggagatgtagtgcaagttagagtgagtggatagttgtgtatgatgggngtcgtagagtggaagagaagatagaagtaggtatctcattctcaattacgttagtactcacctattatgtacattcaaagacagagtagtgaaggaaagtgtgatagataataagatacaacaacagactggaccaaaccagcgaacgcacaagagcccgcctggttgaggtatgtctcgtattgaattatctgctgcgtactttcactgagcaccgcgacgccaacatcgtatctgtcatcattgcttataaaaacttatattacattactacctctcat

SEQ ID NO: 10268 - DNA, 254 bp, Homo sapiens
  misc_feature (1)...(254): n = A,T,C or G
tataccacaagcgaacacaaaaaagaaataacacacaacnnnctataggtaacaatactctatgttaagaatgctgacttatgtaaataataccaagagggcacaatatcctgaagaactttcctgcttgttcgttcattaatcctgaacctagaaaacagtcatgtgatccgcactccagcctgagtgacagaggaagactccgcctcaaaattaaaaaactgtttgagcctagatggcctcaccgtgtgcac

SEQ ID NO: 10269 - DNA, 1558 bp, Homo sapiens
  misc_feature (1)...(1558): n = A,T,C or G
tgtgtggggaagtagtgtattntgcgtgatagcaggatgttgtagttgggtgtgggagatgatgtagngagtgaatctgtgtaagatntngtgttgcatgggcgaggtcgatttcgtcttggtattgctaacgttctgtatacgtaatgtanatgcacatattcgcgagtgatgataacacatganagaacgacgaagataaatgagagaggttgatatatctagtgnggcatgtatcgtagtaaagagcatacatacgatggagagcattatacctaacagcagatcatatatactagatgatgacaaaggagtgatgaatatagtgacagtgtaatattgacggcgcgagcaacactgagacacgtcncgcttgctatgtgagcgtggtgaatatgagtgtgtgtatagtgtgtgttgaatgtcgagagtagcaattgagangcggagcgagtgaaaatggtaagatatcaacagactgacataagacacgactgatctactatnctgtgattgtcttctcgagctgatatcatggcncatgtgtgtaagaggagtcgagcatgagagataatacttacacatagaagacggtgtgtggtacgagttaatgatacgaatatgatgcagacgtagagcgatagactgagtgacgtgacatcaattactctctgaccacagcgtntaggtagcctagacatcacaggtgataggtgtggaattgagctgagtgattgtgcggggcagtagaggaggtagcggaggtggagagagtagtgatgtgaatgcagcgagagatgtacaagtacatatagtggatacgagcgatactgattactagctgagagaaccgatgagtagagagcggacaggatagtcgtgtgcagagtgtatcagtgacgttggaagtgagaggagtacgnggttacattactctatgacggcgaggagccaaggtagccggagaagtatcgttgtaantgccgaagtgtaggaggctatataagatggatgcgtatatacagtaacgtagagtagaggtaatgaaacgagtgagatgtacgtatgagaatagacgagtgcatagacagtgacgagcgtggcgctggatcgatgtcagagagactagagttgtgagatctctatgaatagaaatcacatgctaataactaatcagnaactataatagataatcagnaatnaagcgaacggctgagccacagtcatcagctcgacaaagagggatggtaggtatgaatgaaacgatgacgngngcagtgggtgtcctactcgtgcagtatgcgacgagntangtgagcagtatgaggtcttacatggggtgtacttagtattagtgagctcctatatgtattatggtgtatagagtagtgtagtgacagtatgcgcgaagatgtcgaggaggtgctggatgtgcgngtatcgtgtgagagagctgacaagttagttctgaatgtgcgtagctgcgttgcgcatggtacgcgcagcgcagctngtagatatgataagatactgttagcgctagaatgatgcacatgag

SEQ ID NO: 10270 - DNA, 1458 bp, Homo sapiens
  misc_feature (1)...(1458): n = A,T,C or G
gctactagtaggggaataatggtcacgaacgagntaggagagnagaaaacnacacaacgaatactcggtgannnaangagagaaaaccgcaaggtagcnnaatacgatcatcttatacaagatacatatgagacacccacagcgcgagtcgtcctctaggtgactccacactgcagccacatctctctcgtcgcaatacctacagaacacntacaccctgtacggnctccatccatgagtntcncctccacgttcgtctcttccactggcatctaggtgtggaccttcgtcgnctctctcgagagacctcnctgacgaagtagtnccagtgccggtgcgcctagtgagaggcaccaagatgcgaaccgagcggnntccacacgcgcgctctccgaagtctataaccacgagtgcnaacgagatgcccctcccgacccccatcgctgacacatncctaagtttttgatttcccattacggctgatttgttaatgactacaagagacaagacgagtcagaatatacgactcaaaacagaccattataatactccgcagagtgtnagacatccaatctttcacagttcactacaggctcgcacgtgtaccatagccaacaacgcactcaatgcataatagagccacgtgccagcaacctattcaaacgagagttgagccaagntatttgatccatcttctctttcttagcacctcgtgtcgcctctctcatctgtgattacaagtctccaaactgtgcgcncacagatggttttctcattctttacttgtcnctcacactcgccacctattctctgtcatgttaagccacatagagcagaggaatacgatgttaaaataagcanctaagtatcatcaacaaggtcccacacacgagccctagcgacacacggtgcgacccatatcgagccccacggcgcatgtaccgtgaacgccccacgagagatgacacggctgtcctagacagggcgcctcagtaactagccccacaatactcacgtcctctgaagagtatgtnacgaggaggactcagantctttgaaggcagtagcgataatgtgcatagtagataggaggtacgctatgtcagaatcgtcacacaataacgaccatgatgatggagcaactcataatnntccagcagatgacccntcgagacatcgaactagagaagatgacgcttcccgagtgagattnnacaacatgatcgccactagggtgtgcntcactatcgtgagaggcctctacgtaagtggatgcttcgcatagggtaggcgccacaacgtacgaatgagctcncgttattatacgcggctccgatggtatgtncctcttcatagatttgagatagcgtagcatatacactatggagcnctcaactaactcagtgttctcatatcgtgtttctctatgtctattgtattgtttgatatgattgatct

SEQ ID NO: 10271 - DNA, 215 bp, Homo sapiens
aggctaaatatcactttgagtcagttgccgcagtgaaacttgaaacctgatcattgaagaagcctgcaagttagcagaaaacaagtcataccaggatctgctgctccagctgcatattgaagattcaagtctgtttaaaaatacccttatatttccagttagtttcattgctataatataattcaagccttaaataactttcaaaaaaaaaaaaa

SEQ ID NO: 10272 - DNA, 752 bp, Homo sapiens
agagaaattacatatttcacttccaattaagtggcatcatatagacaagcctaaggccataatctccttagcagctcattttattccaggcagcaagaaaacagacatctacttgttctcttcccatgtctcttgtacagactggagtagctgctactgagacagcctgtcttgttgtttcttatgtattcattttaacagctgcaaacatagtctaatcttgtaagaatttgcataaaaatttcatcttaataaagcaggtcccaaatattgatgttagtctatatactgatagattgtagtgattcaaagtaattttatttttatattttttattttgttaaaatttatttgaattggcagataaaaatgcatgtatttatcatgtgcagcatgatgtgttgaattacatgcgcatcatatgcacatattcaccccaatgtaaagttatttttacatttttctgcaatctactccaatcatttgtttacaaatagattacaaaattaatatgctaaggattatattcaagctcaaccaagtaggtataatttggcacaataacatcttggacagcagctttcaaatgttacagcaaaaattcaacatacattttaatttctttttagtaaaataaaggctttccagttgagaaagtgaaatgaattatatgaattatatgcatttaatacgtgtacacacactatgcacctaaaataaagtcaagtctgatgaaaaaaaaaaaaaaaaaa

SEQ ID NO: 10273 - DNA, 882 bp, Homo sapiens
tagttaaggtattattaaggtgttgtatcttctgtcgtcttagcagtacaatgattctttcccttgatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcatactgagggatattctaaaagaaaacagatcactactcttcaaaaggtacaaggccatgaaagacaaggaaacaaactttcacagactgaaggagactataattacactgccacatggtacccgaactggattatgtgagtaaagaacctggggaaatacattcgttcattgacgaattggagtaatacccatgagcttgtattcgggataaatgctcactggttgtgaccatagacatggaaatagtaagtctgaaataatcagtggcgcgtagactttgtactcttatgcggccacatttcatcatggcgatagttattttaggaccatgatcctatgagcaatatagttccttagttgtgtatgtcactgtcgtcgatgtgacacagtgaggtgatgctgttttgactaatatcattgtaatctatgccaccgtggtactgccctcgtctgttatttgctctgcatttgttgtgataaagaggattagtgtcgtttttgtgtgagtgtattatatactctgtacatggtagagttatggtgcagtatgatagttagcgacacctataaattggtcagagaatcgtgaagcgtttatcgtttgtagtcgt

SEQ ID NO: 10274 - DNA, 1455 bp, Homo sapiens
  misc_feature (1)...(1455): n = A,T,C or G
ctgncggatagtggtgttggtatgagtgagtagtgagtgttgatagagaacacgtgtgatgatgtcagtaatagcagtgagggaggacgtgtgccggaatcgcgtgagaggcgggccgtgaatccacnagagatgcgattaaaggtaagtaggatgaagagagtaaagtcaggagtatatgttctatctgcggagcgcctgaggcgactaggctggcggtggtgagtggtcgtgcagtgatgaacatgtgtagaggctcaactatgaggggacgcgtagctatcggatcaaacgtatgagacttaatagatgggtgtcggcgtcatagcgagaaagcaaccacgtctcactgccaatacaacagaagtaagtcgtagacgatagacagagaaaggctacacaggcgctgcaatgtaccagcacactcactatctaaaccaggatgacaatgagtgagtttggaatgtctatctaagtgactatgtcgcgantngatatngaccgagcgtctgttggagtgagtggtgtcgtgantgaaccgcctatcacgcggatatgaggtcaggaagagaagacgcggagtaacgtgtgctacgtcgatagcaggctgagggacttggtcagcgccggcagaggccactcttagcctccacggtaccagatcaccattgacgtatgtggtaaacagtaatgatgagcactcgacactatcagagtactcaatatattactcgtatgttctggactgtggtacgtagctgtgtatatcacatatattagtaacgtagaaatgtcatgcagcaaatgaagtagattagtgtgtatgcgagtggaatactnaggcagcgagagaaggagagatcgatgtctgatcatatactaatgattagattgtgtcctctcgtaggagatgtgcaccgactctgactctatcacatcttgcatgtaatcccttcgctattgtattattatttgctgtatcatatctgttcgtgcgtgttaaatacgcataagttgaaaatatcgacgttacactatactatatacacgtcatgcagttacgtatactatctatattcgacggtgtgaggtgtatatgcgagtggcagaaggaaatacacaacggacacatatagacgataccttattgagagtgatgtactaagtacttactgacgagggcgacagtcgctgtcgttgtattantatatgacagagagataaagttagtaggtgctaggtangntgtagatacatgcgattattactaggatctacgacacgtctgntgtatagtactgagtcgcgctgagtagctaggagatgcgtcgagatgtatgatgaaatcgagacatagcacatcatcaaagcacagcgacataccaccatcagatagctattatagatactcgacgtgatataatatgtgtggcagtatctgctgcaccgatatga

SEQ ID NO: 10275 - DNA, 227 bp, Homo sapiens
cctaaagcagggccctgtctcaggaaaaaaaaaaaaaaaaaattctatcacttttaactacatttgaaactttacaaaatgcttccataagcaaggaccagatgcaaggtttgcagatagtgaagtacagctcgtgcaaagtgctttgtgagcacatgcttgaaataactgctggtataattgcaaaattgctgaattgaatttaatgctcaaaaaaaaaaaaaaaa

SEQ ID NO: 10276 - DNA, 1409 bp, Homo sapiens
  misc_feature (1)...(1409): n = A,T,C or G
cttactcgtgagatagatatgagtgattatgttactatgtaggatactcttaatacagtnttagcactgtgtgagtgatncgtcgagttagatctgttantgtgatanagtgcatagcaacgactgagatacancataagatcactcacaacgcgtatgctgctgctcgcacaggtgtctcggttgatcagtgcagngcgaacgatatactatcactctatgtgtacatacgtagctcatcgccatcacgtgcgagactatgctctactcgctgtcgagatnttcgctcgcacactanatgtacatagttgtgttacagtctcgcatagatattgtgaggtcgtatagtgtgatccgagtctctctcgttgtctcatgtatgaggagccatgagtcgtgcgtgtgtcatacagtcaggtgatccatagcgctcatctaacacgtctatctcataagaatnanatccatcagctcacatctcctcacnactctgctactccagtacagatantatacacataactagtgtattagactaagaatatatactcgtatagttatttgagtatgctcctagtcacattctgtctgtttattacataccgtcactagctcagtgatgcatgttacggcatgatgtcatgctggtgtagttgtagagtgtgattagcaaggtgcgcagattagctgcgaagtaaggtaacgtatgaacaagatacatataagaactacgaacacgataagaagataaaggcacgccggtgagacgtgtatacgataacgacgcacaaattgataggtagggtnaatatgtcttgatacatagtatagaatatcgcacgagttagcagaacgaatatagttctttcgttacgcatatatattctattttcgattgagtgntgtgtcagaagagatataataacttcaccgcgcagtccacctacatataccttctaatcacgtcctcgatcgtgtctggtgcacttagctcgggtggaaagcggatagaatagacaatcgcaagggacgcaggccgcgacggtagtgctcgtgatgccgccgcagtatacggcgatattatacgcctgtagatatacgtgatcgacagcgcgagtcatacagcaaggaactgaagattcgcgtagttatgattgcagacgagataaggtgtctattcaatcttcgagatgtctgcctctctcncgttgactggcagacgtctaatatagtgtagaataatatagtgtaatcttctcgattatactgcatactgctgtctgtaaataagtagtatgtattactagatttctgcgtttattctcggttgttgatttatactagataaccgtaattagatacattgtatgtactttagaaagattacatatatcaatatcaatagtaag

SEQ ID NO: 10277 - DNA, 1477 bp, Homo sapiens
  misc_feature (1)...(1477): n = A,T,C or G
cgggagtgttaagatacgaagtggttgagtgatcgttgacaaaataggatgcggggaggtgtatctgaatgtgttggtgtgatgagagtgtatgangntgagagangggaggaganaggtatgtgagagtgagaaagggtgggagtgatatgtagaaagataacatgagaagggagatagtgtgatagggatgagaatatatatacaagatgaaggagatagagagtagattgtggtgctagggagagtggaatcgtacggatatgtggttggggcaaacaggagcgtagtgaaggacaggagaggagtagagggaagggaggagggagagaagaggcgacggtggaggaggagagaagggcagatggatattaactgatagagtgtgtagtgagaaaggtgatagagataggatatcgaaggggaggagagagagtggaagtgggtaataaccacgatgtggaagaagaaaatggggagagggttggtaaatggggatcgctagagtgtatatgagaattgacagacacatgtaggtgatacgtatatatgtatatagacgatagtacgacactgggtctagaatagatgcatngacatgtatagcgtgaaagttatataaataagaataggtatagaagaaatgacataatctgtgatgtaagagtaatagtgtattaatgaaggagaacagacacaattggaagaagctagactaagaaatagagcaagtatgagtaagctgntgttatgntatagatgaataagtatgaatagatattatatgagaggatagagaggtatgtgaagtttcgagtaagatataatagaggtgaatgttggaggatgnggcgaaatagtgacagaacgactgagaggattaacgacagagtagagagagnaagaggagagtagaggaggacacatgaggtgtatcggagaggtacatatagagcagagacagntgacgagtgtgacacgcagtaangagagtagcgatgtgtgtgtatgacacgatcaggcgttgaggagagngacacatgaggtactgcgatagancacaatgtagtaatgatagctcagtaagtctgagtgaatgttatcggtggtagacactcgcatgatccgcgatcaggcgattgtggacantgagcgctgtgagagagtcagatagcggatggcgctgatgtcatgcgctagttgtgatgtanggtanatgtgtgtacagactacgctgaggtagcggtactctatcgagtgtcggagtagaaagataagcaaggagaagagaagaatagtagatatgttaagatgagagaggagctgtgttgtgtgtgtgtgtatgcgggtcgcgagtgagatagagggtgctggggtgaggtatgttgagtggaggagatgatactggtcatcagatagaatagaggaaaggaagtgagattaggagataagcatagaatataatatagcagcagtc

SEQ ID NO: 10278 - DNA, 1673 bp, Homo sapiens
  misc_feature (1)...(1673): n = A,T,C or G
cnacagtgacgtctcatgtgtacgtcgtcttgtnntgnagtactagcagtngantancatctnangaacatcatcagtatatactagtcactacaagatcatctangcgntagtaatctaagtatcatcatnanangtacgtaaatatcatngtanagcnagtagtcatcgtactgntgttgangacatatatgtactatgtatatncaacatcattagttagaagtgataccagtgtagacgagtgacatgcgacgaactcactctagcgangngatcggatgtctagtangcgtaatgangntangtgtatgtgatgncgtcgagcngagcgagaggngccgacagctattatcacagcgatgaagacaatatgcgagtnancgctatatagagattcttagcagttcagcatagagtgcgcgaagttcactcatgatctcantgtgactacatatatctgtagcacgagcttgtagtacgcatgtactgcgctgtctaattagtagtaggataccttcagtacnagcngngcgcactcgtcgcgcgtaganancactcgagtctgcgagananacgatcgaacagagtcggaactactaagtgantganngatgagagtagatagagcgcgcggaagcgcttgtacgtgtgctaatgnggcacgtgcggcnagngcgncntacacagtcagagtgtggctggagtatagatagatagtgtctgacgacgctgatcagctnantgtcgtgtgcactacgagganagtagagtatactgctagagagtactcagatagatcgtacaanatatgagatcacatcagatcacatgaagaggtaggagataacgcagagagagagcataataacagatagcgagagagagcagatgtcatatcgtagtcgtagtgatctacgtgtaggaggcagcagtcagaacacgacggagggagataagagaagagagagggagcgacaaacaggtagcagataaggagtctctgcgcgaatgcaccacagtgtgcgagtcgtcacgtcgagacgcagtanatgtgtagtggtangtgaaatcgcgtctctcgatagtgctaacatctacacagcgtgtcgacgagatagtgagtgtcgaagatgactatgaccatgtgggtgatgtgggatgtgtggtagtgtangnatatctatgnttagtatnaactgttaattcatcagaacanttgctcgggtccttatctactgtgtctagtcacgcatagtgatcatcaccggtcgtacactacactctgataagaatcacacaaagaacagagcggtaaagaagattgaagcagtagtataacatagtatattaaagtacgatcgataccgaagtcttttctgctagactacataagctttatgactaccatggcgcgcccgccgtctcgctgatacagtgatatggagactccacaggcaggatgatggtggcgggaagccagaacaaagacggtactcttcggtctagaggcgcacaaataaaagtgaaaaaaaagaaggcgatcgcaggctaaggagcgcaaatagggaacaaagaagcgcatgaaagctacatgcgactgttnacagaatgaaaagtacagagcaacacgaaaagtgagcatccaagtaacacatgatgagggagacata

SEQ ID NO: 10279 - DNA, 239 bp, Homo sapiens
atgagatgaatatgtggatgcttaaaggaaggtgaacaggaattcacccatgtgctgggagggtggcacacaccgactctacagggatagaagctccagaccattccaggccttcctctatgcatttctttatctggcttgttatttgtatcctatgtataaattattacatgtgccatgaaaatatgtacatctattatgtatcaataaaaaataaaattaaaagaaaaaaaaaaaaa

SEQ ID NO: 10280 - DNA, 1363 bp, Homo sapiens
  misc_feature (1)...(1363): n = A,T,C or G
ataccgtgcgttctgncncgagcgcacctccactgagcactctgtcatgagacaatgtactcacttgtctgatcgatcatcaggtactcgttagtgtagtcctcgctggtgtgtgctcnatatcgttgctgcgcacgacgtctgcgacctctcacantcgctctcctctaccttctctctgctgtctcattgcgctaccgtgatgcgcgcgtgttcatcngcttgggtgtgtccagcgtcgagtgcgtgccgtgagggcatctctacgccactatactatttgagtgtcctctgtgtcggcgtgctgtcatagctgcgttgtgattgtcgtgagttaggatagngcacgacgctgtatgcatacgtgccgtgccgcactcactgantcgcgccgctggggatcactacgtgagctcgtctntcttcnctctatcnaccccacacaacgtggatccccatgcgcggacaggaggctagtggctcttccctgtgatcgctgctgaagntcgtactgcgaacccaccccactcacccttgctccgcacgtagagaatcgtcgtagactgtcacttgtcggcgcggctcgncttctttcttgcacgagnatccttgagccttcgtncccgcccgtctagtggttcgtatagagcacgcgagccacagngtccggcctgtcggtgtggcaagcaggatgatctgcatgccgtaatctgtcgtgttgaaatagacatacagaagtaagtgcgntcagacgtactacgctgctctagaacgagagcctgagcgcgttggagagtagnttgagacagtcgcgcgtatcaggcgagagtacgtgnaccctggtgatctgcacagagctcacagtactgccgcacactcaggtagcgagggcgacgatacactgtgcgcccctagagcagtaaaccaccactttcgcaacacatcaccatcgacatataactatcaaccgtgacatagcacaccctcccacagatatcctcatcattgattatgtctatagtttgataacattgtgtgtgatgtatattgtactattaactatgacggtgtggtggttgtcgttgcgcgccggcggtgcggtaggtctgtcgcgtcggtctgacgntgcctgcctacgcctgcttcgctcctttcttgcttcttcgcatgactctgcctctcgcatactatatttatcattctatcgaccgngttgcatgcacagtgtatcccctntaaacnactccgtcccgggtgccccgctctctactacatngtcgngcagtaggtgcgctcctcatacgcggcccgcttcaggctccgtctcgctgccggttgagaccgcctcactgttacctgatcg

SEQ ID NO: 10281 - DNA, 1180 bp, Homo sapiens
  misc_feature (1)...(1180): n = A,T,C or G
ggaggggaggggaaaaaaaanaagnnanaaaaaggagaggaagagaagggggggggcgggagngagaaanaagngggagaaaggagggaagaaaagaaagggaaggagggagagaatgaaaaaaaaaagagganaaatggaaaaatgagggggaggggagaaagggaaagggggagttagttnnagtgtggaggagagaggagggagaggataaataatagatgggaggggggcggaatnaaaaaaagtnagagaatgaatttacgatgcaaacgaacgataagagtcgcaagtacacaacgaggagagtacgcagaagtgggtcacgctaggaaagaagtacagcaaacaaatcaacccgtagcgccacctcggcagccggcgccggcgtcgccactcaccctacccacaccgcaccacacgataacaggcacagcgcagtcccgtaccgcaccctcgccgaataacgcgctgcttttctgtggaatgcatgacaacaggcgtccgacatgcgtccgtacgcccgggtataacgtcaagctatgtgtatgtaatgatgatctgaaataatgtgatgacgctctagagtagcgtatctagcacgcatcacaacggacgcgggagaggaggaacacacgaccgacggacacaaaccacgaccgaggtatgaggaatagtaagaagagaggaggaaagccaccccgacactataagtctgccgcccgtcgcacacaacgtaataaggcacccatccgcgcgataacgcacacaacgcaaatcacggttcctatgattcttcactcccggcccacgtcgctgcaataacaaatctcacacgctcccaacgcgctctcacggcccataacacccccacacgccgtaaccgcccaccggcgctatggcacccacacactctccgatagaaccacgacaacagactctacgacggtacaagcacacaagtatcacgaggacgcgccggtatccgcgcagtcgcggctacgccggcagcctcatgcggataccccgctccaacaccgtacacccatccnctccacggaatagcggtccccgtgtcgggggctacgcaccagcaactcactaaatacacggaccnccagatgaccctcgtgtggantcgcccacacaccacggaccgcgcgcgcgaaagcagcgcgca

SEQ ID NO: 10282 - DNA, 435 bp, Homo sapiens
agaagttggattaagttgattacaagaagcaagaagagccacaaaaaaaaaaaagaaaaaagaaaaagaaaaagaaaaaaagaagaaaaacatcctgaaaatcagaaaaatggaaaggggcaagaaatataccatggaaattacttcacagcataaggtaaaggtattatctaatattaaaacatagtgccctctaagtatagttctgtattattagagagtgaacagatagactaatagtaaacttaaaaatatattcaatggaatcttgtctcaatggagacaagatggacttttcagtaagtgctggagtaagtggatgattatatttgtaaaccaataaaattgaatccattgtactatataaacataccagagatttaaatgttgaaaataaaccatgtaagttttaaattctgtttaaaaaaaaaaaaa

SEQ ID NO: 10283 - DNA, 307 bp, Homo sapiens
tagaactgtaaatcccatcagtttcaccaaaatctgccaaccaaggaggggaaatgttgtccacagcgtcacaggcgacattcattcaaagtacaatgaacttgagggtgactcggaatgtgatgaaaaagaagaccaattagagatacagtaaacaagaaaaggactcacagaagacagtggccagggcatcagactgggacttgaaataaagacatgatttagactggcaaccaggagaggtgggacattatatgagtgtattggagaataggtagaacaaaagtacagaggaaaaaaaaaaaaa

SEQ ID NO: 10284 - DNA, 792 bp, Homo sapiens
taggttcaagctactctaattgacatttgaagaaagaagcttggtcatttggatgggagcttgaccaattatgcaacagaatgaaactgatgaaaaataaaagatctgtgtttccaagcagaataaaaaaaataatgaatgataaactgaacaagactagcaagagctaaatagccaaaaacttatgtgccattgaattaaaaactaaaagaaattagaggggccttttggcccttgagggggggcttttgggccccttttctttttggggggggtatttcagaaccccccccccaaaaccccctgccctgggcccttcgggggggggagagggtttttctctctccaaggggggtatttgggttttccccaaaatcgggggttacccccggaaaaaactttggcgccaagggcccccaaagggccccaaccccttaaagggcccggtggggggcgtttttctaatggccccccccccttggaaaaattcaaaaaatcccccccctaatttaggaggggcaacccccccgggttttttataccccggggtttcccctgtggaacctccctgggcctttcttttttcaccccttcccctaaagaaagtcttcgcctgttttttttttttggagaccgtggccgttttctcatggcctctcctggaatgttttttgtgggggatccgtcgcttctaaaagcgggcgctttagccccggccggtgattaccgcccgtgctctgctcgcgttccttcggctggaccgcccgccctcctctcccagctccgccggcc

SEQ ID NO: 10285 - DNA, 727 bp, Homo sapiens
aatcgtggggaaggcaaagcaggagcaaattcttctcaaggaaaggaattgaacacctatccacaagaaaaatcactgtcataagaaacaaaaatcagggaatctttcagatcttgtcaaagacaaccatggaaatacttctacaagtctgcaagagccacagtgtcattggtcttggggtgtcccctaatgcaggtatggctgagtggccaaagacttagatcaaaacatccaagtttcactgaatacctggaaggccatcccaagaaggactagtacaaaaaagctcacaatgtgaaaactacagtaaatacataattcttcaatgcctgaacactgacgaatatgcacaagcatcaagaccatccaggaaaatatgaccacacaaaatgaactaaataagacacaagggaccaattctagagaaagagatatgtgacctttcacataaagaattcgaaacagctattttgagaaaactcaacaaaattgaagataacagagaaaaaagtttcagaatcctatcagttaaaatttaaaaagaaatttgaaataataaaaaaagaatcaagcagaaattctatagctgaaaaatgcaattgacatactaaagattgcatcaaagtgtcttaacagcagacttgattaagcagaagaaagaattagtgagcttgaagacaggcaatttgaatgcacagtcagagaagacaaaaaaaaaaaaaaaaaa

SEQ ID NO: 10286 - DNA, 108 bp, Homo sapiens
  misc_feature (1)...(108): n = A,T,C or G
agaatgaaaaggaggagaggnnaanaagggggngaaagnggagtgggnngaaggnnagnncacagnttgatattaagattcctgattatacctgtaaaaaaaaaaaaa

SEQ ID NO: 10287 - DNA, 1742 bp, Homo sapiens
  misc_feature (1)...(1742): n = A,T,C or G
ccacacgtgtccgctctgcgcagccgccgcagagagggcgcagcacggcnggtcgtctcggctgtcnctgcgcnatcgccgcctgcacgagtcgtgtcgggcgcgcaagcagtgctcctcagcgttanagccactatcatatcatagctcgagtagatctatgcgtgtagcantacacacganacacacgcaagcgcgcaactatgcagacgcgcgagaatacnacatgatagtcttacgcaagcggatagtgtgagtatatgntngagaatagaatgagaacataggcacaagtngcgcgggtcacgcngctcgagtcgcangtatcagactcgatcgcactaaagatcgcgcatctctcgatagctcgatctctctnccgctctacgtacactgactcactcnctactactctcatattactcactcagattcgcgcagcgagacgcgtagcgctcacgcgcgctcactacatgcgcacacggtctcgctacactcgtgccagcgtcagacgcgtgatacatagcgtatgcacgatgcatcgtgcgactagccatcgagtagcgcgcggagtcagcatagcatagagatacgaactgtcgntgacctctcaaacgacccacacacgacagtgcttancaagatttagngtgtgagtgcgtcgacgctgcgatccgggtcgtgctcttgtctacgcgtgngctnatgataactacgtcgtcgctcatcagatagagttcgagagcgatgacgctactgctattgtgtcacgacgtactcaaatatacaataacgatagtcgtatggtccgcttcttccgagctgcactatcttcggctaggcgagatcggtcgtcgtgacgaggcgcgacatgcatgagagactgcgcgagtctcgatacgctgcgccgtgagacgtgctgcgcacgtacgacgcgtctactgtgcgtgcgagcgtagcgagaccagaggtagcntcgcagcacgtgaggtggagctacgcagcgagagacgagcagncgtaagcgatatcgtgggcaccgctcgagtgcagacgcgcgttgnctcgacgcgataggtgagcgtagagtgtgtgaaacgtnggcgatgatcgtgagcgagcaagatgcagtcgacatgcacgcgcgacactatgatagtgcgcgagcagcgagtataagtgagtgaaacgagagacgatgtcgaagacgncacgtgcagagagcactacggacacgctgcgcgatccgctgatacgacagcacaccttacatacaatgactatatatgcagttgacttaacacagttaganacagctgacgccgtgnataacgagacgtagacatggatactaagaacgctcgngattagtgtatcagtatgtgtatgtggcacatgcagtntagccatcgcgtctgaccgcatcatctgcatctagtcgacccagcgcgcgtggtagttgactgtgaggttgatgatcccgccgcactgcggagcacgctgcgaagtgacgcgccgtcatagcgctacgacgatcacataggtctatcgtttntancaacctatcgacaggacaccacagcgaacaacanataacatataataatgatacgatagcatacgtcactgctccacatctctcgaccgctatactgaccacgtccttctctatcacactcctctctccacnctctgtctntcgactatctctagctaagcnctcgatacgactcgaacatgct

SEQ ID NO: 10288 - DNA, 1346 bp, Homo sapiens
  misc_feature (1)...(1346): n = A,T,C or G
cgcgaggcggccactgcatgatgagcatcagtgatagggatgtgtgtgtgtntcgatgtgcattcatatcatactcgattgagtgtaggntactatcgtctctgtcgctctctgtcgatcgtncagatcagagtgtgttatgcgcgantatgtctgtgngcggtcgtgcagcggcgagtcgatgtgntgaccgctgatcgancgctgcntcgtacatgtatctncatgtcgacagtgcgttcgctcatctcctctacgtantgtgtntgtacggtgcgatcgtctgatcgcatactgatgtgcggttcgacagcgatgatcgatggcgtgtgactccaataatgtacgcagatcatacattgtnttatagcgcagtgtagacgctgctatgcaggctatgnacatcagcgtagtgatntagcacggcagtagctcgctnctatcgagcaggggcgccagtagtntgtcgcagttgcantnttactactacgaggtcagttcgcgcgacactcacaacaagtagcgtgtcagctgatgagagtgagtcganggcctatccgtggcntcacgctgtggtgacgcgcatgactaggtaccgctcgagtgcggtctgagtcgngcgctacaaantacagcaatcggtacttgatagaagtacctgttacagatgtttaatgtgtgagattgtagcgacgcgtggacaggttcatgtgtggacgtntgtcctgccactctaccatcgccgcgngacacacagcccgctctgctcgtccagatgacagttcatcntcgtgcgcgccactgtgccgtcggtcctgtgtgtctattgctataatcgcagggagagcatcgcttactctaataatcggagcatgaatgatgttgaatcgtatgcagatatagtttgtgactatactcgccaatgtggtcgggcatttcgtcgtcgttgtcgtagtctgcttgactnttgcttggtgacgatatgcttgcttgttagttcttcgatacgcagatctctcctactcttctatatgctcgctccggcgtgcgtctctatacgactataacacacctccttgttgttcgtttgtgtgtactagtcgactattcgtgttagcactaggcactccgcggcttccagccgctctctttcgcagatggatgtctaatgtcagagcggcgtggaatcattgtctttgttagctcgatattatgttgattttcctccagttattggtttgagagaatagggaggatatggcttgttcgtcttaaagcgttttttttgtttcccctcaactttctctttggtctttcctttttattcttgctgcaggaggcaccac

SEQ ID NO: 10289 - DNA, 1826 bp, Homo sapiens
  misc_feature (1)...(1826): n = A,T,C or G
acagttcagaaaatacgacagatgngtcactcgtaatgtgacataacattagagacaacgacatataatgtattgcgaggaacgcaatacgaagnagatagtgtatacgtnantgagcacactacgacgtgncgcaacagacgtcactangngcgcgccctcaatcgagangtactcgatctgagaganggangagttagcagtcgatgacacgagacagcgttgagtagcggtaaataatagcagacgacagacgagatgctcagcacacacaagatagacgaggaatacgtacaaactgaatgatccacattacttcagtactctcacttnggaatatattagtgatatgggantagtatgacagtacacgagtcgtgatctgataactcagcgaatcgggatatgagtacatgattaggcgagacagcatcgcagtgcatcgtagacgcgacggcggccgatgagacgangtagaagaatatgtaggatngtatgtagctgagtgtgtcgtggtataatggacacgcgagattgnancttcactccagcgagcgacaccgtatganacgtgacatgacgcgtgtaggcagagcgcgtcggtgaccagacataagtacttgacgtgctcactncatcatatcaagactacacgtcgacagcgcaccaatgantccacacaaagcaagtcctgtatcataccgngaacatcgtatgtagaatgacatgatctacacgtgcgatcgacagagacgacatactnctatacctcatctatcgannttccgatctctgcancacactacgttaacacgagcaagatganangtgatcagacgagaagancacacgtctcnagattagcanactcancgactagcanagancgagcgacacntgatgtgtgnttcaagntcagcaatgcngcgctcagaancngagngnagatantgtctcgttacgacgancagtacagctcagtanacgtgacatgtatagtatgctgtggatgcgatctgacggatgctgtgtagatagtgtnatgtgtngatatagagagcgctgcngggtggtatgatngtagnatatcntgcacatgctacgaggacnantacgaaagtacaacgatatgtagagtagagaatagttgctagcgatgcttcatgatnaaggcaacaatcnaatacacacgtactctacaccacactagcgttgtacactctcatgactcactctgtcacgtaangcgtacactctcacgctnactacactctgcagacactanctatgatatactagcacgatatacnactacagacatacantagtcgaagtnacactcatctcaagatntactncagttctattacgcaaagtcatagacggcgctggcgtcngctgctagacgatgcccgtatatcgctgngcagtgcgatagatctgtaacatgtgcgtcgtgctgcgctgtgctgaggccgtgtcgttatcgtatcggatgcgcgcgngctgtcgcacancagtcgtctgacagcagcatgcncgtatcacacacctcaatcancngatgtananagnagttctganggatggcagcgtgacacggactgcgagagctatgtagncgagtgcggcgacagaganggcacagcncgctcgtngnatacgtagcgcagcgtactagcngcgatagnacgcagatagcaatcatcggtagncgngcgctgatcggagctccagctagnagcatcgcagtagaagatcagactagtagctgctatcagtgncgnatgcagtgtactagtcatgctcgtacgctagcctgacag

SEQ ID NO: 10290 - DNA, 1344 bp, Homo sapiens
  misc_feature (1)...(1344): n = A,T,C or G
caagttaataatctgatattgatttaagagatgtaagtataatcagtaactagttcttgacgtaaagtgatatactacantagaacacataatcttaatatactgataatctgatatgatacacaatcttgtattgatccggtcgtctgcttatcagacatgagtgaatgagataaataaaatgtagctgcagtggtttacagattaagtgttgagcggtgaggtcgtgagtgcgttngatatttaaatactattagtgatatcagtgacgataaaaacgtatatttctggctgaccgcaggcgcatagtaaatgatgactgctttagtaagctggattggcagcgggcgatgaagaaatataataaagcatactgtgaatgtggtgtaaggtcgaacacggttaagttgcagagcttctacaggaggataaacgcagtgtggacgccgagaagttgaggaaggaagtaggcgagggagcaaaactagaatatatggtgctaaacacgctaagcaatatatcagagtaacataggtggaaagagtatatataaaatcattgtgctcataagatgtgagggagcgagggcaagtggagtgtgttagttggagtaagtaaactatgtcatgataaagaatagtaaagcaaatgagaataaacttgtagttgtaaggctgggcggggctcgtgtggcaaagcatataactagacgatataagtaggtcactgtgaatatatacttctccatggtgtagaatatgtgactgttcgcgtactatgtgacgggatatcctctctacgctgatgatgcgtataccgacgtagtgtgtaggtcatcttctctatctaggcatgcgtgtgatcgttttcttgtgacgcgtctgcagtaatggtagtgcttggtcttgaagagactcacagtcccattgtaaggtattatgagatgggtgatctctatcctgcacttagttggacatgtatcaaagggcgaacngtcgtggctagggtgtngctggtcattatgtagaatagtgtcangaaagttgaacatcgagtataatgagtttatgtgtgagtaagaacgattatatacacncatatcgtacttattattttaggcctaaacatagaacaacacaaagatagaacagaaattaatataaaaattaaatgtattaggattctatggttgtnttttttattttcatgagtgagatctgaggtgggtgttgntgagtatgtattagttgaggtgttatgaaaatatcggggcgaggaagancagacacaccgatatagatagatatagacgaataacctgtcattatatcagtcggttattta

SEQ ID NO: 10291 - DNA, 372 bp, Homo sapiens
cctggatcagcgctggcgtgatttcccaggagagggggaagggccgtcacctggcctttaaagactcaccacatggataatcgtgatgagggcgaagcactagggctcatctgttggaatcgggatgtttaccggtatgaatcttgttagtctacatcagctcctcccctccatcctgcctttttatttctcatctcactggcacttgaagaaacccagccaaccgcttcctggaattgtctctgggcttcctcatccattttttttgtgtatttgttttttgttttattctttttgttttaaaatattttaaacttgaaaaggtgcaagaacagtattaaaaatgttcttttccttgtaaaaaaaaaaaaa

SEQ ID NO: 10292 - DNA, 1048 bp, Homo sapiens
  misc_feature (1)...(1048): n = A,T,C or G
agagggagagagaaagggggaaagggaggagggcagaagaaagaaagagttgcaataaangtgtctgcaaagcttcgggacgggaaaaactcacaacgactgttaaagacaacagaagaaacattatgtttttatttagactatgtgtactattgaatgttatatgggcgcggaacgacagtatgggagtagaggctagcattcaaccaccttcgaccggcccgccgagcgccgcgaccccccccctgcgtgtcagcggcgcgcccagtggtcccatgcccccccaccagcgccacccccacgcacccccccccgccccccccccccccccccgcgggccgcgcccgacgccggaggacgcgtgaccagggcctcggccgccgccggcccatccgcgccacgacccccgcgcgcacagaacccaaaccgcagaggcgccggaaccgcctccccgcttgtcgccgtactacgcaatcgtctgatccaacctactagtgccgatcaaggtnccatgaacaccgaccctgacgccacgcgcgaccccacggcgtgcgccaccacgcctcccacgcgcacccgcgcccgaagccgcccccccacgaccgagcacctcaccagacaagctccaaccccaaccatcaccccgaccaccgagcaccccacgccgcccccacgacaggccgcccacaccccacacacgcccccacggcccccgagccggaccccggccggccagccccgcaccacgcgcagcgtnccgcggtcgccggcaggcagccccgggccgccccgtgcgccccgagccgcccgggcaccccgatcgtccccatgcagggccaccccggacccgcgaacggccccacaccgccccccccgcccgctccaaccacgcgccccccagcccgcggcccgagggcgagaggcgcgcgcccccgaccccgacagcgccccacacagacacgggtctacgcgtgcgcacggccgacgagcccaggacccgcacgaacgacggacgcaccgacacgacagcacaaaacgacgccgcccg

SEQ ID NO: 10293 - DNA, 807 bp, Homo sapiens
  misc_feature (1)...(807): n = A,T,C or G
atgttggtggggaatccctgtacgtgcggctcgaaccccccccctgtaacaccaccccaccacacacagagaccacaacacacccaaccacccataaaaccccgccccatccggaaagcaggcgtatagtccaattaaccgtggagtacaccagctccgccgggccccacaccctcccccccctcctcccccgtccccctgcctggtcactgatggtgcctatgatttgatacaggaggccgcacgctcccagcggagaagagatggggcccgggaacgcgcgcacgcagcgggtgacccgccgcagagaccctcggcctaccgcccagttagttacagggtgagagcaggtgagtaggagtgagagtggcgagatagcacagcggcaggtggttttctatttcttaatttttttattgtagaagtacgcccacccgcttcgctaccccatccccctcccatgtacttcttacgagggcgacgccacctcgctacgagcgcacgtcgtaagatagttncgaatggagaggaagtagggtagtattgcccgtggccgtagagagaacgtctattatcgccgcgagctgcacgcgacagtccccaatatatctaccaaatttagcaccacacccattcgcctatcaggcgagagtctactcactgctcaacccccccntatatcgcacgtccccagctctcccgcgcatccacacagatctaacgacgcatcgcggtcagacccacaaggtccgcccgtggatgcgcggtagtccgcaacaacggaagagatgcaggaggcgccagtag

SEQ ID NO: 10294 - DNA, 1814 bp, Homo sapiens
  misc_feature (1)...(1814): n = A,T,C or G
ctggagtatatagtacggtgactagntacactggtatcgntcgngcatgcgatggagtgngatgngaaatgagtatagagtgangtaangtgcgganaaggancacgnccgcagtgnaagaagtaattaacatagtctcgctgtcgcgtctacactcgcagtnattaccatccngancgncgccgntgtnnatgcngtaganantgntcgccgtgacagtngangactatgagtntgtnnggtaacatgnaaagttgctagtaganaannaggtgagagagagagcaggagatanagcagatggctcgtcagngcgtcgcagtatcgtgcattagagtntcagagtgagcaagcgtctgaatgcactcgtgtcataccgcatgcatatcgtcaccatgagtgtgtttgactcgtctatcgtctgtataggangattnatatactactcttctactacnactgtgngacactcgatncgctaggatctcacacaagtacgcgcgcatctctacgtgctntttgatctcgntatgcacatagcgatatgtgcagagacgaacactcagnctgtcaacacgtaatcagtagatanacnaactgaaaggatcatgagtatatgtancatagatacttcgtctgtacgaggatgagatcagcgctagtagtagttcagacatatcacgctgtggagacagtagtcagtgacattagtcacactacctcatctagtgcnaactctcactcgtgccgatctatgcgctctcnctacgcgttcgcgctcacgcgctcgctcgctgagcgatatcaagctcgncacgtgactagtctgtctgctcatcacacctacgagcacgatgactcgacttctacatgtacntcactctgtatcgtgcgtgagatctantntacagatgacgttctctcgactgctgatagcagtgtacggtcgcactctcgtcagcgaggtcgtcgcactgcggctagcggtgcgacgtcgcattagggttcatatgtatacttcatgtncanactctactctctcanangnaactacgcagtcagctgcctctagcgcactntagtcgacatatcaccatctagtatatagccgccgactcactgcgcgcatatacatgctanctcacacgcatcnantcgctacactatatgcgtcctcgctactacacatataactccnatcctctcgcngnctctctctgctcgtccacatacgcgtgtaataaacgcgtgngtgatatcacacgctgacacatcnctctcaacgnctcgtacctacgacagtntataatatcattatactattaagtantngacaacgcgtggataagngngtgtgtcgcgctcgtgctgtagactatggcgtngagcttattgatcgtggattgcatgatcagtgcntcnctganantgctacgactctcatgctccacagtctctgtacgtcgtgtctccttgttctgtatacgcgtgtgatatagtatgatgcgttcgatcggataagcnagagtaagcgagngagagnacacgtgataacacgaacacacacactacgtacgatcaataattattgaatgcgcgccctantagggcacattgtactatgtgtgtactatgatatgactctatcgaacaagcttgcgcaaaatatacatcatactagtctacatcgcacataactagagaagatgcgaaagcntgatttgagtcaatgacatataacatatacattaatacagccttgccctcatttacaaatcagcgacacaccttctacttcacgctctctttactca

SEQ ID NO: 10295 - DNA, 207 bp, Homo sapiens
cgtaggccaaagcagatgtgatgccttgttcagccattgctcaactcttggcaaggatctgaagacaaatagaaacatcttgatgtatttgtgcaagaagtctatgccagcagcagctgtagcaactgcagattttaatcttagacatcaatgtccctgacttggagaaaataaattagattttttttaacaccaaaaaaaaaaaaa

SEQ ID NO: 10296 - DNA, 953 bp, Homo sapiens
  misc_feature (1)...(953): n = A,T,C or G
gagttttnnaaannnannnnnnnnaaagtnnnnnnnaagnnnnnnnnnnnnnnnnnnnnannnnntnnnnnnnnagtttgnnnnannnnnnnnaanaannaggaannnatanagnnnnnaagaggntttaagnnaagnnnatannaaaggtananataagatgtttatagggattaagatgtagggttatggaatgatataataaagagagagagggaggttgtttggggctgtttgggatggaagtgtaggaataagatattagaaatgagtagaagagagagttgttggggtagaggggtgtttgggtggggtgttgagaagggttctagcgggcaccagcgtagagttcgagttgcgtgtcccattgagagaggagaatatcccagagcttacaaatccttcttcccctttaatcaccccgcgcctcctacccctaccaacctgtaattcgcaagagtgtggccgcttgtccgcgtgaccatagttcacgcttaatccccagtgtttgtcccctatagagtcagatatattcaatctccttatttattccacctaagtaatttatcatccgcatattcccatgctatactctgcctatgtattccgtggatgagttccgtcgccatcgtcctctctcctcactgaatatgttcagagatcatcacatttagcgcctacgtaaagaactttcctgtactattgatctatattggntttatgcaccttctacctggacncctgaccccgtgtccgngagtagggagttatagttcgagtgtattgttactctctctcactgctgtagggttccacatgctaagtgtccccacggtcgtacttatgttaagagatcgggcgccccaaggtaatgaggcaccccacacccataaaatccaagcatttctccgaggtcgcccagtaatgaggcgattgcgatcacagtggcgttg

SEQ ID NO: 10297 - DNA, 203 bp, Homo sapiens
tttattaacatatttgagacctgtcaagagagaaaaaagaaacttaagagataccaccacctctggcttaagcataacgaagacgtattacttcatatgatgaatgctcagaatgaaggtggcgtatttgttatctctgactacacaacaaatcaccccccaaacttggaggattaaagcaacaagaatcaaaaaaaaaaaaa

SEQ ID NO: 10298 - DNA, 563 bp, Homo sapiens
cctgtccaatctcagatgtggccatagagtttctaagcagagaaaaacgttcaagagagcgaaacccagaactgccataaatattcatcaaggaaaatctcttgagtagcagagcagatacttttcacatgtatgtattaatttactttagaaaagaggatgtttgtttcttattcttccattttccaaatgagagtattatggtagtgaccatattcctattctctattatattttatatcggagaggatttgatttagcccatgagtcaaaaacccactgcgcccagccagtcctacctatcaatttttacataaatgatactggccagaaagaataaagctgacaggataaaaagtaagggtacaattaaaggatacaaacaaatgtaatgtaataaatgaatagagaagtttccacatataggctgttatgatgctctgcttagtctttacttgactgtgttccatatgcatcatatagaaagttctcttcttgttactcatttttctctttgtgctttactaaatataatttctattgtattctcaaaaaaaaaaaaa

SEQ ID NO: 10299 - DNA, 964 bp, Homo sapiens
  misc_feature (1)...(964): n = A,T,C or G
aaaannnnnnnnaaggggaaggaaaaaganaagaaaagagggagagaaggaggagaaggaaaaagnaagactcacgcacgcncaagaagcgaaccgcaggaccgccnagagacccccggacttcccaccccccgccccgaggtagncagtcaggtagagtataaaaaggccagcagcaaaacccaggcagtagatgggagaagggagtaaaagacgccaacagtaaacagcccgaccttaacgccgccaagcccaacgacagcccgcgaccgcaggnaagaagaatgagagcgcccgaggaaatntgttgagggggggctcccaggggcacaagcacccagaaagcgcggccagggccccgcccgcgacagccccgccccacctcgcccagcgcccccacgccgggcacccctcccgacccacccccagcagcaccaggaccagtgcgnccagacaatcatcgcccggggcacaatagagtggnagtatatcgcccggaggataagaccaaggcacgtagcactttctcccgcctcccctcccacgaccgacgtagcaggncaacgtcgcgcctccgcgtccgacacgtnccgtcacgatgtggtatgttagtgtgtcccacaacgcgaatnccccgcgcacgctccacacgactctncaatcatgaataactcaccacggctatcatccgagcgcaggagcccaccggcnctcgacgggtcacgcgcncncgcgcagaagctagcgacagcagagaaagacagactncaataagagtncgccgctaggaatcggtcnatataagcggccgcgccccgaggaagtacgtcgaaagaagcncaaacagagtatagtaagaaggntnccaacgacgcggtgccagacgctcgagcgcgcgtacgcgcccctcagaggagggtccntacacacgcncgtcgaaggagaggtgcggagcgccagaagg

SEQ ID NO: 10300 - DNA, 191 bp, Homo sapiens
  misc_feature (1)...(191): n = A,T,C or G
atagatcatacaagcacagactattttggggaactaaagaaaagggtttangagaagacanncncaagcctgcncgggcaagacacnngaanncaggangcaggagaagagnactntgcaannaaancagaataaaagcagnnnnnnccaaancngaagaataaaanngagctaaaggaaaaaaaaaaaaa

SEQ ID NO: 10301 - DNA, 534 bp, Homo sapiens
  misc_feature (1)...(534): n = A,T,C or G
cttttggtgcatacggtagaagaaacttanctccagatgactctttggacttgggacttgggacttttgagttaagacttcagaggactattatgaaggcatgattatattttgaaatgtgagaaggacatgagattcagggagccaggggcagaatgatatggtttggatgtttgtcccctccaaatcacatgttgaaatgtgattcccaatgtgatttcctggtgggagtttattgggatcatgggggcagatccctcatgaatggttaacaccccttggtgataagtcagttcttgctcagttagttcacatgagatttgattgcttaagagtctgggaccacacccttgtctctctctggctttctctctcaccatatgattcatctgctcctccttcaccttctaccatgactgtgagcttcctgaggccctcacctcagtgaggcggatgccagccccacacttcctgtacagcctgcaaaactgtgagccaattaaactcttttcttttaaactaaaaaaaaaaaaa

SEQ ID NO: 10302 - DNA, 822 bp, Homo sapiens
  misc_feature (1)...(822): n = A,T,C or G
gatannggganannaanannnatgaagagaagaaaggnnaatanntnnanattnnaannnnatannntntaaattaatnaatcagttcantcaagaatagatgacgcaatagttttgcttgatggaataaataatcaaaatatgaatatttagatggaatgaggcactaaatcacgatactttcgactgatggaacagacaaaatacacaaagcgcaataaagcaacatgaactaccaacaatatcataaagaataagtaaaaaaatcaaaacactacgaccattatacccaatagagcaagagaagctaaaaaaggaaagtataagcggaaacatacctggaaacggacataaaatgcacataacataatagcctcccaccccacccacgcccaccgcacatgcccgcgttgccgcacgaagaccaaccataccagctcacgtcgcatcgctacctccatcacggaccccggtgatacggcggagagtacagactgacctacacggagatatcgcagacacgcgcctcctgcccacataccgaaaacaccataaaaagtgcaggaagcaagggtgtaatcacatcgaccgcgaaaacaatggaaggtgagtgccgtgcgcaccgccagctgcgacgcgcgagccccgcagcctccactccgccgccccttcaacatacaccaaagctgaaaccacacgactggcccaagcatacccaacggacggagtaccataccatttaatatagtacagatatgtcctcccgcggccccaaacaaaaaaatgcccaacccccccctcctaaaagcatgcaagtcacag

SEQ ID NO: 10303 - DNA, 1047 bp, Homo sapiens
  misc_feature (1)...(1047): n = A,T,C or G
ttttatgnnnnnattatttatgattgatgtttaatgagaggagtaaatataagttaaattgatatgtgtagtnaaagtaaaaatatttaggttatagagttaagatatatgaccgtatacggccaagtagagcaagcccggtgtctaattcgtacaacacaaacatagaaattatccagtaccggagggcctaatggggacgcgtgcccaaagggagtgcatgcggcgtagggggggtaatgcacctcagtagccagaggctagagcggggatgagggtggaagagaagggagcagaaagagcncacagaaacccgggcgcccactgtaggtcgtggagctagcggggatagtggagtacgcgtctccacgcgcgacggcagcgcaccacgccgctgttagtggnccagccccggccgccacggagcaagtgngaggtagcggagacgactggatgcacatgtgtcctgctggcgtaggatagatttagaaggtcatgcaggccccaccggcggatccaccgactgaatgtgactgtcccgtcttttgccccctcccgcgtcctcccagcgttctctcgatgtggcgcctgactacctagcgcctacagttgagtcngttaagtgggctctatcttactctatcgatgtgcgtagggagacagcgccctccgtgtgtgccccgtcgccgccgagtccagtagtcattctagttgaactgtcccgcncctgcgcggcggtgggcccccgatggtagcggggctccgcgggtgagcgcgcgcgctcctgactcattgccgatggcggatgtgtgcccgaggtgtcgtagcccaagagccggttatgcgcgngggtggttgccctgtcgaggatctgttgcaggcggcncactacttatcatgcctaggtatcaagcgtaccaccaagacaattaccaacaactccccaccgagaggcgcccacatggtcgcggtgtgtcacgtggcntcgcgtgtatacgggagggaagagggagcgcgcggacgggtagcgggcgtgcgcgctacacg

SEQ ID NO: 10304 - DNA, 457 bp, Homo sapiens
  misc_feature (1)...(457): n = A,T,C or G
ttgatgcactaggggaatcaattaggcaaaaaaaagaaaaatangcttatagacgactcnctaancnncttccaagggatcaactcccctgtgatctgcacgtatacatccagatggcctgaagcaagtgaagaatcacaaaagaagtgaaaatggccggttcctgccttaactgatgacattccaccattgtgatttgctcctgccccaccttaactgaacgattaaccttgtgaaattccttctcccggctcagaagctcccccactgatttctgctgtgaacgccgcccctgcccgcaagagaaaaaccccctttgactgtaattttccactacccacccaaatcctataaaacggccccaccccatctcccttggcttgactttcttttccagactcagcccgcctggacccaggtgaaataaacaggcttgttgctcacaaaaaaaaaaaaa

SEQ ID NO: 10305 - DNA, 1136 bp, Homo sapiens
  misc_feature (1)...(1136): n = A,T,C or G
cgatgaccaacgcgcgcccccgcgcacgacacagcccacgcagaagaagaggcggagcgcgagggggagggacgacaccccttaggggaaggangcaccgagggagnagnaagacaacctcanangaagaggnaagcagacaccacaganacacncaanagaccaggcaccgagcacagcagcaagaccganacaagagcgaccacacgagcaacagaagcangangcacaagagcgcgaaccacgacaaccggacggcaacagcacaccagaccagagcacccaccacacccagcgcacacagaacaacaccgccgcacacacacgcaacacacacagagaacgcgccgacacaaccagacaacaacacacaaccacccacaccaccgcgcacgggagcggcaccgcgacagcgagaaacagaagaccccgagagaccgacggaacacaaacaaataggaaccaggcgagagcaccgacgaagccaaacgcaagaccacaaagaacagcacgcgaagcgagcaacaccaagcaaacacgcagaggacgaggaaaaacccgcgcccgcggcaaacggggaaaaaagccaggaccacacgaacaacgcacaacagcacacggataccacacacaaacagacgaccgacacaacaggaccacgccggcacaccccaccaaggacaaccaacgcgccacaaaccggccaacggaacaagggagcaagacaacaaagacaaagggaggcaaaccggacacagaccaagaaacacaccgcccgccgacggcgacgacaacaaaccccacgcagaagcaacgacaacaacagagaagagacaacaggacacgaagaaacaacacgagcaagaacaaggacgcgagcagcccgaaagaaacgccgacacaaagaaaccagagccaccgcaaaaagcacccccaatcccagcaaccaccccacgcccacaaacacccgcaccgccacgcagcaccgaccgagagaaggagagcacaaaccgaacacgcaaggccagagacgacgcgagacacggacgaggaccgggggacaaccgcgggcagcaggccggagcaccaccgcgaccgcccaccacgagcagccacgggacgcggcccacccgacg

SEQ ID NO: 10306 - DNA, 1929 bp, Homo sapiens
  misc_feature (1)...(1929): n = A,T,C or G
cngcagcgagcgggacgacaagacggagagngagcgcacgntgcgcagcagaacacacacacgctcgccgagagagatcatacagacgagcacgcagatacagcacgccagaatcgcacgaatacgtagcgtcgtagcatatgaaatcatatacagcgaagctagagtcatacgagcggaagtagtagatngcnacgagacacagtggcgatgtcgacggtagagtcangacgagtgacagggtgcgaggcgcagatcgcaggacgcgcgtcagacagancggagcgcggagcgactcgctcgaccagnactgnaggagcgtgcgtcaccagnactacgnccangtntcaaatgacacagagaaagtgaggactatgagtatgttccgatatagtaaganaatgtgangacngngtagcgntacgncgancgcacgctgagacgancgcacgagcgagcagcgtgcacgcactgtganacnacagcggagncacgtacagtcacgcgngtgcgcgagacaggctacatgcagtactactcgtcgcgagagagagcagtataggaggagatgcgcatcatcaatctatagagtctgtatgagcgcgtgtcgctgcgaatagagaacgggacacgagagtgaggtgcanggtgacaacgtgaatgccgagagtagcgatagctgatgctgcgaggcggaggacacgtgattagatacacgcagcgctcatacacacgacacatgcagcgatgacgagaagcacgaccacacacacagtanngggacacggncgtgngcagcgagagcgacgacgcgtcgcgactgnccgcgtgctgagagtagtgacatcgantagcacagaacagttgaggtgtgcgcagatgcgcgcgcatggagacgagatggcgacgcgagcgagcgatgagtgcgggaggtactcagtgacgcangtggancagagangatcgacgacgnagnaggcgagaacgacatccgngacggngatgncggtgcgcgcggatgcgtngntacagagtancacggatgtgagatgacggacgcaagagagcacctcgcatacgccggctnacntctnacagcacgcgtngagnacagactcatacatagtcgatgnaagcacgacgcgcgcgacaaagagaatgatgagcacncgcgganatcgnatatatcagcacagacggcgagaggacgacacacgnganagngacctgagagcgatcgagaacgngacagacgaggagcagagganaaacgagagngcgagagatcgaggcgatganagacgaagagcaggacagaggtgacggtagaccagatgccanctactagcagacactgcaagccacagancacaccgacaagctagcacagagcactgaagctgcgagcgagagactagcgacaacatagcgagacgacagacaacgcatactgcgcatganaggtcgcagtnagcgncgcgcgcgctgtcggcncataagcagagctatcgtccagcgacgaagaggaacaggcgcgagcgcgagncgaaggagagaagcgaggcgtacgtgagagggtggtgagaggatagnanacantanatctgnacagaacccatcggcgcgggtgatgcgcgagcagggaccaacagacaagaggatagagaggagagcgcgagnagnanagngagagaganngatagtaagtggagtatctcgagagtcgcgagcggacgagcaggggagggtcgagagaatgaagcacagagagcagaagagcacactactctaanatacagctacgcgacacaggcatatganaataagtcgataatgaacgcgacgagagatggaagagacgacagagcagagagcaagcgcggaggccaactgagtacaggagtgaggcagtagcagagtagggataga

SEQ ID NO: 10307 - DNA, 1759 bp, Homo sapiens
  misc_feature (1)...(1759): n = A,T,C or G
ccgtgcgcgcgtacgacgtcgcgatctgcctgcgcactctctcccgtgtncgcgttcggcggtcgttgcgtctctgcctctncgtatagcccgtntcgtacagntagtcgcgacgcggcgcggtgtatctcgtcgcgctgtgtggtgtcttgcgtcgcgcgtgctcttgctctgttgctgtttcacgcgtggtacgctgggagtcgngcgtcgttaccctgcgacgtcgtgctgntgcgctctctctcttactgcctctctcacgctgcatnctgctctctatgtgtcacacatctactcgcactgtgtgctctgtgtgtgcgtgtcacgtctgcctcgtgtgcgcgctgctgtgctgttgcggctctgtcgtgtcgtgcntgtcgcgtctgtcntgtcgcgtgcggtggtcagcagagtgctgtcgcgagcngnctgtcgctcgctcgtccgctcgtctcgcctctgtcgcnacgcgcgtctgttggggctgagtncgtctgtcgattcgctntcgtcgcgtgcgctcgtgcgtntgtgtctgcgtccggtgcgngctctcgttcgcgcnagggtnggtcancngctcgtgtgccgcgtcgcagacagctcgcgcgcgctgtgcngctgtgtcgtctgtctatcggtcgagcgtggtgcgtgtgctgctgcgtgcagactctactgctacgcgctctctccgcgtcttgcgtctcgcgcgtcgccgctgttgctcgcgngtngctggcgtggtactcgctgcgtcgtgctggcngtcgntcttcgcggctgctccgctccgtcgtctcccgcnggtctcnggcggtgcgcgtcctgccgtgctgcgtgtgtgtggtgttcttcttgcgtcgtgtctgtgttggcgcgtgtttctcttgtctcgcgtcgtggcgtctgttgctgcgcgtgtctcgtcctcgcctctcggctctgtctcctcgtgttcgtgctcgtctgtcntttttggtgttctctggctctgttctctgcttgtgtgtgctgtcggcgcgcgcctcgtcggctgcccgcgtacgcgccgcggactgccgtctcgtcgttgtcgggtcgcgtacgggcgcgcgtacttacatgcgtcgctggcgcctcttcgctgnctcttcgttgatgtctcctgcgcgccctgtctctcgctcgctttcggttgtctggtgtgtcgcgcggcgtcggcgcgtggctggcgcgctcgcggtctctcgttcctgtctgtcagtagagaggcgcgcgntctcggtctgngcgtctgcgcctcgtcgtcgtcgctgggtctgtgcgccggttncctgcgtcgtggctctgtcctgtccttgtncgtgtcgtgggtgctcggtgggtcgtcgtctcgtggcggtcgccntggtggcgttcgcttcntgtngtgctcgctctgttcgcgtcgtgtgtgcgtgttgttgtgctgtcgtgctgccctcgtcggtgtgcgtgttgggttgtggccgtctgtctgtcttggctcgcctggtgtccgcttccggtgtggcttcgtcgtgttgcggtgctcgcggttggtgtgtgtcgtcggtgtggggcgtgttcgcgctggctctgctcgcgccccgccgcgccggggttttcgcgcccctcgtgccagggccgtgctggtgctcgggttnctgctngctcgccaggggctgtttttttgtgtctttcggtcgctggtggctgtggtttttgttcctcgctggttctccgtcttgtg

SEQ ID NO: 10308 - DNA, 1091 bp, Homo sapiens
  misc_feature (1)...(1091): n = A,T,C or G
attgtgctgnctatcatatacgctcagcgatcgcatgactgataagtcatttgtctacanctcnttgtatcgtgagtgtnaatgcgcgataacntgtcgtctcgntatcngcggcaggtcttacaccgtagaacacttatagatgtgtcgagtgatcgtgacgacgaggtgtagagcgacggtacatcatgctgcgtcgcctncgtgtatcggtgattattgacagtnggcgatggtgttggtgtcgcgtagtgtggtaggtagaggtggtgcgagcgccgagctgtcgcgggatagtgatcgggtctgagtgtgcaccggcgcgcgggtgagtcgtgagtatagatacagtcgcgattcatatacgcggagcaacacagctacgcaactacaggttcaaaagcggcgccgtgtcctctccgcgctgttcttagagctcgccgctcgttgcgctcagagccgtactaaggtggacaccaggacatcacgaggagtctgagattgccttcacatggtggtcagaacgactgccattcgtctgtaacttaaagaggagcgggggtatgagagctcgacagcgcctcgtgactcggaacagcggtggtttgatctggattacgtattgtgtgtgtgaggttggtcgagtagtgtggagtgagggctggcggtcggttgtgttgatactatgagctctgagctgagtagatcgcgcgatcacattgcgctccgcagactcaacctcgaaattcctggatgaagtagggtactcttagtggtggctaagtttgtgttgctntgttatgtatatagggtgaactttgattaataaattaatgcacttattacaaacactctncgtggaaaatcaacacatcatcgttgacgctattgtgtggccttctcttcgcgtttgcatatcatataccaccatctgtttgtttgtagtgaacgacataactagcggaggataaactggtaagtagtctgcttctagcactttttcttcttctttgttttattctattacttaatttttttctctntntctgtatttctccgctctttgnttttggatttctccttttctaatc

SEQ ID NO: 10309 - DNA, 879 bp, Homo sapiens
agaaaaccaactcaacaaataaaacgaccaccacaacccacaacctaagggcaacaagacgaactgcttgtttcttttactctggagcttggtgctgctgcccatgatcaccgtccttctgcacaccctcccttcctgtacagtccccgacaccttaacaaatgctgttcaacttctttacaactgcaagctaacaaataaaagtatttacagtcaccacaaaaaaaaaaagaaaaaaatacaaccacaaaccaccaaaaccaaccaaaaaaaaaataaaaacacaatcgaaaaaacacacaaactggccctcttgtgccctaagggtgggaaactttccagccccttcccctttagagagggtaaataaaagaccctcgtaaacagatccattgacttagagaaatgggccgcgccaaccggattaatttctctaaaaggcggaaatccggtttcccccaaactcgggggaaaacccaggaaaaacacttgcaccaaaaggccaccaaaagcccacaacccgccaaagggcccggttcacgggcgtttttcacaaaggctccaccccccctcaacacgaacacacaaacacgcccctctacgtgcaagtggcggccaaacaccccgcagggccaattcaacaacgccccggctttttcctcctaaatagttaacctatagcgcccgtcagcaccagacacaacccaccgctaacccaaaaaccatttccctccttctcccccttcaaggaacccggggcgccttcttcactaatccccccgtctagggcttccctactacccgacacacgcccacacatcacaaaatgatgcgactgcagcacaaaaccccccgctctccccaccacccatcagttct

SEQ ID NO: 10310 - DNA, 863 bp, Homo sapiens
atttgtgtagcgtataaaataataaatagagcgggggcggctgcttatagggaacatgtgggttgttatatcacacttttaggtgaaactgacttggttaaactgcgtaccagtcagtgctatttgagaattcaggatcaacctagcctacagaggtcctcttcagcatttctgtcaaggatttggattaagacaatacacaagaagatgcttgatggaagagaaaatggatctcatcagttaagctcctgctacgcttcatcttctttgtctattaagaattgacttcacatcttgcctacctcacaaggatgatgtaagaatgaaattaaatataatggatgtaaaagtgaaaaaatattttgttgataatatgaatatcaatataaagtaaattctttattgatatgaaatctggtttcatgttccatatactaaagaaatttagtgttttgtattctctaaggagtgagatgtaagttttgaactttccctatacgaagggcgtattataatgatactctcctccatattcatctcttagctcctcttttgtatgttttgtaatcgagctcattactactaatacttttgtcatgttgcgtgtgttcttgaaaggatgaaatgatataagatttggagtgcagaagttcgttaaatttggtatttatttctcgcacagatacatgtatgtgtgacgtattaaagatacaactagttttatcaggagcgcgtacgcaccgagatgatagttacttatgcaggcgtgtaaaccggctgatggtatccgacgcacgccagagtttaatacctatgccgttttgttagtaaagtgtagactagatatatacagaaattattaa

SEQ ID NO: 10311 - DNA, 1255 bp, Homo sapiens
  misc_feature (1)...(1255): n = A,T,C or G
cgagtaggctactgacgcttgaatcctgcacggagtggtacgtcgagggcgnagacggcgagcacagcgctgccgtgagagagtgtgcagcgatgacggggatcgtgatattntgctctctgtgctctacgtccacatatctatgtaatgctctctgatgccgggtcgcgaggngaggatgttggcacgtgggtgatgtacacgcagcgtcatacgagcgcaaataacttctatgctgtgaatagagacgcagccacgtgctatgcgagccgtcgatgcgccacgtcacttgactggtgtcgactgagcgtagaaatgttgtagagactataggagtgngggcgctgagatggatggagagcgctgatgaggatcgaggatgataggtggcagacgataagagacaagagaaatgantccagatgtaatgatgagactcggtagctacattgtgtattagttaattgtagacgttgtcggcgcctacgtgaagtagattgatcagattagacatgtataatataactgtggataaatgtatangtgataagcagaagcaaatagaatacgaacgtagagagagtaactgtacagtagcagaggcataaaaagagtgaagtaccggtgngcaagagctggcgaacgcggacatagcacctacagcagagttgtcgganagnaggtaggtgagcggatatttctatcaggcacgcgaaaagacgagagacntgtgaagtgcttgattttggcttactttcgtctttccttgttgttcttactattgtagtcgtatatgtttgttctatatttgtattaggtatttggagatgtatctatgttgcttcagggcataagatgcatttattnacttttatntgttcagtaaaaactatgtttaattattcacaacctatcaatctatntgaaaaaacacatatataaacagtaatacttctacctgacctacaagtaatacggacgttagacgcacgattcgacgttggtgagggacgcgacattaagattagaatgagaagaagttagagtgtaatgtagtagggacatgcgtcaggcatgagcgcctgcgatctcaaacaccaatacctccgttaattatgatttcaaaaaaagaagagtataagttagttagaaagtnttaacagcagacgcggaaactcgagggcgcttgaccgcgtcaccacttatggtgactgcggggccgatatagagagtgaaaatagagactggagcaact

SEQ ID NO: 10312 - DNA, 1007 bp, Homo sapiens
  misc_feature (1)...(1007): n = A,T,C or G
cgtcgtgcgctgttcccgttgcccggcncgttccccctgtcgtcgctcttcgttgcgcggccgggggcgcgtctttggtcgcgcctgctgctggcctgtctggtgcgtgggtctcttgcgccggcgctctttcttctccgtttgctcttctgcgttcgctgtctctgtcggtgttttctgtgtgttgtgtgccgcctgccgtgtcctgtctccggggtctggcgtttgccgccgtggtccgcttctcgccgggctttgcgctcccctccctcggtgcttcgtgtgtgcgttcctctctggttccctcccccttctttggtggcgtcgctgtgtctccgtgtgcgccgcctctgctttcctgtgtgcgtgtcctggtttccctgttcccttcccccggggtgtcgtgggggtggtcgccctccctctttgtgtggctcttgggttctgtcggcccgtgtggtgtggcctttctctcctcccctttggggtggggcgtcggggtggggtttccttcccggtccgctgcgccgcgggctcttgctcgggtcctggggcccctgctcgggctctcgggtgggcttttttttctctcttgggggtgtcggggttgtgcctctgtctttctcccttcttgtctttgttgttgtttcgcggcttggttggctccccgctgttggggccctgcggacaaaagtgtggtctttttctccctggcctgtgcggggttttctctcttgcgcggccccgcgcgggggggtggtcctttctccttgccgcncgcgttgggggttgcgcggccccgccctcgttttttggctctttcctttgctggcccttgtttccttctcgtctttgggtcgtggtgggggtgccttctcgttcttctcttcttctttgtggttttcgcccggtccaaaggctgtgtggttgtcgttgtcccccaaaggcctctttccttcttttcgcttctctctgttgtctttcccccttctctgtctgtctttctg

SEQ ID NO: 10313 - DNA, 306 bp, Homo sapiens
  misc_feature (1)...(306): n = A,T,C or G
cctgnaatgcatcagaagagatttgttccagaattcaaggacaactctacaaatgacccaccaatattatcagatataaatacaaatagatacagacgttgttagataatatagatacagatgttatagatacatatatagatatctcctaaggcttaaagtctaaatgaaattatgatgtctgctccaaataatattaaagaaatctattaagctgtctattttattgcaaagaacatgtctctgggtgataagaccaaaaaagatattataataaatattacaaacagctgaaaaaaaaaaaaa

SEQ ID NO: 10314 - DNA, 178 bp, Homo sapiens
catggtacctgtgccacgaaattccttcctccttcacctctctgaactctggtgtgtgtgtctttaattcggtgagatcaatgggatcttcctgtgtttgccctcccatagaaggcaccatgttttgtaatgtgtcttcatgaaaaaagccgtgatgatatcagtaaaaaaaaaaaaa

SEQ ID NO: 10315 - DNA, 799 bp, Homo sapiens
cttctttataacagctcaacttgtgtccaggtttaaaggtggctgtcctgtcccagactttcagccagtaaccaccatagcacattcacggtgaacccctcatatgtgggtagatgctttatgtatccttgaatgaaagaacatgtctgggttgacagaggactcactgctcactgtggaacaatcacagatggctatatctgacacagacacacagcaggttattcctgaagaaacaaccagcctggtggactggataaaaggcactatgagccccacaagagcaactgcagaataaagaggctgcccgaccccagtcccatggagaagacttgagcttgctgaattatggacagcaggtgtcactttcactccaagactgggctcccaccaccactgagaaatcctccccagagacagaagaaaatacaaacctcaaatactgatatctctttaatactttcatcattcaagtttgttcagaacattacaagaggcatgaaagaaaaaataattccatttttaaaactctgtctgtccaaagtataacatatgaaaccatgccattatctcttaggaaacaaaagcattcaagattaatttggtattaaagttcaagattcagactaacctcaaagacggcatgtgcagtgtttaagtgccagaagtttttcattccaattattttacaaagatgctgaatgacgtgtgcaatttgaaatattaaatcctttaggtttctgaacttagtgtttaaatgaaaactgaattgttgcaaaaaaagaaaaaaattggcccg

SEQ ID NO: 10316 - DNA, 1053 bp, Homo sapiens
  misc_feature (1)...(1053): n = A,T,C or G
ctgggagatacatactgtgacactcaacagcaatatatattagatatatgtatctaatatnaagtttatataaccaataaatgtgtcagtagaagtactaatatgataatttgattaaagtcctatctgtatcacgacgtggggccgtctgggacagatcgacgagagatcatcgaggtgcacctacatcaggtattacagatgagcacaaacataaacatacgtgaatcattatagtatcataataacaacagcaaatataataaattaataatatatgatagggaaactagatatcacgtggtggagaacaaaaaatatatagnagcaaatagcacggcacgtaataaccaaccgacagtctgagttctgagttgctacgtattggcgcgtaactattcctttttgctttctcatgtgcaataaacaatgacattatataattgtatgggactctctaaatggccacagtaatggccatcacggtccctctcgaacatctctcttcttaatgagcttgggaggcgcgcgcaaaactagaagtccaagtagacgtatatgaatatatcagaaagtacgctatttcagaaatttagagcttaagttatatatgtatgacatgcccgtgggcaggataacaggaataagaacagaaatcactaaataagaacgaggatctaaagaacacaccagaatatcacatttcacattaacaaaaaggaaaataatatagatattattcgttccctagattcgaacggacgctgtatgtaaataattgttgggcgttactcatagtatccaagctgaggtgcgacgtgtgcgggcattgtgtgtcttactcgaggggggtgctctttcgtctacacgggacccggaacttcgtcgctgttcttgattgtgttgctatgcccaatatcgaacactatctacaatgctcgngagtccatgaagcgttgtacaattgaacgagtatgtgactttgataaccagacagtactacagtactaactatcgacagaccatttgcacacaaataacatgacgtctaca

SEQ ID NO: 10317 - DNA, 741 bp, Homo sapiens
actcctgaccccattaatagttgggaaggatacccgttctcctcccaaccttgacagagcccccaatcaggttctaaagcgtcctccctagaggcctttaaaccatctgtaacatgagaccaattaagctttccccgcaaattaaaaaagggggtatttttaactaccgggaccgctgcagtgattaatatgtgttagcatctcagatccgcccaaccaatttggcaaagaaaaattataattggaaccactcagtgccaaaggaagatgggcactcttgcacattcctattgggagtaggagctttcgtatctatctttttgggcggccatttggtaatactaagtgtaactgcagcttcagaaccctgagtgtcatttgacccaaccatttcctttctgggcatatgttatacggaaatgggatatatgaaccaatgtgtatgaacatggctcttcactatagtaattatctgtaagcagaaaactggacacagcttaagcgtccacctgtagaagactggttaaactgctattttggcacacactttcaatggtctcttagcattagtggtattgtagaattgtaattgatcacataaaatatggtcatggaacgctgggatatcttgtgcaataatgtttactgtgtaactctggtttgtgagaactttatctatacattgagacaaagatataaatgtaccatatatctgtggtatccaaaaaaaaaaaaaaaaaa

SEQ ID NO: 10318 - DNA, 833 bp, Homo sapiens
aatacatcttccccgtaaaaataaacccctcatgatatttaatactagggccaacacagcacatcttcttcttttgcctcggcttccaggattccggtatgaaaccgctgccatttgcactgcacactaatgacaagctggatgtttgcatgaaagccaatatgttcctacactgctttttgagacaagtaataatcagtctgtcatcaatgtcatgctgcaatcaggctttgacaaggtttgcaaataactcgaaaggaattgctcattcctgaacactacagatcaaaaccagacctgaacataaactagaagtctgctgagtgtaaactgcagcatcttatgaaacgtgctgcgaataagcagaagcaacagtccatggaacaaccaagccttagccacccgaaacccctgtctataattaaaaaaaaaattttttttttgaatatagctaccttcactgactaacactaataaacccctcgctctaaatgacaatgttatccctaaaaacacccaccctggctagaattaccacctgtcttattatcgagaatcaccggcaacccaacataaatacccattattcctgcggtttgttctttacattaaagacatgagatggcctctattctgggctttatccatcatttctttacggaataagatctccgccccctaaccttgagacaaccaatatgattcttgatttctacgtccttccgtaccgtcctcctttattatgatcgatgcccgtattaattatttgacaccatctatccaaacaaatgctctttgaacgcctacaaaaccctaaacatcgatgtatttat

SEQ ID NO: 10319 - DNA, 911 bp, Homo sapiens
  misc_feature (1)...(911): n = A,T,C or G
accgcagcatatcccaaacaacacaacacacaaggaataagttgncacacagcacacactctgttgctgaggctgtactgagcgcgagaccatagctctctgcaaccttgcactcctgggctcaagcaatcctgatacctcaccctctcgagtagctgggactataggaatacgccactagtacctggcactccatattactataaacgcctagtaaagatgatgatctacccataacctactccctcagtaccacaaacaactatcatgacattccgctttcacattaaaatcgcctttatgaacaacaaatccaactgcattatcgaaacccctaaaagcgatccctagaacgcctccgtattccattccgcaaaatatgtactcactacactctcttcccgagcaattgacctttggaacccctcaacctagcggaagggaacaccccctaactgaaactggcatctcccagaacaacaacacccacttactcgccactaccactaacacacttcctacactgatataacgtatgagactatcgccagaaactaaccagtaagtacaaagctccccaatcctatgtaccacctcactcctgatatcaacgttccttttcctccccccagtccaacaactccaccacaccagactaaatataaaaataccccaccacatgagtattaataagacaataacgtcactcaatcaataaaacaacacacgactgccctacaaatcctcattccctacgacaacacaccaaacataccacaagttcncctccatgaatacaccccgtaacccttcccacctccactcaccacctcctatatcactatctcctattatataatataatacgtcacccaatactgaccacaacaccacctctcaatcccacccat

SEQ ID NO: 10320 - DNA, 1923 bp, Homo sapiens
  misc_feature (1)...(1923): n = A,T,C or G
acgctgcagatnacacgaactgngcaactcgtcggtcntntactagtanatnatgaatntagacattgagtcgcgatanatctcatcagtagcatcnacatacnacctntncanttcgtctcgtctctcgacgtantancncgctntngtgtgctacgtcttcgaccgcngcanagagtantcgttatcatcgtctatgatcacgtcatgtcagntctgatgtangtagcttatcagatcgtacagtatgatctgactaacntatgntcgtctacagtgtgcatgngacnatagatgatactagtagctcagatangtacncatcgacntcgacgtgctcgtacatagacggactcactgatcgatcaattcttagtatatacnacatgancttatacgttantanacatactactacacggcangacgangtcgtagtgnagtatgatgantgtctnctcgtcaacctnacgaccatcactcagtcgacgcaaagacgtgagcaaccgtatagcgacgtgcgtcatcaagagtactagncgtgtgtcantacgtcgcagctctgnntgctnatgcacgtatatngcattgagncatacatnangactctacntanaagctacgtaacgagacatcnaaattacacgcanatntgtnantcgcagtnactgtcagtgtgatgngaagtgacgcagtgcgtagtgangngaatcgtgatgntcgancaatngtgatagtcgctacaganaganangtatnctgcancgaangagcgantcgnctgctgggtgangtgcgatacacaganagtcgcancagacacagatcgcagatagagtacacntncacgactgtcnacngcatctcgactcctcaagacacgattgtgatgtcaacatcgaccagatcgangncgtcggtcanctcagcatgtgctcggacgcntcgctacagactcgtcantcacgangnagagctcagactctctacagactgtacagatatgntagctntaggtgcaagaacggatgcacactcagtanatcgctgactgactccgagacatacatcgccagaacatgatcgaccgcgatatttacggcagtatatatagtatgcactacacgatcactataccacatgtatcttacaataccatcacagaatgatcatttcantncgatctatgtcgcantgcgtgcgcgaggctagactgagtcatgtatgcgaagcgtgacgtagtacgtgacgctacagtgntnacgtntnacctgcaatgcacgtatgcngcgatcgtcattcgncnntcatcgcatcgcactacttgatcgacagccntcagngactagtatatagcgcgangnatagctcgtagtcgtcgntatcntatagttgacgtcaactctcacgcgcgtatgacgcgctgtacaactatcacgactgctgcangctcgatgacagtgaccacgcatgactacagttngatgagatgcatgacnanctanacaggcgacgatantagctacactatctaacgtgtcgacgantcgcgcatgngncgcgcgtgcagcagacttacttctactcacatgtcactatcaatatctgtgtcgccgctgcgtatctatggcgacgntagtgctctgactggcagtgatagacgcgtccagtagctgacgtcgactctgactcgcacgaacactcacgtgacgttgcgccttaactctctatatctcgtctagctgaatcgcgtacatgacnatcagtgcgtatgtgnanngcacacgccctnatgtccgtgtgaagcgactcagttctgncgtctgtaggagtacattacgtctgtcggtcgctgtgtgaacttaacgtgtgtctcagtctggttgtctcgttccatacgtcatcttacactattctctcttc

SEQ ID NO: 10321 - DNA, 814 bp, Homo sapiens
ctctcccttccctctctttcttttctctggattcctaccctagatgcctttgactcgttttcccccgtggtaggtcctgcatggcgatctgatggcatcatgaaaatatttctgtttctcaccatatgcttttgttggcattatgcagtaaccattgtcatcgttggaatgaattatgctttcattacctggttggttaaatctacacttacgaggctctgctcctcccaagttggacttctgaataatgctgatcgagatcttcattcagacccaagaactgtgttttttatgagcttccacactttctagattaaccttctcttttttacattgtccttggttctctctctcgatctttatgctcgacaacatctgccttacgctgactctaatcgttcgtgtctgcctttccattctcgttttcgcattcgacttcaaacctgctcttttatacccttgtatatattctaggcgatactttcattttgctaccccatgcacattatggcctttccggcgccttatcgactcttttctctattatttaccgcttcgtgcccacactaccagatcatctatcgttttatctctcttcaatactttccacctgtttccctcctttcttcttcccgtttcttcccccaccatcttatttccccgctcattatgtttcctcattcagatgtctctattcgcttctccatccctccgccatccaatataatctttgttcgtctcgcccctaatccctgttctcccttcttagtatcttctccgctcttccctctcccccatactccttttttcccct

SEQ ID NO: 10322 - DNA, 1656 bp, Homo sapiens
  misc_feature (1)...(1656): n = A,T,C or G
cagatgtcgacgatnactcgagagtgaggagcgagctgaggaagtgatatatgtgantaacacgtgtantcgtcatgatanattatcacgtagctgctatctctcttantactcatcgattacgnggtcgactagatcgatcgtngtgtctttgtaaggagacatgtgacgcgtgtgaagtacgtagagtgacagtattgtgtggtgtgtatcatatgctctatgtttcttgtctcgcgtctatagtgtgtcngtgctatgttgtcgtanggacacatagagcgagtatcgagagngacacattatagaaggccactaagagttgaagacggtggtgtatataaggatacgggnggattgcacgacgggatatattggcgnangtatatcgagggcaggtggaagagcactcgcgtatatccaggagggtcgttagtcatctgagtgatggtgagggtgatgtgggttcgagttgaaaggggctgacgagcgagggtgcgaatcgctcggtgattgcgtcttcttcggtgncgttcgggtatggtgtatgtctgatatcggctctcaatcatgtattagatgaagaaggttggtttgtgagtacagtggcgagagtgagagttacangcgactcaggtcgtagcgttgaaattatacagtaagagagtggctgaggggcgcgtgaggggtagatatggttagattgtacatagacatattacagcgtatgtttagaatgccgcgagcagtgaaggantttgtggtcatattcgtctttacatgggatcgcgtcctctacagaggtgacgacacttcgtgagtgaaacatggactacgtgtgatgtcgaggtctacgcggcagantctcncgcagctatcctgtattatattgctaatcanttgtacgtattatantattantatatcatatactcaatatacatagcatcattngttatctatcttcagtacatattctanatatactatctctcacctcangacgnacacgacagatcacgcatcatctatacancgtgnactcgacgtacatacacacanactnacttantggctaatagcatacaccagtatctgtcgatactgagagatgtagagcaacgaactcgtagctcagtaatntgttcattatgagcnctacatctgtnnacgcatggtgtgtcgngtatcattgctcttagctcaccgtactgtcggagagttatgtggtgtagtgagnatncgtntccgagtatatggacnggtnaanagtgtatatagagaanacattnctgtagcatactcggcactagaganacngtngtcntnatcgtnagcgcgcgatcgacgcacaacngacncnacncnctagtacgtcactagactgttaganatactagcnttaagttataactntnatcattctcacgtacacgacgactgtctgnatctgcgtgtgacgactgnnngngntnctcgatctctagtgagatgagngtgnatctactctcagatacagnacgcgcgatgagtctngntcgcgtagtcagacgcatgacacnacagcatattagcagagtgttgtgtgataatcgtagnatacgacgcagatgaggcgtagagagtacgatgtgagctgtatatgggtagatagtg

SEQ ID NO: 10323 - DNA, 1352 bp, Homo sapiens
  misc_feature (1)...(1352): n = A,T,C or G
agtgtgagtgtagttatgtgtctgagttgttatgtactatagtactctacaggtgcacggtcttcacacgtgagatagagttcgtatatgtctngcgcgnatagacaagcgtaggtatcatacaccacacgagcatgcatgaagcactagaataangatgatatatatagagttacaatcatagagatgaattagtgnataacagagtaaacgtaatcaanggagagtgaaggagacagcagtcgagatagtagtgcgagcattacacagagatatacgtgatatacgtattcatgtngngatactttgatacatccgtngtgagtcgctcgtatagctagtaaacattacgaattggaactctatcgagagccatcgtgcgtcgtgctattctngaaantancactgagtactagagagcggacggtaggcgngnggatagtcatgtggtagaggagtnagtgtgnngngtgtgagtgtagttgaggtgtancacgagtacttagtgtggtgctgtgtcgtgcatagacggtatagtcaaagaggagcaagatngaccanacatcatgcacgaagtgatattatgntatgtcgtatactctaacagtctcagcgccacagaggagcgaacagtacagaatggagttntgaggcatgtactaactgtctaagagtagataatagtgagatagtgtcgagataggatgcaggacagacacggcaaaggtgaacgacagtgtaacgcgccanatacacaggctgaagagttgtgtgaagcaactgtatacatctatgggtcagtgacgatatngtacgatcacatatcactgatacgatgatactagaatatgtctagcagtacgttcacgataacacgtcgacaatcgtagatatatcaacacagcaaacgtaacaacatctatactcgtntcgatcagtgcgacctagacgnagacggcgcacgcgtatttgcgagtacgcactagttatcacttcattcacacggtcgactcgtgcacacagaacgcatcagttctgcgctatctattaanatttatgattgtataagaagacgagttactatgagatgtacagtcaacagcaaactcaaccggtgtaggtgtggaggtgcgaggtcagacgctgccgcgctcgcatacaccattaacacataacaaatacgaacacattgatactatcatagaatgacattcgtatatattatctaatatcaactgtagaacatacggcgagttgaagcacatgtcagatataatagacgtgatatactcgcgcactagacaaacggctcggacagactagacgtagtggcatacgcttgtgtgcgctag

SEQ ID NO: 10324 - DNA, 230 bp, Homo sapiens
ataataaagtatgaatacaaaatgactactaacttaaaaataaaaaggagtttttagggtattggtaaactggctcaggtaaaacaactggaattcctaataatccctgaacaattcttttttttttccttttcctgtggacattagccttttaatttttccacaaggaattctgggccaatttaactaataaataataacagaattttctaagtgcaaaaaaaaaaaaa

SEQ ID NO: 10325 - DNA, 818 bp, Homo sapiens
atatattattactttcataccacacacgacaaaaaattttaaggtctcatcttttgcctttctggagtgcacaagtgtgatcatggctcactgcagcactgatctcccaggctcaagcattcagcctctcgagtagcgaggactaaaggctaatttttgtagaaacaagattttgccatgttgcccaagctggtctcaaattcctgggctcaagtgatctgcccacctccacctctcaaagtgctgggattacaggtgtgagccaccctgcgtagtcctgctattaatttttaagtagttaattgcgtcttcaattcttatcaaacttatttattcataatattgattagaatgtagtctttgtaaacatatcttattcacacttatctatacttcataagcactacttaagatcttaaatttatctacgccctctcatctgtcgcgctctatcccgctttttttactctctctcttactatatgaataattcagtctgctccgtcactctactacacagacccggtcccccaaaatgctattagtaaagaaaagtacgaattcattatgtaacaccccacacctctttattatcccctatcttgattttgtttttttttgtggcatccacaattacgtcattagcatttgttactcttacttgcagttactatttcgtatttttcgtgaacatactaggattgtgtttcctcctttcctccgtctttctctggtcccccaataatctgaactatttcactttttctcgctctccgtttctttgtgattttatactattatacacatttcctcttact

SEQ ID NO: 10326 - DNA, 1635 bp, Homo sapiens
  misc_feature (1)...(1635): n = A,T,C or G
cacatatgacatcacctctattcataaccacacgatatgtatncacacagtcacgtgagtctccgatagttgacaacgtagtgtctatatagtgnaggatagtgtatcgtantgcgcacaacagtgttctanatactcgctcgtgtctcaagacagtatacagcgtanacagctgtgatcgagagagaagttggactgatgagagggagaaagagagagcgaacgctgtgtcgacgtcgtgtggcgntacatgtatacagctacaacgaatatgcacgctctctcagcacatcgagagacaatagagactggacgagcatagagagtgatatagagtaacgtgactanangtacgaatcgacgtctgccttctgatcgcgcgtctggcatgcgagtcgtgagtgtcgattacattgagcaganggangagcgcatatatgagancactgtatacgtngcgagatgtcttaagatacgatgcatantgaaacgatgagcttcgtgacgtggnaagtgtganatgtaggtcacatcgatagatcgaacgctgagccggtcnngtctacgatgatagtatgatantatattgtaatngacacggtgcgcgatacgcttctagctctcaatcactcatcanagaacacacgctatcactcactatgatcgtgtctctatacgngatagctaaatatatgtaacatatcataagctatacgcccacanatactcatagcagtatagtgatatgcatnattacgtaagtagaataagtctggtgagtgaacacatctctatgtatacgtagatgattggtngngangagagaagactgagacaataggactaatcaagcaatgcgnaaccacacgctaccctgcttaaggcactagcgatgcatcgcgcaactcgacttactcgtctcgtaatacatatcactccgatcgtgcgactaaataatccaaaggacctataacagcgatagacacgaggtaactatatatgagggactgtaacatcatcgcgtgcgntacntgcaacgacgtcgagtcnacgaatctggaataanagacttaacatgaaacgtcactcacagcaatatactagtctactattatataatacgacacatatttatatccacatatanataacaacnatacatatcaagtaacatctacactatctcagtattatatagaactatatgtgcttgtagacgacgatcgtattcgaatctctgttggtcgaccagcacgctcctgtacgattcgtctgtcgctactctatcggacancgcgagtagagtgctatagcagcggacganggaagtacagctcgccacacgtcactcgctccgagcatgcgaacatattgtgatgtggtgtcatgggtcgtcggcacncgctgtcgcgtcgcgtcgtatcaactgtctgttgatcttagggtgtgcagacgatatgtgtgatattattatgactcatngagcgtgcatcatgtgctgcgtgatgtgtgatgtgntgantgtctgacgtcgcgcatcttgaaacagacgagtgcactgcacgtgacatgtgtacataaggccataatgcaacacacacgactagcaacatgggcgagttgtggggagtgtga

SEQ ID NO: 10327 - DNA, 707 bp, Homo sapiens
  misc_feature (1)...(707): n = A,T,C or G
attgctccgtgttctcgacgattccttccccttctccacattattcgtccgncagggacgattgtggttttgcaatccactctactgacttcgcgatgcggggcggctcccttccacgttagggatccttctgtcctctttccgtgcgcccgcaagttgtggggggttgtcccgttggtcttttaccccgttgtccatccaccctctgtccgccggaggttttctctcctcttatctcgcacttttctgcgcttttgtggttgcttgctgcgccttgtcgtctctccggtgtctagttcgcccttgccccttgcgtttgttttgggtgttgtgatgcactgacttcttctactgtccgtgcgccgcggggctcctttttgttctttgcctcgtctcggttcctcttgtctgtcttctaggtgtgtggggtttttttttctgcttattcccggtctccacgtcgtcacttcttgtccgctctggggttgggtgctatgctttgggctacacttgctccgtctctcctattgagctccctccgtgcacttcttctggcctctataatattgcgcgccgccttgcgtttgttcgtggttttctctctcctctgtctttttttttttttctttgtcttctttttcagcgccgccctgtcgttcctgcccttttcactctgtccaatatatagacgacgagagcaacgaccc

SEQ ID NO: 10328 - DNA, 1761 bp, Homo sapiens
  misc_feature (1)...(1761): n = A,T,C or G
aacaactagatatcgctctaatacagtggtcgcgacatnttgcgcgtactctgacgttcttagtagtcatacgtgnatagactagtgcgctgtgtcgcactatntgncgacactcacgtgagatcngcgcactatactcgccgtcgagagcggtcatcttctgancgcctcagcgtcgctcgtggcatagatcgtggctgtgactcttcgtcggtagtgangagtgtcagtgtngcacaacacaacacgntcganatgcggcgagcgcantatcgcgtcgtgantatatctagcggagagancacgatgagtgctgtcgtgctctgctagtgcgngagtaactgatgcagatgacgcactcacgaatgatgcgaacgacatagctgtgaggtgcacgngcgcgggtccgttggtgctcacagcgtgagtgagagcggagcgtgggagtgttgggngcatgacgatccagagtgagactctatcgcacgcgatagtatcatctgagtatgtatatacagatatatatnaagcacatcctacacgnttctcgacactcgcacncttgcgctgcntangacacgantcgatcgagagagtacactgacagagagatctgagtagatgtgtagacgcgacatgatcagcgacagntatcgcatcgntcatacacacatcgngagaacagcatctctgaactatgacgtctgcgacagcgctcgaggacacacacacgcacttagtgcaccacgttgacgcacactctggngatcatgctacgatcgtatgttacactatatattaatattgagatctatcgtctcgttgtcgtgagttactgtgttgtagaggctgggtcagcgaagagataacgctgngcagagagagtgatgatcatacaacgtcgacgacatagtgagattgatgcttagcgcganagtgaatatgatcgtgataaatgacttctcagcttaatcctcgcgctggtctagcgtggcattactctagattaccgtcgatactagacggtgatgtagatgatggctaatatgattagtagattgtcgtaatgtgattaatgtgttgtctaagtattgaagnaagactgatatcattagtaagaacatggtctgtcacgtaatatcatgtgagtaagaagcaatcattcatntgtantggataagtatctcaccacaactcgacactatacgatactatccacgnganacacgcgcgcctcatccacctcatctccatcaatctggtcntncgtttgcacagtganggtagtntantantgaanacagtctctagttagtgntantaatatctgntgtatgtcgagtagtggtcagatgtcgctgctgtctcgtggctatgacgtcntctgcgagctcgcgatatgcgctgtagtcgcgtggagacgcgtgagtgtgcgatcgagtcacatactgctcatgtcancngcagncatcttacagtagactgtctggtgcacgtgagcgctctctctccacgtgtacacacatctctcacatatccactctcancttgcgcagatcgctagtgaccttgtactccttctgcgtctacgagngcagatcgacatcgataanagctgctgtgcttacacctgttgtgcgactctagntagcgtatatctcaagangcgcgctcccagtacgttcgatcctcgttcgagagcacgacgcagagcagtctggtatagtgtaagtctactatcatactatgcngggtgcagcg

SEQ ID NO: 10329 - DNA, 1139 bp, Homo sapiens
  misc_feature (1)...(1139): n = A,T,C or G
ttgataaaaattattnnattttattananaaataaaagtttgtagttgtatanatgtgtggatgatgagataaatatatagaaattttttataaggagtaatattttaatataatnttttttattttttttatagtattagtgtattattttttggtattgaatatatatattatattattaattaaaatgaagataaatgaaagntagatagttgggaaggagatataaaagggtgagggagnaatgtggcgaggnagttggcggacggggtgccataaaacaagatgacaaacaacactacgacgagaccacaacagcgcatntatatgagagtatttttcttaacgantgtgtcacccaccccgcacgttcttatntttatttttttaagtatagtccactatgctccagtacgcaaccgccccttcgatagctcccttactctgactcgattgcgtatgtacctcgctccacacacactcaccagtagccgaaagacgaagggacagtacgaactttccgccgacagtgcgcaaacgcgcacacacagatccgcgaaggcatacccaacattatccgtacagacctcacagcggcgattcattcctccctgagccgcacgtgttgtcgtaaaatgtatctcaccatcgacagtggatgttgacgtatatgctgggcttaacatgaaggactcatgacacagtactctcagattagcgcgactgcactcgcatcgtagtggccgccactcgctgtgaacacacactccacgcacgcgcattacgttatttaatatagtggaagggcggcgcgaaacgattaaggacctcnccctcgacatatcgccgccccgcaggagcgcaccgcgggcccgcttgcgcgccatgccgtcgttgctgagctgttcagttgcctcagcatgacgcgaccacagacgcgctgagtgccncgtcaggatgggtcgagaacactccccanttattaacatactcaccccacgaatagagtaacggagtgggcggcgtctgtggcattgcacagctctatcccgccaccgcgtccacgtcacgttcaccagacctctctgctatcgcgtcgtgagcgaccgatctatcgcacacgatgtgatgtgcactt

SEQ ID NO: 10330 - DNA, 790 bp, Homo sapiens
  misc_feature (1)...(790): n = A,T,C or G
cctagntaaatgtagcatatgaccttcttctggccaactgaatgaggcacaattttacatcatacctgaagcagagatctcgagaagatatattatgtaatctgccttccagcatcaccaataaacttctaattatccatacaacacacttaacatctcctgattgatgagccaaatccatagtaacaacctcccctcatccaaagaagacaagatcaagttctaagctagcagagaacaaaatcatatactttattcaaaggcaaaccctagctgtgtggaagtctaataaatcatcattgaatacagaagggattcagctgaaatctgtgcagtctcagatgtacagccaacactgcagcactgtccttcaagcctttgcaggtttactgctctaaatgtatcgagtccacctgggaaggccatcacccgtggtgccttgcagtctctgaggccccactacgtgaaatgtcctggtccataatcacagtgacttgactaagcacactttccattcattctttccctgactatcaagctcaagagatgaaaaaactacagagaagcaggtgaaggatcagtggaatttcgtggcaaaaaaaatcactgctggcacacacggatcaaaggggggaaaagggtgtgatctagggaaataatgcactctttcagttaaatgccctgaagtctgggaagatgagagtcaagcaggtgcctttcccttcaaagggncatatgtatggctttatttaaggaacaagagcattgggctgtgaagaattgaccttat

SEQ ID NO: 10331 - DNA, 735 bp, Homo sapiens
tgtcagggctgcatgatctttaacagaaataaataaacctcattatggcaacagaaaggtgctgacattaaattacagtctaccgtatacctggtcagaatagagatagaatcagtccctcttctaagttcggctggcactttacccatttttaagaaggaatattgcgtggtttgccaaggaagggtgaaaaaggacaaattgtaagcactggttaaaaagagagctcttctgctggattttacaattctccatgaatgagatgaatgttttgtctgtcatgctgcattctcaaatacagtcagttacaaagaaaggctcacttactcccttttaagatagtcacaccaagaagataaagaagctgaagtcacttccctaggagccacggctttgctggcaagtcaaaccaacaaacattcattgagtatctgtgtacccaggactttcctaggcactgatggaaaaatataagaagcttgggactcagtcccaggacacttaccctccccaagcagagaaggaaaactgagtgtgcctcatttagcagtctgacaaaacaaaacctgaataatcaaatgtcccttgtttcatttttgtaactttattttattttgctataatctatgtacctttggaatccattctctcatctttctaaaattagatgaatatgaataaatgtatagatagacaaataagtaaacaaataatgaaaccaaaaaaaaaaaaaaa

SEQ ID NO: 10332 - DNA, 324 bp, Homo sapiens
ggggtgtgggaggaggaggagaagagtgggaggaggaggggggggtttcatctaaactacctcatttactgggagtgaccctccagcaaccatcttggaccacaaacgtggccttcgacgatacgaggtcagggggtgggggataacacaccactaaagacattaagaattatggggggtctttttgggatgacttctctaaaattatcataccgagacctgtgtgtacctacgcttcagactctttgtttagagagagaataaaccattgcggtgtttattaaaccataaaaaagaggggggagaatggcctcggtggcctca

SEQ ID NO: 10333 - DNA, 1156 bp, Homo sapiens
  misc_feature (1)...(1156): n = A,T,C or G
tgttaccgtcttctcatatatatagctgtgacattctgacgtgcgttgcagactgcacgtgtgccgtggtgcgtattgtggcatagataatgatgtctgagagtgggtgatgcgcgcgacgactcanacatcataacacacgctcacctgcaccacgtggacagacttcggcgtgcgggttagcatcatatngaacatgtgcgttagtgtatagtagtgtatactccagtctatgatgagcggttagtatgaacacgctcgactagactaagcgaaaatacgtgtgacgaatagaagaggcttgtgagatcgctacgtcacntatcgtcgaggcatactattaccagatagccttgcaggaacgagtggtaagagtaaacacatctcgaccgtgacatagcgtaaccctctttcgcgacaatgtaaactgattcatgacagacgcgcgtcgcaaacacttgacggcttcggcgcgaggctgtcgtacggcacgaggtatagctggccacgaccgagacgcaagtgaagacctcgggatggtcgggtactgactaacctggtatagttaatcagtcgcaccttccagcacgcgacgctccctaatgatgtatatcgtagatgacgcacaataagataggttagactagataggaaaaagagagagaagaagtgtcgcaggaatcgtgtgaacgttgtatctttttatattttattatgtgcggtagaggaacgagggtgcgtgggctgaaggataatcaacgtgcagtccggattatctacccggctcaagaacagacactagaaatctcaattttggtgaagtcgtatcctctttgaggaggtatgaagtatatagtgggtgtgtagattaaaataaggggccacgcgtggacgctgggcagctcgtagtcctatgatcatagttgaaaggacgcaagccgactctcccggctcgtatcttgcctctccccctaggcggtacgcgataccactaatagagctggctaaggcatgcggacccgctgtaggtctgccgggcgntcggctgtgttctcgggttccgngtnggcggggctccttttttcttcggtctgctgcggtgtgggggggtgtgnttttttgtaaagttttgttnntnntggttttccctttcagg

SEQ ID NO: 10334 - DNA, 1636 bp, Homo sapiens
  misc_feature (1)...(1636): n = A,T,C or G
aacacactcacatctactagtttgtgttggtatagtctgtgtgtgcactctacctatgtgctgatcgtgcgcagctgcgcgtgaccgatctacgagcgnagtgancttctcttctctcgcgcacatctctgtcactgagacgtcttctctctcacttntctgcacagtagctatatatatctctcacgcgattnagagacctctgtgtgatttagtagattctgagtgcactgacgagcatagtatacgaagcgatagtacgacgtcgnnagagttcagctgttagtcgacatatacngtatgtatcaagcttctcgtgtgtatgcatacgactggagccttaacgaagcagttaaggcgcatgcatgtcatcgtcgcgcgtatgatcagcggatgcgcgagtagcttgccggtgaatatctccgtacactacgtcgcggtcactgaacacgttcaatgtcacgaatctaggataatctagggagtcgatgtcgtccanttccgcagaanggtcgacgcggtcccgactgcgtcgcgtcatgagcagtcagtgccgtgttcctgccgcggtcctgtgtgcacgtgcgaggcgcccgtgcgaacgagaggcactatataagcagatgagcggaagacgtgtaagcgagctgtctagggtacggtatgcttgtatacacgtatagtatgatgattcgatagngcgcaggcgcgagcatagagagcgacgtcaaacaagatggtatcgtataagaattaacgatgatacggcgcgtgagactcggcgtgaacgacgcgcgacgagtcgtgcaatacgagtgatacgactagaacgaancgtgatattactccactgacangcttatcggcgacacgagcagtanacagatcgatatatgtagtacgtatctacacgtctagatgcagcgtcagtcgctgagtgtctcgccgctagcgagcggagtacgcttgcttgcgatacagtgtngtatgtacttgcgagtgcgcagtgaggtctcggtanatctacactatactagtcctctgactacgctgagcgtcgtcgtcgtgcgatggcagttcncatcacgactatcatatgcgtgtactatagtcgtactcatcttgctttggagatcgtatgctcttgctaatctattctctacttagtctacgtagaatcctcgtagtcgtcgtcttctgtctgcagttcgtctatctcgccttcacgcgtctacaaggtcagtgaactcatgtcatatggcactatcgctcatacattcgctaatcggcgcggcttacgtgccgagcgaacattatctagagctgattctatagcgattaatagatganatagtggatcgtgagtgcgtgtgcgtgggtcgaggacgcaccatgctgtgcgtctgtcgcgtnccatagcgcgaactctcgccactcacctcccgtcgacgttcttgctctctacttccaggtgcgctgggcgcgtccctttagtcgacgatttaaangtcaagaactagagccgtatagctatcagtactcgcgtgcgtattcactgagtaccgcgcgcgcgtatatgcactccgttacatcactgtgtgctgcgcggcggccgggagtgagccgtgacgaggga

SEQ ID NO: 10335 - DNA, 867 bp, Homo sapiens
  misc_feature (1)...(867): n = A,T,C or G
acgaaaacggacaacggagctcacgaggatggacgagaagagagggggtctcaggttctacgaacctaacagcttggttggcaataccgacatttggactgattcccaatccaagtgtctacctcntaccgggggtggcgtgggggtacaaatactactcttattcactattcttcgtgtgagctactttcagggcatgaggattcatagacgatatatttatgaaccacttcacaaacctgagaacaaaacccaagaacaatcaggagacctcaccgtttcttcattcggggggggtggctatccacaaacgcccgcccacaaaagggagatggggaggccgcgtgggaccccagaatgactacgtagaaggtcgtcagtagtaggggtgcgccgagtcgaacgaatgggggaatatggccggaaccagcccgaacccagaagggtggccctcagatatgcgtaatccaacagattccttagccttgcgggaatctcgagaaacccgcagcccggtctcgcctggcagcgagcgagaccggcttaagatggcctccctaaacgcgcacagcttgtgtggccggcggcctacacccttgaatctcccccggcggggccccggaagtatggagccggtcccagcccccaccgcgccttccccctgcggccccattcgtgcaggcttatgcgcgacggggcggggcgacagaacggggggagccaggcgtggccgctatccgtgggagggctgtagggcgggctggggttggggcgtccttatgataaccgaacggtggtagagccacacctacccggccggggacgaaggcgagcaactgggtgcgtgctgggaggggtgtggttggg

SEQ ID NO: 10336 - DNA, 796 bp, Homo sapiens
  misc_feature (1)...(796): n = A,T,C or G
atgccacgctcgcaggcggcagggcgcttacccagcccacgagcgaacgggccaagaaacaggtgttgggcgttcgccgccctatgaaataaggatgcattcatgagggttcccaagcgtctctggaaaaccggtgctccctcctctcagcaccttaccccgctcttcgcagcctcaacagacgaatctcgaaagagtccgtaagagtggtctcagtaccaaaccccactcaaaaggcaagcgtaccacaggggtcctcccttgaggccgcggcagaccatattcaggtctatttttaatagtaaaacttagtgtattttttcatgccatgtgagagtacatatagtatctttaaaatgaagccaaacaaaggattcatttaatcacaacatatatcaggtcatttctattttgtagatagctcaaaaacacttctcagctcttgaatttggtgatgcctactactaccagctaatatttagtatattatggtcgaacactcactctcaatatccctatgtaatacaatgtttctctaaagtgcatatatctgtaatacacacactatcagttttcctaattcttcatgcgttatctatcacgtttgtcaagtggatcataaatatattgtctatgtatcctcatgtacctaaagtagctcagaacaataatagtgaagaagagcaagcaccaggaccaagagaaaagaaacgaccaggtactacacatggactggtacatcagtccagaatgtctactaccacgnaacatagtctgtcagagaacgagttaacat

SEQ ID NO: 10337 - DNA, 1680 bp, Homo sapiens
  misc_feature (1)...(1680): n = A,T,C or G
actcgngagacgcactcgtagagcgaggtagcgacacagtaaggcantcgcgtcagagcagagatgcacgganagagtatancgcacgcgcagtagtaagctagnctgtgagtactaattatgtangtagtatgcgcatganggangatctcganangtacgagagactgtctacagaacanctcgcgagcgtgatgagagtcatacgtgcgagtagcgagcgcgtgaggatgtantacggncgctcgtgatagntagctcacagagttcgngatagtaagtattaggtgtctgtaccctgtcgcgtgttgctgctatgtagcgtgcgagagaagtanctganggagcgcatcaaccgcgcgngagcgancgancatacnggcgcgcgtcnttacgctatgtgctctacgagctctactggtgagagcgcagcatgatagtagngatatgtgtctcgtcacantcactgacgtgtgtcgtcagccaccgtcacgacatagagtcaatgaacacgattagagtnanaagtctatgtctactcgcccagctcagntgcgcgctcacgtcttcactgctactcgctacttataccgtactcctactncgtatctcacccgagtcacatgcgtgcgcacacgtcgtgtgatgtagcgatgangaagcacgaccacgtacgcgnaacgcgcatcacacttcacgctgacgtctgacagatcaacctgcactaccgtgctaacgtgntcacgcgaacagcgacagcgttgctatatggtncagcacacgatacgtacggtggagtaggatgattagcagagaagagaacgagtgatcggtngcatggaggacacgcgagacacacgcacatagaacaggacaagtatcgatcgacacgtagagctagaacatcgacgagagaagagctgcgcagaacaacgatagtcgcacacgaggtcggagtgacgaggagacggcgtgactacgttgcacgcatctacgcgctccatgtctagactttaacactgcattggtcgtgatttgtttgtatgctaatgattagggtgatcgtgtatgagtggtctgttgtctgtggatgtgagcttatagagtttatattaggtgcanatgtantntggagcgagtgtcgtctgtnatatgttgttgtactgagtattaatatanacaaactcattcaccactccatattctcttcattaacaagacctatagtctacaataaagtagacacanacgacactcgcgaactcggctcaaagacaatattacgcaccaaccattcgtttatganctacttatgatcgtcagagcctgtatctcgctctctgctatgtccgttatgtgcgtgttggcagacgtcggtagacgttcgctgggcacgcacgcgatccttgctcctcgcggggcagcagtctcgancgtagtactcttagctgttcgacactacctcgacactggcatcctccagctcattcctatgtctgtgcgtcgccgtgcgatattcgccactcatcactacgtgtggcaggcgcacatgtaactgattcgtgactcactcttgtatagtactttgcctgcgctttaggcgacggctcgcgttactgacctgtgcttacgacgagaggcaggcacacgtatgcactgcgctcgtctgcgtagcgtcta

SEQ ID NO: 10338 - DNA, 1586 bp, Homo sapiens
  misc_feature (1)...(1586): n = A,T,C or G
aggcgcggtcatgctgatcgctcgtcgcagtgggccgtgcctacagctagtacataactactactcgctctcggcagcgtagaagatgtatctagaatgaaacgaaccgcgcgcgacgtggctggcgtatacagtatacaactacctagagcgtgtaaggtcaacgccaggcgngcgtgantgcacaagacgtgaagtaactgagtggcatacgtgtagactgactgatcatcgatacacaccgagctcatcttctgtcagagacgtcgcgacgcgtcgcttcgcgcctcgcctgcgcacacgcgctcgtctcgagcggcgcacctttccgtacgcatgcaactgtagatatcgtgatctagaaagtgtgcgatactgaaagacagaggaagtgctgggtatgtgtgcatggaagttgcgtgactacgacgttggagacgggaactccgtgctcgcgcagcgctggccactcggctgcaatgttgtgctgttactgctcaaggtcatgtttctctgtacagctacttcctgagcgatgngctgcatacaactccacgctgcgctcatacgctagctngagtgatcactgcgggaagaggacgttaggtgcggtacctattcagcgtcgtgtcaccgcgcgtgtcgtcatcaatagactgtgtgtgatactatcgtagtgatgacgatcgacgaagatggacactacacgtgtcctgcgccctgaggtgtgcggggcgggtgatgacgctggggcgcggcgctcgtgtgtgacgntcgagcactaaatgggtcgtgnatcctgcgttgcttgcgatctctgttgaacttcgatatgntcatcttagtattgtgtatgatgtaattagtcgttgngagatcgtatacggacatatagcagcgagtgcctgtttgagagcacgtcatgccgtctntagntttctatctctacgatttcttcggtctnaatcgtatgtctnantttcttactaatcttnntncgnactctccaatntnagtttnacttcattctgcntcatngtcatacttgtntnatctcacatatattactctcattgtctcgagnccgcaatcgtgcgtcatcctattcgcacgcgccncgcgcctacgcagtcatnaagcaagctgagctgtacgtacgangnacggcatnagcacanatctactccgtaaattagcgtagagactgatgctacaacagctagcgagtgcatgagcgatgtagtgtacttcntcgtccgtctcgtcntcttcgtccnactctctccttctactatttacttctnctctntnatntcgccgttttcgcttttatatnttccttttttatcatccttntgtgtccctacttcttcgttgntcaatntacgtcntannntnnnnnttataatntaaaanncnattnnnnnnnnnnnnannnatgtatnnnncntnataataaaaaaannntnantttnncntnnnnnnnnnnnttttnnttcttnntnnaacnattnncnttttcnnnctttccttcttcnntnnttnnttnannnnannnttttnntttttttaattttaaanntttt

SEQ ID NO: 10339 - DNA, 660 bp, Homo sapiens
  misc_feature (1)...(660): n = A,T,C or G
taattatcccgntcagttgcctgactcccctcgccgctaactacaattctctgcgtttgtataaagcacaacgggngnactccccggtctgtcctgtcncctncagtaccacgtcctcgacctcgcatcccttaactaatgccaccgctcgttcttattccctttctctgtcaggcgggtctctccttaccattccnntaccacattanaccccaccttcacaaccctctcgttccccatacnatcatnctctctactaactcttcccatccaatccctcactcagctctcgccctagccncctctcctacatattttgtncttgcaccccacactatatcatattcccatcttctatattcttccnnctgcacgcctcctctcgctcactccctttccttgntctgatcttctcttctatagccttcactcgctcactcacacctccacccgcccccactcccggccttcttaccgctcctactaacaggctcgtcnctaatctgacacgccgtgccacatccgtcatatatctcattnncctacttgatcactctctgttccnncgagcctactacgcatatacgtgcgtacatatncacgttcatccctgtatctttcccctccctctgtcccttcaatgcttccaattgatttatc

SEQ ID NO: 10340 - DNA, 715 bp, Homo sapiens
  misc_feature (1)...(715): n = A,T,C or G
ttgcctgactccccgnngngnnngggcctgccattcgggggggcttcccttttttttccctgtgcctgtgtttttccgtgtgctccctccttctctcggcttttttttctggttcggccggcccccgggcgggcccccgccttgattggttctgccctctttccccttctccttcctcttttgttttcccgggggctggttgccctggggcagggttgccgcgcgtttcgtgcttctccgctcgggcggccgtccgtctctttagtttacctagtcgttgaccgtgttccttgtcttctgttgccccccggtctcctcttctttctttgtcgtacggccattttcccgtttaacccattaaactggtggtccactgtaccccctttgtctctcttacttgtgaatgaacctttttttgcgccttcttttcacgaacttcgtcttcttttttttctgtcccttttgctcctgtcccttttttgctgttcgtagcccagcgcttttatttttcgtcctgctcccttttccacatctatcttttgattttatactgggctttatttttgcggtgcgctttcgtttctgtcgtgtgttttgagtcgttgccttttctcctatttccacggaaattatccaatatctttgattaatacttcaccccgcttgatatccatattgtgcgagtttatcggtttcagcaattactccataacaa

SEQ ID NO: 10341 - DNA, 381 bp, Homo sapiens
  misc_feature (1)...(381): n = A,T,C or G
gtttcagaatcggtccaggctaatactaatttcanaaacattaaccggaagaaacctggcctttaagaatagaggaattaaggtcctaacactgaacctggcatagagcaagtgtttggtaaatatgttctgagccaacaaatgaaggagtccaataaacaggatgacgttatttgccttgaccacctcttcttcctattaccatgattctttatgagcatgtgtgatttaggtaattgttctctaacccctatattgtaaatggtaattaagaccaatgatagaagccaaattcccgagtgacatttcttcttcaagaataataaaagttggttataacatctacccttgatgttattcacctactcaaaaaaaaaaaaa

SEQ ID NO: 10342 - DNA, 953 bp, Homo sapiens
  misc_feature (1)...(953): n = A,T,C or G
tttgttataggttattaacagtgtgttggacggaggtggagaggtctaagcacccacacaccttcggagatcttcaaatgggaccctaccactggataaattcaagatcggcagtctactatcggggaattagaggagggagggggattaatacaaaaactcctgctgataatatacaacgcaagacaggggttattttaacatgggattgcatgcaggcgaatgaagcacataggggttcttacaccaacacaggaggggacagtcggatttcgactttgttaaagactttgtgttnctgtaccattgggggggtgtgggcacacacaaacgatggttcgacttaaccacaaatgactattggaccattgccgttgaattctttttaacaacgtgagttagtgtgacgttttgactcgattgaaatgggtatagtctgaattaacgatggggtgcgggtttctagcaacgatacagacacgtgcctctccttatggccatgctccgatggttacttctcgggggctctctacgccttgttgaccatgggccgctcacatcgatgcttcccgtgaatgtcctctcgggacgtgtgcggcgctcgattatataacatgcggccagcacccttaaacaaataagcggagatgcggagcgtcatctccgtccgccgcacataccactgtgtagtgtacacgggctgatcgactccctttaaagcgggtaggagtcgttgtagtatggacaattctccttgtgatgtatttcttagttctccagagagagggcgtggtctggaggtttagtcgtcagcggcgggcgaccgtgcggtcgcccccccttctcaccctttacgggctcgctgatggaatgctccgaaaccaagaatggctcacactccacttaactctctcttggcgttcattgtgctctgcagccgtaatgtcttgttg

SEQ ID NO: 10343 - DNA, 1562 bp, Homo sapiens
  misc_feature (1)...(1562): n = A,T,C or G
ctaagaccctaccgtcacaaatatgctaaaactaaataggctgagagtatgtgtatcaatctagttacgcaccagtaatgtagtcaagatgtatacacacaacttgtagtacacttcatagtgagancactccaacatactcacacgagccacacgtcagaccacgctacatcagaacgcanaaacacacaagtgtcgcgacagattcataagatacgatgctagcaatactatcagtacgtcttataaagnactcaacaatacgtatgtatgaagtacgtatacgttcgcacacatactactaataactattcacttgtaatataatcttgtatataactatactcttcagtaatcgcagtatatgacaatctactatacagtatacatcacaatctccaatggtcgtacatcataagtgagcacatgtcttgtntgagtatcaagctcatgagtaaattatatacatacaatctataacggtcgtcctgcatctctactcgaactgcgtgaatacacatcaactaagnacaacgtagcntaatctcgtaataccatgctcaactctacctctactatcttcactatcttagttgtgtagcgaaccgaaacgcacatgtgctataccgtatatcacgtcttgtctcgaggcagtatgcncacgcgcatacaggacgctctcgactctggtcttgagcttaggactgatacggctatacctcaaaattactagacataacgtaactagagagaacagatctgaaagacacgacgataattgggacatactaaaccacacacacataggaataacgatcatcacgtaatcggagaatccgtcatccatatatgtttagtttctttctactcatctcacgcncagctggagatgcgcaatacagatgcgagacactcantacacagagagcgtatagtagcacgacagtatgtaggaagaggagataatgtgaggatagatgtantgctagaacacaggcacagagagtgagactcacgcggcagngcacgaacatagacgatgatgangtgcactgangtctacgagcacagaanagcaacaagtgacatcttatacaatgtgagatataaacactatataacaagtgcacaaactacatcaataaagtcaccaaaaactaatacccctctctatttaactaatatcaaccacgattactggagaacacatatacgcattgagactcgcattcctccagtgtncgagttacacgcagcggaaccctaactccatacagggaatactctgcacaccatacacactactgacagggagtgatctctatactcgtcaccgcgacatcacgcancgaccgcatcagacgcatactactaaatctgtnaacacatcattgcactcaatgaagcattatctagatcatatttatataggagtatactcatctgtagcctaggtagagactatacgtaatattgtttgacaatatatctagcccatcacataagaggacagtaaaacatataaaccagtttataaaccacacactacccgcgcccaaacg

SEQ ID NO: 10344 - DNA, 1115 bp, Homo sapiens
  misc_feature (1)...(1115): n = A,T,C or G
actgttgctctcgagcacttcacaatcaatgtcggtgcagtttcagtctaagtctagttgtcgcttacctaggaagaagtagtgtgggcagcgagcggcgatgtccactcgncctagttggcaacgcggttcggttaaagatagagtgactccgagtattatccacttctgacgtgtttaaatggcatgtgtgcatactgttctcttatgttacgtactgctcaagtgcgggactgagcatctggtcgccagtcgtactgaaactcacttgctttgctgcgcgctagggagtactgatgaatgngaggatgactgggtagaagtcatcgtgatatcagttgactagactgcaacgtgaagatgccctgcagcgatgttagaatagtggccgtgggtgcttatattgtgtcttgtcagaggtgctagtgcgcgttagtgcttcttaggatgagccagatgacaaagactacagtgtgcgtctggagctacatggtagcgaagctacttatgaagacgcggtcgaggcgggtcccgagatcgaccattcactagtttgtatgtgtaaatctgatatcacgcttcgacgtcgtgtagaaacactctctgtattcgcagatttctatatattgatataatcatcagatataaaatgtgtatataattcatatggaattccgtgtgagtgaggagtacaggccgaaaatcgagttggtcgttgttgcgccattcaattgtaactgacacgttgacattaaagcaccatatggtgttcgctttcctcataccgtaataggagacaagtagttttgtgacgtgttctggcaggatcttgtttgtggggggccggctgtgcacaattttggagaaagtaaatgtgcgagcgacgactgagcgccgaggatatatgagttgtattaacgcactggttatttttttcgcacgtttgtatttgtcatgggtcatgtcgctcggtgcatatgttgtggtttaatatgatttgtaacgcttacaaaaaaataacaatatggctttgtggtcctaagcggttttgttgtncgcctctaggctctttctatgtggcgcctctgtgttcggttagttcttcactcgtttcc

SEQ ID NO: 10345 - DNA, 1035 bp, Homo sapiens
  misc_feature (1)...(1035): n = A,T,C or G
agggggagtctagctgggaaggaggggggggcagggcaggagaggtttgacacccacacagcttcgaatattttcaaatgggaccctaccagctgagaaatcaattatggcactcctactattgggaattgagggggaggggattaatacaaaaatcctgtcataatatacaaccaagacaggggtcttttaacattggattccatgcagggaatgaagacatgcgtttcttaccccccacaaatgggacaggggatgaggctttctaaaccactttgttttgtggacatgttggggggggggggacaaaaaaagagagggcccctgaacccaaagtattatatctgtacgcgctggaactggtgcggcagtgcgggttttgcgatagcctagcgacacgtctagcaaaggtggaggtggtgtggtcaacgagtcgctgaggcactcgagacatggaaaagaagaaaggttcgtccctcgcccggcatccggagagtgagaaggttgggccggcgcctgtcgctattagtaggagagcgaggaatacgtagaaaagggaggctcaagaacgtgcacaagggagcacatggaatcgaggaggtggttgagtgtccagtagtttgtctgggtgaggtagcgatgggggtgtgcggccgggtgacggctaagatgggtggtggtctggctggacgcctcagcacctgatgtgacttggaggaaganagatgggtgatctcagcacccccgtggtaaggatcggcgagtggtaggggagggggtagtggtgaagagcattcctgtctatgcggatggtggaactgggcgtaagttgaggtgtgtggtgtgcaagagggtggtggtgcagatctcgctcgttgagtgtagtgtaacgaacgcgccgctctcgcggtcttgtatggcacgcatatggacgttcacggcgtcgcgaccgcggtgagtcgcgtagctgcgcgtagtgcncttaggtggtagacgggtgcgcagaggcgctagagagaggcacggagggagcgg

SEQ ID NO: 10346 - DNA, 1429 bp, Homo sapiens
  misc_feature (1)...(1429): n = A,T,C or G
cgcgagnagacttattgcgcgtacgctcatcatgtccgagactcccatcatcagactatcactagacgccaccatgtgagaactancacngtgacacaccgacttatgcgcacaagcgtgtcgagctagcacaacatgtgccgcgacacacgcgcggactcatcatacacagtatcatctcgatgtgagntagtagtataagcagcaatanaataaccgagagagcatcgatcagtatcacatcgagaagacgcacagactctagcagcatgcaccgatgtctgcacagcgcgacactctctgcgtggcgcttgtggagtacgtgagagttagatccgtgcagcatattgaatattcgcgtgagtngtcatgcgcgatccgagcgcccgcgtccgatccacttgacantcctaacgagtcgggtagctagtgtgagcgtcgtacgtttgcggccatgtcagangcgctacgatagcatgcgcaacggctcnagtctaactgcagcgtcaacactgacgcagctcgctacgcgtcgctcaccagtatcaaccactcagataacaacgagttacaattcgtagtagacgtccttgtgaaatcgcagcacacgcagtcataagaacaatatgcatagtgtgcagngacacacagtacgctaccaacatctacctaaagctgcgtcagtcaagacgtgtgatagtcttacaagacgcacctccgacancgcacgagcgagagangnatgatagctatcgcggcacgncccacactcgccgctactagcangcgctgctgtcactgcgtgtacgcttactcctcactctactgtcacatttcctctcgtctctgnacgtgtgctctcgctcgataatgatccgtctatagtataggagatgttcgttatgcatatgtcacctcgcctcgccacacaagcatacaacatatctggactattctcccccactgctcggacaatcacaccatgancacgtactactctacgcctcacacataccccagctcgtgcatctatttatattaacagtctctcntcatctcaaacacantgctacaatagattaaacgatgcaccgcagtgcgtatttatcgatcanacgcgctcgcgaccattgtgcgctgctcnagtcagactctgcgtctatagtgancgagcgtagtgcggtaagtcggntgatcgcactgacttcgtcggcgngcgtctctacttagttactgcgcacgacaaccaccctacttcaaaagatatatcacccaggtgccgtgagggcggcatatgtacttgaatatcgntggaagccctctcaccgattggaccgtccacgcatgtcgaccacctgagatcacgctgcgctcagagaggacttagatgtctatgtgcgacgtgtgatctcagtcatagtgttctacc

SEQ ID NO: 10347 - DNA, 382 bp, Homo sapiens
catgctgtcagctttgacagtttcatatgtccccggtcgttgatacatcaagatggcggtcttatatggggcattgaggaacaatggattaatccaagagtcttgtgataatattcaaccaagccagggttcttgtaacatggtttccatgcagtgaatgaagccataggtttctttggctacactaatggacagtggttttggctttctagcgtgttcttttgtggtcgtttttgcgtttgcagaagaaagatggcgctctgcccctagataatagtttttaggcagtggcattttctgcagtttgatctgtatgtgtatgccctcttgtaagtgttaattagtaataaaatttgtaacatcttaaaaaaaaaaaaaaaaa

SEQ ID NO: 10348 - DNA, 1109 bp, Homo sapiens
  misc_feature (1)...(1109): n = A,T,C or G
atgtactacggacgtacttcgcacatacgcgtactgactacatcgatactacgtgtaagcaccgctggcgatgcttgttcgacgatacacactcgaacttccgctccggctgcacgagatctctactatccaactgccgccggcacacgtatgacgaggcgatggacttcggtgtgaggatgcagtggcatatcagtgagtatatcgaactcgtgtgctagtgcatcgctaccagtatacgtgctgcggtgcgctcttcttgcgcgcaccagtggtcgacttcccgcntcgctgtagagacgccagcgggcagtaatccctactcttgggaactcgagcttcgcaccgttaaatagcgtacgaaacgcagagggcgagagtaggaagagtgtatcggggtgcggcgcgtatagcgggcgctgcgctctgccgactntgcggggcgatacggcagacaggagacggcgccgctaacgcagagtcctgtcgtccgtaccatccacactatcgtccgaccctcggatcgtgtacaccgcggcgcatgaggtaggacacggttaaaaagatgagagggagagaacgagggagggggacggggctccggggctgcgctggctggcgggtcctacttctctccggccaaataacatctacgtcatgtttttatctagccctcaacctcccttcatccactgggactagggagctgtgacagttgagccactcccgcggctagtgtagtgtccgcccgcgctcgccggggctcgcgaagtacgctgccccggctgccgcggcgctgcagagcggagaacttgctnctgggctccgtcgcacggagacgcgcagcgtctgacgcaagcagaggtgtgcgggtgagaactgcaccgacgcaccgtgcagaggacgggggcgcgaaggggaatcgcaggggccccacgcgccccgtcatcgtcttttctcttgtcttctcgccgccgcttgtttgtgcgtgcagggtttgctgttcctctttntaatcttttttnntatgggttttcttctaagattttactcttatcattccacttccttcactcccacctgnnnntntncnntcaattttccctttt

SEQ ID NO: 10349 - DNA, 456 bp, Homo sapiens
  misc_feature (1)...(456): n = A,T,C or G
atggcaggcccagtgcgggggggggggtggagagggggngganctccacacccacacaccttcgaagatttcaaatggaccctaccactgagaaatcaagatggcactctactattggcnaatcaggggaaggggggttaatacaaaactcctntnataatatacaaccaanacagggttcttttaacatggattccatgcagtggagatgaagacataaggtttcttacccaacacaaatggacacgggatttgactttctaaacactttttttgtggacatttggggggtgggnaaaanaaatatcgcccactaaccaaaataataaattttatgcctcgaattttttccagtttgagttgtatgcctatgacctcttgaaatgttaatttttagtaaaatttggccccctgcaaaaaaaaaaagaaagaaatgggctcgttggcctcaggggg

SEQ ID NO: 10350 - DNA, 1842 bp, Homo sapiens
  misc_feature (1)...(1842): n = A,T,C or G
ctcgttgtctctatcnctatctagtgtactagagtactcgttggatctgactctgtatcgctatgacnacagcgcgttgtcacgcgctgctgtctgngtctggctgctctgtgcnctncatgccaccgctcggcngtcgctagatgcgtatgctgctacagcgtacacactcacgcgcgtgagtgttggcgttggcgcacgctttcgcacgctcgcgcgngatttgagctgacgcatgnggtgtgagcttggcgcgctantgtctnnctatctatgactcgtcgagcgtcggtngctggaggctagctatcgncatctctacgaccgcacacgtctgtcgatgatcggcataatggtaggacccgtccgtctagncgcgcgcgaggctgagcgtctagctccggactcaccgccgcgcgctcggtcgcgcgcgtgcgcgcgtgcngccgtcgtatctgcgactcacggtctcgcttccacggctcagtcgtcgcgacctggcgttggtgtggacgtggaagcgcaccgcganggctcgacgccgtgctggtcgacactcgtccgctgagctgcagntgcgagcgcgcagcgcgagcgcgtcgacgngcatcgctgcacggtcaatggcagtgcgcttgatgaccgtccactccgccgccgtnctcnccatcatctgcgctggttcatctatatctgtcgtacgncccatcacnactacgactanancnccgnncaactgtcacgcgcgctcgcagtacgcccaggagccacgancnactgtcgtngtgtctctgactnacgctgcaccgtcgaggcatgtagacgtgggtgatgantgacgagtgtagctgggtctngtgtgcgttgtgattgagtcatgtgtcgcgatctcgattgtcgatgcgcgacgacttcctgntgcgcngctnccgacgcatctactctctccnctatcgcgcactctcccttcgtcgactctctcacacacttcacgtgctcgcgcgcgccgcgtctctctttccgtcgcgtctcctctctcctcctctctcctcgtgtctccttctnnccatctcgnctgtccgcgcgcgccggcntgtgcctggcttctgtctgcgtgcggantggcgcgatngtgcggcgtnagagggcgcgttgcnggcgtgcgtnttngacgtgagngtctcgcgntctcgncncgctcngttgacagagtcttagtcgcagcgnattcacatcgcacactacttctgcttgtctcgctcntgtatctcgctacttactgctcgtctgcgctgctactcgtgcgcgcgactcgtctgctcnctcgtttgtggtgtatctgtctccgtgtgggccgtncgtatgctctcgctgcgtcgtgctgtctcctatctttcgtagttcatgcgtcancgatcgtgcnctgcgagcgcgactacacgcgctgcgacatntctatcacgtgccagagacgtggctcgcctgctgcgcagttcgtcgagcatagatcggtatcgctactgctncgttggccacgtgatcgcgcacctcgtntcgacactcttatttgccgacacgtcngtcgtcnctgcttgctntgctgtcatcgcctatcgctctcgccgtcagtgcgntncgacggcgccgggggtggangttctncctttcntttataaaagaanttgttntntnnttnttnntctggtgttttcntccttactncaggggtttttatttttttntnnantatttacttctattnnncctctctccccatcnctcanattctcgcgcnnnntannntnnnnntcttttatcntcntnntnttnttctcttttttt

SEQ ID NO: 10351 - DNA, 133 bp, Homo sapiens
tgacaaccaagcccatcctgaagctgacatcccatcaaattgcatgacaaattgcaaaaaccactaacccacaggctagggggggtgggaaatacaatttaaataaaataattttaagtgaaaaaaaaaaaaa

SEQ ID NO: 10352 - DNA, 248 bp, Homo sapiens
gctagaactttccctttggcccagtgaagatcttcatctagcggagagatattaacatttatgctttggcttacctgacgctgtcctgtctccagtattgccttaggtgcctccatcagtgaccgatctacttagagaagaaggccagccaaaggaacattcggctaattgtaaaatccttaagagggaaaaataaataactatgatttttgagacctaaaaaaaaaaatcataaaaaaaggggggaa

SEQ ID NO: 10353 - DNA, 876 bp, Homo sapiens
tttatttttctccgccctctctaacaaaacaaatattaggttagacgacgaagagaccgcaacagtgccagggggcaacctaccactgagaaaccaagaacggcagccaactctgtgtgaattgaggataatctgtttaatacaacagtcctgagataatatacaatcaagacagggttccttttaacatggatcccatgcacagaatagaagacataagttccttacccaacacacatggacagtggatctgactcattaaagactatctttgtttttttttctgcatttggagaagaaagatggcacactttcccatataatagtttctatgcctgcaatttttcgcagtttagacttgtatgcttatgactctcttataggctcatttttattgaaacctgttacacttaaaaaaaatattaaatccggcctctgttgtactaaagtttgacactttgcctttgcttttctttagtaagggcttcatgcatgatcctcactcactgactcgattccactcggacttcccggttgtttctaccggttttattttccttaaacgctgttattacggttatacccagattcatcgggatactgcaggaagtatattgtgaacaatcagacaccctcccgccaccataccctctatacgctcccttttttgcttcttttactaggcccctccctttctagataccattataatattttcccttacgttcttgtgtttatttttgttggtatatcttataattttcctattagcccgtgtactcacttgttatctattttggccccctcttcctttatctttctctatcatctttttcctgtagtaaaagtaagactcttctatatattttttagatg

SEQ ID NO: 10354 - DNA, 1721 bp, Homo sapiens
  misc_feature (1)...(1721): n = A,T,C or G
ctcgcacatcgtagntcacgcgactcattgcgtacgcgacatcggacacgtgtctcgcggctcgtagncagngtganatcgcgcaggactcgccgcctgcgtnacacacgtcacatctcattgantgctggccgctgnctgacgtgtagtgancgncgcatcgagacgtctacacgatgcgnatgcgatgagncgcgctgcctcgcgtgcagcgtagcgcgacgcattctgactatgtacatgngcacacnacacagtgtaatcatgctcgcgtgtagcatngntgcgtcgncagcagcgcgncgtcacgcggccgcgagcgtgacggcgtgcacgcggctcgcgcgcgagcgacggtctggcgtanagatgtgggaggagacgtcgcgcagtcntntatngctcgctcccgatgtatcccttccacctctacgnnntcagcagctcacatacatcgctactctacacatctatcctcaatgagcgagatatgtgtcacnacaacctacgccgactgcgcggccactgctgcncgtatnctgactctcgcgctgcagcgccgactgacgcagtgtcgtgcgtgtagtactgtctggtgatgcgagcgatgactgtgtgtgtgcgtcgctncgcgaccgcgtatcacgctccgtcgccactcctactctcgacagtcagtntctagttcgcctacgtactgcggtgntcctctaccatctaccactgtcagtgtntctagtcgctctccnagtcgtgcaccgtatggaactctgcgtgccgcancacgagcacgatcgancgtcagtctcgctatgatnacgagcgcctgcgcacgagcgcgcgctgcgtacagccgcgncgtcgctacatctactatactcgcgaatacttaatgccangctaactaacacatatgacgangcgggcgtgtccgcgcgncactgcgcctagcactatactgactccacgctactatctnctgtcantctacctgtactcanatgtctggcttgcatctcgcgcacgactgcagattggcgtctatcctcgagcaacacatactgacgcgtgttgctgagtgtgnagcaacttctantacagtcgacggcggaatgctgtgttgtatgatgngggcatatccgctcgtgtatactggnntgtcgccgtngattgcccgctcgcatngtgatgtcgcgtactcgtcgtctagtcccatccggcgactacgaccttccttagagagctcactctgtttgtcgtgatcgggttcaagacgtgtncgcgngaccgtcatcgggccgattcgcgtgcgagcgaagactagcaaggagctagtcgggcagctgagactgtcgcagactantccacacgagnaactcagtctcgtagaggtgtcgctgatgttatgatgtgtgtacagatattatgataattcacttcacgcntccactcggcgcagtactgcgtctcatcgacgcccagcgagtggcaggcgcggctgcggtcctcctggcttggtaatcgtctctcgtcgcctcgccgtntaccgcggcggagtacgtncgcanttccacagaagtgttgannntnnntnnannntggttccattcaacacaaaaggtaacnnntcaactgtnnncaataacacatancctcactcactctaccctacactctgnccnntctnnccanntacccnacncntntcannccacaaaacc

SEQ ID NO: 10355 - DNA, 598 bp, Homo sapiens
aggctcacacatgtgatcttttctgtactgcaaaggcgactacactgcctaagacacccacctattgattctcttccgtgagatacacttgagtatgttccagcctctttttcttgacgaactgactgacctaccgccttatggaatgactctgagtgctaaatgacacatatatatataacacatcgtttctgacgacttctaccctacgtgatgcaacttgctccattttgaataacatcagttcctcggaatattgacttagcaacttgagagactgcaattcagaaataactgtctctttaatctagttcaaagaaaattcttaaaaaatttgtgaaatgtttctttatatcagtttaatataatgtattatttatactcagaagataaaatgtgtttttttcattttctaccacagaattcaatactttataaactataattatagacaaatttctcagaaaatgaaaagtaattgtaataatagcagttagatagttacattactttttaaagccttattgttcaacagtttataagggggcaatatgtaattttattttaaatgaagtaatacatttggttcactttaaaa

SEQ ID NO: 10356 - DNA, 1788 bp, Homo sapiens
  misc_feature (1)...(1788): n = A,T,C or G
tgcgctcgttctgtcgcatctacgctgcatactggcgccgagtgacgcatctactttagctctcganactcgaccgcctcctcggtcgcgcgacatctactatctccatccgtctcgtgctgtcgagtatcggtccatcgtacgtnagtacatctgcgtcngngccgcatctctcgcgtctcgccgtcgtgncacgtcgatgtntataacnttcaatagatngtgcgcgtatacgttnagacctcgacagtcgcgacgcgancgctgcgtcgagtnantacantcatccactagcgtcgcgccatgtctgcatcctctcggtgcggtaccgcatcaacgtgnatcacagtaccagctgncgacgctcggcatgatcgtccgacgtacgcacgtcgcgactgtgaanactctgaggtgacgtgcgtgtcacgactgtagtacagtaacgcgtgctcatccgagagctgngtcgcgcgcggngcggcgncgatagatccggcgtgcgtcgcgaggtaactgcgcccgcgtgctgcggtgtgtgcgctgcggcggcccagncgactctacngcagctacactgcgtctgtcgcagatcgtctntcgatgtgcgccgcncncgngtcgccgtngtacgtnagtcatncgcgcgatgacgngcgttgcgcgccacgcgtgcatcgtcgtagtgtctcgcatgtgtgcgtgacagactccgtaccgtgcacggcgtagtcgcatctgcacatgntnagacgctcacgcgtgcgtgtagacggttgatcgtacgtgcgtngtgcangagcggagacggccgagatcagtgatcgtcgcgctcgagcactatacatagcgacagcagnctctatgaatcacgactaccatatcgtganatgcatcgaaacgncgcgtgntgagagacggtggacgangcagggcnattgctatcactctgatgntnntctcgatncgtgcttcacatncgttctaactancntcttgncanncgtnactgcgtgagctgtcgctgtctactactgtgcgtagctgcgtcggcgagtngggagctgtcgatgcagtgccgactgtacggcgtcgtcagcagtgcgtgcagggcttcatcttgntttcgntnggttgcctggttgtgtatngatatagntagataggatgctatcgctctgtacagtcgtagatanngntggcgtggctggcatgacctgagtgtgagncantcagngtgtgtctgatngctncgtattcagctcgtgntctntcatatcgtgctgcctgtgcatgtgtctgtngtgtggtcacntctcgcgcntcgcacacgtngtgtgcgccgtgatcctgacgtacangccgcggtgaccagcanagattcgtatggtggcagccagatgcgacgagggcgcgcgagagntacgacgtnatgtctagagcttatatgctgctgncggcactcatgactcngacgacgcagtcantangatgntctactntgcgaagnngagaggcttacgggtagagcttncntcntncgctccgtcgtggtnatgaaaatatgctgtgtatngtnattcatngggnttcgtctagtntntngcttncntctagcgtgtccnagnggtttgtntgntgntnnctgcgtgttttnttgtgcttgatnntntntcgaaagnnnngcgtgggtttgctntcctnnncannagggttgtttntnccctcnantcttctgaggggnttnntttntncttctntttnttnttntatatntctatcacacnc

SEQ ID NO: 10357 - DNA, 324 bp, Homo sapiens
ctaagagaggaaaggccatgtaagaacgcagcaagaaaatggtcaaactagcaagagaggcctcaccagataccaacactgacagcactttgatcttggacttctaacctccagagctgtgagaaaattaatttctgttgtataagcaatctagtctgttggattttgttatggcagcagaccaaactactagaatgtgttttccaagttgttgaattcaagggaagtttggagacactaaaaacagtgtggatcccattagcaaaaaatgaaactttttaatgtattttttatttttaattgataaaaaataatcatataaaa

SEQ ID NO: 10358 - DNA, 812 bp, Homo sapiens
gaagcgtgcatcccagcaaattgcatgacaaattgcaaagacgactaacccacaaccaactcttctggaaaatacaattgtaaataaaataattttaagtgaagaaaaaaaaaatcccactaaacacaaaagccgatgggaaatgaagggccatcagcccttacaacatgaacttaacattggacttggggaagagctggtttctggtcgttcatctgtttatagaagacagaaggcccgccacttgcccctgctgggggaggcgtgctacctgcctcgcttttggggggcatgaataatacccccacctctcggtatggtggaccgagctcagtccccgcggcgacaagaggtcttttgcctgactggcggtagccgggatcatcccggagtcgggtgccccttcgcgctgattaagtgtttattccacgggcgcgatactagcgccgccctcgttgccccccgctcggcctagtctggtttttcttctgtggggccgccgccctctcaggaagtgataaacaatctgagcccttcctcattggagtgacttgcgcccccgctcaggcctatcaaaaacgtcccgggtattcccctctcgacgcgcttttggccggttttccttggaaccaggcggatgttcaggcaaccatgtattcgtctccgctcttggaggatggcgcaaccccttacaaggtccaggctgcttgactcttttcctcggggtgctcccttatgccatataggtggtaaggccatacatacatctaagtgctacacaggctttcttgtctatatgaatggagtgcgtg

SEQ ID NO: 10359 - DNA, 1720 bp, Homo sapiens
  misc_feature (1)...(1720): n = A,T,C or G
acagagagggctatgcgaggtgcggtanactcgtcgttcacaagagaggcatactagagtcgggtaaacncgacgtcacaagatangactgtanaatctgnacgagtcanatngnacagtgtctgctactagccatagncagcgagagagagcagcgagatagctactagtggagtgttntccagagagtggcggcgtcagcgagatgcgngccactgtcgtgttgtcctcgaggagcgtaggtgtctatgntcctcgcgaccaaccgatctacgatctcagcagnggtactgtcnccnantagataatgctgatcccacgcgcactgcacatctatcggtgcgcccgcgtatgcgtacgcagagcaagcaccttgtggagcgctgcgctccatacttcnaccaccgacgtgtctaaggttttcataggcacacgtgagctgaancaagcagcgacatgagtgcgtggtggtgacgganagaagtangagctaagagtgagatancaatatgatcacaggctngagtactntagaatagggatcgctcattcangtgcatctncacgccatcaatgagaacagnagtaatctgagtgaacgggctgacgnacacgctactnataaactctctatgaagtgacatctactctctacacgcgagtgcatngcgagcacancgagganctactgagacgtgcgaggcggcgaagggcgagncnaagtacgattagagcgtcacacacagcggtacatacacccgtatacacacaacatatatacattcaggcaatcaagtcagtctcacgcgaggtgtctctcacgtgtaatcctcagcacgcctgtttcgacttatctcagattcacagcgcagagtctccacacgntgcactcacactgctagtgtcatatgtgcgtcacacagatgacggtncacanaacagacaccacgcgcgccacgtggtacgcacgctagtaggctacacgacgatgtcacagacacacgtcctcgtgagnggcncacgaggtgccctnctacgcgatgcgctgcactacggactgcattagcttactagtagagtccaattcgtcagacacccatcagcagccgcagccnacgaggtgtcggtctccacagagcgctggtcccgatgtgactntctctacgtcatggagagaattgctagtggtcgtccagagctatgacgaggcagatggccccaccgcgatgtatgagnnnctgcgattccgtgctcgcatnccgagtgttctatagtatagctgttcgcatagaccgtgccntcgcgtgcagattcattgatcgagattgcgatggtgattatgcgtgaagcntatacagcgagtagtgcgcccgcagcgtagtgtcgcacacctcgaaagngacgtaagtaagtatccatagagatgtgatatctaccacgggagtgagtaacatagtagtcatggttcacgtagncatcgtgagtagatgtccatctcaccagtagcngtcacaagtgcgntcctcacgacgcgtcnctcagtatgtgtcnnctanctgtggagaacgctacacatgcgtctncatcgatcgacacgcnacgacgatcgacgactgnnctcagacgcgagacgtctcacatacagcatctcgagctacactgagcgtctccacagcaacagtgcgtacacacgctgtgcgtggatgtggtctcggtctct

SEQ ID NO: 10360 - DNA, 994 bp, Homo sapiens
  misc_feature (1)...(994): n = A,T,C or G
cacacttatgagtacaagtatctgccattgttatgtttccagggaaacgtacaggatccggcatttctgtacctccaaaagatctgctccttttgaagactcacacccccaacagcttctgccacagcttattagcaataagagtcacagtttacacttgttttgcttgtccctccccccgctctgttttctttgtaagggaagaagaatgaactgaaccaatgatttgttaccttaggggatcaatacctactcccatctttattactaacaaaatacaaccaacctctggcctcgttgtgatcagaggacgagccttgcagtcaattgcctttattcagggataatacatgatacccgctccttaacactcttcacttccccctagcgtatatgtttattcggttacttctctctaatccagtccatctattccttcttacacacaggcttcccaccgccccacatcactgtcccagcctccttcgctcccttactcccccctccccatcatcacgtcttctcttctcgcatctttcacacatcttcgtacttccttacgatactaacaccgtaacatccttcgggtgtatacggcaggcatgatctttacgttcgctttggtccacgctgttctggtgcgccccggtgagcnctctacttatcctccatctcgtccccgagactcgcccctagttgtagctcgcgtgtttctctgtatgtctaagattgagtgtcaggtttatagtttgtacggtaccgtatgtagttagtaatgggtctccgtctagccccaaaatcagataataggtcnaccgttgtctctttccgtttctctactgttttcactaatcttgtgtcactcgttgtactatatttaatcccccacgtgcgactcccacttgtcgtccccttcactcctcgctcttgtctgcctactctcgttgctcctctaatttcctctgtgtctattttgtttcacgtcataattact

SEQ ID NO: 10361 - DNA, 928 bp, Homo sapiens
  misc_feature (1)...(928): n = A,T,C or G
ctttcagggcagaccggnatcagagaagcattttggcagttgagcgggcgatgtggagaaccactactggccaagcattcccaacctgacagcagaacagaagtacagcagtgctgaggtgaacttgacggagaactttgagaccatgaaggcaaccatcacttccaactcatcacaacctgcatctcccacagatttattatagaagaactcaaccatctctgtgtcaacaagaaatggtcctcactctacaccatcacccttggatttcgatcatggggctgttctgtctttagtatggaactgaaaactttaatttccacaaaaatgtaaggttttgggctacagccttactaaaacaaacaaatatgagcataatggtctacagatggaatatctggggctctagacaaactgctacttgaaagtataatcactctctttctgcttgtttctctaccctggcaggacaatgtcacaaatttccttggtcatacagaatataaacattagcccaacagaagcagaatcaaagctacacactatctccgggcgtatttgcttaacgataacatacctgtcgggggctccatctcataacgcccggccggctaccgtccatttcaccccgctcccgtcaaactgggactaataaatcggccggtacaaaccggcattaacccgggagattaggttaagctcgtacataaatagcggtcgacgcccgacagaacaatcaggttctgtcaaaccacattctcttttccacgcgcgacgcacggccgccgaactaaccgcgccatcttagccaccgcccatatacgaaaccgccctccgtccgacccgcgcaccccgccccctccaccctcggaggagatatcctaccacgcctccgatgcatgatccttaatatccccccatcccgccc

SEQ ID NO: 10362 - DNA, 995 bp, Homo sapiens
  misc_feature (1)...(995): n = A,T,C or G
ttttnaaaaaaaaaaaaataattaacttttttttgtctttttcactttcccataaccatccatctccttcacccacacccattattcacttttcctcccctccccccctttcctccaccccccccaaaatattagtaaccactcccattgctataaccaaaaagtacacactatctcccactatctttaccaccacacctccatcatcaccatatcctccttcttacactctcttatcctctattcttttcactttctttcttatcccccggccttcctcctctttctatcgccaacctattactcataccctctcnnttttatttttactaacaacaataaaaatatttcaacaaccacccatacaataaaatatacacaaatctatctctacactccccttttttttactcaaatccatatcttctaccttcttctctcatatatcctcctgttctttcctccaaccaccataaacatctctcttcttctatactcaatttcttatttattatcccatcctcacatcccaacttccctttactaccatccattcttccccacatacctattacccactcctatttcttgtctgactcaccattaccccctctcccctcctcctcctctccttcactccttctcctcttacaccatcataaacacacaacaactctccgcctcctcaacatcgtcccacccactactcatatattctctcccttaccctaacattatatatatattatcccccaactccctccctcactatcatcacctacatatccacacacccaaccaccctctcactccataccactctaactatatcacacaccactctcataatatcacacttcccaaacnctccatttataacaccatcccatccactacccaataataatatactctattgtatataattaatccgaccactctctcccacaccattctcacactctcatcanactccatatatatataaacacaaa

SEQ ID NO: 10363 - DNA, 910 bp, Homo sapiens
  misc_feature (1)...(910): n = A,T,C or G
gtgagtatgtccattgaccaggttaaagaagaacacttngcctgttcgctgctacccccagcttttttgcgctatacactctgggactgattcccaggcctattgtctacctgggatcttctttcctcttggtgctgatgctgctattcttcactattcttgttacgagctactttcgatacatgaggatctatagacagatatatttatgaagcccttcacaaacctctacgaatacggaagaagagttaggaaaactgatagtgtgattattacagatatacgcatatacagaaacagtgcattacatagtgatattgacagtgtgcgttatgaccaagaaatactaagtacaagctcctattagaaggcgtcaccaaattcaagatctgaaaatattcctgagctatcttcaaaataaaaaagtctccatgtatattgtcatggcatgaatccttcggttgcccttcgtctttagatactccttgggctctgcgctgggatgcataaatcaacctatctttgcccatcgcaaaacaataaagcaaagactggccttgtgtccctcatcagctgagatctttgagatccgttctcctgtaatgggagggacaattacttgttcctctctccctggactcgcatgagcttggcctttacgggttgcggtaaggtgtttacagttcacttaaacggttgttctacggttatccccaaaattatccaaatatccccggtcctatcctttgttccatagggcccccctcacggcccaaaaacctacaaaatggcacctcttcctggcttttttcctaaagattcccgcggccgtatcgagcattcacagcgtcgcccctctacatctcaacctagtgacgccatagttcctctttaaacatcctccgatggc

SEQ ID NO: 10364 - DNA, 1322 bp, Homo sapiens
  misc_feature (1)...(1322): n = A,T,C or G
acttntatatactattacatgtagctcagtggattcaaagagtacttctagtactnttactctatactgcgcgtgctctcacatgacctggatactacgacgtcaccactgtctgtgntccccgcatngctcccgnttcgcgactactaacatctcatcgtcgcagttttgatgcgtgtgcagtcaatctcgctcacgcgccgtgacacacntgtgacacgcctgagacagcgcacgatcacgaagcncagatgcaggtgcgtaactatatacagtcatcaccatactcgcgncgccacgctcgtatgtcttcgtgatggcgccggcgtagagatatgactgtgaatggtatcgcgacaagaagttgtggcgataccggagcttctacgtatggcccctgccacatcactctctcaccttcttcgtcgcgtcggcgatctccgtaatacttcgacggagacgtgtcttgtatcttggtcgctttcgtcgctttcttgcgtttgcgcgcgcctcatccttgcctcccagtagacactctcattcgacaactagcactcgatatacgtacctgngagacacgtgcaggacgacgcctagacgacccccacaccgcggatccgattgtcatagagaacagactagtaagacaaatagttatatattatgataggctagttagactgcgtttgccctgctcgattgcgtgcttcatctctntcagctgcgacatacgcttgatcgcttgaatatcatgtcttagtccacgctgtctcatactatcgtgtctaatatcactatatagtatagagtagagctgttcacatgtacggtgctagagtaggaccgatattgtatatantgtataactatactcattatcgatcattatagtaggaacatgtatgctgttgagagtctcctaatgtacatcacgtgcgatagagcatatccacaactgtagcttcatacgtctctttgcatgcatccaaccagttgacttagctatcaaacatcacacctcgcccttactgagcgtaactatccaccatgtaacatccactccctcttggtgtaattgggcgacatccgctgaagtcagctccctatcggagtaggcgtgtcgcagaacctagtgcgtgagggggccttgcatgcgcgtgctccccgcgcggcgacccgctgttgtcatattgggcttccgcgggcagctcttcccttagggaggaggttgcgtcgtataggcgttgttaagcgcctagtctctttaagacttctaccgtaaaatccgacccatacgtcacgaggaccctccgttgcccgca

SEQ ID NO: 10365 - DNA, 733 bp, Homo sapiens
tgtggcttgtatcgctgtcagtggggttggtgttggtgtgtggtgcgcctctgggatgctgtggggttttctgatggagtcgggaggctgggcgggcgcgctagttgagggtgtacacggagctgctacgagagattttgggggtgctatggcggagtggagatgcatttagttcaggagtctctcggggccggggttgtgtaggggtcgactatattgtattgggtgttgggagagttgtgtgtgggttttaaaaggacatgggtggttatgtcgcctggtcagggtgttgccatggtgtggtttatctcttctagcccctgggatgattttatttcagtgtttgggtttgggcgccctctggggcccgtggtttttaggggggaatttttatgtgcccctttgcctgcctcgaagagtacgtgtgaagggtttgggaaattttgagtgtgtgtttttcggagttatgcctatacagaaaccctgtgtttcaaagtgatattcagagagtgtgtgtttccccaaaaacctctatataagctaaaagaggtgggggtcccccaaattacgatgtgtaaaatatttttttgctatctcccaaatagaaaagttttctcatatattgtgattgaaaagaacccttgtgtgccctctgttttaagatactctatgggctctcccccggcgcgtaaaaatagcgtacatttttgtatttcaaaaaaaaaaaaaaaaa

SEQ ID NO: 10366 - DNA, 1163 bp, Homo sapiens
  misc_feature (1)...(1163): n = A,T,C or G
agaaactgagatgtcggttgagatggtgatgcataccagaacactttctttggtcgtggagggtcatatcttacttactatagggggtttagctagtaatgtatatctctctttatcattgtggtttgtgtggtcttgtgctattggcgccgtgacgacaaggtgtggaacctggggtggtactgcggcgtcgtatgggatcttagtgtgtagtagncaggaatgctctgcgtgnccctatgagatagcgagtcggggagtgggtcgaattgggcgctatgagctctactcgctcagnggccctctccttacccttccattctttgnggtcagtgtgagcggggctgcggcctgtgactgcgtgtgtgcgtgncgcgttggggcggactcgcgagagtcatcgccacgggctggcgngcgttttcgtcttctgtggtggtgcagttggccggatctaggcacttgtatatgggatatgtagaggtgggatcttcgacacggtgtgcatcgtgatgagacatgattgggtgggtagtttggtatggcactgatggaggtgtacgacacgtcaactcccatctctcattgattatctgtggcagaagctctgggagctcttgctctggatggaagaacggtaaccatctcagtagttttcttgcggattttctcactggccttcttaatctacgtacatgtggtgggtcactttgcggacactctctcggcgctcttactcttacgcgttnngagtgtcctcgctatctcctctatctcgtttttttttcttgnnccactcactccaccnnnnncacaccggccctctcactcgcattgtntattctttngacccttcgatgtgttgtgacattgggagggtagtttctgctatttaagcgggagtggtaatttctgaccctctttggcttatgcacttgaaggtcactattagttacttacccttctntctttctgtnttcttctttcttgtttttactctctttcttcttnncttctatcatactttcctcctgctctcggttcgatcttatacaaaaacatgtcttcctatnncgtttttctcctctaaaacttnttctcttnnccttatctctcttnntctcttatttcactctctttnncctttttnnnnttnccctttt

SEQ ID NO: 10367 - DNA, 273 bp, Homo sapiens
ctcagttttggtaagaaaataaactgacaaacccagcttcttaactgcttagtggtctactgaggtttggatgaaacagagagagaataacatgaagaagtaccagctgcattcaaatatatttgttgtcagggtagttacaaaatttattttcatggagcttctgaaatataactctagtatataaggggtatactaatgtaaaatgccaaatttaaaatgacatttgcagataataattaaaaagaaaattgatgtgtaaaaaaaaaaaaa

SEQ ID NO: 10368 - DNA, 795 bp, Homo sapiens
cgtctgggatggaccactaccctgacatatcaacacggcaacctactctcggggatcgtggaaagatgtattaatacataactgttgtgatcatatacaaccaagacagggctcttgtcacatggatcccatgcagtgaaagaaaacataggttacttacccagcactgaaggaccgtgcatctgactccctaaagacctaccttgtgtacatatcgacactcggagaacagagagggcccactaacctcaagatagtgatatgcctggaatcttttgcagctcgatctggatgcgtatgacctattaaaaagtacatcataaatagagttttgaccacttaaaagaaaacataaactggccttccatggcctcatcgtaggagctctagccccccttccctcttctgatgttagattcatgatcctagctaactgactctctagactcggtcattctgctggagcgaactggatcccctcatgcatcgcggtagtcggttttccacaattcattgaataccgcataaataatcatgcgttccatactgcccccatagggccaggaaccttcaaaagggccgagttgtttggatttatatcataagcggccccccgtgacaacattaaaaatttcacctcagtacaagtgggagaaccgccggactatggctatcaccgcgtacgccggagttgccttccccttcctttcccccctgacgataccgaaaactgttccctttctccttgggaaccgcgcactttttttaactcacccggggtatacccaggacccg

SEQ ID NO: 10369 - DNA, 962 bp, Homo sapiens
  misc_feature (1)...(962): n = A,T,C or G
aggagcgttgagggagaaaagaggaggaaaatacaaaagaaacaaataggtagatggagagagaaacatagaaagatgttgcgttgttcaaatagaacttaatgaaatcagcttattaagaagttttacgtctctataggtnccatcggaacaaataatggaagcataagtaaagtagaaataaatctgtaacgataagagcagtgctagatgaagttgngnagagagaatacagcaacgtaatgggtgattgtgggatatatatgatatagatagggatttatagtggagcatcatgtcgtgnaacgagctaataaggagcgtttgggtgtggacttggtaggaagtnagaatgggaaagatctacagatgagcaacgggataaagtgagactgatatgtcgagaaacagcataaagaataaatatagtaaagaggatgtaaagaggaagaataatatagtaaaataaaggaaaacgaaagatgttcttggaaaaatggaaatgacttgaagcaggagtgagaatgcgagtggagagatcgggggcaataaataatgtagaactatgaatatgattcttagttngctagtaaaatcccatacactcatgtacttgtnaactcatnnacaactgccttctttcgttgtcacttntaaacaaaaaatcactaatcaaattattcannacatatcaatatnnaaaccaaaaatacataaaaaaaataaacaccatgaatttattaaanaaacatcaaaaatcattgaaaaaaaaaaaccatacctagaaagaaaaaacccatatcacttttatattaaaccttttttcctctaattcctccataataattnaccatattcatttgtaaatggtagggtccaattaaaattttccanaaaattttctaaaaaaantnatttnnaattacaaannntatttatnttnntaaaattnnnnccccttt

SEQ ID NO: 10370 - DNA, 1017 bp, Homo sapiens
  misc_feature (1)...(1017): n = A,T,C or G
tattatattattacaacacatgagatccaataacagtattttcattttctttcgangccncacaggtagcacgaacggagtctccaggctagacangctgatacancagccagcaagnattatcgatcgacataattagcaaacgactactaccnccacaagcctacgtgggtgctggaaaatacaatttaaataaaataatttgagatgattttcacctgttttcaaaggacatgatacgagttaataagtgttaaatttaaaaaaagactataatgtgcttattgacttttcatcattattgaaagaaaattttatcaatgggggatgtagagagatgataatatcttaattatattatggctatttcccgttaatcttagaatacgaagaagaggtaaagttctatttgtttacgactcaacatgcattagtgacttagcattaatttgatcagagagcgaacttgcgtgcattgtaatcttcatatgcgaagttacaaccccaatattgaagtaagcttgtttttatgcatattctcgatcgtgtctaaatgatttattagagttacgagtttttatttgcttctggtccacactcctggagagtattatgtataatcaagcttgccaagacgcttcactcattttaatcttaagagatgaatatgagtctctcttgtcacatgaatctaattcgttcccgcatggtatgctttatgtaagagcgtgtgtattaggaagtatattaagcgattcgcctcgtcgttgatgctcactaattcactagattgatatgtatgagttcttgattatggcccctctttatcctgaagtataccgataaaatatgacgggataatcgtctacctgaattcgcacgtaggggtgctgagtgttagagtgacgcgttgctcgagctataatctaagtcgtttagcgcgccgtagatnctagctaatagtatgcgttgaggcgaatcagcgtgtagacgagtcgcacatcagcacatgaatat

SEQ ID NO: 10371 - DNA, 990 bp, Homo sapiens
  misc_feature (1)...(990): n = A,T,C or G
ttttgtttgtagtcccgtgtgtcgtaggcgcatcatttcgataccaagtggctacctggtagcttctttcctcttcgtcctgatgctgctcttcttgcctatgcttgttttgagcttcggggcggggagtgggatttatatacgatctatctgtgaaccactgcacagatctgacgcgaatcggtgtgtaagagtctgggaatgctggccggggtgggtcattatcagatgtcatccgtcctaggagaggacggcgcgttagtaggtagggtgagcgtgaagggtggcgtggtggcgcgggagatgggtagtctctctttgtgcgccatgtgggatggcggaggcgccgtgggtgcgcgcgcgctgcgggtgttgattgagttcgtctgtgcaggtgggcgagatagtgcgcggccgcgatattgttggtgcagcgtgcatagtggggctncgtattagcggcggtcgcggctcgtttggttcgggtggcgttgcgtgctgggttcggagcgccccgctcgggattaagagtccgattcgtaaattgcgtcggcgcttgcttcgagcgacgcggctgtgtagcggtgtggcggtgagatttgcgtgtgggcggtttggggcgggccgcggacgagagatggtgagagacggggcgcgcggccggcgagcacggatgccagcggagtgggggagggtgggagagggttgtcgggggtcgggccgattgcgcggcgttgtgttggtgtggggtgacgcgggactgggtgccgggttagcgagacggcgctggtgggggttgctttaggtgtgtggtgggatagggcgaggggggacgcgggtacgcggggtctgcggcgtttttggggtttatgggggttggtgaggaagaagcgtggggaccgttggtgagctgcggtgcatggtggttgtaacggcctgcgggtggggttattggtggtctagtggcgtgtcgaggggtagggtttgatt

SEQ ID NO: 10372 - DNA, 907 bp, Homo sapiens
  misc_feature (1)...(907): n = A,T,C or G
gtatgtgtcacgataatgttccgangaggggatcccactttctatnttactgtgaacctaacagttatgtttgcaatagagacatttggactgattcccagtccaagtgtctacctggtagctgcgttccgtgttcggcctgatgctgctcttcttcactattcttggttttgagctactttcggtacatgaggatttatagacgatatattgatgaaccacttcacagacctcaaagaaaacgtaacaagaattaagaaaactgacagtttggttattacagaggtggggggtatacagaaacagggtagtacatagaaatattgggagggggtggcgggaccagaaatactagatgtccggctcgtggtgagcgggcagtccgtacgtgcatgatcgtgaaaatatgtggggaactatgagcggagagaggtaggggattgatagataggtggtataagaggagggcttggcggtgagttcagttcgaagagagtaggacgcgctggaaccgcggggtgagaaaataagtcagcggtgagtaagaataggcaagagcgcgtgatcaaaccggttggagagtgatctaggcgcagaggcacagagcggggggagtacgaatggggcatgttcgcagacggcgtggtcgccgtgaggcgacgggcggctgcaggggggtacgacgaggtggcaggggtcggaggggcacgaccgcggggccgtacggcgcgtgtgtggaggggcggtgttgcgtgccccatatagggtgtggcgcgtgtgtgtgggcatgagcgggcgctattcgggatgggggggcgcgtaggtgcggccggaagcgagggtgactgtacggctgggggctgggatcaaacgcgggcgtaggtatgaaggaggctgcgctatgaat

SEQ ID NO: 10373 - DNA, 732 bp, Homo sapiens
aagtcttctgaataatcaccaactttgggctctgtccttcatccagtgactctgcccacttaatccagtttaagcaagaaccctgctgcatcagtttaataaaaatccttcacacttgctatctgaccattctttttgtttttgtttttgaaatggagtcttgctctgttgcccaggctgaagtgcagtggcgcaatctcggctcacttcaacctccgcctcccgggttcaagtgattctcctgcttcagcctcctgagtagctggggttacaggcgtgtgcctccatgcctggctaatttttgtatttttggtagagacagggtttctccatgttgtccaggccggctccaactcctgacctaaagttatccgcccccctgggcctcccaaagtgctgggaccacaagtgtgcaccaccatgcctagcctatctgatccttcttgatatctgatcaaactccttatcccccaccctcaatatcttgtcacccttgcctgccttacacagtaatcctgccaaggtggtttagccggaatcccaacttatccctggtgttttctcttagtaattttccctccactgacactcaccatactccttggctataaatttccactggtccttgtattcagggttgagccctgtttctctcccttactacaaaaccccattgtcagagcccaccttgaataaagtctcccttaccatctttaaaaaaaaaaaaaaaaa

SEQ ID NO: 10374 - DNA, 132 bp, Homo sapiens
caggagggtggtccttgtgtgcgactttttatattactttgtccgagattcagcatgccagtggaaactaatcaacttgggcctgggtgcatggaagataaataaaaaatctcaataccaaaaaaaaaaaaa

SEQ ID NO: 10375 - DNA, 429 bp, Homo sapiens
  misc_feature (1)...(429): n = A,T,C or G
tcagacttctctgtctataaagctaacttctgggaggctgaggcaggtggatcacgaggtcaggagatcgagaccatcctnggtagcgcggggagaccccgtctctactaaaaatacaaaaaattagctggatgtggtggcaggcgcctgtagtcccagctactcaggaggctgaggcaggagaatggcgcgaacccaggaggcagaggttgcagtgagccgagatcgtgccactgcgctgggggctgggcgacagagcgagactccatctcaaaacaaaaaaaaacaaaaacaaaacaaaacaaaacaaaaagctaacttcttctggtcaggtcattggaatacttattctattttagggaatgagagtgttctagattctggaattgcgataaagcccagtgagattttcaactaaaaaaaaaaaaa

SEQ ID NO: 10376 - DNA, 949 bp, Homo sapiens
  misc_feature (1)...(949): n = A,T,C or G
tattgtggtgcgccgacgaaagcgccaagggccacacaatttggcttcaatattactcggnacctaacagctatgtttgcaatagagacatttggactgattcccagtccaagtgtctacctgatagctggggtcctcttcgtcctgatgctgctcttcttcactatgcttagtttgagctactttctgggacatgaggatttatagacgatatatttatgaaccatggaacaaacctcatagataacgtaacaagaatcaggaaaactgagagatcagttattacagatataggcatgtagagaaacagggagatacttagtgatagtgagagagggtgatcgaccataatatgatccgatactgtgccgagtcgtccggcattggataatcgcacaatctgagtagtctgcgtaaggctatgctccggaataggaaaagttcgaatgtttatatggcctgtacagatcccagatcacccaccggaaatataatgagacgttaaactactcggtgtaatgatgatgcttacgtgcgaccgttgcgagcactcgcccggattgcttctcgatcgcgttatgtgtgataacggacagggccgcgcgcagctcatgggatcaataacgaggggtatggactattagcacctcgaaaggccagtaacacgccgctagcgagatgggtgccatatcgcgggctgtgagccactgatagcgtgagtgcgcatacgcgaagctcggatggagaggtgggtagaacggagtggatttaccacgccaacactgagggagaggagcgcagtgagttcgcccgaggcggccgcaagagcgaggtatccgtgggatggctgagaataagtacggcaaccaatatgtatatatattgccactatcgcctacggtatattcagacgagaactgagttcgtgttaccataccgacgcggaaag

SEQ ID NO: 10377 - DNA, 737 bp, Homo sapiens
agtaaaggatagtcccccctatccacagtttcaatttccatgttttcagttacccacagtacagtacataccttcaatatagtacaatatttgagagagagcaagacggtgtgtgcatgaaagagttcccaagcgcatattcacataacttttattatagcatactactatcattgttattaatctcttactgtgcctaatttataagttaaagtttatcatagttatgtataggaaaaaatatggtgtatataaggtttggtacaatctgcagtttctggcatccactgaggagcctggaaattatccccacaaataagggaagactactgtatatttggattaaggcaattccttcctgtttactagccctaaattataatccaaataccaccttaatgtggtacatttgctaccaaagacaaataaaaatcatattcagaaaataaaaaattatatcaatattttttgataatacttatatccatttaccatgatctaaatagagaaaccacaaaaagggaaaaatttaacgttttacaatttctacaacatctctatctttactcaaatatttattattggttttatgattattattccagatcttttccctcctcttccatatttaatatgaatcattgcctacatactaatataaaattacaaattttgttttattgatatttgctctacatacatcattaaagctttattactaaaaaaaaaaaaaaaaa

SEQ ID NO: 10378 - DNA, 898 bp, Homo sapiens
  misc_feature (1)...(898): n = A,T,C or G
ttcagagacctgattgataaatgctagcacgtgtacattctcatgtgagctcaaggacagagcttgccctctcctcactgtctgcagtncgggggccaggcaggacctgccatcaagtcaatgctgaaaatgttggccacacaaaaacatctgcaccgtcggaaggaacagaagcttcagaacaatgccctgggcttcaagatccaatggaacctttttccgntgaacgccagtcttgaatccaggtgcgtcttgatttcaaatgtgggtcctctgctgtatcatcagcgctcttggggcgtcacggctggcttaagtataggggtgagaggagagcccaattgcttctcagagtgggtctatctgggatcgtggtccgttgcctttgtccgtgctcttgctattttgaaggtttattttcttgtccctgcttctagcggttggcctcgggttctggagatactggtaaagatcgccctctacccggcctacgtggggagctgggtggtgctgtctcctggatttcgcgtgtgggtcgcttatattgagaatctgtgggtctgagcgcgctccgtatggcgtgctgccttggggttgagattttcgtcgagtattggctaagatacccgagctgtggtggtcgcttcgtgtcggggtctgtatatcgttatattttcgggggctgtcgcgtatcttataccgcgcttcatctatcagggctctgtcagcgtggtcagagagtatggtttggtgtatgtttgcgccgttcgttatcttcgttgtgtgtatgtcggattgggtgtagtacatcttggaagtgtggtatatttgtttcaccgcgcgaccattctatttttcgtctcgtagacagttatgcgattgtggggcgggtggtaat

SEQ ID NO: 10379 - DNA, 984 bp, Homo sapiens
caaaggcttgaatattttgaaatggaccctaccactagagaaatcaagatggcaggctactatggggaattgaggagaaggggattaatactcgagacctgtgattatatactaccaagacagggtgcttttaacatggatctcatcgcagtgaatgaagacataggtattcttacctaccacaaacgggacagtggattcgactttctaaagacttttcttgtggccgttttgacgtgtgggagaagagagatggcacactaacccagataatagcctttatgcctcgcaattttttggactcttgatgtctatgccctatgatctagggtaatgtcatatatttaataatactgactacgacgttctaaaaaaaaaaagcaagggggcagctgggtgctcataacgtgggactctggcgatgcgcttactctctcagagattggtggatttattgattgcacgactccttgaaccttattggccacgggtctgggccgcgtagcgcgtaggcgggggctaagtgtatcttgatatgatggtctggggggccgtcccgggagatagggtgatgacggagtgacaaaacagggcgagcagataggttatcccttagggtgcctatatcagttgaaaaggctgttggtcttggcgagaacatacgttagagtggtgggtttctcgagagcgctagtacaatgtataggttctctggtggcgagatgtcggtgtggcgcagaggatcgcatattgtcagttgaggtgcgcgctctgaggtttacagctctgatgtcgcaggttatcaccggcgcgaagatcggcgtcgtgtcgcaaccgcgagtgtggcctgaccccgcggggaggacggaggtagataagggtggcagataatggcgggaaagctatgggctgccatgtcgtcggatgctatgtgttgaattatttcagagcgcagagtgggtgatcggtccgcgcggatcgttc

SEQ ID NO: 10380 - DNA, 1352 bp, Homo sapiens
  misc_feature (1)...(1352): n = A,T,C or G
agtgatctatggtattagagtagatgagcggacgagtagcgctcatctctcgtacnagacatcagctaagagatgcgcgcccgtcacgtaacccgagctacgcacagtntgtncgggcgctgttactcgcttatatatcgtanacctaccatcgtcggtcacgtgtggcgagtgatgagtcgcacagagcgacgcgtgggactctcagggagacacacatgatgatagntacagcgtatatacacagatagattgctacggcggaganggacaactcacagtgagcatagcctctccacnanctatcatangaggacgagcangagcatgactacaggtgttactaggagcgacacatcgcatgggagagacactgcgatcggtatattgttagtagcactctacgtgagcgagtcacggactcctcgtgggacacatcagctatatagnagaatacttagtatacgatactaacanacagtaatacgtgggtcgctatagcgcctttacctgagtctagaacgctgatgtcacagatcgtcacanggaacatancacaacactgatgangatacgcgatacacgcgngccacgcgccacgcggnacgatcggncgacaccagtccgagcggtgctcgaatagcagaagagacgacgagtgatgggaacattctcgtatgatacgtctgcgagtggnagcacgtanggnggtgaaactgcgcgagaggactagagagggacacgacggacgatggccacgcgcctatgcgtggaaatctaagaataatgagaaanaacaacataacaagaatgccgactcacgcgcgngtncgacccgcttcctctcacctgtgccccactctgagacatagtgtgngacaacacataagaagcctgacataactcacacacaacagatacgcgcatcgnaacaacagaaaattgaacaacgcataactatacgaccatacaccatcnacactcanaacatacattnacnacatcatgataagtactaactataaacganaccaccagaatagaagacaagagacgcaacgtgcgcagngacttcacgtaccatgacatacttgaatggggctttgtgcattcacttctgttgtcggtattacttgtgtgttggaatattaagacatacaaaaatctancacccatttctacatgtttccttttttcattcttctntntctttttnnctccatgtcttccttcatttttccttnnccgcttttctncctccatactaatgtccctnctcttnnttgctttctcccttntaaggttatttctttttntcatccatctcncnnnnnnncctccttcttnnnanc

SEQ ID NO: 10381 - DNA, 1021 bp, Homo sapiens
  misc_feature (1)...(1021): n = A,T,C or G
taaacaccaaacttcacttggactatgaagggagatacaagtagcacgagacaacgacctctaaaggcctttaacaaaatatttaggtagaagacctcagacgctaatacgccatccaatatttgatatgatgatacattgtcacctcggggtaactcaggccatagagttgcgaagaatgttttagtaagtgtagattacaatgtttggcctcaacaatacgactgaacacttcaccctcccatcacagtttgacctattctatccggaaccnacactaaccatcgatcaaacaaacacatggccccaacggcatcacactctcttaagagacattgaatcatataacgaaataaatatactaacgcaataggtaaagggnngcctatcgcttcctctgaggngtcatgtaattcgtggacactattgactgggtgatctactaatanaagagtatgaggaagatgaagagcaaaggaatagtgaatcaaagatcatataaagtctacctacacatctagncagcggagaggaggagactccagcatttatctgnaaacataaaataaaactaaatcacagaacgaatnaacaaacatggacacatanatcaagtttatagcttggcttcaatcataaacataaataaacacctcaaaacaccacttcatatcttatnaccaaacacacaaataaaatcctccaacttgcccaccttaaccatcatcacctctcaattgaccccctcctcncctccaacattctctatnaacgaaagagcagatatattcctgcgttttaattctctatantcacatcacttttnnnctnctccctacnnatttaaaactctttcctcagctnngtataaaataaacaaaaacataanatgaacctnngnngtacatacacactggtgnnnnntnnnnnccgtnaaaagtnnnctnnncattnnacttnnntcccttnnncacncatactntaannnnnncnaacttntcttcctnnnnacttcctcttt

SEQ ID NO: 10382 - DNA, 695 bp, Homo sapiens
  misc_feature (1)...(695): n = A,T,C or G
atcctataaaaggacataccttcattatttacataatgtgaggtgacatggtactatatcaggaggtggcttatcctatatcgtatattagagtcatctggagacgttaacaggagcgggggggcgtggtagcctggatggagccgttgaaaatgatgaaataaaacatctatggacgcggaagatgagataaggggaaaaattggctttgggcgatctcaactggggaactgcgggcgccgattcccgtgaagtgaggggtgacgccaggagcccggccagactggcctagttgagcgtagggagtgcggcgtggcgcagggcctggtcacgcgcactctatgggattggatgtggttaggtccggtattgacgggaagacgcgctgaatcagcgctcgagcgaagtgcggaggctgagggccggtggcactgaggcgggcgggtgtcgggggggggatacgagggcgctcggccactggcgagcgccgagaagaagagcgcgtgantggtggtcgtggccggcggggaaaagcgctgataatgcgcagtggggtgtgggggtaggacggctgggccggtcactcgtgccatgacgaacgcatcgtgatatggatgtcggcggcggtgtagcgccggccgacggtgtggcgagtgccagtacgacgtcggagtggggcgtcgcggcgtaatagt

SEQ ID NO: 10383 - DNA, 1089 bp, Homo sapiens
  misc_feature (1)...(1089): n = A,T,C or G
ctgtacactgggtntagtagatcgtgagtcatcgattaaattgactgtagtatgatagcttgctcgatcggtcatcaatactccacgggatgtggttggtcattttatgaatattactaaatcatcttatactatttggtatccgtattctgatcatatttagcaagtgtaagatcgtggtcggtgggagttagagttcggtttgtcgttggttttggtagtggatactatacacgctgcgtgatgaagtggttgtggctagtatcgccattttagtgtgtctttctgagtcgattacatcgggggcgctcatgtttagggcgcgtagatgtcctctctgctcttctttgnggttcgatgtgaagccattacggacacgtaatagcgtgtctgaatgggtcatactatattgtggnntgtatgcagaatggatgaaatgtagaagcatgtgaattatagttggtagtattcttgagtaagtaacgtgggattaggatctctggtggggcgtcgtggagtcggagactgagaggagtagttatgtgtgttgttattttgatcattcttgtatgttattttttatgtgggtatcactttgttatggngtgatgtttttatgtttatatctcttctcttctttgtctgtttcgactcatttggctatgtatnctaattgtntatctatacgtttatattttacggtggggagtgngtgtttgaaattgggctataggtctatgtnattatgttgggtgtagtntatgtatttgggattggttgtattatggcgatttgcggattggcttgggataggtgatgactatnccgagcatgatatccggacacagggatggcgggaggtggattagatcattgacaaaatagaggagaggtatatatgtgatttgtatgtttggggtttaacctttacgctctctgcgccgagaaccccacttgnccccatgtctccgtnctcactctcngaacgatcgtaccancataaatagctnnatgnnnnnnnnnnacttnnnacctaaaannnnnnncnnnnnnncacnnncnnnnnnnnnnaccccccccttttttccc

SEQ ID NO: 10384 - DNA, 187 bp, Homo sapiens
agcatgcaatcaagcacttgacgagacgcacccggaaggcgaagagggaccttcagtgaacactgcatgcggtttcttctgacattgcacaaataatcatctttggcaaaagcagatttaaaagacaaaaacacgtgggctgggaatttgcaaataatctttgtttgctataggaaaaaaaaaaaaa

SEQ ID NO: 10385 - DNA, 833 bp, Homo sapiens
gtgctagatctcatattcgagataaggaagacttgaaacatcctggagttatgtctctttccccgtagacatagaacgtcttgcaaagctttttccaaggactcaccatgctcttgaggtatataacccagggttctcagctgtgatgcaagtgggccggctttccatatgccccccgtcttagcttccctgatccttcgagtactgggggggggtggaacctagcttctttttccctttgcctatctgtaccccatgagctctcttcctatcacacacaaccaaaagcggccttcggggcactgactgagcccccccccacccccccctccccttcacccacgggcgctgcctcatgcgccgtccagtggcggggcgacggtggcccggtccgaggcccccccggcgtgcggttattgattccgaccctatgttaccgtgccccggcccgactggacccgccgccgcgcgcgcgccaccccggcttgattgtcacttggaatgcgcgcgcgaccgctcaagttgagctatacttctctttcctcgcccatcttgcccgcccttctcgccccgcccgcctactctgcgcccctgccgtccctctgtgggaaacacctggcggtatccactcgccgctttagggacgcccctcgggccctccgcctgcctatcgtgtgctactccaagccggcgcgccgcgcttcttgtgtcgtgcctcgcgccgtccgctccagtccctaatccacacccccgcgcctctgtgcccgggcacacgggtcaatgcagcgtagtctgcccctccgcgcgcacacggcggcgtatagccacgctgt

SEQ ID NO: 10386 - DNA, 237 bp, Homo sapiens
tagtttacatctggaagggatgaagagaagtcagctttgtggcgatcaacaatgtccacactactggcaaccaatgctcaggcccctgccatatgaaacgcctgttttctcttcgctttctaccatgattataaacttcctgaggcctccaaggagcagatgccagcaccatatatcctgtaaagcctgcagaatcatgacccaattaaacttcttttctttataaaaaaaaaaaaa

SEQ ID NO: 10387 - DNA, 675 bp, Homo sapiens
actactttccccagctgtgcctattgcaagattccacgtgctctcaaccattgtgatatttggtgtgtgatgaacatttataaaggctgccaagtacttctggagaatgctgagagcttccagagggtgtcagaagcttccagaactatgaagcaaggagacactctaacttaaaatttcatcctctatcttatccaggagtgggcaaatttcttctattaatattaaaatgacatccgcaagcttatctatgttttcatatttgtcctgtaacaaagaggagtagttagttccctgtgtcttctgttaacgatttaccattttaatgcccatttcaactttgcctgtccaaatgtctcattttccatacattttatgtgtttattaattatgtatactttttcaattcacttttgaaattgtacaattcttttatagttataacctatgctacttttacacatttttatatgcaattaacatccccaatgagcgcaattccattttggaaaaatggccagggcaaaaatcagtagatatatgttaagttggtaatgatcttataatcatggctcatcttataataactatctattaatttccctttcccccttaagaagtattgtctatttgcaaaaaataaagttaaaggacacatgtggaaaaaaaaaaaaa

SEQ ID NO: 10388 - DNA, 756 bp, Homo sapiens
  misc_feature (1)...(756): n = A,T,C or G
gctgaccagggactattccaggatttccacacacatgacttcatttaatctccacactcttcttgtgaaatgactgtttcttatccccattgtgctgaggaagaaactgaagctcagaaaagttcagcaactagttcaggatgccacagctacaaagtggttgagttgggacttgggctcaaaagcctgtgcgctgaactgccgcagcccagtggtgaaatctggatcataggggcccncaggaggatcccataaggactaaagtgcatcctgaggggcgtgtggggtacagggctggtgcttgccttgctggtagtggatatcggtcacgatgtccttgcgcataataagatcccgtaggctgtcttttattcactgtcaggtgtcctttattttaattgatccagtagccactctgtctgtcgacgttatattacattgtagcgctccgcagatggagggcctgagtaaattagctggctctttcgcttccagtgacctgctccccccataccctgcctagctgcggcggcctactccctaaccctggcagcgccttgaccggtcacagcggcgccttcgtcttcccatctcccggatattggttaacctgatgcagcacgagcagtgggacgctgtttcgctgcgtaactgcctgtgcgattgggcgctccgcgcctacccactccgtgcttcgcccctctcttcattgatttttactggtatggcgctcggccgcgcacacgcgcccggccg

SEQ ID NO: 10389 - DNA, 836 bp, Homo sapiens
aggcggtctaaggcctcacaattgtggcgcccccgtgctgccgcggcctcgtactcgagagcagacatagcagccatgtaacaaccctcttatgatgacagtgctgctcaaatgtctatctgagaggaagttctgttgctataccaaacaaccatacttatctcctgaggcagttacaggaagcacagacaactgacaaatgtcaaccaagtacaccttttcacaggccatgcaatacaagtaacttttgttcactaacatgagatgacagattaaatagaaatatggctaatagaattattttccttactggataattaagatcacacaaaataatgtttgttaaagggccttatatctctaatccccattaagatcaagtaataatatatattaaaaagtaaattaattacacagagaacttgccagtacttctaatgactaaacatagtagtgtaattagattctgctttttgacaaagcaccatgaagggtgctttcacattatttatttaactgcttttaatttccatgaatgcccagtttattactttcattcaagtctcagacttgcttatctaatggaatagaacccttctggagactaagaaaggctgtagcagagctgaattaaatcgatacaatttttattagctgatcaaaaaataaaaggacagagtggtatgtttaggcctcaacggtggaagcttcgggtgccgtttcactatgcggaggtgatatactaatgctagatctatgaatgatggcgttagaacggtaggctgagaaaacggtagagatgactgaaaggccttaacccgttatgcgaaacttgg

SEQ ID NO: 10390 - DNA, 879 bp, Homo sapiens
  misc_feature (1)...(879): n = A,T,C or G
atccaatccgcgccctcatattaggccccccagttataccgacccactcgtttganggtgaaacagatgccacacgcttatgtctatcgaacctgatctcgcccgccaccatatagaggcgctgcttaacacgactatgcagcatccgcatgacagatggacggccactgatcgtctgctttctatatactgaccgtgactgcaatgtcatcctgcgctctccgcatcgataattcattcctatccattccttatctgacagagagccccgtatgctgggcctgtccatggtacccggacaccaaatctctatcatcgtcgtgcagagggaaagtctgaccatacctccgtctctctgaccacaaggcattttacctttcagactttgtttaaactatgaccgaccaaaaaaaaaaaatgacctcctatgcccacaatcgctcagtgctctaggacgaatacattcatatgaaggatccgatatatatattaaataacggaatactctgcactacaacataaataaacagcaaaaacccgcctccacccactacaaatgacccaccagctgctctcttccaaatttaaggtctaacaaccccaaagtaacatcttgatcctgctctccccaatttgagatctctcgatataacgcacatctacatatagagatttcacgtaaagatctcaaccgatcaacgaacaaacgaccatttcatcacccaagtctatggacgtcaatcactaaanaattccaccctgaactcctatgacactgcagtcatcatacttacctccaacagaaaaataaaacaaaaacatatctctatcaccggaccccatcccccgcacattttatgcaaatatgtactacatatt

SEQ ID NO: 10391 - DNA, 349 bp, Homo sapiens
taggtgaagatcagcaagaagacaggcattggcaagccaggaaaggagggcttaccagaacccagccatgctggcagcatgatctcagacctccagcctccagaatggagagaaaaagaagaggaggcaaagacacagacgaaacacaccaaaggatggccataggatgacatgggagaaggcaagcatcagcaagccaagaagagggacctcagaggaaaccatatctgctgataccttgatcttggacttccagcctcctggatggtgagaaaataaatttctgttggttaaaccacccagcctgagctgcctaatacaggttgatttgttcacaaaaaaaaaaaaa

SEQ ID NO: 10392 - DNA, 2043 bp, Homo sapiens
  misc_feature (1)...(2043): n = A,T,C or G
cagctcgtacgatccgagtgtggagcgtgggtcacgcactcgcggctccgcatgcttgtggagagagnatagtgtgtgatagcgcacggtgagaatggtatgagatacgtatagngaactatgcgtnatgatatatagatngctagcgtgtgatagggtngtgctntcgtgatgtactcagtcgtactagtgctacatnatttatcgacgntgtacgagtggacgtatgaggtatggtatgtcacacagatgagatggatatctcatgtcagtactgtcatacgtatgtgtgtgtgatcagtcgtacactctatcatcgcagntagtatagcgctagtgtcattagtctatgtantngtgtgtgtgtgagtattaggagtacgtgtgtgatgggcagtgttgtagnaccgtctatggtattgagtagaatagcagatgacgatatgtaganctggtgtactcgagtgttcgctcgcatnacatgttgcgttgtgaatcctatacatctaacactattgtattctgtacttaatatcaatatanatatgttgggctcgagagctgatgatagtatgtgtgatgtatgcgtgttcacagtagtagantaatatgagattgatcatatagtagatacacgagtgntagttgatgttactatcagtgttgctgctgtgcggtgtggcgatgcgcggagttgtgatgaaggatgtcgatgcgtgtgatacgnagtagactgagagaacagctcatgagtaaagttgcgtagcacgcctngcatgncagaggtggctagtacggatagacgtgatcaagagtgtgcacgatgtgatgatagagatatgnacatgatatanagcgactcagcagtagnatatnttagtnttactcttacntgactangggagattactgactangttagntactgtgtgctgcgcgagncgancgctgngacaggatgctccgntagngactctacgancacgaacagtgntcacagnacagtcgcacngcagacancactacgtacngcataatgatgntagatcgtcatatgtagaganatgtagtangtagtagcgtgaaggatactgtatagtagtagggngtgagtcgncatagtanaancatcgacacttanatactnancnacagcgcagcgatgntngcntgcgagatgatcagtggccgtaatatagacgagagcagcgncngctgacggaatcagagacagtgatcgtcatggctgcgggcggtgtgtggacgctgagtgaggatggggacggcgcgcgtaggtgtcgtgtggangcctatcagtcacgagcgagagatnaacagacagtcaatatagagacngcganagngtagagagtangacgnangggatgctgtcgtatagangatgntaggtagatctgttagcgatgtangtatacacgagagtctgtgntangtgaggctgtgcgtagctgagntctgtctttctnatgtngntcgagtttaatctgtacanatngattcgttcgcactcgtcttctattcagtgtgtaatgagtagctccgcncgctatgagtgggcgggacgatgcggtganaaggtggagttgtgngntgtttcgtgtatgactactgacgaatgangatgagnggtactgtatatcaagatcgagacaatgcgcggctgctgtgncntngctcactntagtgantgtcagnagagtactacgctcttgagagtggttagcggtggagcgagcgcgtcgcncgatatgctgtgtagatatactggtgtagtanctatcgatgtgtagtaaatctacntacgtctattctgtgtgatagatgtatantatatacgaagaatanagatatgatctataagtagaagaggtanataagaagagatgatgcgcacgatcagcagatcgcgtgtgnatgtctgtagtagtctgaggatctcagtntcagatatagtgaatgatgtgagatcgatagggtnatgatgctagngaagatgagtcgattatagagatgatatgaaac

SEQ ID NO: 10393 - DNA, 1012 bp, Homo sapiens
  misc_feature (1)...(1012): n = A,T,C or G
tctagcccaactgtgnataacattagttcagaagtcagaggccaggccgccccccctgctcgggcagcacacaacgcacatcctgaaggaggtcctgagatacgatgacagggccatcggggagctgctcagcgctggagtggtggaccaacatgtaactcactgacaaaggaaaagggctcttcctcataacctcgatccgaatacactggcaaaggcaacactttgcttggacccttctccccagttctgataccactaagaagaagatttagagtaactccagatttcttacatggcatctccagaatggctctggtattaatgaatctagtgccttttaaatgtatcccacgttttgttccctaccatcttttttttcagatgatgatttcattatggatttgtgggattttttaaaaataaagaatttaatttttttttcctggggaaaaaagaaataaaaagattgggccctcgttgggccctcaacgggtgggagcctctggcgggccggtttcccctttttaattgaagggttttaaatttcatgggaaccccttcgcttccacttgaaacttcggcttgggcgcctccggggtccgttttcgggccttgccggggacaaagccggggtaatttcaggtcttcaactttaaaaaaggggccggggttaatttaacccggggtttaattcccccaccaagggaaatatcccggggggggggattttaaacccggcccaaggggaaaaaaggaaaaaccctttggttgggaaatccaaataaaggggggcccccaggcacaaaaaaaggggcccccccaggggaaaaccccccggtaaaaaaaaaaagggggtcccccccggttttgggctttgggggcgggtttttcttttcccccctttaaggggtcttccccccggccccccccccttttgggaccccgaaggccctttccctccctaataaaaaatttccaaaaccgccttttcaaaagagcctccggaagg

SEQ ID NO: 10394 - DNA, 193 bp, Homo sapiens
ttgaagagcatattcctgataaacacagaatggatcctcttcaaaaggaagaaaaaagtccttcccatcctgtagatgaagctatccatctatagcaaaggtggaaacaaatctagatgctgttatgtttccaaaccaatcccaggaaatgtaaagaaaccaataaaaattaatctcaccaaaaaaaaaaaaa

SEQ ID NO: 10395 - DNA, 248 bp, Homo sapiens
gtgtgtgtttgctcctgcactgctctgcggtaggtttgacgcgcggcttgatcaatccgtagattttgcagagaacgaccgccttcttaccccttatcctcccgtccgcgtgctcccctgcattaagcactcgcaatataacccactcacaactattggcccctccgtttggtccctcagccgcgccggcacgcctctcgcctgtgccagtcttgcccctcttagttgcaggcgttatatctgatgta

SEQ ID NO: 10396 - DNA, 1867 bp, Homo sapiens
  misc_feature (1)...(1867): n = A,T,C or G
atagtgntgntatgttagagtngatggtgtgtngntgctgaatgactacggacgncgangaagntagaganataatgtnganccattgagagtcagctaggtcatgacatgtagatacgntaggangtagcgtcgcacgtacgngtcgtatactancgagtggatgactgagagantgcagcagtcgnnagatangtntgacgngttgatgagcagtgtatgcgcgagacggagagtatgttantgatcctgtctgtactcctagtctgctgtgacctcgtgtgatgtgaatgtgcgcatgtcgacntcgagcgatcgagctgttcacgttctgtgcgcacgacggncgctcgctgcgnaggtatgagttagtgtgcgtacacagcntatagacgagtgatgatatactcagcagtgtattatagtgtgagttctagcttcgatgactggtatatgtatagcgagatgataagtgagtccagcatctgtgaatgcgcgagcagtgtgagcgagataagagtattactggtgacgaggatacatagatatatacaaatcgtggccctgangcntgatattgtggtgttagcgtgaatctatatatgtatatatanatgaagtcatgttactangtgtatgagtctgaggtagtgcttgtacgatcactaaatgtgagagtatataacacaagtctatagtanggtnacgatgactgagagtctgagctagngtacttgagcgatcacgnactgctgtcgcgtcgctcacaccatgctgtgacgcgcgcacatctctataccgcactctgtcatcacgtagtgcgagtacatctcntgcgcgcgtcgtggatctcgtgactgatgatgacgcgttaatgtacgtacgncgaccgantcggacgtacatatacagtagcgctcggcgcgngcganctgccgtctcagctgngcactatctcgatgttactgntggtcncgtcggacgtatcagagatancagagccagtagtgcggcgcggatatgtgcagaatcaagtctacagagtngacgcgcnccgcacgacgtcacgcgactggcgctagagtgcagaccgcagtcgagcagtagcgacgcgtgcgtgcgaccgaccgctgcgggcncgtactcagtagagtcgtgcgngaagcgacgcagtaacgacgacaatagangcaggagcgactgatcgtnancgcgactgacgcgagagagatgcatcgccgcttcgactcgctgcgctactctacgccgccatgcgagagacgacgcgcgcgtataggcacaggtcgannaatagatgatgcacactgtagactcgaggtgagacgtgtgattgatcgactgcagtgagagagcgagactgcagcgcgcagtgtcgtcgtacgnggtgagtctgcgtctagcgcgcanatcacgactnagcctatcgtctgttcagaggnatgtcgagtcaggcaaggcagtgagagcgagtcgtaacagncgtggacgtacgcactacnaaccgcagtagtgcacgacaagagtcacatagcgctggacgcgcgacgcgcgacggatatgacgacctatgcgncgacggatgcagagctcacgctatgcttatgttgcctcaatgacatanagccaanactactctggacgntagcacgatagagggataacgaganagccngaagattcggtgcgagtgagagctgcaggtacgcaatacggaatggagctgtaccgcgcgtgtactcgcgtatagtgaaatatatgtcgttgtgtaatgatagtgttcgagagatgaagagtgagcaagggcgaagtcgagagtgattgaatggtggttgagtagcgaggagag

SEQ ID NO: 10397 - DNA, 1264 bp, Homo sapiens
  misc_feature (1)...(1264): n = A,T,C or G
ctatccccccccccgccagttcgccgtccatgctcatgccctcttggcttttccttgtaccatccttggcactccaccgctcctaggttcctgtggccttgtgaactcagcgctgagcgactttacattatgaaccatcctggccctccccttcgcgtatcttcacagcgcgtctagaggtctcgcggcatgcgacactcaccacctgctaggccttcctcctcgcggactttctaaccttcgccacgcacacgcccgtatttcgctgngagatctctctctccaggccctagcgatatacctggcgatcgacaccaacatcccctcatatacatacacagccttccctatcctaaatacatctacactacaataggagagaacaanacaacttgagtctttcttgtttgcgcaccctcagcccggntagcgcagccatcctcgtagtgcccgccttccccctcttcagaggcagcggcttatatctccatccgaatcacccttcgtctacaacatagacctcccacctcgctcgctctaccgcntacgatttcccacgctctgctccagcacacgactggcaattatctccctccccctcccaaacgcgccgtgttatattacacgtgactcatctctcctcatcacccnctcatcgtgactcccgctccaacctcaattccaccacacgcgcgtgtcctcacactcacctcgtcctatcccggcccccatccaaccccccccacagcgagccatccttacttctccccgcacacccgcccacccatttattgtgatctcttcatgcttctctctgtctccaatcacccgccccaacccaccgantattcacgctattacagcaccgttcacggttacagtgcacacctctcacccagtatngatccttatgtacaccaatctcgctctcattgtgttgtgatccccaccgcacagagctaaccatacaggtgccagcttcttacccttggtgcaagaccacctgacgcgagtttacacaggatacacctggcggcggccttcttcttcccttgcggagaaagcggcggggcctttttcacataacntcacacccttgtaagggaatnttcaagttccggtgtgtaggcccgtttcacttcccaacctccgggtctttgtgacacaaaaccacccctatataaaccccagaccgctgtggacttaatcccggggaattattgtggttgagtgccaccccgggaagaaacccacttatccgcct

SEQ ID NO: 10398 - DNA, 1062 bp, Homo sapiens
  misc_feature (1)...(1062): n = A,T,C or G
aacgacacaccacaccttcagcgccgcccccgccgctacatccctcattccccctccatcagctacgacacttttgcacttccccgcactcaccagacggtattcatcccaatgacgcgcccacccatgtctacccctcttcggagagctttcgccctcgtattctaatcgatcgctcgcaatcaatcaaaaacgtatcgcttctgtttcacgcttttttgaaaacccaaaaaacaaaacgcccctcccttgcgccccacccgcgcctatcctctcctcgccccctctccctttcagctgacgcntcaatttaattgacccctcccctgcacctgactccgtcttcccctattataccttcccgcctgcgccctcacctgcccctaaaatttcacctcacacggccgtcactcaaatgtgtcctctatcaccaatccccgggcgactacacagagcgtacaagtaaccattgtctgcaccctcccacgtccccactatatgtgactcatcacacccgcccacaaagtgttttatttcccccttggatactcttctcacattaagtctcccacccgccccgtgctcccagctctacaccataaactccgtacatcttatantcctcgtacgccgtctctaaanctccctcaccggtatccatcccatcatacacccccgagtttcacctcctttccacagctcccctcaagggcgactcatatgttgtaacacaacacctctgccgctttaccaggaatacccttgttccgtgccctttcttccccttcacggaaagacgtggccgcttctcttcataagctcacggctttaaagtaatttaaaattccggggtaaggtacgttcccgttccaacctgggcttgggttgaaccaaccccccctttcagccccgacccgttgccccctaatccgggaaactattctccttaaatccaacccggtaagaacccaactattccccctgggcacaaccccttgttaacaagattatccaaccgaggcttttgggcggggtacccaattttcaaacggggcctaactc

SEQ ID NO: 10399 - DNA, 1695 bp, Homo sapiens
  misc_feature (1)...(1695): n = A,T,C or G
atcttcctccagcgcgctccgcccacgccgttcgcgctactccgctccggtcngctctcgacactcgcctcacctatcctttanatgatanactaacacaagnactctcgncagacctcttttccctctgtctngnagagctcggtcgtacacacctcaccgcacngtccaacctcacacacggccacaagtgcaacgctataacatnttttcacccacccactctccactagcactcgcctagacctttcatagtggcgtactcgcatagtcaacgcaatcacaacacgtcactcgcgcagtctcccgcacacaacaaacaacacaacacatatagcgcctcttccgtctcgcgctctcctacccacggctagtgcagccatactggatgacgcaccgcatctccaccctgtntcaccgatgtatgcgcgcgccacactgcatcactntgcatncgcctcgctcgccttctatcctacgcagacttcntgactcgtctgtcactacagngtatccccntcntctcgagtcttatgcctcacgccgctatgncngtcgcncatactcacacacttcaccnctgcacaccagtggcccgctgtcactntaatgtgtgctntaacctgctnactcgacgcgacatgtcacgcagcgacgcactcaccncncgcgcatatgaagtcagcgcaatctcacntctcctgatagcgtctacacacatgcccctcatatctcatatatagctgtccaccgcgcgacacaccgaccaccactatcaattgctcctgtaccctcangagattgcgcncactcttnctccncaactatcacgacgcgctcgccggatactcttcgccttngtacacatagtgtcacttctctcgctcagagacactctctagactctcctccaacacgctacgaacgcacacgcatagtgtcataatacttgctctattctccgacacctacatcatactacgaccacacagtgtatatcgtcagaactgcgcgctccgctacctctncgaaccgcgtcgcacgctctcgcntccttatgatacgactcactcatcgccccactcgacaccaccctctatntcacaccncacgtcgtcaccnctcagtantgacatctggatcgcccctcctctcatcccgtcgctctctcactcctcaccgcgtctaacatcacgctgcaagcacgatgattctntgcnactcgacacnttccccagctaccacatcgtcgctntgtgtcgcacngacgatcacactctgatnacgcccgctacgttgctacgnacagccgacgtgattgcagtatagtacgcacgtactacgtgaccgcgccatagngcgtccgcgtcacatnagngctgctgccccgtatatcatcctcgctacctctcgtgatatcacgatcncacgtntaactgagtagtactcgctcctactgcgctactctcggcgcgacntgatgatgtctctgcactcacacacatcgncggannacnanattacacactgactgtctaccnatctcgcacgcacacgccgatatatatcgactcgcctcatcacagcggactagtctaccgcgccgcgtcgtatagtnacatgacgtacacgtgactcgtcccgacacnctgagccctcgtcncatacgcacacgcagcgcgtcgtcgctctacg

SEQ ID NO: 10400 - DNA, 1258 bp, Homo sapiens
  misc_feature (1)...(1258): n = A,T,C or G
tattatctcctcccaccttctcttctccattccccgcggcttcgaatcatctcatcncacactactcttccacgaggaacgcacccgcctgcatcacgccgcatttcactcatccgtccacagtgctcctcctatcgtagcatcgtacctcgacaacaactaagcacgcatcaatcacgcagcgcatctcgtaatatagcatatcgactcacgcaccacgcagcaacagcaacagcaacactcagatcacggcctcctgttgttactcctcgcgttctttgntttcgctccacagcctgttttctcctcgctctcacaatagcccaacgctctacctcgcgctcaccctccanccagcaaccatnttcacctcccacatctttcttggcaatagaacctcgtttgccctcgactccctaccagttcgccacctataacgcccaacctgtagtatttctacacaccttaaaccacacaaatctcacaccaaaattggcgcctcctctacggccacccccgcctataggtacctcatagacggtccagccttgccctctcttatagccggggccacccattatcgcaccccctcctcctctcccgtactcctctcttcccctccctctcctctccctttatctagcacgctcctctcccctgccactgcttcattctcctcccctttctcgcgccgccctccgctctttcgttcgcacgacgtaacgccgcctacgccgtttcctttgattttcattgcggttatcacccgtacacctcctccccacgtctaattcgacgttcacaacgactcaccctattgcacccaggcgcacttatgcccgttgactctcctcgtcgttctctcgcgctctcctcccttcctttttccgctgcacccctcaagctctatcgcgcgcgtccgatcacaccggcgatttttaccacctcgtcgccgccttgcatatctcctccacgccaatatcctctgcactgtcacccgtctcgatctgtgttactgcttcctacacagcgactattgatctatagcacgccgccttatgccgcgctccacccttttcgtcgtggatcgagagtgacgtctggcgatccctctcccaagttgttccctcgccgcgggctgaatccactagggcggccatgtgatgtcccacactcactgcactctagtgtctccatgtgtaccactctcttcggccactctcngcgtatcttgagtccgtcgcgccgctgcccgtgc

SEQ ID NO: 10401 - DNA, 194 bp, Homo sapiens
acccacccccaaccctcacccatcctcaccctcactctctctcctcctcatttgccccccctgtcatttactcagcatccatacttgaaactcaagcttcatatcgccaactttgggatgattctcatcaaacagaagaggctgttcccatgctggaataaaacatataatattcacttataaaaaaaaaaaaa

SEQ ID NO: 10402 - DNA, 463 bp, Homo sapiens
tcttcctatccctgtcgttcccttctcctctttttcccatttctacatgcacgaaggacctttaataaggttacaaccagagacctgaaggaagcaaggaagaaagccacatggttgtcaaagagaagaggaaaggagatcactaagctggatgacgttttctgtttctttgaaaacagagaagatgacaagttagggagagatcagaggtcatactgtgaagcacctttggataaacggcagggactttggattttctttttgaatataagcataatccattgaaaggtctcatgcagggaagtggcaaaacacttttaaaatttttcatcttttctttctgaggcagagttcactctccatttatttgtcttctttgatatctctcaatagaatgttgcagttttagtattctcctattaaacatttgtttaactttcttgttcttctaaaaaaaaaaaaa

SEQ ID NO: 10403 - DNA, 202 bp, Homo sapiens
attctccctccacgcgcttgcgccgctaggtctcccctattccacccttccctggcacatttttgactatccccgtactcaccacaaggtattcatccaaatgagtgcccaccatgctaccctttggaggctctgcctgtattgtaatgatgctgcaataataaaaagcatgttttgttttgctttttgaaaaaaaaaaaaa

SEQ ID NO: 10404 - DNA, 1670 bp, Homo sapiens
  misc_feature (1)...(1670): n = A,T,C or G
ctaggtggttggtatgtagatgtcgtacgcggtagacgagcagacttgtctatagctacntgactagcatctatactagaaattgtgctncaattcgtcgcgtatgtgacacagtctcatcctcgagatcgatacgagctctagtanaggagacgcggntcacaccgatctattgacgatgactagactctgaggtgcacgtagcggtgtagagtcacactgtcgttatacgaatctcgtgaggtgtccgtctagtcgcagatacgacgcctacgcgccatcactctcatacacagacgtatgatgntacgtaccgtcaatctaaatgtctcgtcacgtgagacgaccagacgacgctgttatcatatatagtttcatcgtgcgcttcgactcggactngtgcgctgactacacttgacgatacgtacgaggcgcgatctgatctactctatatcatatcatgtacgtacacgctctcgttatacttgtcgcatatcacctagcgctcctgcgtgtgaaganggatgagtatgtgacataacattatcgtacgtagtatgctgatatctactatcactagagtagtgtagttatgtgacgtcgtgagntatctcgtactgatcgcatctcacagtgcgttgactgtatacattgtatatntacgtgtatatgacgctgcgcgtgtcctcctncncgcgntcgtgtatcatcgcgcgactacttaactcatgtatgtactcatgcttctcgcanactactacgaatcgancgaggagcgagtgncacganantgcgataacagagcgaaagcgctagaacagaacagacatagatctctgatgtagctcatgcctgtgtgagcttcagacgtctctntatcatcgttcggggtganccganctttgagatatagatatgtgtggcggtgcccggtgacaaacagagactaactaatgttgctgtctgccacantccgccgtctcgtgagtgatgtacgtctaacatcactctcgtctngtactgcctttcttcacctctntctaccctctacccgttcactccacttatctacccnccaccacacacctcataccttctccctcctctcccaancacctgcacgtccnccacnctccaaccattccctactctctcgtcatatcacgtgttaaaatataattatatatgncatacatatgctgaaagtacagacatgatannacatagtcgantacaactaatatagacatatagatcacatagtagaaacatataaaatgacgatgaccatagataggtgtgtaatcttctagaggtgttgagagtattacgcagtggttcatgagtgtggangntgggtggcgagagtgtacagcaccacagagtgtctcgagtagtcgagtcgtgagggacgggcgatgatatagaagtcattatcgcgttggaactaatattaataaattaatggtggcgctaactttctcacaccggntgtagtgggaagttgtaagaccgacgcgcgacacnctatatcttagataaacatataaaaaaatataaacaactgtacacatatcagaaaagatatnggtgaagatattnaataaagaatatgatacaatgtacactatacaatatataagattnnaaaaanaagatataaaaaagaa

SEQ ID NO: 10405 - DNA, 336 bp, Homo sapiens
tagatattcccacgacgcgccggctatgatggccgtggccgcggcgtcctatttcacctgtttttggcgcccgactccacccaccaccccctacgcaggctctctctcattcaaccactgcctcaccatgatcgcagactctctgacctccaacagaatgactctacgcaccttccatactcagctcgctcacagacataattctctggatatcccttggcccacagacctcacagcccgctggcctcctcgtcaaattcaaaggcataatttcccctcgggcaaaacaaaacaaataaaataatcggcgcctcgtttaggctcctcacccggcgc

SEQ ID NO: 10406 - DNA, 225 bp, Homo sapiens
ttctttcctcccaaacactatcaccacgtcaggtatatccttcattctcgccctcccttccgcacatgtatgactattccccgactcaccagaaggtattcatccactcgagtgcccaccatgctaccctttggaggctttgcctgtattctaatgatgctgcactaataaaaagtatgttttgttttgcacaaaacaaaaaaaaaatggcctccttggcctcac

SEQ ID NO: 10407 - DNA, 1417 bp, Homo sapiens
  misc_feature (1)...(1417): n = A,T,C or G
ccagtgacagatcagcggtatgtgaaaggaagacgacaggcgattacgtacggatatctccgccacgactcccctctgttttgaaagtacgcacggtcatacagtgtcagtagaaggagcaggaacgcgatacgtcgtgtgatgattcacaggagagcgagagagagtgtgagatatcgtgagcgcgactacgccgagctgcaatttactcatcgaccatgcacttagtgtgaataagagatagtgtatgatagaagtacacaagacacacatcaaantctacgtgaagtcggactgtacagagtgtgaacgaacagtatgtgcgaagttgacgaagggtaagatatacgacatacatatcgcacaaacggtaggagacgcaagagagagataaaagaggagacggaggaggtcgatatagcgcgatgagcgctcgaccacggagagtagggacgagagacggtgacaacagcgaaggtagatgagtgacggagaggcgagtgtagcgacgtgagctagataagtatgatggagatagatgcacgcgagtagagtgagacagacagaagttgtagagacgagcaatgagagtatacagagtgtacgacatgagtcgactacctcggttaacacagaaggacgaagaagagagacaacggcaagaaggagacggataaagtaaaaacagaatcaggttgtacgtgttgaaaggatggtggggtcgtagaatattaacgttgtagacgctgacatgctcaacatacgaaagaggcgtcgagtggtacacgcggttattgtgggcagcgtgtatgtcattatattgagatcacacagcagaagtaagagcgacatacaagtgagattgcgcatgtaatcaagcatgtcnaatcagcagtgcagatggtttaactctccatgtcgtaacacctaactctacaggagcggcctcgcagtcgcacctgcgatacgcgctggacccgtggaactactgtcaactgaatacgtacggctagttggaattgtgggaaggaagtctaagtggctaaatgacttttgcgctgtactgcaataaacgacatgtacgcaccaggggaactaactcgccgaggagcagagagaagagagagaagcagtgggtgagatgtgatgatacgagactaaaggggcaggcgctatgcatgctgttcgcgcttactctcacataagcgcgacgcacccccagggcatggttcgacatctgcaaccactgagatcttaggtttgcaaacaggtaactgcaaggaaacactcgcgtagtcgtgaggaggtgcgagtgagactcgacggagagggtactggcgactacaggcgcatagaagacgtccctgcatactatcgccgaccgcactgcacgcgacacgtgactcgacgcactcca

SEQ ID NO: 10408 - DNA, 986 bp, Homo sapiens
  misc_feature (1)...(986): n = A,T,C or G
cgctcctacgcaccacctctcccccaccgcttcactcctgccgcccgctcgcaggcaccctgatattcgcctgtcgcttcgtgggtacttgcatgcactccgcgccctccatgcttgncatctggaatgggttagcctgcaggcatttacgctgcccttctactaccacagaacagccntcactggccccagagatcctctcgcccagctaacgctagagatcttctacagcaagagcttctcgaatcaatgaaccttgcacacgaacggacttgatcaacccgacttccttgtcaaaaaactacactgtgcccgacggcctgcctccggaagacacgcatgccctgagaaccttgaccgtgataccatcagcgagacccatatgatgcgccacactagtctctcgggctcctgccccctcctgcccccccatctacactcctccaccctcatgaccggatagtgtattagttttttgcccccgtcgctattcgctgtcctcnagtggatctgaaacaataactgacaatcgagcgctcttagaccctacgcgccgtggtccacatcccatcgctccgcctttccagtgagggatcacgccaccatcccttacctcaccacacccacctcccccccacgctcgtacccctcactccacaacgccgcccgccactccctaacatagaggatgncttatgntctgtgtgtcgtgctccgcttccgtgcatcctcgcgtgcgaaatctctatagtacatcaatgttcttcatcgctatttatcaagtgggaccgtctcacggctgtggcgatgtggantactgcgtgtctcgcgtcaagccactgtncttcgccgatcctctagtatttcttcccacacgtccaccctcatcaactcgcctctcctccaccctcccgcctgcttccttactcgcaccacgccagcgcgactgtaggctacacatctgcttaataattaagaccctctcg

SEQ ID NO: 10409 - DNA, 370 bp, Homo sapiens
gtcctctatgtcacagagctcaggtatagtcaaaattgtttcctggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggccaacagacatgaaaaaaatttccaacatcattaattatcagagaaatgcaaataaaaacaacaatgaaataccaaaaaaaaaaaaa

SEQ ID NO: 10410 - DNA, 1092 bp, Homo sapiens
  misc_feature (1)...(1092): n = A,T,C or G
ccaaaacctaaaaaacccaccaagcacgcaaaaaaaaagcttagaggtactcttccatggctcacaggagaaacctgccttaggaggaganatcttcctcatctacttaggatgactgagatgctccgcttagactcccacagggcacaaccccatttctgagagatcactaagaaccagatattcactcccactggaatactgggaactactggggtgctgcctggactcctagagagccacctgggagcaagaaggcctttttttcttgctgaagactccatctatcctaaaaaaaaactgaatgaatcctccttgcactagaagcgctgatcatgtcctcgaaacaaacaaaaaaaagaagaacattggcgctgctctaggacccccaaccaggaggcaacaactaccacgcaaagcatacatcttcaacaaaaacggcaaccaaccaatgcattcctaacagtcgaatgtaaccgaggtccacgaccccggcagcgagcccgacagcaccaacaacaccagctacaccagcaaatactaaaacaacgcaaggcagacaaggtcaccccaacgacagtcacaccagcgcagcaaaacccccgccgaacgaacagcgcatagccaacgcaactacatgaccgccacacataccagcacacgctaccntagagacctcagcgatcacacaaccaacagatagacagacatcaccacgacatgccaccacaccaacgccaccaaacaatcacgccacccctagaacgctgacaaccgcgtacgacgcccgagccgagtggatacnatcgagcggatgagcaactccggcacgaagacatagaaacgcacacatgacgccacatctcaactacataacacctcaacaactcgccataccaccacatactcgtcaccacctacaccaactcatctcgcccgaatatcccatccgacagcgcaccagaccaccaccaatacacctcctaccaccatgacagtcactacaacacaagacagagacaanctagtagacaagcgngctccaggcggaggccgacaaacggagcacagacaaccacaaacaaccgagag

SEQ ID NO: 10411 - DNA, 1355 bp, Homo sapiens
  misc_feature (1)...(1355): n = A,T,C or G
taaataatagtagatatagacgacatccgcaggatgaaatagaatagaagaanataagagtctgctaagagtcgacgacagcacgcatggctgccagataatttactaagtcctcatagaggagaccttagagagtgaggagtgaggcataccaattcttctgtcgcctccacatactcgacacagtgtncaaagggggtgggagtgggggggtgcgcgcagacnacagagaagctaccaacgccacgcatcgcgagctccccttcaccattcaatgacagtncggaaaagaaggcatagctagatcgtagcaggccatctcaaggcaccaatagcgtgcctagaagccctataagacgaccagcgctgccaacatatagaagcactatgtaacgaaggactcgcatatggaagcagcagcctctctgagccgagggtggggngtgcctcgaaccaacattaccttgcaccgcaaagctctccaagcgagaggaatggtgaccacggccaagaacacagacagcacctagcatgcggcgccagcntatatgctcatcaagagcgagggagatacttcgatcgcacactagtaagaagtgcaagaaagcaggctcgcatataaatagagacctcgccacgtcacgagcacacacaagagagctacgggacgacgccgacgccaacgaacagccgacgttgcataagatactatccacgcggagcatactcgccagagattagcagcggacgntcacgggcagagagcaaaacggtaatgcgaccatgagtgatcgacggtagcccacgggccaggaagcgcgcacggacgctgaacatgggaagaaccgcatgacacaacgcgcacaggagaagagtggagcagtgcggcgacgagtaaagatgcgccgctagatcagtgcggcgcatacactctggcagtatatgaccaccagcgggacggagcacatagcgacgcatgctttanaactacgtcgcatagagttaaccatactgagaatacggacgcgcaaggagtgccgccgatagaggcgcgagtccagagacgagcatgacacgcagantacatcacacctccatcctacgagatgaatggtctangatgacagaccacctagcacgcgcggtagaggtagagtagngtagacgaacacgcgtgcgctcgcgacacgaggagcgcgtatgcagaaggacctatgatgtcactagaggagacgagacgacgatacgacacgcagagcggcgcacgtagtggttatcgcancgcgtcgagacgcatgacagcggcagcaaaatcgatgccgcgcgcatgtcgagcgctgagagtagatgcgtag

SEQ ID NO: 10412 - DNA, 1266 bp, Homo sapiens
  misc_feature (1)...(1266): n = A,T,C or G
gcgcgcccggatctgtcatccaccggcgactacggttgttggctctataactagagcaaacagcgtcaatcgatctcgtatagctgaatgagcatacttgtgaagatataagaaccacatgtcgcgtagcgaggcgtagtcttggtatctatccgtcctccgtcgagaaagggtctctgagaggtgaacagctctcaatatacagtcgatcgacccaagctagatatagcattcggtgaactcgcggaagttgatagtgtgctcgatnactgctgttttctcgcagctgcgtaaatcgccgacacaacagagggcacgttattatcgagttttatccgggcgtatcgccgacgcactatcgatagaactttatgcaggaacagaatcgcaacgtccgtcggtacgaccccgctgcacagaagcgaaatctcgagagtaggatactaaagaactcgatatataacgagatcgcaacgactgcaatggaaatgtcgcgcggcctacatatctagtatgaattacactgaagcgttgctggcgctagttgttcttagcactacatatctctgtagaaaggcaggatagtgagttggcgttaagataaatcgataatcaggtctctgcagcgtggagaggtagatgcgagatggatcgtgcggggcacaatccgtatttagggacactgcgaatcccggtaagaccatctgagtcgacctatccgtcgcgtaccagatcaacacccactatatccgccgcgacataaggtgggggcgggctcggcgtttgattaattagtagtttctcttttcgctatataataaacatattataatatcagacatgnttcttatatattccgtaccttctatatatctattgtactggggtgggggggtgggccnnntctctgctctcgttcgatngtggtcgctccagtgggacgagcggcaggccgtggactggggnatataccgtaaatattgacgccgggttcgattgatgttgagcgcgcgagcgcccccggcaagcgactagcttctctctatatagtgctgctatcgacatctagtcagagacggcatgcgagtagaccttgcctagacgcgcgcagtatcagatagggtatgatgatatcgcactaccgctacacagatcgccgcactcgntacatatgtgacgactcgacaatatgtcacacatgtgtgacgtcgcaggtcgacttgcagccgaggaagatgcgcgactatcagcgctagaggcttatag

SEQ ID NO: 10413 - DNA, 812 bp, Homo sapiens
cctacatggtaacaccgccctataattttattgatgccgccttcgggatatataacagggggcgtatccagtgatttttctgggattataagtcaaccatagctaaatggatgccgccgcctgagcttttatcgcaacatggtggacgtaagtgcctatggactctatctgttaaccacccttgaggggtatagacagaacatggctgacattaaggataaatgctaatgtgcgggtttcatcttccacaaagaaaaacataaaactgttttacttctgtgcatgcaaagacctatcttgttggacggccagcagatgacccacgtgtactagaacttgttcagtgaccacatgatgtatccacctaaactaattgggtaaaacacctatggactggaggccaaggtcatataaagtgtcagtgactccagctcagaccttcatatgggcatcctgaaccacatgctagtgcacggagcgccggcctcctacacgggcttgcgatcacagatacccttataaatgttctggctggaggaacctacgcttttgatgaacttggcacgtatgccaagggtgtttttccctctgagtttggctggaacatcacgtgcgggcttaaaggctatggttccgagggtaactcttggcgtcagggagtgggctcttcttgattaaaagaaaaactttttttgtttggctttaggaccatgaaagctgttcttacgattcatccttaatgttacgcctgtactgtttatacctagcaagttgttaatcaaaataaggccctgaggcttttctccccacta

SEQ ID NO: 10414 - DNA, 1110 bp, Homo sapiens
  misc_feature (1)...(1110): n = A,T,C or G
agaaaaaaaggannaggnnggtagaaagggnatggtagagaaaggagagagaagaaagaaaaaagaaaaaaaaaaaacctaaaaaagaagacaaaggagaaacacccttttcgggggggcgaacgganggagagaggagaaaaggagagagaagacagagagaaaattttaaaagggggggacagggacccccgcgcgagcccgcgggccccggcgccccccgccncaggcacgnacggngcgncggcgnnggcggccgccacacgagcaagcccgagcggccccgccgcccgagacgcgcagccgcgcaggacggccggcaccagggcggcgcgggcccacgcacagccacgcccgccgccgcgcacgccacacgccgcccgccacgccacacaccaagcgnnacccacagtcttcgcccccacgcgccgcacccccgccangcgccgcgcaccaggccgggagcagggcgaacgaaggaggagcggacaggggcgggggggcngaggcgcgggcgggggcgcgggcgggggggaccgcggcgcgccccacacaccgcccggccggaacacagccggggcgccgggcggggggccggcgcggacgcccgggccagcgccacgcaccacacccccaccacacccaccccagaccgagggcgccgcggccgcacgggggagagccccgccgccccagcccgcccgccctccacgcggcagacgcgccagaggtacgcaagcgggcggggccgcgggacgcccgcgcccggacccgcgcagcacgaccacgccccgccgggcgcgcgggcacgcgcgccgcacgcgcaccagcgcgcgcgcggccgcgcgggcccgccgcgcgctccccgcgcgccggcgacaggggcagagaaccggcgaggggcaaccagcgcagacccagggccggggcggggggcacgcagcgcccggcgcagcgggaagcgcccggacgcgaacagcgccgccggaggcgtcgccggccagccggcagcaccagcgccgcccgccggccccggcggcgcggcccgggcgcccccacaacgcgccagcccccagcgcgcgccgcgagccgcccgcgcgccgggggcgg

SEQ ID NO: 10415 - DNA, 1886 bp, Homo sapiens
  misc_feature (1)...(1886): n = A,T,C or G
cggtgtgtagtatgtatgtgtgagagagtgangngcggtgagtataganattagtatactatgcgatnagcgatgtagtcataacnagcgtgtgatgtgattacgctgtgtaagtgtcgtatggcgtgagtgaccgtgtcantcacgtgagtgatacgtagtnggctacgcactagtacacacagtatatgagagtagantcacgtatagagagtaggtagagtattgcgtagcgaggagtacatcacnatgcatanacgagaaccgtaacagtcgtatgagttacgattngatgttatcgcatactctactgggctcatcatatgtgtgacgtagagcgttaatgatgcanangctagtatttctgttctcacaggacttggtctcatatgtagccgtaaagcatacttacttgacagtgtcatntatcgtagaataacagtataatagagctgcgtcgctttgcgtggaatatagtgcatgntgtcgagatatagccggagtcgtacgtacaggatatgtatactaatagaagtggaattgtantatacatatcatcnanctataacgcgaagacggagcgatggagcgagagagggatatgactaaatctctaatgacagaatataaatacattacgagtatatatgtttgtgtataaaatagagtgcagttgagaacttctatcaaatgcatgatgtatgtatctacgtatagatcagatcgatagagaaatncaagagattgaatgattagcacganaacggctgcgagagcggatgagatagcgtacnttcgagctacatgatagtggatcatactctcgcagcgtagagatacgacatagctgagtgaagtcacgtgctcgttgtgtattgagatctcatactgtacagatgtngcttgacagcagcgcacgagagtnattagatactatatacgtgttctgcgacgagacagntagtgtgattacacgtagcacgtcacagactaggtcgtcagaantcgtcgctgagtgcgccgacgtcagataagcgtatntagagatactatagtnagatatcactgtnatatctatanttatatctcagtacatggtgactagntganttgtagtcgngctctgcagtgngcgcgtcgcgatatgagtggcgctagtcaggtgacttagggacgcgcntacgaggagtgattgtactcagatcgatgtcatatgagctctgctagcgctacgngcgacgtagcngaganatgtatcggcgatcacagcagcgactagaagtgatcgtgcggttatagtaagataactgagagatgatctatagaccgcaatacatatncgcnactgccagtganagtgctgngtgcgatgacgagngactgtatgatataganaaaggagtgatgatgtcatagcagcgtcgataattctgtcnagactancgacacagcacgaagctcacgcgagcatactctccactctcgcagtcagcacagatanacgcagtagagagagaggangagtgagtgagatgagacgcttgactanccgttgtgtgcagtcnctgctcgtatgtcgagtgatacattgcgcgtgagttgatcgagtatatacacagtcgcatgactgtcacgangatatataaatcacatatgtatgtagtgataggttacgtggacgcgaagcgcngtagttgctctcgtngacgacagagntcgtcaagagcaccggtatgcggcgaggcgatntcgccgcagtaccgtagagtattctgagacgaggaggcagatcntagatgaagagantgtatctacatgcgacagatatagtaggagagagacgagcagatagacacgacatgaatgtagtggagtgctgagtagct

SEQ ID NO: 10416 - DNA, 1771 bp, Homo sapiens
  misc_feature (1)...(1771): n = A,T,C or G
actgtagacttgtgtgtctctgntgttgcgtcactagagagtaaatagaatactatacgaggnngcacgagacacggcgngagagacgcncatgacgacannccgagcagacgcacncacgnacnactatcgcagagcgcgngnctgagcagcgactgngcnnnagcnacacgtcagtgcgngggagncgagcaagtgtgtcactatatgtgnaacacaacngcaaccgtactcntcgancacgagcacacagcacacaagtacganagcgtcagtacggcgagancngaggacgcgcggcaaccgcagnggacanaggaactgcacagactggcncgcgngccgcgcgncgttctgttggacgntgtgtctgacgntccgctcgngcgcgcgncgcgcgcgcgcgctcgnggcgtgcgngcgngcgcgtcgcttgcgncgcgncggcgtgnggcgcgcgcagccgggnngnnnngctcgccncggcnctctactctcacgcgcgcgcgcgctnggnnngcgcgcgctcgcgngcnggnngggcncgcgcgccgcgncgnccgcgcgnctgngncgcgcgtgcgcgcgcgcgcggcgcggcggcgcgcggcgcncgtgcgggcggcgcgcgncgcgcgcgcgcgcgcncggncgtgtcggtgtggccgncgcgccgnccccgcgcgtcggtggtgcgggcgcggggtcggccgtnnnngnngtnggcgtntccttgcnnggctcgcctgcgcgccgcgccgggngnccnccgcgctcctcgngcctctgcncgcgngnccncggcgcgccgccccgcccctcgccgcgccntggctcgtgccctccgccgcgccgggccgcggcgggggcgcgcgcggcgccgggggnngcggccctctgccgcgccgcgcggcgcgncggcggcgcggcgnggggcgcggcgccggcggcgcgtcggcccgcgcgccgcgcgcgccgcgtgcngngcgtctcgcggcgcgcgcccgcggcngcgcngnnnncgccgcgtgcgcnggnncctgntccgcgcgcccgncntgcgcnngnncgcgcccgcnnncgcccgncgcccggcgccgggcttccgcnggcgnncncccnccncnncntttnattatgaaaaaaataattttctctctcttncttctctcttctccctnctccnnncnnccntccntcctccnncnnnncccttccctccctccgcgcgccncccccgccgcgccgctcgcncgcgcgccgccggcccgcccgcgncgcgccncccncngcggcgccccnnncgcgcgcccccnncccgcgcccnngccnnnncccccgcgcgcgcngcngcgcgcgngcgcgcccgcnncngcgccncncgcgcgcgccnncgcgcgcgccgcgcgcgccccgncncgcgccgngncncgcgcnnnnccccnnccncnccgcgcncnncnccntccnnncccnntcnnccncnnnnncaaccccttcctntnnnnnnccnnccccncnccncnncnnnnnnnnnncnnnncnnnnncnnntggnnnncnntnnnngnctncnnncnngcncgcngncngcgagcggnngcngttgtgtgtgttgtnntngatnnnnnnncnnaaacncaagggcncnccttttttttcttctctttttatatttctatctttctataatctctgtcacaaaacacaccacacaccaacacaacaannnncncaaaacccnacccacaaaccnatatatactttaacac

SEQ ID NO: 10417 - DNA, 853 bp, Homo sapiens
  misc_feature (1)...(853): n = A,T,C or G
atcacaaaataatatctcgacagcaaaaggataaaacccgcaaaactaaaaaggaacgcaacaagcatctcnacgcggacagacacaaagacaaaagaacccgggagaggcaaaactgggcgaccaaggacacggccacgcaggacgcagcaaacaacacagccgcaagaggccacgcccaccccaaggcccaggaaaggggaggaaccacccccaaacaaaaacacaaggaaacccgaaggcaagggaccaacgaaccccacgagcaagcattttttttggatgaaactaccaaaactaacactgacagcacacgcatttatcacgccatcctgcaaaagttatcccaccagcctagaagaactccccgcccctaaacccagcctgaaagaatgatcctacactacaacttgatgggaataaacatggaaaacaatgccacgacgcgaaaatattcacccaccaacctgacgggatgtctaagacataagctgatatagggtatgcttcaacccatagcccgacacaattataccccattgaagacccagaatatacacagcgtcgtcaaacacaagataacatataaccctccttgttagacctcaacaaatggaaaccaatcccgaaccccaaaaccgtaaacagaaataatactaattaaacatattgccatcacagactattagacagtaatacatgttcagcacctacgcgatataactagaactaaaggagtaataccccgccaccataagaaagaagataacacctcttacacacgccatccccaccatataattcgcccgattaccacacaataccataaatacaacataattaccgccacccc

SEQ ID NO: 10418 - DNA, 847 bp, Homo sapiens
  misc_feature (1)...(847): n = A,T,C or G
aaaagagaatccagaactacgaccacaccgaggagttttntttcccccacagcaaccagacagggggcgctaatccagctgaggccaggaacccgaggctgcacagcctcccgatgtaaatatgaacagaagccagggggagaacaagagccacaccctggagtcccacctaggtcctgcccagctcctcgcatcctccaccctaaggcatcacagaccccagatctgaagaggtcctcagcaactgggctaggctctctgggggagtcagaaaccctcccacctcaaaagcttcccatttctttgaatgacaagagattggctggtttcacgactgtcaaggaatacctccaggcaacgcctgtacgtcccgcggggagagatgcatgcatcctgggagaggaaacacctcttctttctagagactgagcagacgacagaggctttttctaaaggagggtgctgctaaaacccaccaactgccccaggatccgactgtaggacagaaacaggcacagagccagagacggttgcctctgtagcaaagtcagccccagggtctgtcctgtaatgaataagggctgctgaagacacctccatttgcaccacacgcgtcaacagacctccatcggcttatggaggcgccctgtgtacctagcttgaaggtgacaaatcaacctatgttctaacatggtgggctcaaataacggaaggcgattcgactgtcccatcggtgaatccacggggaatccacgttattggtgtgaggggtgaaggactccgcattaccagttgatcggtgattgacatagggcttgtgccgtggcccatgcttcgatatttatgc

SEQ ID NO: 10419 - DNA, 243 bp, Homo sapiens
ccttggtactgcttatctggacttgccaggaatgtctatggagccatgagcatgtgttgccagcaggaaggtgccccaggccatatggactgaccaatcagtgtccagatacctgacaccggcagatatgttcaacttatgccctggtatttgctcataatgcaaatgtagaaattttcattctttaaaatgtctatctctttaaaaaatattttggttgcatttgttccaaaaaaaaaaaaa

SEQ ID NO: 10420 - DNA, 875 bp, Homo sapiens
ttttaggctggcgtgcagcggcgtgtactcggctcactacaacctccacctcccgggttcaagcgattcttctgcttcagccttggcctgagcagctgggattacaagtgcgcaccatcatgcctggctaatttttgtatttttaatagagacggggtttctccatgtttggccaggctcgtctcaaactcctgacctcaggtgatctgcccacctcggcctcccgaagtgctgggattacagggtgtgagccactgcacccagccttaaaagaatattttctcaattaaaaatactataggcttccaaaaagaatcaattaaagggatagaaaatttccaatatattatctaccaactgcaactttgaaaaatattgcggggcatttttttaatttctgccaaaaaatgcagggaactggtataagagataaattcggttgtaaacagagagaagttatgaattagaccaaaaatattattctgcgattggaatcttagctttggaggacaagcgggaaatggagggtaagtgaattggattatcaaaaaatgcaatttccgatacggggggatgttagtgttgttaggtttgcagtgcggctggccgcttctgggagcccttatgtctttaaacgagaagaaaggcatcagtgggggcccggcctgtgcgacgcggtgccgcgcgcgggctctggggcgggggtgtaggagctgtttctcggtcctgggctgcgccggggctacggcacggtaagaccgctaggggcggggggcggttagactgcttaggcgacgatcggaattcggtttgacgcggccagcgaaatgggacgcccgctggggatggggaggtacgcggacacagggagaagg

SEQ ID NO: 10421 - DNA, 1395 bp, Homo sapiens
  misc_feature (1)...(1395): n = A,T,C or G
gagatgtgntgatagcttgntggctggtacatcaagtgtcgtcgantgttcggtgtatgancgcggtattctaagttcantagatgctattacgtgangtgagagaagacgagcgtgcatnagggatgtagtgcgagtgtnctgtcagtataacgcgcgcgctgtactagtgtgatgaatcagtatcagtgagtgcgaagatattactgaagtatataatcatattatcagattaattagtactgtactcagtataaataatatgatcatattcgtggcgcactgcgcttgtgaggtgtggtttggcggacgtcgtatagcagagaggtgtcgagtatgacgcaagtgcgtgagcggagagtgtcgggtgagccaggagcgtgcagtagtgtcatgagtgagtgcggtagtggggatagtagagagagcgtggagtatacgcgagaaggacaatagaggggagagacgggagggcgagagacagaggagggagagaacagtatgatgggtgagcgtgcggcgagtaaatagtgtcgagagggtggatgatgagtggacagaagctgatggctagaagcagtaaggaataggtgaagattatgataagaataatatcggacgaggtggaggtgagagagntgagacgacagctcatagatatgcatgttcacgagatgagtcgtttggtacagatgtgtcggcataacgatctgttcgaaatataaggcatattataagcgacgttgatacgaagtcgaatgaaggcagtaaggcagcgcgatatacaggacgattagtgtattgaaacgagcatgtggtggagacgtaatgttattctgcgtactgtcaacctctattcttcgctgcaggtgttgttaggcgaatgtaaacgtgaatatagatttaactcgtgcgcgaacggggtattaagaggcgtacggcctggctcgagggtggatctcgtccgcgcgtgtgtgggagagggtgaagtactgggcacatgtatatactgagtgcgatataagatagtagagaagagcagtaggaggcttttagataggtattaatgtgatgtgcaccaagcgaacaggcagtagcgatgaaaagcgtagaagcgaacgtggtcgagcatgcgcacaggccatcgtaagtgtgagatagaaggagagaggagtgaacaaacaatgcatgagagatggcgcgctagcagtaatctagtaaggcggccagcgacatgacaaaggcaaagaagagaaatcgtaagaacgataatcacggcgcgagggtaggatgcagcgttgctgtaatgctatacagtgcgtgcagctagttgcctagcgcgcacaaaagacacgatcactgagcggcggaccgacaccgcacaacagcgtagca

SEQ ID NO: 10422 - DNA, 858 bp, Homo sapiens
  misc_feature (1)...(858): n = A,T,C or G
ttgggcgtttggcttgtggtctcggtccgtgttcgtggttctgtgtcggtgtgtgtgtcggtgcttgccctttttccttgtttcgtttttctgcgccgtgtgtggttggggggtggtggtggcgcttggcttgtttttgcttggcgtcggtctctncgtcgctttgctcggggtgctctcgctgcgctcctctttttggcctgtgtgcgggggtgggctgcgtctgccggggtgtgttagttgtcgcttgcgtttctttccctgttttttccctttcttttctccggtgcgtcttgttttctgtgtcctcggtgctttgggtgtgtgtggtgtctccggcttgcggtctttgttgcgtttgtgcccgtcctcttcttttctttgtggggcgttgttgcggctgggcggtgctcttggtctggccggtttgaccctgtgttcggcgtgtgtgctttcgcgtgtgtgggtgttctgggtgggcggttttgtctgcttgttggttcttgggttttggctttctcctctcggtgtccggtctctggttttggtcttggttttctctgtttgcctctttcgggtctgtgtgtctttgccaaaaatcttccttttgtgtctgttttttcttttttgtgtttccttttggctgtgtgtgtgtcctggcgtgttgtttttggcggtttttcctgtttgtctgttgtttgtgggtgtcgtttttgggtttttctgtgtgctttgtccgcttttgtgttcgttcattcttttttccgtctttttcttnggtntgttttgcggccacncggggtgcgtcgcgctaactttttttgtggttgcgttgtgggtgcgcgtggttttgtgttt

SEQ ID NO: 10423 - DNA, 872 bp, Homo sapiens
cctcagactaacataacctaagtctttcaaaaagaaataccagcagatcacagggagagaacaggagggagacctcacaggccacgagggacaggaaacgctgcttctccagggactgctccggcggggctgaggcatcctggggccctgcagactcacattacccccgccccccaccgccccccagcagctgcactcattgcctgtactgccctggccgacttgaagatgttgctcctcattccacgactcgctatggttcgatctgaagttaacgtactattagccttactaactcttgcctgaaataaacccacacgagtgtggttaccgctttaaacaaaaaaaaaaatggccctcttggcctcaaagagggagctaagcgtgccgatacctttagcgaggggcaacactgacccccgctacctgctccacgccctcggccagtccgatcccgcacgcgtatacattagcctaaatggcgcacgcacgtaatacacccataaaagggtaatcgaggaaggaactttagagcaagaggcaagaaaaggccatgagcctatgaacgcgacataacccgagttgtccttagctcccctcccccccagcatactgcgacccgtcctgctaacacagcgacgacccccctgatctcctggatcagcgtgtggccccgaacacgcctacgcctcggacgtagcaccttacgtcccaatacgggacctagttatcgctcagcgaggcggatatatattaacctccacgtgctaacagcgcaacaatctgtggctatcggtgtgtcacgactcctcaaagtgcaccctccctcccaccctcatacctcacacagcccccgaccacgctcagatgct

SEQ ID NO: 10424 - DNA, 1245 bp, Homo sapiens
  misc_feature (1)...(1245): n = A,T,C or G
tctaataatctttctaatcagcccaacaaagcaaaaaataaaagaaaanngtgccaggtactcaccatacacnctagcacattctnggaacggtcactcctcagactggagccacgcactccactatcgatactccacacataggacactagtatcactttcacgcgagagcactatgccaaccatgcttggtaacccgagctgcgaatcgcactcaggctgaacatactatgtcaatcgcaaagtcacgataagcgtatacttcggcggcaatctcgcatatcacacttatcacgacacagaataaactcacacttcctcggcagcactagaaggcttctatcctacctacctcttaccgttatacccaacacctacactagctcactctatagtaatttcagtacagttacacccagtcactgcgtatcaattcgcacccaatcattagatacgcaccaccatgcactaacacactccaaccanattaaatcatacacaccacctcctacatatatctacgagacgactatcgatctactcgtcacacatncacgtaacaagtgcgtataacattatacatttagtgtatcatataagcaccatcctaacataacacacatganataccctcactcaccacctatccgcactcaacgacacatacacgctctaatacgacatcccatcgtatagttcaacaaatctcctcatataaccacaatcctactccgcttataaacccatagatangatacacctaaaatatacaaacacatcacgcaacgcacgaccacattatctcgcgatgcaagcaacacaacacgataataatcccatatatgaatctctcacaataaaatattaaacattcaaaatctaatcttacgttctacgactaaccaacacacaccccatacacctcactcaattaaagcgataacaacctacaaaacaatcacacacaagaccacaacaccacacaaacatctataacgaccgatcactctacaacatcatcctcacatacactaaacaagtatatgacatctctctacactacgagtcactcacgacaccactacgacactctactaaacaaaatatacaatcaataaccgcatgcagagatatattacacaaattcaaataacacatcgcagatcatacaactatagcatctcaccccgtcttagcacaacacataaaacatacaccattacacactaacaacaaaacatatag

SEQ ID NO: 10425 - DNA, 851 bp, Homo sapiens
  misc_feature (1)...(851): n = A,T,C or G
tcctggtgtggcgaccgagctgtgaattcctccccatccagagattacctcaaggaaggtggtgtcgaccagccactatcaagatggcaccancccacacttcatatgaacaagagctcaagatagtcattggaacaagacacctagagccgataccctgcactctcctgcatgtttctcataccaaatttcccttctcgaaccctgtacccagccggggggtggtgncacgatcttttagaggcaggagccttaccatgtctacactgcatacaatcaaataagagtacttaccttaaacaacacaaaaaaagataaaactgaactcgttcgcctcggcggtggagctctgcgccccctttcattcacgtagccgctaatccctcatacccccctccctgcgtcttcgcactgcgagcccatatcctcataggagccacgcgccctttcctcaatcgagccatataaaattataatcccataccagagatacgctcccagataatcattatacaacaccgtctctcacaccagtcctacctcagcacggtaccgtcagatacttaagtgagtcaaagagaacgcccttgttaacagtaatacaaagtcctcaagattccacgagaccacacgctaaagacgatctgccgcgagctactgcctcctaagtcgcagctaatccgaccgtctgcgtaccatgcgtgccaggcagcactcgagtatatgtaccatcgcctcccgctctggctcacataccccatggttcacccagctcgacgaccaaccccacatacggcaccccataccgtcacgccacagcccagaaggatcgccccattctcatatgaagt

SEQ ID NO: 10426 - DNA, 692 bp, Homo sapiens
  misc_feature (1)...(692): n = A,T,C or G
cccacctgcccaccgcagccaacaaaaagacgtcggggctggctacgtgcctgctttatgacttatgagaagatggggggggtcgtggtggccgtgtccaacgctttannctttttctatcctacaggaaaaataaacacgatgacagacctacagtcaattgatgcatcatcaaataacggaggccacatggggggcgtggaaatccaaataaagaactacttagatccgtgacccaagccggccagccgactattgcccccaggacccacgcacaatctaccatgaggtctctgaccagacatccagtcacgnaaaatgacatcagtatcatataagggccaacccctcccccaccacttggatccacccttncaggttcgcgtacggatgccagcaacgggccgatggctcacggcaagtagcagggatcaaggaagggttaatttctaagagcctctntatgaaaatgtggggagcacaaaggatggtacagtggcccgaggttaatggtacgtggagtagccaccatgactaagactaaaggggcaagggagtggtgtctggaatttataagaatctcaaaaaggggaccctctgaacaggatcagtgacatttggttgagcagcacaaacagcccaaggcaatctctcagaaagggatcctaagagaataaataacctgaagatac

SEQ ID NO: 10427 - DNA, 2058 bp, Homo sapiens
  misc_feature (1)...(2058): n = A,T,C or G
aaacnactgtcgngatnttcgtaatgacgacgacgcggagatngtagtacagcganaggatctggagcantagtgcagactatcatagacnacgcgcangagcgctgancnaagtgctgacgtgatacgacgatgcgctgcactantcgacgagacattcgaagtagtgatcagactnctgcagcgctgagcgctgcgcgcacatcacatgcatgtangcctcatctcagacatatcagagtaccgtcgngagattattcgtgtgagagatattanagtanacatgtcatatcataacgtagctngtctgatgggcgctgngtgtcagntgacgcgtngtcggtaagaatgcgagcgtgtcgcgtgcatcattcacagcgactagcacgtacatatgcggtcgacgtgagtctatgtcgagtcgacgagcagtatcnatccgctgtatgcgcgatgcggagcgatngantgcgtgcgacgagacgggagtagtgcgtgtgcagcgcggacggtganggagagagagcgagtagcgagagagagngcatgcgcgtagagaaggcgatgggtggtgatgtgtatgcgtggtgagtctgtatcgcttgcgctgatcgagtgagtgtagaggatatgcaagagttgagcgtccggcgtatacaagatagatgcgcgtactcgacgaccgacgngcgtgctctnagtcatggatgtgagaccaagtcgtaggctgagtgtgacagtgagtgtggtgatatagaatgagactcgcgagtgatcacggaacagctgtctgacagatcagaatcgagtngtatgcgtcgcggcggatacggagtgttgtagacggtgtcatatatatatagagtagtagatgtatgagatggtcgatactagaggtgtgacggtgtgtacgatagtgtgcgcgtgcatagtaagtgcagtcagcggaatagatcgaacggatacgagagctgcagactgaatcatgacaacgcatgtcgatnagcgctgtgatactagcgttnggtgacgtgcgcgtgctgcgactntgcacgctagtcgcacngaagacgntgcgagcggcgcgaagtcgcgatgtaagactagtgtagagagtagcgtgagtatagacatncagagtagcgagaganangagatcagtcgtgtcaatgtgngtgagntgtagnagcgtcacgcgcatacanatcgcagacggatatgcaganagtacagccgtantagaacagtgatacagcgtgttcgtacgataatcagtacgctcagcatctanagcatgtacagtaatcagtcancaacaaatagtaacatggngacgaatgctcgatcagtggactgncactgtncgagagtcgtgcgctgcgctgctgtatgtacgcgtagtgcatgtcgacgctcatcagctcgcgtgtctgcgcagacggacgtacgagtatgagatacngccgagatantctgacgagntgatgtntagaatcaggacctgctctaaacgtatcgagctcagtatctgcgncatgncgtattacgcanttgctcactacantgtagtntaantggtatagtactggacacgtacattagtatgtnanctagatgtgtgaatatgtgtgngagtctcaatgtacncactcatctcgtcatcggtngtgtcgntncgntacngcgtagtgcagtcngcactgactangacagcaggcangagctcagcagctacagcancacgtcagagactancnancagcagcataatacnacngnactatacatgacacntgactcngtcatagtgatctaatgctagcgggagaacgtggtataatgcgtaggngtnatagatagcgcgcactcgtctgtggtcgnacaggtatgtganagtgtcagctcgtcgtncngcgtactagctagtatgtangcnatcgctgcgcaggagcagagtctaccgactgcgcgacntagtcgagttcgtagctgatatcggtgtgctgtctcatgactcatgtcatgagagtagtactatactatatctctcccatcagc

SEQ ID NO: 10428 - DNA, 1448 bp, Homo sapiens
  misc_feature (1)...(1448): n = A,T,C or G
ctcccctccttcccctcgttctagcactgnattctctcctcctctctcctctcgtgtccntgctctctcgtcagcgttcctctccgctcgctccactcctcggtattcctctctcctctcccctctccttcctctcttcctacctctctgctaanttctctggccgtgtctatccttatgctgtctccgtctcctcatcgcggctctcctcttctctctctgtccttctccttctgcacttctctctctccttgtttgtcgccctgcgctgtccccggtctgcccctgtgtgctcctctgtcgtgtttcctcttctatctctgcctgtctctgctcttcgtcgcgcttctcttctgtgtgtcctctnatcgcctctctttcttactcgttcttctgctcgcgtgtttcgctgtccctcctgtatcgtcgcctgtccgatttcgccctcgctgcttcctccctcttcctctctcgcggctcttgcctccgttcgtttctgctctctggctgccccggccttctatttgctctctatcctctctgtttcttctcgtgtcttctcccctgcttcctgtgcttcttcttcgccccttcttcctccttcttcttatctcncttccttcgtcgcttctncgctctcgcctcctcttctctctttccgcnttctctcctctctttcccgtctctgttgcgtcttcgtcgcgtncctctgtccctccctctcggtctctctcttgcatccttcgcctctccctcgtcctgtcatctggcctgcctgcctttcgactctcttttgtttccgtgttgttctcgttcgcctctggtgtttacttcttttctcttccctccgtctttgctcccctcacgtcgtccttgtctcgttcttgtctctcttcctcccgtttcctgctccgcttcttcctcgcttctacgtctccttcngtctctcctcgcgctccgctcctctcttccatataatagataataatctctccctcgctgctttctcgtgctcctgtctctcctctcgtgtttcgccgcgcgtncgcgttggcncgttcttctgttccctngtctctctnctctcattgtttgcgtcctcggntttcgtggttctgcctcgngtgttgttgtttctgttcgtcgtcttcccctgncgcttctgtgcctctctcccctctctcctccgctcctctctcgntgttgtctgcggttctgcgcctctccgccgtcgcggtgtgccttctgcttcncnttcttctnctcttagtagcagtnttntntcttctctttgctcntgtctcngcgcncncgtctccncgccccngctaggtttcttcctccgncccnttatgtatccgccnnncgnccgctagtcctnnccttancaaattttggnccctcctcccctgccccggtccctgatacatctgtgtggctctagcttc

SEQ ID NO: 10429 - DNA, 317 bp, Homo sapiens
  misc_feature (1)...(317): n = A,T,C or G
cttcggtaagctgctgngctgtgtacaggacacatgttaaggaatggaagaggcctctaggagttaaaagtggaacctgattgacagccatggcaaattgagactgcaggcctacagcttcaagcaacttaattctgccgacaagcatatgtgcatgtaagaagaccacgagctccagaaaataatgcagcccatccaagaatgcagtctatccaagactgagaccttgaaaagaagacccacctaagtgctgtgtcacctaatgcacagaaactatgagataataaatgtttggtaagtcacgaaaaaaaaaaaaa

SEQ ID NO: 10430 - DNA, 234 bp, Homo sapiens
ctttcaggtaactgacttggtgttatgataaatctgaaatataataagggaatgaagcatggactgtgtgactctaccaggagcgaccccttggaagcttgtatttggtattctctggacttcattcatgtactttttccctttcctgattttgcttttgattctttagctataataaattcgaagccatgatttgatgaaaaaaaaaataaaaaatggcctctgttggcctca

SEQ ID NO: 10431 - DNA, 345 bp, Homo sapiens
ctcagctttcagcctggcctacataaaaaggaaaaacagaagcagatgtgagcctactacccgcatttacatgttcaccaaccttctgcagagcacggaaccagctggtaaatacctctgcagccaccatttgggcctggcccctccctctcccagaggaggcagttcctgacagtcacacgatgtctgctgaagagtatgtccaagcgattccagtcatggtgtacaactcacacttttgctctctacaccctcacccccaaccccagcaaaactttaatgaaaatcgccttgccttttgttaataacaaaataaacagatgtagaatgacaaaaaaaaaaaaa

SEQ ID NO: 10432 - DNA, 242 bp, Homo sapiens
ctcaggacccttgccagctcattgtgtgacacaaaaggccctctgtcctctttgggaggcaggaggctgagcggacaactgaggcagatggatcttctgggagccgggtgcagtggctcacgcctgcaattccagcacttttggaggccaaagcaggtggatcgcttgagcccaggagtttgagaccaccctaggcaacatggtgcaaccccgtctctactaaaaatacaaaaaaaaaaaaa

SEQ ID NO: 10433 - DNA, 434 bp, Homo sapiens
ctttcaggggaacctgaatgcaccagcatcagccatatgagcttggaggcagatcctgctccaattgagactcagctgagactgcagccccagttgacaccttgattgcagcttcataagatcctgaatcagggaatccatctcagctgtgcctagactcctaacccgtagaaatgcgaaaggaagagcaagctactctcacctgggaggtccagctggtgaagaccacaagagactgtctccagtgggaaagagccttgagggagctcatttactgcttccacatgtgtggtcacagaaagaggcatcatctatgaacaagaatacaggccctcaccagacaccaaatctgctggtttcttgatcttggacttcccaacctctggagctgtgaggaataaatttctgttgttcataagccaaaaaaaaaaaaa

SEQ ID NO: 10434 - DNA, 1412 bp, Homo sapiens
  misc_feature (1)...(1412): n = A,T,C or G
gcgcaccactcacactgtcgcgcagcagcgcacagaacaacaaagcagcgaacagaggttcgcctgcgcagcngtaaacctngntatgaacgaatttaaccgctatcaccatatctcgaagacgcccactnactagnagncatcgccgtagcgcgctgtacggctgtactattataatacgataacactangcacataagaggcagtcgcatgcgtggggcgagggcagaagcacactgtacgacacctacgccttcagccacacgacgcgcgtacctcaccgacctcagcgcgtctgccctagacgacatcgcaatcagcacacacgcaggatactcggagaatcacactacgctcacgacaactacgtccgttacgaaatcacaaatgttgcgtgagacagaacgcagcagatactagtgtacacattgcatacgacaagagaagaatgctngtaatagaagagaaggcgcacgaaccatcctgattaggtaaaggtccctgcaattggacatcacattggaaactaggtacgaaatccacgactcgcacaatatcatgttcatatcgaggtaacaanagtcttaacgtcgagaactcgtagcgtatatatgtgagcacggtcgaacaaccggataccacacgaggagagacgcaagcttagaatcgacaatatataaacgcgcacacgcaaatgtaatagcaatacccgccaccgcgagccctccgcactcgcctattaaagagagaacgtacaacgaacgcaatatgatagtcagtcggagngagcgcgagacaagtaatagtcgacgactagaatgatgaataccagacgacacataaataagaagagaactaaatagagcagagattcagatcgaggatcatgcgcacgttgcgatataacaatagatgaaatagttcgcaacataacgcaatggtaataatagacgcaacgcagtgatgtatcaactgatattctangataatcaggagatcgaacttagtacatgcgaagatataaaagagaaacagcaagatgaaccgcgagctcgggcatagagagcacagcacactattacgagaaagaaatcgagcagaatcaattgaaaaataaataagaagagacagcaaactagcggcagaatatacaataacatacgatcaacacatagtacacagagcgcgacgctaagcaactaacgacaaataggacantatatagcagcacgcgcagagacgagcaataagagattcgtaatccnatacgcgcagaaanagtacacgtctcacacgtcacatgacagtatgaangtagaacggcgtagcactccgacaacacgagagttgacgcnaaggagaggcacccgtaactagatcgatgaacgcgtaagctcagtaagctcntctag

SEQ ID NO: 10435 - DNA, 526 bp, Homo sapiens
  misc_feature (1)...(526): n = A,T,C or G
ccaaaaaagtcatcaattaggaagacccctcacaaccgtttaactgagcttgggnggattaccaatatcagccataccactaagaatgagataattgcaacgaactgctgggtgatgggaaacaaccaattgtccacaatgtcatgcagtctgcatattatgatgcagtacaattcataatctccatgtaacattataaggatttgaaggccaggcgtggtggctcacacctgtaatcccagcactttgggaggcagaggcgggcagatcaccatttcaggagatcgagaccatcctggctaacacggtgaaaccccgtctctattaaaaatacaaaaaattagccgggcatggtggcggccgcctgtagtcccagctactctggaggctgaggcatgacaatggcttgaacccgggaggttgagcttacagtgagccaagatcgcgccactgcactccagcctgggcgacagagtgagaatccctttcaaaaaaaaaaacaaaatgagctcgtggccctaccagg

SEQ ID NO: 10436 - DNA, 450 bp, Homo sapiens
ctcagatcacggactgagtctgttttatgtttgacctttcataatgttgatcccagaacactatccttcgctgtgttcctgtgctaacttgttgattttcctacatactgtgaaggtggggagagggtgaggacatcataaacaaggatggaaacatcttgggacaaacaacagaatagtcaatgttacttctggataataagacacaagtggttaaaccttaagcttttttaaaagtgtttattggaacgagaaacagcaagatccttaaaggaaatgatcatggagagtcaccactatcatcttaaggctagaatttcaggctcttagcgctcaagaaaataaaattctacttcctgaaaatcaaagggaaatttaatgaacacatttccatggaaaaaaatgattaccatgccacaataaatcttcctaggagttacactgccaaaa

SEQ ID NO: 10437 - DNA, 919 bp, Homo sapiens
  misc_feature (1)...(919): n = A,T,C or G
atattacattatatttaaaataccggaaangagcttcagggaaactgaaactgtggattgagaaacctaacctaagggaggactacagtacatcaaatggaccaatcatggctttctgcaagtctgaaaactttacgaatcatctaaaattttcctaaaatatccaagcttgcatgtacaggtctgtattaatataatgatgctgatattttgattggcatcaattaacagaatgctgatttgcattatatagtaccccatcactctatttttctctgtaatctaaatttaccgactcaaacttcaactactcatgtacatgtccgcgttcttatcaccataaaataaatacttcggtatgcaccaaaaaaaaaatatatgactctttggccttaccattgcgacattgcaccctgcttctcttttataaggtttattacatgatcctcgctatataactaactagactcggcactgtcactactaggagcaatatgaacttactctatggccattttactgatatacctattattccatgatattccattaactaactcttagcaattacacacctaacatttattacataaataagctcctttactacttgatttctttcacccttatccatagctatcactcattatctatcttaatactattgtgccgatcccattcgaatttacattcatacccgtcacccccacaatcagctttatccttttttaatctatcttctcttctagtaatttcctactttatctttataaatttgaattatcttatcaactacttcttttcaatatccttactcttccctcctattagctactatccaaatccttacttcacctcatgctatatcgactatcgtattctttgacttgttatagtcatagtactcattcttctttca

SEQ ID NO: 10438 - DNA, 1084 bp, Homo sapiens
  misc_feature (1)...(1084): n = A,T,C or G
ctctctagtggttcccttgtttctggtcgcgccggtcttactatgctgagaccacnctgcggaagtacgctaacattcgtattcaacgatcgtgtgctggcgattcaatagtatgatgtactcggaggcatgtcttatgggcggagagttcgtcgcggacgtccggtgtggtattattcattgggattggacggagtcgagtgcgtcgattctatgatattctctgatgttanatcgtcgcaaggttgtgggagaatctagatagcggtgcgcgcggtggcgtgcacggcggggatggcgtcgggcgtggctggggtgttgctagtcaacgtcaatacgatgtgcggagtggttcggtgcgaggatgggccgatgtgctgtctggcgagatgattgagggcagggtaggcgagtgcgcgctgcggaggtggacggaaggagcgacgggcgtggtgggatgacgagatggatctgagagtggggggatccccagtcggcgcggcggctgctatgaggaccaatagtgatgggttaggtgtggtgtgggcgtgtagggtggtatgggggtgttgctagctcgctcggtcttcttagccggttctgtatttttctgcacaccagagaacaagatatttatttaagatcaattaattctttttttttttttcattatatctctttactaatactgatagtctgggaagatcttacgttcctattgcccttgattctggataaaaagtgtttgtatcaattcgagccgcgttcagagtgctcattcgtgcgagtatggtgtgagaagtgcacagatgcaacactgcgtccttcaagatcctactacattcaccaagtctttttactatcttatgcatggaagcggcccgatctgcctctgtactctcttgcgtggtgacgccacagtatccgttgaagcgtggagtagtgagcgcaacgatggagcctgcctgcccggattttccatatggaaggttttcgntncaggtgtgccgcccaaaaggttttcttattttttttgtctttttcttctttttctcttaatttcntccnncactttnncatctcc

SEQ ID NO: 10439 - DNA, 187 bp, Homo sapiens
ctcaggaacttcagtgatctgcctaatataacaagacaggtaggagggactgtatttgaagatgttacgataccagatcaaagaaaaatggtgacctgtggaaaaataacatcaaaaggaatgaatttcattttgatttccagaaatcaaggaataagatatatactgaagtcgaaaaaaaaaaaaa

SEQ ID NO: 10440 - DNA, 369 bp, Homo sapiens
  misc_feature (1)...(369): n = A,T,C or G
ctcttatagttttttagggggggaggnccccttgtggttacgcaaggaagacctaaaggaaaatgcaggtcaagtgcttttatcctgtgaaacttttagaagagcaatcataaagtcacagtgactggccctgattttcagtgatggaaaaagaagagcaatagaatactgaaattacgccaaataataaatctacagaggcctccaggtgtttgagtgaaaggaaaatttgcacatctctgattttaattcaaaagcttttttttaattaagcttagtgaggaagacatgttgaaagccaagacaggctgaaggctaaacctcttgaagcaaacagttagccaatttgtgaatgcaaaaaaaaaaaaa

SEQ ID NO: 10441 - DNA, 1061 bp, Homo sapiens
  misc_feature (1)...(1061): n = A,T,C or G
atatgtagtattatattattcaggcaacaagaaggaacttctaggataacactagaggnagacttaatttttcagctgtctgctgaatccctgaagcctagcatgtgtcagaagacacacaatgcatatcccactgaggatgatgatggctgtcccttcagaggcatacgaacgcggctgtccttgaactcctcttgcactgagctgggacaccagcagaccccatcagagggacaggatattgtgacctattcacttccacattgctgtgttctgcagacattttctacttcacacgtaccataacatgcgtataccttcaactgtggttcacaatgtttgctttttctatgatagttattatcaaaaccttgacatctccccatacaaaactacgaaaactccgaggcctctccgtgcatcaaccatatgagcttatgcccgccttcttcgattctcacgtatagtacaactcatcgatccctacactaaactgacactacaaccctctgtctacctcacagtcctacatacccgacttacatcatcctttacatactgaagcaatacatagaattccgcaccataaagtacgcctaccgcatagatccatatatttacttctgtactgctctctttaaccgacatctatatcaattacatgggtccactaatcattagtttcttcgaatattgattcctgtccttctgatcgtatcattaatcgttccgtttctacctctaccacgtctctgctctacgactctagcgcccccacagtgatcccgttggtttcttcgactggtagtatgtagcntcgcttgtccagcacctaacgctcagtcccctccatgtagcatgaatcacctctaacactcactacaagccgcactaccatcttcaatattaagccctatacagatataatnttacagtacgtattacttcagctatcatccacgatactcttgacctaccatcacctgactagagcgcgtaccctcgtccaaagagcaaatgaagaatggacaacatacagactatagtcgcctcatcaccct

SEQ ID NO: 10442 - DNA, 1465 bp, Homo sapiens
  misc_feature (1)...(1465): n = A,T,C or G
tcctgtcgtgtgtcttctctttgtnttctgttctcgcatcgcgtgtcatctggctctgttcgtcgtcntgctgctcgtcgctgctcgtctctcttgctccgcgtcgccgcctggtctcccgccctctccttcgtnccgcgcttcgttcgcccgtcgtgccgccgggcgcggtcgcgcgcgctgctgcggctgcgggtgctgctctaactcccgctgcgcgttgggttgggtcacgggtcgccgccgggtcccgtcgtgtgtcgtgttgtccggcgtcgngtgcggtgtgggcgctcgtgtttctgcgtcgtcgtgtgcttggcgcgccgtctgtggcggcctctcactcctgcacgcgtgncgcggtccgacgccatcgccgcccgtcttaccgtgcacgtgtggcgccgctcatcgtgccgccgctgcgcgcctcngcgtcgcgtccgtggcggcgtgccggangcgcctgttgcgcacgggtcgcgtcagcgcgcgcgagctacgccgccgtctctatcgcctgcgcctccgcccgctccttcngtcgcccctgtcgactcgtatggcgcgtgcgcgcgctgtcggcgtctgcgttcgtctgcgcgtgtgagggagcgctgtgtgcggcggcgtgtggctgcgccacgctggcgcggcgtgcgtggctcggcgtccctgcgctggcgcccgttgcgtggcgtctcgccttgtgctctcttctctgctcccttcgacttcttctgcgtctccgtcggcncgccccgcctttctctgctgtgtgnctcttctgtccttctcgttcttcacgacgtgactccacacttccanccgtcctccgctgtcgcgctatctcccctgtgtcttggcgggttctctcttgttgggagtgtgtgttgcgcgtcgttggggccgancgccgcgtccgctgggctgttcctgnnctgacgagaagagacttgtgtgcttgtctgtctctctctgttgtgtctcgtccgctgcttcnttcgnccgcgcgctccgccttntcgctttttgtgtgcttgtagctgttngtttctgcgcggtggcgctgcgcgctgnctggctgtgntccgcgtcgcggggctgctgttcgtcttcttctgtcnggccctgcgtctctgcgtgtcgtgggctttnctgtgcgngncgcccggccggcgngcggcgcggcctcttcgtctctntcgngcngtgngtctgtgcttcttcgttgttctcgttgctcgaagatganggnntctgtttgtgtgtttgtcttncttctctggcctgcgcctccggnngngncgcgntgtttgnnnnccncncnctaaaagnggtnntnttnnttttttnntgtttctctnctttnttagggttcttttctntctttctttctcntctctcttctttcttctcttctccnnncctctcttacnncnnactttcttcttctttctct

SEQ ID NO: 10443 - DNA, 1144 bp, Homo sapiens
  misc_feature (1)...(1144): n = A,T,C or G
aaaataaactaatggtgagacaagaagggcctcaggataaccataacgagcattgattctccgacgtctgctgaatgcctgaagcctagcatgtgataccaagacacagaatgcatattcactgtggatgatgactggcgtggtctcttccagaagcactctgaacgcgagtgtcactagacactcgctcctcgtcactcgactttggttgacactcagctactactccactgcagtagcggcaaaggcaactctgtagctcttatgatcatatcactagaatcgccgcgctgcacatgccaccacgacgctcttacttacactacggtcacgatatcctcgcatgatcaactcctatcacgccgcctccgagcacagtagtacgtatattctcttggaccaggtcacaatccatcacccagccgttcgttgtcgaaggaactgactaataacgaatcacccgggcacaacgtggggcgctncagctcgctggagatcctaccgcgccacctgctctcttttggagataggctatgtcctacgactacctcatgatcgttgagtattcgcgtagctctttgtgttgatcgagaatgtcgacgctagaagggctccaggtcaacttctgtggtatgtgttagccctggatgaagcacgatacatggcaagaacactgtcgtatgatatccgtgactagcatcagtcctagtanaaccgccccgaacacgctctcaacagcccctcgtgcacgatgatatgtcgcaagtcctccctacactcgtaccgtacggaacagtataaattatctcctctatcgatataggttggagcgctctagcgtagcacactcaaggctagcatgcgcggaatcccatctgactgatctctctaagagttataaagacagtgaaattggcggatgtccagagaggcccacaccctcttcctacctgcgagaaatagcaatcaccatctatggtttcatatcggtgttagaaaaggaaggatatgtagtatcacatatagtacagcacatcgcactacgagacatggaggagtcgccactagacgagcgtacgtaacgtcacgtgcagtcgagatacaggcaagtaatgagatagaggagcactacacactcgaaaat

SEQ ID NO: 10444 - DNA, 1252 bp, Homo sapiens
  misc_feature (1)...(1252): n = A,T,C or G
tcgcgcncttcgcgcgcnctctgcctntcttctngcggcgcgcgcgcgccngccgtcgcngnccggcggccggcccgccngcgccggccgccgnggcgccgnccgccgcgcccgcggccggncnncgcgnccgnncgccgncgccgccgcncnncngcncgccgncnccgcgcccgcgcgcgcgcgcgcnccgcgccggccgcggcggcgcgcgcgcgcgcgnccgcggncgncgcncccgngcgnncngcgccgcgccgngccgcgncnccgccgncgccgccgcgcgcccncnccncnngcgncncgcncccgcgccgcgtncgcnccccccgcntcccccngcgcgnncgcgccncgcgnccgccgcgncgcgtcgcgnncgngcnccngcncgcgnngncgcgcgcgccgcgccgcgccgcgcgncngcncgcnncngcgcgnngcggcngccgncngcgnncgccgcgccgccgcgcgcgccgcggccgngcgcgcgcgngcgnncgccgcgccccgccgcgncncgcncccgcgccccgccgngnngcccgncgncgcgcccccgccgcgcgcgcgcgcgcgcnngcncncccgcgcgngcnccgccgcccgcnccnncgcgcnncncccgnggcgnccgcgcgcgnnccgcccgngcgccggccgcncccgcccgngnggcgcgcccgcgccgncccncngcngcgcgcgcnncggngcgncngccgnccncncncnccgcgccgcgncncgccgngccgccgcnccccgcccgccgnggcgncncgcnccgcccgcgcgncgccgcngcgcgcgcgcgcccngncgcgccgcgcgccgcgcgggngccgngcgcggggncccgcgcgcccccgcncgcgcccccgcgnccgcncnngccgcccncngcncngngccngcccgcgccggcgccgcgcgcgcngcgcgcccggcgncgncncccgcgcgcgngngccgcccgcgcgncgcgncnccgcgcgcgcgcccgnggccggcgcgccgcgcggcggcgccgngggccgcgcgcgccccgcgcgcgccgnctcgccngggcgccccccgcgcgcgccncgcgccgcccgcccgccccccgccgccccccgcgcgccccgccccccgccgcgcgcgccgcgccgccccgcccnncccgcncccccgcccnnccnncnccctttagnagtgagggagtcttcnccttcnctcttttcttctctcttttctcttt

SEQ ID NO: 10445 - DNA, 335 bp, Homo sapiens
  misc_feature (1)...(335): n = A,T,C or G
atcttagaaattccataaggatgaagtatatttttccgttgtctgctgaatccctgaagcctagcatgtgtaagaagacacagaatgcatattcactgtgtgagtacattttatcttgtggcatcgatgatccagggccagaggagcatccagaaaaggacagcagagcctcaggtgctcaccggtgtcaaggaaggtctgcgaatagctttgatgcaaactgttaattttcattactggtggcttttgtgccaactactanaggtacttgttacttattagcagaatgactttacacgcttcaaataaattaatgccccttaaaaaaaaaaaaa

SEQ ID NO: 10446 - DNA, 1579 bp, Homo sapiens
  misc_feature (1)...(1579): n = A,T,C or G
gcgtctccgtcctcttcactctacttctcatacatcagcatccgactactcgccgatcaccgcgtgacgngacgaactnagacgcaccaagagaccgtagntattactantgtncgcgctgggtatcacgcagtcacactatcgagtcgtagagcnccactagaacacaggatgtgcacgtttcantaanacgtgatanacagtccattctntagacctacgcatcctatcttctccgacgtantgcagtgagatgtaatatcatctgactacaagcccagtcctcacgcgacgtacagctaattgcagcacantctattcatgatacttccacaacatctaccccgtattacgtagtatcgctttctctgtcacaccacgcgtcctcgtcccaccagacnagcgtatagatagcggttctgcgcgctagagtcctgcacatcgtcgtcctagngaatgcactcngtcccacggcctctgtcatcacgtccctgtcttgacgctgatgtgcgtcaccgatctagccatcacatcatgctctccgtctgtactgcttggcacttcgcagactacgtctgcatatcacggtcccgtgcacantaacgcgcgctgtcctctatcgcatactcgatgcgtcccatccattcgtatatctcactcttccactgtccgtgctgntcgatctccgcgctagtcacctatacgcatgtcacgtcacgtccactcncaatgcatcggagcactatacagtcgcgnttctgcgtcgagcgttactcagctagcgctcgctccgacatgacatcactgtctcttgtctcactccgctctcacgtcatcgccgtactcgctcgcttatacgtctcgtncttcgacatctctcatcgtcgccgcactcgcgccgcttgcgcatctgtattgtactctctcgtctcttctcgcgctatctactgcgtatcatctgctcgctcccncattctctgaagctgtgtcaatgagtctctccgtcttacgcgcgantagcactgctccgcacgagctcagcgccggtccttcagctcaccacctgcgtcctctcttatgtcanatataccgcgttattattgtccactccactaccagtcactctgctcatctcatgtacatnccacgactcactattcttacttcgtacttatntctactcgatgacgtatacgtatctctcactccgttcgtccctcacctactcacactcttctcgtctcattcttcatgtatctgtctnctatctcgcgcacatacctatcgtctcacctcatcctctcgtgctcntcacactcgccgctcttcgtatcatcttctatctctcacatctcgacgcacattgtacatcccggaccgcgcatctcacgatgtgtcacctacgcgctgcgactcgatagatccatcggtcatatagcgatcgtcaaggtcatcccatctttgactgcgatcgattcgtatcattacgcacttatgaatatctgatgaactcacatcgctcctactgtcttctcgcccgcagtaactagattctaccttcacgtatcaacagcttctt

SEQ ID NO: 10447 - DNA, 1472 bp, Homo sapiens
  misc_feature (1)...(1472): n = A,T,C or G
cgngatcgtgagatctaatactctcataccagagatcgagagnctgcgcacacgcgatanntntgntcgctctgacntcgtagtcgggtgcagtgatgcgcacantagagangacaaccgaacgatggcagctcgangaacagcaggtcgtacacagcaacnantgcatcnaacatcgcggcgagtgagatcctgaggcggtgcggcgtgtagcgagcgcgcatgatcgagccgtgcgatgcttattcatacgagatgtatctaccgcgtncctatggatcatcgcatctaacgtgtacggtatgagcgctcatatcgagtctgtgatctacgacgacagagcanantactagcgcaatgagccgactacatatgacatcannacggcaccgacgtgcggacgtctcactagtcatacgtcgcngcgtgtaggntacgagagtcgagacataagaacctggatggtgagactactgtcggcgcagagcatctntgagtcnaccttagctatgtgatgtgttgatcnacgcgaactgcgactcgatagtcatagacgacgcgacgngcgacgccgttcacgagcgcgtgcgcttcctcgagcgggcatcatacgtctcgctagcgtatccgctcactgccagcatggtcgcactacgtctgtgtgtcgctacacatcgtgccagcgctggaacatgantagaccgcagcagtgtgagtanggatgttgcccggactagatagagatgagtaggngagtaagaagaccagcatcaatggcggcggcgtaacgcgaactcgtantgcagcantagaggacgacaccaactgacgaccagcagtacgaggtgtccgcatgaagcgtctatcgcctgagacacatccggttcgtcaatcgctatgtgacgatgatctctgcgaatagcactctcatcggtgtcgttagnagccgtgcccttataaagacttcacggtgattgctggtgcgtcgtgactcgctttctgctacttctctactcttatgcgacgctctacctatcctatgtcgtcttctcaacctcnacctctgtatcttacataactctgccttcgatttcttacgtcctatcttctgtctaaggtacgaatatgaaatgtgttatactacgtaggatcggtgcagagacatacatctcacactatgtaacagacatangatcaagtacacattagtagattattatcacatctcnacacaacactcctcactctactctcttcctcgcnttcngtccctcctcctcnncatcacatcncttccctcctccatctctactgccttcctccnctnattccccaactccataaaaagnnncnntnnnnnatnttggtcatctcccaaagaagggcccttactcactctctntcacncncctctctctatctatctcccctctcnntcctcctnncncnctttcnccncnncacctctcttt

SEQ ID NO: 10448 - DNA, 1031 bp, Homo sapiens
  misc_feature (1)...(1031): n = A,T,C or G
tgcattctcctgtaacccagctcgccaggcttctgagaagctcaagtcacatgcgggaggccacgtgtcggtgacctggtcaacagtctcagccaaagccaactctcatccacacacctgtgggtgccagacatcgagatcaagaaacttctcgtcgactacaactgacacctgatagcattacccccacctacgatccacctgacagatgacaaaacacccacccctacatcgacctggctgtacatcacctacatcaaagaaagtcatgtattctaatatgcatgacaaattcgatcacgagacaccaccaacaacaaaccacggccagttccccgnccccactcgtctcaacgctatgacacacttttaccaaccaacacaccgtgtatgcaccctgcgcattttactaccaccaccacacatacaccatcaccaaaactgactcttaaaagcacagccatacagatccaccccatttgcatatacttccacgctaccgataagcacacctcctgtacttgaccgagagatcatactgcatcttcccattcactcagcccacagcgccaacactattcacccgcctcactcaacataacctacacactctacctgccacgatgccaactacgataagttcagatctgcacatacacacattctattctcgacattccaccntcctatataccgcacctggnatccatacatcattcacactctccgtacactaccaattgattcatttatcatataccgatactctcgcatcccccctgctacgctaccaacctagcctcttttccgaccattctctcactcacaacattatcactagcacaacccataacaaaaacacacgagccccaacactatctataactcgctcacatactgctctactacataactaccacagtaccaaagacaatacagatatactctatatatctctacgntagcaaccagtattacgcgacatcgaatttgtatccgtatcctcacacaccaccctagccatatatatt

SEQ ID NO: 10449 - DNA, 869 bp, Homo sapiens
  misc_feature (1)...(869): n = A,T,C or G
ttttccaggggactaccaagggccaatctactccgtggagacctgggactcctctgacagtcacgtttggcttgaagactcctggatggctttgctgaacttgccttagactatacagcagtctaagatgccttcacccaatcttctctccctctcttcttcagttggatagagcatttgcttcctgaagaacttaaactgacaccattggtaacgctgagatntctctgggctttctcccatggttgcaaaaaggccaccatagtttgtaccattacacccatcttcaaaagcagaagaaggaacgaagaaaaaaaaaaaatggccctcgctgggcctgagcggaggaggtctggcggccgcttccctatacagaggaggaattcatcgatcctatctcactgactccgctgccgctccgcgcgtcggctgcggtgcaccgcctcaccacgcctcacaggccggcacttccggtatgctcagccatcaggggaaaccgacatgtaaagaacacgcgaacgacaacggcccgcggagggcttccaaccaatcaaaggacagttgtgcgagcgcttcgctggcgcgccacagctagagagcctggtacagtgctcactcctatcaactggcgcacacccctccgccttgagagaacccgtctaccgcccagccaccccgtcacaacctacgaccatcccgcggccccacgaaacgggacactcgcactctagcacggggcgtacaccagagtctccccggcggctcgacttgaggcacgcgccagtagcttgcacggatcgatatcttaatcatacaattacggacccctaacacatccgcccgcacgatgacatccgcctcgccggcgt

SEQ ID NO: 10450 - DNA, 943 bp, Homo sapiens
gcacttcagaccctcccaccccacacgcccccatccttccggtcgccctgaaatgtattggtaatctgatgccggcaagacaggattctaaagacaaaatgggagggcccagcatcatgaaagcgtgcgcgcatgatttctactgtctgctatgaccgttgcttccagaacattaaagatcctatcacatgttacgccctcacaagctgccaccttcctcttaacaataaacgaaaaccacaatcctctcgcatccttaaaaaaagaaaaaaatctggcctgggtgcccctcacctgtgaacatctgtgaccgcttcctttttagtgagggtaaaatcaagatctctgcccacttatgcaccgtgatcccggtctgcccagctctacgccacaacagacttatcatccatagcggttcttcccgcgtttcctataccactaccgcccatccagccgactcgatccggtcatctctcgcaccgcgcaccacacaacacttcctaccaggccgccccaagtaggcccacccagcgcgctctcggccactctctcgactggctaactccccctctcctcccatttaatttccctgccttagatcgcaatacctcacacgaaccggcatgctctctgcaacttgcatctagctcggcgctacattaccgcctcgttgttcatcgtacccaacccaaacccacccccacctaacgcaagcgacgaacattaatttcgcacgacgtgcagtcccacgagagctcgttgtagatgaacacgtcgctacatcaacgcactcccttctatacacagatagtcaaccagggaaatcacggcacggcgcatgccacgaatcactttatctgtatactacagatctttatatcaataagcaattaccacatctatggtgcacaccgcaaatatcgatgcatctcgaccgctccat

SEQ ID NO: 10451 - DNA, 889 bp, Homo sapiens
  misc_feature (1)...(889): n = A,T,C or G
ctcagatctctagagagcagagggtatccttggagtttcttcagaggcggccttcaagaaggaagaattagcatagacgggaagctaggtggaaaccgtcaatagatttctcaaagaagagtgaatccagaaaaatcaagatcccaggaaaaaaaagactcaaaaaggaattgataaagttaaacattcatgctcctcggacttcatatcggatgctcatttaaaagtaaactcttggaagcaacgttgggagaagagtgatacagagtaaaaaattattttaaaaacacgactccatattttaatggttttgaacttcatgttattacctgtgtaatcacacacacacacacacacacacacacattttaaaaccccatctgcctaggtttatcaattataaataccaactattctattacacacatgacaggatattttgtggccctttccccatgatgngcagatccactgaatggtaatgctagagtgattaatgtatccacatagttgcatataatttttatagagaataatactttatatggtattcatttaaatgacacaatttattttgtctctctaaacgaacacgtaaatgtctatcctcagtttcctcattaaataactaataaaatgcccatatgttgttggctagtaaataatatatcatgggattttgtaaataaaactcttataagtccaggcagaaacaagatattttatcttacctaaatttatatactgtaggataccgtgaaacttttactatcatcaagacttccctccagaaagggtttttataacttatttaaagtccataaattttaagtgcaatgacttataaaagttgctccttatttttataaggcatgggataaaaggaacc

SEQ ID NO: 10452 - DNA, 1386 bp, Homo sapiens
  misc_feature (1)...(1386): n = A,T,C or G
acactgggatgtatgacctacctcttcactactcgacacngcacattcgtacacttcccgattcacctcacgacgagnccagcaccgcgcnctgagcccgagcgatatacgcctctatgtgtagtattatgtaaatagtaantccgaggtattgcatcatagattaatcgaccattggtataaatagtaatcgattataattacgtatctcatatactaattacttagtatgtattatatatagatcagttgtgcatcactgcattgtagtganacatgtgtgnactacattaatgaacagaatacagtancatgtctaaggtgtgataccgntcactncactgtctaccactgcaatgatcgcagtgacactcttgttantgtcgcgntgtcctagattacctnatatcctctcgcatacttactgcgctctgtggccatacgctggagggttccgacggtgacatgaggatacgactactcgctctgcattcatctcttgtatctcaggtgtcgcgcgctgcgcctcgtgctctgtcgcggcgggctgacatccagatatacccatttgagcccaaccaccatacctacttcaatcgtctagctccgccagcgcgttcatacgtacacgcgctctcnacagacacaggatagcacagacgacgatgtctcgcaaggctgaacaaacgcaacacgtgatcacgcgcatcgcgcagatcgtgcagcgttcacacacatnagagcgtgactnatgcgtcatcgcacgacgacgcctctgcgcccgccgaggcgacatcgcgccgcccgagtcagccgtggtgtgtgtgctgcgtctgtagtctntcgcctcgtcgtcgtctctccatgcgtccacctagctctctgttgcattcgcatccgcattccgctctacgaattcacgtgcactaacacacacacccccgcgacacgcatgactatacgcgtcgcgccgcgcnccagtctcgatcgtgtaatcgtcatcngctgagtgtgcaccaaatgtacatcgcgcnagccagcacatatttgagcctcatcacgcaggtgcgcgcggacgtgcatcgtgagtcncttctatcagcactcaacactctcatacacggcttgtatacgaaacattcgcctgacgcgtcgcaccggctccngtacgtgggagctgcgtgtcatgtgcgcgcatgcgtgctgtatctctccgatcgcgaggcctacgctgtcacantcgcttactgcgcgcacggcgcgcgtcgctnacgctcggctgactcacgcccgcgtcggcgtcgcacgcggcgcatatgtcgacgtattcaccgagctgccattgcacgcgttgtgctcactatcagtactgccnacacttcagtg

SEQ ID NO: 10453 - DNA, 1971 bp, Homo sapiens
  misc_feature (1)...(1971): n = A,T,C or G
cgttagacgtncgnacgcgagtagcgtgncngtgcctatgccgtccgagtacgctcgctgactgtagatgtcagcgcttgctgcagtactgntgctgatacagnatcagcctcatcggtctcgatgcagagatcgagcgatngagcgtcgtctcacgactcagcgagcgtgagctgatgtagcgctgtgctgctagtacnggtngtgcgattnganagagtntcgagctccagcttcacgatgtcgttcngcngtaagtgttctcgtcgtgcgtcacccgtactgctgtatgcgtcgcggatancgagcagctcgagcaacgatagtcgacgcacancngnacagtacaactgatctagttacgctgcacgatgcacatcnagagcacnctcatcgtcatcgtatgccngaacagtagacntgccgcgctncgtggtcgtgtctatgtctgtgntggcgatgacatctctactatcgacaatatctcacgtcagcatntcacgcaccacgatagntctcgtgatcggtgcacntcgcgtggctgctgatcgctcgtgcgagtcgnactgaggtattccggtgtatgcactccctgtcantgtagtctctctganctactancancgactactgcnagcattcgtgcgtacnatcgtgaggcatgctccaactcggactntcggtctcagatgtgaccgtggnatcagaagccagcagatggtgttgcagtatacatatcctaacgtctaaatcaacaccatatatgcatcgattgcacgtcgatgtccggtancgacagctgcgatngatgagacataggtataggatgagtntagtctcgcgtagattanctgcgctcctcgcgatgtcacgactgctctcgctgtgtacgtcgccnatcganacatncactcatacgtgcgtatcnaccggctncgtcgctatngtcgcgcgtcngacgtcgacccagacacacacgcacttggcgcagcatgcatccctgatgatnacgtcgtcactgttcactatctcnacgactcgtgcctactgcgcgntgctncttgtatgntcnntctanctatttntngtatgnagcagatagagcagcgggtcatgctgtcantcgtatgatagtgatttgcgctcangtggcgcgtactagtgtagtcagctcaatgantatggaccatagantgtgagctcgacgtcttntanctacatantgtctagtactactactatctgtccatanacgtgcgtgctaactagacgtcactaactgcgagagtgatgtgctgatgctacttggtatatgatcactacgtacattcgtaatacacatacatctngatggtgnttgtgtaatcgcgcggggtaggcgcgagggtgcgttgacgtatgtgagaccaacgtttcancacagcgatagtgtagttatgctacaatagctatgcantcggagcgtcgctagtgcgtctgagccggaagactcgctacgcgaccanatgcgactgantctgcgacggagatccgatgaatcacgcaccactatatacgctgcagtcacggtatgactgcagtggtgtctgctgcatgtcatgtgagtcntgccctgtactctagagcgtgcagttcgtcaacgactcntgaatagcacgtacgcgctcagtcacgnactatgcgtgcctgcgctggtatactgactaacatcagacganagtcctacatgtctatacactgtntagtctcacgtacactacnattagacgtncgcctctgagtctatcatgctatggatctgctgtcgcagggagagggatctcagcactgtactccgaccacnccatactcgctgtactatcagttcggtataatatcagtgngncantcantgatgatgataagctctgcgtgcgngcgatgtcggttctcatacgtagttgtagtgtcctcgactgcttctgtctctcg

SEQ ID NO: 10454 - DNA, 897 bp, Homo sapiens
  misc_feature (1)...(897): n = A,T,C or G
cctaccctgagtaagggaggggaggtcttataaatgagaggaccgcccctgtanaacanactcacgagagacccttcctccctacctgtngngggggcgcaananaaactctcctctatnaatcacaagacccggccttgagcttagacctcccangctccaaaactgggagaaataaatgggtctggggtataaccccaaaacaacagcggacaccacagccaccacaacaaacccaaccccgggggggggggaccacccaccgggggggggccaaaaagacaaaggcctcaaaaaggcctccggcgggggggggcttctggaggccgcttaccctttagggggggggggaatctccatgggcccccccgccactggccgcccctggccccncgggccggcccgccccgccgcgggaccgggcatcaacgctccgcccgagggggcggggacacccgggtatcccccccgagccccgcgggagacccccacaggaaacaacctgtcggaccgccagccggccgccgcagcgggccccagccccgcgtaacccggggcccccggtcgctccggcggcgtcccctcgaggccccccggcgccccgagggcggcgcggagcaagaaataccgcgcggccacgcccgggcgggggggcaccgcgccgcgcggaggcgcaccgggagcccccccgcgcgcccccccgccgagagccccnctcgaggccgccgtcgcgcgcccacgcccctggagaaaacggggggcgccgggcccgcgggccccacccgggagcgccggcgcgacccccacggccccggcggggggtcggacgcccgggggccgcgcgccggaccactgaggcgcgacgcgcccccccccggtccgcgggcgcggcggggg

SEQ ID NO: 10455 - DNA, 263 bp, Homo sapiens
gctcagaggcccataagtgggtaaatgttcctaaggacaaagatatctataaatctgcagagtgtacatctgtaagaatagaagactgattcctcgctcacatcctcactgatctaataactactctggcttccaagatgcttcaaaaactaaactcagcaaaaagtgcagaccaaatatgtggcagaagttgaactgagctcgttaagtttcatattatgtatatcctttaatatagccttttaatgccaaaaaaaaaaaaa

SEQ ID NO: 10456 - DNA, 529 bp, Homo sapiens
gattgatgtctatgtagtaatttgtcagaagacaaaaaaaaaaaacttagtgtgactgctgttgactttgctggacttctgctgagcccttcaccttagttaagctaggagtgcaccatttctctactacagtaaagttgttcctcttttagccaaagtctgctgagtgagctgtgatagcttcagtctttttgatgcagaattgtaatgaactgaatatttatgtccccactcaaattcatatgctgaaatcctaacctccaaggtgatggtactaggaggtggcacctttgggagatgataaagtcgtgagcgggggtgacttatgagtgggattagtgaccttatacaaaagaccccagagagctgccttggctcctatcacaagtgaggatacagctagaaggtgccatgtatgagccagaagacgagccctcgccagcaatcaaatctgccagcaccttgatcttggagttcttagccttcggaactgtgagaaataaatttctgttgtctaaaaaaaaaaaaa

SEQ ID NO: 10457 - DNA, 473 bp, Homo sapiens
ctaataattgattttcattatgaaacaattcttgctgtttgaaagaagaaaaccaagggaaagaaatggaaaggaaagaaacaaacatgagcagagaaaaataagagaacgagaagtcggatgaagatctttatgctacaaaagaggcaattgcagttgcaatgtggaccgtgcaattgcacatctcagatagaacaggctgaggaaatcctaaagtagtgagtttcacctttttttcctctcaaaacatgtattagaagcattctgtggcaacttaataatttgggctgaaataaagtaaatagcggtacacgcttgatctttcatgagcacaatgaaatcagccaaattaaataaattgttaaaatagaagtattactgcaaagtcatttgaccatcattttgaattcctatgtgatcatcctgattgttgtatgctcctaataaagatttttattgcaaaaaaaaaaaaa

SEQ ID NO: 10458 - DNA, 141 bp, Homo sapiens
cctaggaagaacgagtctcactgactccaggattcttggcttagccattactcaagccacaaatacttcagttatccagtgagtcagcagccttcaaccacacttttaaataaaggccttctatcatgaaaaaaaaaaaaa

SEQ ID NO: 10459 - DNA, 415 bp, Homo sapiens
ctttagctggagcttcaagaatgtgtttggatcagctgaattagtctcaagagtctcagagtaatgaatgaacgtactgccacaattgtgttgtttcatcaaataatgctgaggttgaagatgtatacctggaccaagcaaaaaagtaccaagcacatatacagactagacaatgtataagacttctctagccttatacataagcattgggcatggagggggacaagttacaccttcagaaggacttgtaatctgtgctcacaattgtgaaactcctggctagataaagtcataggaagtttgaatatttgtctcagatgctgccgctgatcttgctatcatttatcaaaacattgttttctactgcattcttactacgagtaaaatgcattttatgtactcaaaaaaaaaaaaa

SEQ ID NO: 10460 - DNA, 2799 bp, Homo sapiens
  misc_feature (1)...(2799): n = A,T,C or G
atcgnggantggntgcgnaatcgnatggntgnngntnggttnggnnngttctagnnagtntggctganngtgnnngtangtnagntgcaatcgnnagttgaangantagctgaancntgntnggcgcngattgnngtngangttncagacgtnanggaagtagtcgagcgatncacntagtcnaggnagttgagntcggtcaggcagtcangttgggcttctntgnantgtagctaggatggtantgcnntcacngnctcagcttgtnnntacatnncagntcagcantcgangcatgcatcntacgactgtcgntcagncgacgganctagacgatncatgcagtcggtncgcnacnggtagtcnntnctacgttcagntgnncaggtgattagtnnangatggtaantagnagtncaggtaggatcgacnntccagtcaggatcagatcatcagtgcntncancagnaggtagatcaagnatcgacgacggatgncancgtcattgatncagctnnantcntcnnatgcagctagtnagncgngatgatggcagntgcngactgncgaatgntgatnttngtntactcnntnactggantgatnaagngttnntctgncgatgatcatcagttgangtngtnaagntaccgantgntagtagtnattcatgagntctnnatnangtnttagtaggtacttcgttgatgcgtncngttnnanntncatgatngntcttangtntacngagtcgcnatgngcagnntacgactgacngttcgtncngctgtgctggtctgatcatggctgangagtagtgttggatgagtangacgtgangatgtnagatcgtcgntcantganntcnnagcttcnttgatcgtaagntgntcgtatgcggtcgnacgatgncagattagcagagacgtantggaacgcgtggagntantncggtgangnattagacgataganngangnagnntgatgcagcgatggctgtngacatgactngactantcaggtcnggctgacgatgctngattcctagtntggangtagacngcacngatgactancaagngatcgtcntgctgcgacgagacgtatgatngnannantggcagntgagatanctcntcanngtggacatcgganccnggnattgtcatcgatcgncantacttgagtgctgcgtanagcctgnatcgtngnatcacctgntatagcttaaagcagtngtcatatggcantcgtcactaacgatngatccgtnatcatagnganganngcantgancagtagatcacgagtatcagtacgntcatngtatctgcgtcatngcngcnatnatnntgcgacngtangatatagtngaantanngaagcnagtaagncnganctnactacgatgtgtcattcgnntntgctangtnatgtcgatgataatntanagancgtaacttcatgcagtaganatgtgntgctactagcnccagcgcatcacactagacagancgancgnacgtncagcagcatganctanctgtngccgtatncacgtcatgctcagctgacgacgtctcacgncacancacggngacagtccagactgcnnctgncagactgaacgcgatgacttangangtcggagatatgtcattgcgtgatgatgntcctacgtacatcnctgtatancgatgctagtcntcgagatcgactggccgtacgacganatagtcgatcncatantaacagatnctgnatncacgangtngctcatgtgatcgtactatacnntantagctagagctcagncaacgantnagctgagagcatgatcangntgtagtncgtagtagtagcgagtagcantgggcatanatgattgtcgcagtagcgancgtaataacgtagantagaganagagcacatagcacgantcatcgcangcacgaganangagttgtacagctcggcagagagtagatcgagtagcgagctgcggtgtacgatgcgacgatcactgcacncgcngtcagtntnctgcttgtgcgangactgtagacggaggcatcgtatcatgctaggangcgacgtatcagtncgagcacactgagagcgtgatgtgcaaggatagtcagtcantgngcgacgnagcgcggcngcgtngtacngcgaacagctgtgacgcgtgagcggagctgngtgngcgcacgtggaatacagtgcatagtgcngntgtactagtgcatactcagtagnctatatcngctcgantagcgacgagcagtgacantgcatatatccgcacgcatgtgaccgtgccgacagtgggtgtgacggtactgcgtgncgcagtcgcagcgntgacgaaggagtgtgtcggacgtctgcngcgatcgcngntgcgagtagtcangacgtagagacgngcagcangagactcgtanggaatagtgatgtcgatggtagttgatnagctccgctgacgcagcangcagcgtctgacgcgatcagcaganagcatagagtgctagtnaanagtagtgatctagtnagtagaagangagacngngctgcatgtcgtgtgggtagcgatgagatgacaggtngttgtagctgacggtcgagcgtgatgantanctttntgaactgatgtatgcgctgatgtgtnctcagctgatgatgcagagaagtagcgttagtcactgagatgtacagtatnatcgatgntggatncagntgagtgtgnagtgngctcgtgatgtatagctcgaagtcgctgantcagtagtgg

SEQ ID NO: 10461 - DNA, 364 bp, Homo sapiens
ctagaagcttcaggactgatcctgacagaacaggcacctccaggattctctccccagcagaagattacttcaagaccggagttgggtctggactgactgcaaaattgaatgtgattgatttgtaacctgtcaggtccacaatggtgccatggaacaataattcaagataagccatcagagcaagtcacaccatttggcacctcctagcccccttcctctcttgcattccaagggggtgttcttaaacccttgccgtctctccagaaattggaaattggcaatttttggaaaggattccagccactttccccctcgctggcaacggataataaaattcactctctttttatcaaaaaaaaaaaaa

SEQ ID NO: 10462 - DNA, 248 bp, Homo sapiens
ctaggcagcacagtcggtggattctatcaccaaccagacgagcctcctgattcctgttcctcctcagtggccgctgactcacatagatggagcctccgactgtcttggtttggtcccccccatgccaagaaagtgacactggtatcaatttttcatcagcgcatccctgtcagaggttatatttctgtcacttataagcaactccttcacactgagattaaaaggcttttcaatcaaaaaaaaaaaaa

SEQ ID NO: 10463 - DNA, 537 bp, Homo sapiens
ctaggaaagaaaccacagtcataatgctgggacttacctactaccaacaaaatttccttaaaccatcatatcatcaagttgtcatcatttaatcatgacatcatgttgaaaatgccatctaaaagtcaagagatgaaaaagctggatggaaggaaggtcggatagataaactggacactgaagcagaagctagaagatgccatcagagacccagtagccagatgtagctgctgattacgaaagacaggatctacactggctactgagccattgagggtacctacaccttccagcagctgggtgatcctttgccttctggggaggggctctgtggaagaaaaaagaagatatcagatttcaattgcacattttctttggatcatgaattgacattttgacaatattcccatgtacgtaattttaaacaacctctggatttatttacttatccaacagatactgactgagtgacattaaataaagtgccacatattttcttaggtgctggagatccagcagcaaacaaaaaaaaaaaaa

SEQ ID NO: 10464 - DNA, 377 bp, Homo sapiens
  misc_feature (1)...(377): n = A,T,C or G
gctagtaaggaactanatctggaacctttacactaatacacgagatgggagactcagggcttctaatcttgaaaaggaaaagcctacctggatagccctccttgcttcaatgaagaggtaggagtttgcaaagctcctctcacctggttaaattatactttgatcttttgtgagatgctgaaccagatttttctcttagaaagctggtgtctggcttttggtctcaaatcatacaactccatctgaaacctcctctcagctgggattttttcttttctcatatgttcacacaccagccctgaaaatagagcgattcaactgcatgcagacagctgcacttactaataaaaatatcttctgaaagaaaaaaaaaaaaa

SEQ ID NO: 10465 - DNA, 950 bp, Homo sapiens
  misc_feature (1)...(950): n = A,T,C or G
cacaagattcccactcataaatgagaaggctaagtccagaccagcaacaggccacttaggggaaacaccagctcgtggaaacttgcaaaccatggaacaaggggaggcactacagtgacatccaaataggaaccaatncatacggctttggtggggggtgggaaaacctttagcgaactcatcctacaaatcttctcctagaaatagtccaaagcttcgcactgtaccatgggctgctacccaatcataattggatgcctagattatattctagatcagcgccaacacatntagacgcggaattgcgtcgattgtcgtatttacaaaacgaacccccacccaatcagaaggtgggcgctggggatctaaatttccagactcaaacttcaactactcatctacatagtagccatcttatcaccataacacacacatttccgcattgcaaacaaaaaaaaaatcgccccgctgggccccatggcggatctctgccgccgctttccctataagagggctaattcctgaacctagatcactagactcattcacattcgagagtcagcatgcggccacccccatcaaccccctcgaccgcggcccatagccgcctttccacccaccccggggatcgcgctaggcaaaaacctgggagcaaaagggccccgatatggctcggtaacccctaaaaacggccccgccgcttggcgattataacacaaaccccacacccctggccgaggagaaacagaagcccgagcccccgttcgagaggggcgcacggatgccaagcttttaagaataatatgagatcctccaccgtaaccgtctccctgccctactcggttcacccccccccagctgccgcaaccctcgacccgctctccgataacccacagcgtggactctcttattatttagcccctgctcatagaaaccacgagtcccccacg

SEQ ID NO: 10466 - DNA, 1660 bp, Homo sapiens
  misc_feature (1)...(1660): n = A,T,C or G
agcgatctagatcgacagtaacgtgcagagccagatcgtgagaanangaagtatgtanagagactgtctgtctcgataatctactcgcnatgtatcagcctgcgcgtatgaacgatgactacagcagatcgaagagcaggcgncgagtcagcaagagtgagacagactaatgaacanagttgtcgacatagagaagagcgtgtgtactacgcggtacacgcgatgtaggtggatgctgtgnaggccggagacgcgagcgtaatgcgtgtatcgcgtggatagtacgtctgacgctgacctnaggtatagcaagctgcgtgagagaatagaccacggcntgcattgagngcacgcgacacgtgaggatacagagataggtcagcgaggatgatagagcgggacgagagagngagtagaagatgcgatatataataggagatatagtgaagcgcatgtagttagatagacggagtaggaaaggatgatcgagtggtacgtctattagaagagactatagtggtgtgngtgtaagtgagcgagagcgcgtcgactacacgggagagtagcgatagtatagtgtgaggagtggtgcagcgaaggaggagtacacagggattgcgatagtatagcagtgcatatgcagtgatatgtatatacgaaatgatgatagtgagttcgtagagaatgatgtatactactatgaactagttactatatgaaagtatgaactatgtcttcagttacttacctcaacacaacgcacacacacactaccgcacgtacgcaatactacacgcgcgngcacgtaacggcacaggcaggaacgagagatgtagcaacagagaagtaataccattatcacgganatactacgctaccacaatgagtagagntgagatcagacactgagggatgacgnggacgtgtgctaggtgngagtagtggtgtggtatgtgatgtngagtatagtgtgacgtgaggtgatgcngtgtgcgtgngtgagtatcaccgngagagatagcgcacgcattgatatgctgtntactgagcgtgtgacagtgagcagagtgacgcgcggagctaatgcgcctatcgacggtgcaggcgatgttcgtccgcaggtcgcacgtacgtcgcgcggtagcgcgatgacgtancgagatgcagacgagtcagagatgcgagtgagcagtgatctcnggctgcatgtgtgtcatgacatgatcagtctgcacgtattgtgtagtgataatacgccgacattcgagtgcatacgtcatngttatatatgctatgcgccagatcacaggacgtcaggatgtatgacgcgcgtgaccgacgcatataagctcatcatgactgagtgtggnagtggtctatatcctgacatgcacgacagcgcggtgcgctcgcgcacggcgctactcaaagagcgacactccacgagagcgagggaacanactgacgccggcactacgtntgcggtctctaggcgttgacatctttattgaggatcaacgatattcggggcgtgcgctatccgtgcggcgagtaagaagtgcgatacatagaagtggaggaggaggatgaccgaatgagtggtagagacatgtgtgacgctgatatatcatgaagatatacatcgagctnggagtagcta

SEQ ID NO: 10467 - DNA, 971 bp, Homo sapiens
  misc_feature (1)...(971): n = A,T,C or G
aggggcgtgtcgcgggttgcgtgttttcctggtggctgtgggtctttcgttgtttgtggtggggctgtgggtctctcctttcttttgttgtcttgccgctcgtgctctgggtgtcgtgtgcctctgctggtcttccgctctcgcgcgggctggttctcgcctggttcggttcttcttcttgcgttcccgtggggcggcgtttgtgcggtgcggccgccccgggcctgtctcctcctcngtcctcgcgtcgctccttccttgtcctgttgtgccccctctgtctctctgtngttgcctctcggtggggcctctcggtgggcgcttgtgctttgtgctcggtggtctggggttcttgtcgcctttttgtctgtggctgtctggtggttgtgtcgttcggggttcgagcgctttgtcggtttgccgtgttgcttttcttttggctccttggctttgtggttggtgctggtttccgctttgtggtgggcctggttgcgttgtctcttggtggcgtggtggcgtgccgcggtggtgccggcgtgtgtcttcctccgtgctgtgtgcggtggtacgccgctcgtcgtgtttgtcctgctgcggtgtgggtgggctgtgtggtggtgtcggtgctctgaggttcttctctcttcggtggtcgctgtcgcgttgcttctgttgcgcgcgtagtgatatgtgccttctccttgcctgctcggtggttttgcttacggcggctggtgtcgccggcctggtcgctcctgttttggtagggtagcccttctttgtgccgttgccttgcgctctgccgttccggtctcgggcttcgtcttctctttttcttgtggccgttttcgcgcccttggatgtcttttttggtctgccccaantttgtanttgggcttcgtcggctacggcggggtgtgttcccccgaggtttttttttttttccggctggtctgttgtcggtgtccgcg

SEQ ID NO: 10468 - DNA, 1260 bp, Homo sapiens
  misc_feature (1)...(1260): n = A,T,C or G
attttcttgacttattcgattcttgtgcggagatctcactatctaatctagtttccacacacagagcttcacatgtgcacttatcgcacacgtaacaactcgacacctatacgctcactcatacacgcgctatcgctgccctgtagatcctgttatcagccagcggctgcggtacgagcttgcagcattcaaacttctacancccacgtcaacgtctcccacacanatcgctcctgccatcagctaactcgagataatgaatatacgaattgtgtgtggtgactatacttatttgtataggcttgtgtagcatactgtggtggcgtcaagagctgcgtgtgattctcggaccctcaccctccgacggaccacaactcttatgtccatattatgattatcatacatctacatgaccatcgctcttctgcttagcactcatttcatcacctgaaacatactacacgcactaactcangaaacactcgcacaaccgccactgtccgtcacaacatcttacacctccacaccgtctacgctcccaccgtcggagatagacgaccttcggacaccgaccagccgggactactcaatgaagaaaggaccgagagaggagattttaatgatgagaacactaaacttggtgaccacgcttttcgttgtatcgtgcgagtacttgctttgcgtagacgtgtagagggttctatacgccctacactaacggaaattaaaagaacgcagtgataaaataaataatggcatagacatataccaataaccgctgcgccgcactgtcttccgcgcgctctctagccttcattccgtaatactataacacgattttaattataaatgtaatttagtaaaancaatattgaatacggattatatctaactatctctaacattacttctatatcaataataaagcttcgcgcacatgagacggcgagcagaagaccagacgacccatatacaatcgacattccccctcgcccatgcgacacggcgttcatacggagaggcaaccgagaggcgccgtcttcgcactatctcttaataattattcctttacacatatacatatgtataaaatatcttnttgattttttcactcctatgttcctctcttttntctggcttgtttctgntcnttaaaaaatnttnttttttttttgtttcttccctaaagatnttnntttttttcttattccttcactcacttaacacactttatttttttttnctcaaatttttcccttt

SEQ ID NO: 10469 - DNA, 887 bp, Homo sapiens
  misc_feature (1)...(887): n = A,T,C or G
aagcactcgcaacacccactccggacgggcagaaaagaggagggcgcctttagtagaaacgtncgatgacacttaaccttaaanacgcctactgcctccacctcccaaaaagttcaaagtccagaactgagcggccggggaaggatcctaatcagaccttataacaacaccatgtagaaaatacaaaaacacagggcgtaatggcccaagcgaagacacatagcagactgttgcgtttacagaacaataacaaagaaagctgaggtaagtgactcaccaccataagctgggggagaggcatgagcggtttctgatgactaccctccagaaggaactatctctgatgactactgggatttaggcaggactgactttctgaactaagagacaacaaatggccggtatccaaagacaagacagaataatggcggtctttcttaccttaccggtgcgccggtatagcataaaaatccttacactagggtaaaattatgagtcctcgctaactgactatgtacatcccatacgagaacccgcagaaagctcgcctaaactaccttccaggccgcaacccctgcccatccacctgaaacacgggcatagcctcccccactacacaggacgatccgaaggggccaacataaacgcccaccaacccggaaacaaagaccaaggtgccagtgcccatcccatataggctacacagagcacgacaaacatgcccaaaaatgccaagattaattcccatattgacggaaacccttcatagttgctctcacactcccccagagatacgactcgtgtgagattcgacaagagagacatcagtacacgcaaaactcatatcaaagcggttgcgcgggagacctaccaacatcacgagaagc

SEQ ID NO: 10470 - DNA, 1080 bp, Homo sapiens
  misc_feature (1)...(1080): n = A,T,C or G
tggtgtgttctgtgctggcgttgcgttcgcgctgtcgtgcggctctgcgcgtggtgtcttagttttcggtgttttcgtgttcgtcgtgtttgctttcgcctgggcgcgactggtccgcctggccggtcggccgggctgcggtcgtggtgcgtctcctgcgcgggttcggctcgcggccgcgcggttcgcggccgtgcgcgccgcgccgctcggtctgcgtcctcgtccgggcttcgtgcgccgctcgggcgcgggcggcgtcggctcgtcgtgggtctgctttggtctggtggctgtcgtgggggatgcgtggtgcgcctgttccctctttcctctcctgtgtgggcggcacccgctggtgtcgtctcttctccggtagcgttcgtgggtgggccttttcttgcgccgggcgcgctggccccctccttggtggctgtctccgtccggctcggactgtgttttgtgctcggtctctttggtgtgtgctttgggggtgcgcgcgctgtgcgtgtgtctggcgtgctgcgattgggtgttcggccggcttttgggcgcgtcggcctgggtcgggggtgcggccgcgcgttcggtgtgttcccccccctccgcccgctctcttgctcgccttcttttcgtcgctctcccgtccgtttctcctttcctggctgcgcttgcggtctccctttcctgttcccgcgcggcggccgcgctcctctcaactctcttcctttgcttttttcctttctggtttgtctgtgtcttcggcgcngccccgtctccgtttcgtcgtcncctccccccccttggtccgctgtctgttgctgntcgctctgtctcgtgcgcggtgcgtttcgctctctcctctggcgccgtctctggctctcctctcgnctgccttcttcttccctccccgcctcttttcctctgacctcgctcncctctcccctctcttccccccccccttctttggggtttcntttctctcttagtttccttttnttttttttttcctttttaggtcttcttctcctttctctctcctccccccctctttcttctccttctcctctctccttcctt

SEQ ID NO: 10471 - DNA, 246 bp, Homo sapiens
tctttgacagcagatgaaactgccagaaaccatggaaagtggaatcgcggataagagaggactactgccaagccaaggaacacagggcttgcaggcaacccccggagctggaggaggcaccagatgcatccttcctcacagcctccagaagggaccaacccagccaacacctcgattttggatttctggactcccaagctataacagaataaatttatcttgctttaagccacaaaaaaaaaaaaa

SEQ ID NO: 10472 - DNA, 146 bp, Homo sapiens
cctaggagcatcaagcattgcaaagttctctcttctgccaattttctccctggagttgactgactggccttctggcctcaggttaatgatcacttagtgtccaaaaaggagactgaagtaaataaacaacctgaaaaaaaaaaaaa

SEQ ID NO: 10473 - DNA, 1906 bp, Homo sapiens
  misc_feature (1)...(1906): n = A,T,C or G
cctgctactantgtgctgaaccctngtatacaatacgacggagattatgtaacacgtctaatagtgaatncaacagcaatctgagggttgtgtatgtataggcgatacacatgtgtggtagacgagccagctgctttagntnanagagaatgcgggtgtactccatgngctaccacagcgagatncngatagactcaggcgtaataatctatctacataacgatctcacactatcnntagtagagtcacgatgcggggtgaagatgtcgcgcgtngtcgtatcaaagaccaataataattacatcatttctatgtatctagtgtcgatatnagaatgtnctacgctctctctgctatgtacttcgtctatactcananctcaaagatgagtcagatgccgcacgatgaagaataagttaatgataatcgntctcgtgtctgatcgtgatngctactcacgacacagtgagcgtgcttttcgtttcgtgttatcgttnagtcagaagacattcgnatnctgtatcactntcanccttacttgtttcatgcgtgactagtcgaacacacganccagtctgatgntgantcagactntcacncacgctcgctgcgtanggcgtgtgtgcgacgcagtaactaaanacatacagatgagacggagacgagagagtatgtacgntatntacatatgactacgcatgatgacgancgnctagtagatcantggagtacggtcgtacgaaatctaactcgtgagctcgtgacgatttacgtcgcacgacgnactcgtgagcgcacgcgcantatctgcnggcgtcatcatcactatacgtgcagagaatgcgcagaggacagagcacanctgtcatagataatacgcggacaacgtacgatagtagtagtataanatantgtcagtaatacatgtcntntctaatacatacgncgaccagtcctgctctctcgtcanatcagcaganatcgcactgtctactgtancacatagaacgccttactcttagtacctttcatgatgtcgttagctctactctgtantagtgatagacgtantacgaagcgacagacaggagagagtcatatactcacgacacatcatgtatctgtacatgtacgatagtctctagtagctatacgtcacacatatcgcttcgtactgagtgattagatactcatactatcatacgtagagtgagnagnatngatcgagtcnanttnctaattcacgttgtgntcagatgcgtacnatatatcacnattagtngttaatngcatgagcatacatactnagatngntanatcgtgtgctgctagtcaagtgtcgatcgtaaagagacaacagcacananantgctcntccgtgtgancgtcgtgttattgagcgttgaatctcagagctaccacacacattacatgtactcatacagtgcaatgancagctcgtcgattcgtatganatgantagttagcacacgctcgtactcttatatgcgtgcntacatcgtntcatatcacacaagatctactagtgntgcgatctgtagacgagtcgtagtagatgagcacatgtcgactcacgcactctctaantngncgtaagtagtcgatggtatntacgcgtctnatgtgataggcgtatgantatctgtcacagccntcntctacgcgtagaaactangatatgatagtatacncgcgtatctctcagctatatatacacngctcactacctagatctctgtgatgatacttatagatacgatgaagcatagcgcatntaacanantantacntacagacgacganagagtacagcaatactcgagagtancactacaccacataatntctctgcttgtgtatgtagntnngaataaagcgacgatat

SEQ ID NO: 10474 - DNA, 1341 bp, Homo sapiens
  misc_feature (1)...(1341): n = A,T,C or G
aaggagcgagcaaaaaggaacaagagcgagaagaacaagaagaaacgaggaagagaaagaagagaagaggagggcctgngtcgggaagaaccagagagggagggggangttttgggggagggganaagaacaagagggaaagaaggaagaggagagggagaagagngcaggaggaggcgagggtgtttaaaggaaggaagaggggggagaaccccgacgagaaacagaggagcgggagaagaagaacgagaagggagagagagcgaaggagagagagggccggacaangaggagagacaganagagagaagacggaggaagaagaggaagcgaggagagagagcgaaaagcgaaagagaggacagacgaagcgcaaagaaaacagaggacgcacaacaccgagagaaagaaagaaagagacgagaaggagggaatagagaagagagagagggagaagagagcacgaagcggcgaggggagggaggaggaagggggcgagagaagaaaggagaaggcaggggacgaacgaagcggaaaggggaggaaagcgaagaggggaggaggaagaagagcagaaaggaaaaagagagagaaaggagagaagaaagacgaagaaggacgaagggggagcagggaagagcggaggaaggagaaggggagggagaagagacggaggagcaaagaggagagaagggcaaaagcggagagaggagaggagaagaggcggaaaaaaagagagaggtggaggagcgaaggggagaagggagcaaagaggagaggagaggaaggaaagagagaaagcagagatgagaagaggggagaggggagggagagaagagaaggagagggaggagagagagagagagggaggagaaggagagaggggcaggggaggaggaggagggaggggagnagcgaggacgcgcgagaagcgcacaaggagaagccacggacaaagacgaagcaggaagagcagacgcgagaggagaagcagaaagagcgaaggcagagacggagagagaagagaaagcacgaagagcaacaagcgaggaagaaacaagacanagaacagaacgacaggcgaaggagagagaagataagatgagagagagcggagagagagaagagatggaggaacagacatgcgacacgaaggaggagaggagcagaaaagaagacgacagagatgagagagagggagagagaaagagaagagaagaagngagagagagagaaagcnaagagagaaatagcacaggaagatgatacagccgaagcagaagtgctagaacgagggaggtgtgaagagcgtagagaagaaggagaataagaagagagata

SEQ ID NO: 10475 - DNA, 1131 bp, Homo sapiens
  misc_feature (1)...(1131): n = A,T,C or G
gttgggggggaaaggatnaanaaanntnttnnnncacaatggtaagaaaggagaaagaatgagaaaaaaaaagannnnncccttannntaggagaccgaactnacaccagcggtagcnctngagnggaaaaccnggcgcagcgcaaggaaacgaggggagaacaggcgggtgaggttgtagggcacgtgcacgagggncatacactgancaacacccccccgccacacgtctcgcgccgagccgcgcgggccggggcactcaggcgcgacggaccggcgccgcgccgccgacacgagccacacccgcgctgaccccggcggcaccccccgccccgcccccgcccccgcacccccccgcntcccccacacccgaaccaacaaacaaacaacaagagagagctctctcttcgcgcgcgccccacgccgggcgaggtcanatggcacgggaggcttgtgtcgggccggtggntntcgcccccgcgccccgcgccgacgcacgcgcgcgacgagagtgcacgccccagccgccgcgtcgcacccgcagcaccccaccacgccaggccccacaccgcgcncgaacggcagccgacaccgcgagaaggacccgcccgcgccgtcgccccgccgctcccgancgacccgcacaccgcgcgccgcgacccgccacgtcccgcacacccacaccccaccacaccccccgcacgcgccgcgccgacaacccgcgcaccgcgcggcgaagagccctccgcctcgcccaccacccccgcccgcccccccaccgggccgccaccccccccaccgagaaaggccggcgacgcctcggcagcgcggcgccgaggcggccacccacgcgcaatcgccccacccgagcgcgcgccgcagggggcgancaccgcccgcacgcccccctccgccccacccaccgcgcgggccgcctcacccgagaaccgccgcccgccaccgcacacgagacgcaagcgacgccacaacggtcccggaaccacagacaggccacaaatacacacacccgcccacaagagcggagatcaggagaaggcccctccccacccgcgagcgcggggcgcagagcagcacgcccccgcgacgggcaaggccaggccggagaagacg

SEQ ID NO: 10476 - DNA, 1507 bp, Homo sapiens
  misc_feature (1)...(1507): n = A,T,C or G
gatgtggtgttagaagtgtagcgagttgaatgaggtagtgagtaggtgtatgtatgtgacagtggagtgaagtactgtgtaggagtagacgtagagggatcttgcataggttggtcgcgncagtgtgtgtntgagagtgagngctcaagagtacacatgcagaggcacgagatgngganggatgcggatataggtagtagactggtgcgctgnatatacacctanactctacgaacagagtagcgtgtgtgctttatattttgggtcgttgcggcgcgntgtagaactatgatgaccgtgcgagagcgtcgtgtgcgtcagcataagtagcgatgagtatagtgtgatgtagcacactgagaagagagcagctatacacgagcatacatgtgagacatgagcgcgcgaacgcgagccgccaggggtatagcatctantcaatttacgatatatgtctctacgacacaccatgatatagataactttaaaaacgccagcataagcgtgacagnggatgctgaacatgagagagcgagccattaatcggcaacgtagagacgatacgatgatgtgttngggatctcgcgacacggataagacggcgaccactgtccacantgtgatacgtcaaagcttctatactggagatagtagtagtaacatataacgaacagagaggaagaacagccgtgcgccgcggcgatatagcgcgatggcgcntctagttatgtatgcatgcgtgtcctacgccgacactacaccaccgcgacgccccagtcagggatgcacggtattacgtcagtttgcgtcgctacagacaaattgaagaggtgactatatattatatgatagcgatcgattatcagttggactcatgcggccccgtgcttattatgtagacaaaacagatataaaaaagaagtgctgagtagctcggacaggcgaggagatgccgtgcaatacgaggagcagatgtgcgcgcgagtggagaggtataagagtngttagtatagatcacggtgagagaggtgtagatagatcgcgagagaaggtgcactacgaggatgatagtacgtgagagaagaaaacgtctcgatggaatacgcacgagatangcncgagaatagatagagaattagtccacgttgctgtgtcagatagtgtactatagtgtagtctataagtatctagcctgagacgagtgtgagacattagacacgccatacaggtagcatcgatcactagctgtcgatgacgcgtggaggcgcgacacaagacgtagaaaggtgtttattataaactacgatgcacagtttaatgtcgagatcgtgttattgatggtgtgtgagttaggggaagtcagctgagatagtgagtagtggagttagacgatatgtgagatgcatggttgtgatgcgtaaccgacggaacgacaagagatcgtaaatcactatatatattatgctacagagatacatcatcacgtactcctctcacacctacggtc

SEQ ID NO: 10477 - DNA, 1451 bp, Homo sapiens
  misc_feature (1)...(1451): n = A,T,C or G
agagcgaagcgagggagatgagatatgccagacagcaacaccgtgcgccaacacagtcacagctatgaaatgaggaggatgcgaggagtaggagtcgtggagtgtatagtgctatggatacattacctcgtgacgtgatgaagataggacgcataaacaaatcacgacggcgaggagcagaaaagagacatatacaagtggcataaagttagtngaaagaaagncgtactccgtgatcgcgtacagccgccgtccggccgagcgctgcagttcaatggaacgcaggatgatggctcctaacaggctagtgagatgagaacgaccaaaccaccgacgccgccaaacaggaaacggggagagcaaagaagcgacagangccaagaagctgatgaatattgctagcaagacaagatagaagatacgacagacggcgcagagcagcgcggccacgagcgcgcgcaagggtagagaggcacagcgagagagaagcgcgcgagagagatagcgagaagagacgaggaggagagacacggcacagcacacagtgaagcgcgacagcaaagacgcaaagagnagaagatagaggnagacgcatgaacgagcagacagacaagcagagactacggacgagagaagaagacacaatgagtaagaggagctgaggaggatgctggtgaagcacgacacgtagcagacagagtggcggccagacgtagcagatcataatgtacggcggggcgaggcggaaggaggaggcgcgatggccagcgggcgaccgcggtgcgacacgcgcgaacagcggatgcgnngcgacggcgccacggggacgcagtagagtgacgccacaacacgacagcgtgaggcggacgggagatacaagtgagnaactgtggaactcgaagacgnaacgacgacgactgtaacaacaagagcatcgcgtgatcacacgtaggagaagtagtggggtaggagtgtaaggacgaggagaactcacnacgcgctcgcgagcacacgcagatcatgaggagaatgcggcagacgagagcgagggagagagaggcgacgcaggtaatgagacgaganagtgtaggatgtcgcnggacgcgtgatgtgcgcagaggtgtaacccagtgcgtgcgagtgagcgagagaactgggacagaaggtagagacctgaacaccaaaggcgaagatgaggcggagcgtaacgagcgcaatgaggctcgngggcgacagcgaggatcgcgacggaggcgagggngggagagagacaatggacacgaaccgaaaacacaacggaggacgctacggcaggagatcggaaggcggagcgcgnaccaggcggcgcgcggcgcagcacgcgcacacagggaccggggacaccgggatgtgaggaaaagacggaggagcgagaggacagcgagcaacaatcgagccagtaggcacacaca

SEQ ID NO: 10478 - DNA, 845 bp, Homo sapiens
  misc_feature (1)...(845): n = A,T,C or G
taaggatggatgtagtctggggtgaaataagtgcgctcccggggactctggcatcacactggtgtttcctgaaagacttgacccaatgggcaacaagaaggagcctgagaagttgccagaccatgtgcctctcttttcggacacagttcccagttccacgaaccaggttgtgggcagcaggctggacacacccctgggacagactctcatccgcatggacttcttcttcacagaaggggcccggaagaagaagctggaggaccagatgcagcccatctaggagcaaggagggctgggctggccttccccagacagagtctcgcactgtcgcctaggctggagtgcaacagtgtgatcttggctcaccgcaacctccgcctcctaggtccaggcaattctcctgcttctgcctcctgagtagctggaattacaggcatgtgccgccatgcctggctaattttttgtatttttagtagagatggggtttctccatgttggtcaggctggtctgaaactcccaacttcaggtgatccgcctgcctcagcctcccaaagtgctgggattacaggtgtgagccactgcgcccgaccatgcctggcttaattttaaaattttatgtaaaaatagggtctcactaagttgaccagcctggtcttgaacttttgagctcanatgatcctgcccacttngccctccataagcactggtataacgggctccgggttcacttcctccaccttaagggacccttgtgattttatacaacctttatatttaggcaaaaaaaaaaaataatgggcttgttggcctaaggggtggaactctgcggccgtttccttagtgg

SEQ ID NO: 10479 - DNA, 368 bp, Homo sapiens
ctgattttacaaatgttgcgagtactctggagttcttatggtagtaaaatgccgtaaagaaaattctgctttgaaagaatgtctaactgcttactataatgatccagccttttatgaagaatgcaaaatggaatacctgaaggaaagggaagaattcagaaaaactggaattcctacaaagaaagggctacagaagcttccaacaggcatgtaggcagatactcaaaagacgttcaggaactctaatattcatggaagtcattttatagtccttaaataatggactcaagcatgtatgtttgcttcaccttaattatggaaatattaactttatctgaaataaatattctatttcaaaaaaaaaaaaa

SEQ ID NO: 10480 - DNA, 429 bp, Homo sapiens
cctacggggacactcttgtagttctacagtagaatctcacctttccgggaagactctgcaatacccagccctggtcacctgccgcgtaccttgggtgactgaacggtccctcacacgtcccactgaagcatgatgcctgctggttgagggaaactgggagcctgatgcttttgctgtcttctgctttgtatggatttcatacacagcaaacctactatgagaacacactctttaaaaacaagtgcaaactgtcaataaaaggtcctctctttcaagtcctcggaggttcgatgactgagcaaagacagtttgggagcatcattgtgcattaaacatgcctcttgctggggatgggaaattgatgctattttataaattagttgttattaattataattaaatgagaaaatgaagttaaaaaaaaaaaaa

SEQ ID NO: 10481 - DNA, 519 bp, Homo sapiens
cagcgtgtggtcgcaaaggatcacacgtatggaagtgagatacctcccgcccggtaagggggttcaaggatggagaggactggggacaccagtacaggccgaggaacactgttgtcttgggaagccggaggacttagacatgggtcgggggtggagtgaaagagccaccctagcagcggggggggggcgagaggtctgacaggtgaggcggaccttgggtcccgggtgcaggcacgatacgtgcgggccggatcgtggtggagctccgtctggagtccctttcgtgggggtgggatgaggttggcgtgggatgggctgcccgtgtctttggggaagggggatgggtgtgagggcgtgccaattagacgcgcatctataggtgtagagtgggggtaccaagggtgggcgaatgggaaaatttgttgggggggtgggcgttgcggtgtgtgaattggttgccccggctttgctgccaaaaacgctaacgcaacccctcgagcggggagaacgagggggagg

SEQ ID NO: 10482 - DNA, 678 bp, Homo sapiens
  misc_feature (1)...(678): n = A,T,C or G
cttttttacaaatatataaaatctattggaacggtagggtatggataaattatttataggtcacaatcccccccactgtttatcctaagccccatctaatcactcacccgtgggatatcagcttatttttttgtgaaaaaagtccttttgcaataacgttttaattacaacattcttttttcaccccatatatgaaccgctcggtattgtccacagctcatggggaacgttccggtacatgtccattcccatggctttagtaattaggccctctataaggcgacagaaggagtctttccctgttgttcaggctggagaacaatggtgtgatatttggctccctgcaacctccacctcctggggtcgagcgactctttccctcagcctcccaaggacatggaattacaggcgcctacccccacgcctgggtaatttttttaatgttagtaaaaacggggttttattatgntggccaaactggtttttaactcctgacctcattatccccctgttttggcctccccaaatgctaggatttcaggcgttagccagcgggcctggcctttcaaattttttaaactttgcccccccaacaaagattttgttaagctttatatcccatagtttgtattaggaaaaccaaaactgtgtttaaaaatttaattgttattatatttt

SEQ ID NO: 10483 - DNA, 350 bp, Homo sapiens
aaagaccagacttacaagagattcttaagggaattcaaagcatggaaataaaggaataataccagctaccacaaaagccttctgttactgatttatttcttttagcaaatgtcttgaatgttcatccacaatgttgtatattgcaaagtgtctttcatttttaagtctaaatagtaatctattttatgtatatacaagatgttctttatcgattcattgttaatcaacatgtagttttttcaatagcttggctcttgtaaatagtgctgcatgaacataggaacgcttatatctcttcaagatcctgatttcagattctttttaaataaatacccgaagtgatattgatg

SEQ ID NO: 10484 - DNA, 1343 bp, Homo sapiens
  misc_feature (1)...(1343): n = A,T,C or G
gtcaattcctgatattaacatcgtcacaagcgctatagtacggtgtttactgcnacgcaaggtctaagtaagcaatcggctcataaccacagcgccacacaaagcgcaccagtgcctcaacgaaccaatacctgtcatcacccgccacaccacggatcccgtcaccnccctcccgctctctcagccaccaacgccaaccatccaccctcacatcctactaggcccatacagtacctaatgcacctcgagtcatacatctcctccttatacagcctcttagtgcttcggtgtgncggtttccgtccccctcgcctcccagccccaatccctccatcgtctaggccacactctactaaccactcctgccactcggtcgtctccccttcccggcccacgctctcatctcacgtcctcatctcccacactcatgcctcacgccctatctataatgtctaaaatgtacttgacgcccaccctccgtctatttttgcttctcttacctacgctcccatgtgaataaaacccgtaacaccctaccaatgaatacacccacagcgatcatataatctatttcctttcatatagcccacaataatcttacaacgatgtcnttatcggtgatgatacgtgtaggccagagacagtctcataagagcttacccaatcgtcacttgagttcacttataactgctccccgatgtagtggttataataagtcncactatgttattatgctagatcgctgcacctagacattctaacgtttcattcaagtcttctttatcgtcaggctatgcgccgacgtacgagacgtcacatatagatcnacatacacagatatctgtatcnctatcattgactctcctgtcgatcagtcttctcctgactgtcgaggaccgctgtatttgctgttatcacattcaccatatgcntcataggctacgccccgtagtacagctacctatattcactatagtcntcccacctacaactcatccgcgattatcaccnccactccaacttcacagccattctctactctcagctacatgctctctgtnctctttctcgcacatgaagtgtntctctccgctgtgatgcactctcagtacagccgacctagataagcgntcacatacnacagcatcagtcgcacgtatggatcctctcatgagcgactgtcncatacatgatgatgttgccgcacctctcattagtgcaccaactcctacgtccctccgcggcaggtctgtcagacgaggntancagagtaacgncncacatcgtnactctattactgatagtatatgctgataagtatacaccnatcgcatctcagttng

SEQ ID NO: 10485 - DNA, 1678 bp, Homo sapiens
  misc_feature (1)...(1678): n = A,T,C or G
gagagtgtgagtgagtagatgattaagacaggagagagcgaggaagagcgccttcgagcgagctaactcagagattgnacatttcgttcaagatggaggatcaccacggcacatcgacacattatacggttgataacagcgcacacgtgaactttactaattgtacgtcgatgttgaggtacagtcgcgtgatgtatgagtgtcatgtaagataagtgagcgacatgtcaagacatgtataagtaaactcacattatacaactaatagatctcgcgactacatgaaaagtggtcgggtacgtcaacacgcacgtcatgcaagcgtcgtactaagtgcctcctcgcccaggcatgcttctcttacgtctagcntactgcggagtganaactcaccaacaattacttgacgaggacagcactcaggactgacgtatganttcgcatatgcacaaaatgacaggactcgacgagtaggcagactgtgcgattgatgcacatgatagaagtcactacatacagaacatgagtgcgagtaatgtcgtagacatcagatcgcgtgacgtgaccaagagagtgaacgcagtatgtgagagancntgattatctnaggtganaacagtagactctacacacanacntcacgtaatngaatctgcacgatataacaggctnctagtgctgtctntcatacactaacgtttatatgtntactagatgantatgcagatcgcnaacatctctactcatacatagtgtgatacgttaccgtntgagtgagactgtccacgatgcacaagagtagagatatcgtgtagtaancgcacacgtactcntncaaacantccagcactacacttacacagtcagtagagctagagactctcantgagacgtacactactagcgagagagccacagagtnacaggtatagnatgatancgccagttcctactgtcgtcgagtgtcacgcttctgatcagcacgttgantatagtagcgtaacttgtntgctgtcaacgctaggtgccagtacgtgtgacatgcgcgtagatagagnangagatgcacgcgcgcgcgtagactactgtcgncgctcgactctaacantcatgagactcgctgcantgcactgctacgacncgaanagtacgagancatcatctctcatgcatcgcgttgcncgtgctgcgctcaancctactagacgtacaccacgcaagctaaacacataagntatacgacgctccgtacacgcagacagacacnacacgcacaatcgancgtctctcacgctttagtagcactatactacatatatagancagnatatcnacgatcactacgggnagcnacgctgatgtagtagacntngcngcgagcactctaatcacgctctatgntagtatncncatcnacatanagttatttctactcactatgagtactcactagtgaatcanaacagtantngaaanacgctgcgactcgcactnantgtatngnntncagatcgagcanagtgcgagacgagncatcgtgatacagcagaatncgtcatgctacgnactgtcgcgcgaatcgatgnanctcctacacctntatcanacgntacatacgnctctacgntgatagtacgancataagagtgcatcncnatcaccatgacgagcgagcaag

SEQ ID NO: 10486 - DNA, 234 bp, Homo sapiens
agttttcaagcaaatttttaaaatttcatgtgaaaaaccaatttagcatcataaagggaatttcagatacccataccacacatatgggtttgacagtaatagtcccagtttagatatgacatagtgttggcccatctggtatccatgtgtatgcatacaggtttatgtctgtgtgtgtttatagaatgatataaattgtgttttttgttttgggttgtagcaaaaaaaaaaaaa

SEQ ID NO: 10487 - DNA, 1357 bp, Homo sapiens
  misc_feature (1)...(1357): n = A,T,C or G
ccattagttgtgtgtcaatgatgaccctagcacacgctcattgtgcgcncgtgctgcgcggtaggcagtctcagatacacgtcttaaccacaccttctgatgacgcccaaccaatgtctctgcttctggagccagacgcggagacgacctacacacacccactcgacacacgcaggcgacgtacagccgtcaccgccctccctactcgttntctctcgcgcttgggaatcatcaccacgtgaagnccagctggtgcgctgctctgttgcgtcgctgcgcgccgccaaggantcgtcatgcgctgggcagccgcgccactccgcgcgttcaggaccagcaactagagacagtaacaccaccaatatgcgcgcctctatatgtgcttccganaaatcggacagcgcgagcgcaacggcggaggacggtgacaatggtcaagtagctagtgtgaggaacaatacggtggtccatcttatggcgtgtctgcgtggccccgttcggtggacaatagatttcattanaagagctctagcgacatgggtcgaccgatcactctctacataccaatcgagtggtactctccgtgtgtactcttatccgccgcgccatgagtagtcatagttatgtatacgagtggtatctatcagaagtctgacgcgccgagcgtgagctatgcgcgcctacggcacggaggagtgantaataaggagcacagcgccatgccgtggccgctccggtgagacaacagcctgtacatctggttaatctagagtagactcgatgatagcgtgatgtgacacctcacatattccacgcaggtgcggncgtgtgcggtcgctgnaccatgtaagtactcacgcggcggtgggacataatatgtgaccagcgtaaggcgcgacgggcgaggcctctcgcgcgcacgctgtgtgacgtgcatcagaagtagctcgacgtcatggggtctctatacgcagcgtgctctccatnanctgccgctgcgcgcctactgtcagagcgcacgccnggctccgatgtgctggtacggagacctcgtagggtgatccgcgggccgatggggcttctcgcgcgtctctgtctgacgcgggtgtgtacagcgtctgtcgcgcgacgcgcgagcgctcagtagacgcgggtgcacacccgtaactactcaatgtacacgatcgattcagccgctctcaccacgtgtaactcacaagagcgcataagctctccttcattgtagcttaactaatatcctccgtgggcgtgttatatcttctacttcgattatgtgaggcgcgatcatggagggcgcgactggtcgggggacaccagctgaatgtgaggtgcgatt

SEQ ID NO: 10488 - DNA, 835 bp, Homo sapiens
atccctgtacactaaagcacattaaatcgtcatgtttcaggccgccaagaggcttgatgatgtgtccattaaagatagttagaatttgcagtacaggaacactcacaagtgcgatatatactcaccacaacagcctagttactagggacctaccatccaaattcacaaagctgcttcctctcacgctcaccaggcgcgcccgactgggcatataacaaacgattgtcttaacccaataaacttattaagcacgatagaagccccttctctccacacactgttgtgtggcacagactggtcaaattgcacaatacgttaacaaaaataatctgatatattgtctactagatacaagctatgacgtcaccggaaaacaagcaaagaacataggctagagctcatatgtcttcgcatataggctccacagcatacaacacacagggtctaatgtaatgtaggcaaacccatagaaatcattttttcgccttgtaactaaaagaagccgcagaactcagaaagtcaccatggataataaagataagcacgacgcaaagaatactaaaattcaaagtcacgccaattaactatcaatattgaggaaccttagagagaccaagttgcatagctatatccagaacaagcctagattaattatgccaatgcgttaaccccggaaaagcaggagccgtagttctcctaaatgtacacgccaatatagtaggacgccaatataaacaacgagggacaatttttgtccatgcatacttgtttttctgaacatgttatgttttaaagatatatcaaatattccaaaacactaaaaaaaaaaaaaaaa

SEQ ID NO: 10489 - DNA, 1250 bp, Homo sapiens
  misc_feature (1)...(1250): n = A,T,C or G
atggatgaanggagtaagcttatggtatgttgaatgtatatgcagcacgagattcagaggtgagtgtgtgagtgtgtgtgcggtggggagaggacggcattggcttctgttggcgaagctgccgattaagtgtatgcgccgtaagatgtgtgatacggagtcatgttatgcaaggtcagtaaatggcgattatgacaggtaaacggtagaggtgttgagtaggagcgaggattagaggcgcactcagttgcgaaggtcgtaggcgtaatcgggagaccaacgttgtcaagtaaatataggttggtcgaggagggaataatatggagataagagagattgttggtgtatgagtttcagtatcggtgtttaagaaagttaaggtgcaactgaagtgctgtgtagtggaagatgtgtagacaaggattatcaatatggtcgtaatgagatgcgaagtgaggcgaatggtggtatgatgttgaggaagtctagactcgaatgagcgtttttgttcgcgcatatgcgttgagtctcgtgtttgttatcttgcgagagtgtctagatgtgtgtcacgtgcaggttatcgttagacgccacgacgtgctgtatgttaggatcggtcgatcacacagttagtagctagatgaagtgtgtggttatagagaagataactaagagaggagagtagaggaaaagatagagcggtagagagtgatacgctatgagtaaatggatgggatggaagtcggtagtataagtcactatctatcgtaatctataattcacggtcangatgtagatgtatatgatatagtacaagtacagtaatgacacgttgtatgtaaatgagaagtgtgcagtagaggaagtctaaggatcttagcgaagagtacagttgatggtagatctatactatatgtatatacgtaaggtggaatcttctggagctggcatagctggtgtcagatctaatacatgtgtagtagtttgatggtgtgaattgagactactgcattatatgtgacggtcgttatcctacgacttggctagtgcgctctactgagatcgagtagggacacacaacaaagtgatgtgaaatgtagaagatagttgtgtttctatcaatggtggtgggtgagggttggtgaggagtacgtggctacactgagtntgctgtanttagtatgagataaactagacacgaaaggataatagtaggtaataaggcgatcgtcttacagtaaggaatcaat

SEQ ID NO: 10490 - DNA, 425 bp, Homo sapiens
ctgagctggagctctttgcttacatcgtacgacccgagctcactgtagcgcgcgtgcgccaccctgctacgacagaacacatagggagccgctcattctacgttgtagatcacagacatacgccctaacatgcgcaacaccgtgctgccttacctgacctacgaatgctttaccaaacctctaaaactataagcttgctctcagaaaacttataattcgaaaaaagtgtggtaatatgtctacagaatttttgaaaacttatttacatggaatgacagctcaatcacatatggagatttcattaaactggtttaacaagaattcctgttcagaagagtttagtactgagcaagctggttaccaacctgaagagtcttacactttaaagatacagtaaaatatattcaaacataaaaaaaaaaaaa

SEQ ID NO: 10491 - DNA, 1774 bp, Homo sapiens
  misc_feature (1)...(1774): n = A,T,C or G
ctgtgtagcgtagagtgcgagaggtcgcgtgtatcgagtangancgagatgagcgnatgtgcagtgaggtatagatgagttgagacagtgtgtngtagctagagtgtgtgtgaagcagtgatagagatttatacttgttacttgatatatnatctcgttgatctatatangatgatatntagtntatgatgtgttctgtggtagttganagatatacacacgatagacttaattaatatatcgtgtgtgtacttctntagcgtaatactcatgctctatactgacagatcgtagtanangagattcttatatacaatatatatatangcgtgatattgagtaancatacagagcngaaagatatataagacactgcntcgagcacatatagagagtgatcattgagatttatatgcgnttgtantacagagtatgantatcaagacgtagctgacncttantatcacgatatngagaatctgcagacttcagtnacttatatcgntcagtagtaaatatgagctaactacantcacgtgtntantgtagtantagacacagcgtcttaatgangnagtngtggtcagntngnttactctctacgcactcagnactagctngcgtacgagtcgctcnacagacaagcgtgcagnagtacagaactgtataagaagcaatgacgacactagatgtgtacgtaactnggtgccatgacgtcataggtcgtgaccacaatgggactaagcgataacagagacgagagtgnataggaggtgcagtcagagcgagtggctcgcgagtcgtctatagcttatatgtcacgatgcgatgtagagtacatatagactaaatacatataggatggagaagggatgataatagatagatagcatatagnaagtatatacagtaacatcagtaatatacagatataaataacaactnagaaagagatagagaacntacatataatcagtatcaactagatgaggtagtaagctattgtatatactatagtagtgtattcataataattagagcagatgtgcgacgtgtgtgacgatttgatntactatgagatgagtaataatgagatctttagtcagaattatgattaggaatgagtgtgagagagtngtatcgacatacactcaatattgattatcatacntagatggtatngatagtagagtacgctcgcatcgcactctctaacatgatctgaatgatagaattatgataagatngtatagcattataggatgcgagatgtgagataactgttgttgttgtctatctctacgttcantaggtatctgtctgagaggngcgcgctgctcaggtgagagagagtagtgtcgtatgcggatagtagaggagattaggacgtacnttacgggatagagaattgagttaggaataatatgaatacgctcgatctcaacggggagacggtgagaggacgtaaggagaagatagcatgccaaatctggcgttagtcgctggagaggctcgttcgtgagcngcaggcgagaagtgagagngggtaaacatagacgatcgacaagagtcgcgctgcatggaagagataggagcgagtgatacaagataaatcagatgtagcgagtgagtagaatgctcttaagctgtatagtagagagatggtatgtcgaaatgtaagccacganggatataaacaatcactagagngatnagnactagcagtgacgggtatgataacgatacagtagtnatattntagcagtgacagaat

SEQ ID NO: 10492 - DNA, 1609 bp, Homo sapiens
  misc_feature (1)...(1609): n = A,T,C or G
gagtaacttagtaggtcaggccagagctaagaagagcgacacacgtantcacatacgacaaacacgcgaggctcacgcgtggcgtcgtgcacggctactcgcagtgagtgcagtgcaagcacgatcctcgacaggacactcgtgcatcatcacatcgagacgcatgctcacatgactaatcatccaggacaggctgcgcgcgcgcgctcgtgatgtgcgacggtcgcgagcggacgtcggacgcgcacacatagcactgaganatggacgataggcgatgctatgggtgagtagtgatcagagcactcactcgcggaaggagagtacgtagacgatgagcatgagagcagcggcgagtgtgcgtagacgancgccatcatatcactataagcatgaacngatgtataatcgcagcgancaagcagatcgctgctaacatactaagaatacaaacataacagagaccatgcgcgcggagtaatagcgaggaatgtacacatggacggaacgtgcgcggctctataacatcnccaccaacaaacagagctagaacagacgcctacacgcaagcatgtattctagtaatgctacatagatgctaacactctagcaggagtatagaaggcgacaaacatcgagatcgacttgcgtgcatacgtgagtgtcagagcaggctcgttacgagcgatatgtccgtctgtactacgaattgcgagtcacgtcgtgatgaggagattagagatcgtgtacgncatgactataggtgcaccacgaacgcgatatcgagctagtagatgagccggaaccagtacagagccaccagtcaaatgtcctcgcgtactgtgagtgttactacgagctgatgagcgagccgacgaggngggtacagaacagggatggagggaggagacatagtagtcatctcgncgtcgcctactctactactcgtaaccacaagcctgtgcagagagctacaagctcgggtcaccgacnggcgagngagaggtagaggtagacgcgaggatctgtgtgacgncggatggacggataacgcacttagtaggcagatattagacacgtatcgtcagcgagtatgtctcgactgaacggagggagatgagtgtcgaagaagaaganagagcggagatagaggagcgagaagactggagactagctaagagcacacgcgtaagcactgcagactataatagcaacgtaagagaaaggcgacgacgagncgcgtccagccggagnccgggcggcggcgacgcaagacagtgtgttgacagcgagatgataagagtgntgcactcgagacgacgtgctactgcgagtcacctcggacagggcgtactgagggagagaggtgatacgcatagaggtaatggtcatgtngtgacacgacnagaagcgaaggtgagagcggaagtagtgacggtgangaagtgnagcgtagacgaacngagtacgcagcaggatgttgtaatgttagacgtataaatcgatcgaataatctcgtagtgcgacgtgaagcacgactcgnggagagctatcgagtgtcgctgtgcggagcgagacgcaggaagactgtcacgctgtcggacgtgaa

SEQ ID NO: 10493 - DNA, 1742 bp, Homo sapiens
  misc_feature (1)...(1742): n = A,T,C or G
ctgtaggcactcagcgtcagctgggcatcgagganatgagagtatatgcattgagatatagactatatcatgtgatgtctacagaggtgttgtgcattnagtgatgtgtctagtttggtgtcagtgagtagtgctctgtagctgtgtagtgtactgtacgtgtagatgactgtagacgatctagatatatattantntctctcgtntgacttagcgtcggacagtacgccgacgatgaggtacagacactgctagtctgcctgatgtgtcgtgcatagagagacgctatgcttgtacactctcgtctgagtcgttgangcgtgtctgtgctantagtagataggtcagatgtgagtgctcgcgatagaagcatgtgatgggtgntacagtgnatgntatgantgtgcagtctgagtctaggtggcgtatataacctcatgtcacagcgttatcactattgnatntcgntgantgtaatataantacattgtactgagtcacgactccatatgtcgttcacatcgtactgagtagatcagnacgatcgcgtgngantgacgaanagtagcagacgaggacgnacgagagagacgcatgtgagtnatatgntagctagatagagaatagagtatagtatatcacacgatacnatatagtanacatgtaatacaatagactatacagtagatgtatgggtgagngtgagggatatggtatgttatgatgnagtatgagtagntntgtagttgtgtagcatangcgtaatgtatatatgacggcgagtntagcttagtgtagcatagcgcgcgcgatgaatgtagcgantcagcgcagcagcgnaaatgactcatgtgtcggtcgtatatntngacgcgtgtgtgtgtgctgtatgaggtgtagagaatcgactcagaatatncacacanatgcagatgtagatacactagtngagaagnagagaatcgcgaatacagaatgtgacagtaaagctatgagcatgctggttcagtagctatgtatatcgattcgtagatgacgaggtgcgaagcgtaggtgagaantgnatactcgagtnatctgtgaataggcataacatcgaatatgacacataggatgagacacacgtaagtaagaagtggcgaggagagtgagcaagctactgtgtcgtnatagatgggcgagatgagaggtctcgcgcataccgagatattatgaatatgactgattatatggaagagagtatgagtatgacgtgaggtagtgagcacatatagatgtataagagatgatgtgggnatatatgacgcgcggatgtatctagaagagancacaataactgcgcagtcgctgagagtggctatgtgctntagaataaatggtatttcgctantagtgtcagatattatatcatgnagaaacacgtgtctggcgcgnttgtagttgctgtcttattactactctcgtatagcacatatgctatattgtatgaaggtgtagcatttggctcgataccatatgacagttgtatacatctcataatgtgtcaatccgaagtaaagaatagatagggagatatatattagtattagacacatatgtatatagaacagntctaatatagtgttcacgtcatggtcaataatattgatttttataattagatatttattacaatatcgtcacnaaggaaagagattatatatgatattttatgtataattctttaaattcacatcttaata

SEQ ID NO: 10494 - DNA, 386 bp, Homo sapiens
tagagatggggggtttcacgatattagcccaggctaggtcccaaactcctggcctcaagctatcctcctgccttgacgttcgaaagccctgagattttcctctctgtcctgccgccatgtgaagaaagatgtgtttgcttccccttccaccgtgattgtaattttcctgcagcctccccagccaagctgaactgaggaaggctactaagaagccagctctacttttgaccatcaggtaccatcttaggcttcagtttcctcaggagaagaggatccttggacaagaggatctgcaaagttccttctaactaatattctatgattctttttctgagtaaaaagatggatttatgacaaaattaaaaaaagaaaatcagcttttaaag

SEQ ID NO: 10495 - DNA, 798 bp, Homo sapiens
cctagggtcttgctattatgctgcctatgatgatctcgaactccttggctcaagcgattgtcctgcctcagcctctcaagtagctggaactacggcacgggccatgacaccaagccctgtctcagttttgacagacctggtccttctcatcttttatgttgatcaagggccatgtcccttaaagaaagctgttctgcttacccaatcgaaatggcctcgctctgtcacccaggctggagtgcaatggtgtgatcttggctcactgcaacctccgcctcccgagttcaagcgattctcctgcctcagcctcctgagtagctgggattacaggcacctgccaccacgcacggctaatttgtttttttttgtttgtttgttttgtttttttttttttgtatttttagtagagatggagtttcaccataccgatcaggctggtctcaaactcctaacctcgtgatccaccctcaacggcctacccagatttttataatataatctaaacactattttaaggctattaagtaagatatttggtcattttataacaatttaaaagtgatttgtaatttaatgtatgaatttttaaaatctgattaaccattaggaagtattgtattaacactaacatttaaggatgaaatgtccttagaaataacaaataatctacttaacaatctattggcacataacagaggcatttttaattatatttgaattgataaccaactatgggagaatcacagattattattttattattttcttaaaaaatatggttattttaattttaaaaaa

SEQ ID NO: 10496 - DNA, 722 bp, Homo sapiens
  misc_feature (1)...(722): n = A,T,C or G
acctccctaatcaaatacctggatatatgggaaaaaagaatggtgctataccttgccccatatttcagagcttgatttgtttcttcaaatatacagtctgcgaatgtggagaaatatttataagaaaagtttaaacacagcttgcatgaccccaaaggagtgatacagaggccacataacactaatgattatcttttgaagctctncagggtcacctcatggcacaatcagactgagctgtacttaaggatcgaatatccctggttggctgttacatggcatacccaaaattttatgtgcacatggcatattcaaattgtcctgaaaccaaggatatataatgtcaacagtacatggctggtcccattgtgctaaaattttaaagctagtctcaggtgaccatgtccagaaaaaaattacatccctggagactagtcattataattaaagataacttattaatcaaatagggacactccatagcagggaggtaattttttattatgcaaacaaatatttatcacatatttactatgtacttggcgttgcagaagatgttggggtggcaaagccattgttacagaagctgtgatgtccctcccacatcctcaggccaaccaccaagctcgtgacatttattggatctttccaggatattggctactgctggaagtcagcttggtatggtaataaaaaaatttaaaaggaaaaaaaaaaaaaaa

SEQ ID NO: 10497 - DNA, 1433 bp, Homo sapiens
  misc_feature (1)...(1433): n = A,T,C or G
caggggagaatgcagtggttgagtaggtgtgtgtacatactagagagagtgtagggtctgaaagtggttgtggttgttatagctgttgatgtggtggattattattgagaggatagaaacgtaattaggtgaggagagaacgaaaagtatagcgataagtaatgagtcgaagcagagtagaataaaatatancacgtgagattacaatattgatatatactacgatattaacactagtgaactaagtgaagacacatcacttacatgcgcacancatncactnctgtcgatcatagagtatgaagagattagcgtagatagagtgaggtacatatagctgtacagttagcggtaagtggatatatangagagaatagtagagnagaagaagagagtcgagcgcgttgncctctgatcgctgactatatattatgtatataacgctgtactacgacgcacagtccagcatnagaggtagagangcgacagtagcgcgtacgtgatatgatatagattantnatatactaatnataggtagcatgactgtagtcgttgtgatgagtggtactgaantgaatagatgagtagatgagataagcagaacatagagagacatatcatatgtagacagatgatatagtgtgatgtgatgagactgagntcagatgtcgtgatataatatggacatatataaatgtgatggtgaagcatcaatcgagtgacagcagtggcggagatagatgtgagaatatagaagtgctactgatatatgaatatgtcgttgtgtgatcgtatgtgagagtagcatgctgtcgtatgttaattgcgcagagcgagtccaagaagataagtatcaggatataaacaccgcgcacgcagaacgcgaacatgtcgagcgagcgttaagtcgtggctaatctagtatgctcacgctagtaaatgctacagtgtgaacggagtgcgatgagtgaagatggctagcaaaggaaagactacgggaacctttactgttatatataaattattatttagtatgtgatgtgtgaatggatccaaaaggtgtaatcatagctgtgtgggtggtgtgttagtgatggtgtggcagacagagtgagatatgaagagagaacagaatctgtcatgaattggagacctatactatcagacntactatcgttataggttatgacgctggntatggtattgatttatgcatgctctgagcaggagctgcgatgcggaagtgatagtgtgtaatgatgagcgcagtaaatgtagatagtaggatgttatacgtatgtaatggtatgttgtggaggcagtagatgagcggacggcgatatggagatggacgaacacagagtgtggatgtggaggagatacattaaggtgattaaatgtatgtaggtataattagatacgcgttattgat

SEQ ID NO: 10498 - DNA, 1484 bp, Homo sapiens
  misc_feature (1)...(1484): n = A,T,C or G
ctcattagtgtgcactaagcagttagtgtgataatagttaatgtatacacgcatgtgtctagaaggtagngagacgatgaacgagtgtatgngtggaatagatggagcgatcgaagaggactgaataagctcgaaagngcggtcgcttgcacgagaatgagcgagctgagattgatatgatgtatatagtggcgagtgtgtctcgtggcgtcgtctgtaatctcanatctncgtgtaatgctcgacgtagtntcgattagcatgatcgatagacgtgctcgactgtagtctgattagtagaatctatgtatgtgagtgtangagtagtactctctacgagcgattgaattgtagacgcggngncatgcgaaacagttgataagcatgattatattaagtatagtatattcatcttgagaccgatgacttatctaagttatagtataatatgtagtcatcaggattacgctgatgctgtatactcgnattggtgttagttaggttacgtacttttgattagntacgactgactagaataacgacacagtcgcacagganatggtataatggagatgtagtantgtagtagctacgctaattctgctgtgtgacatgatgtagtttaagttgctgtaggctcgagaagacgggagaggcatgagcagtcgcatggagcattgtatctaattcntgagaatattatgtgtgcaaagcgggtacgatgtctgtaggatcagtcaggcgaggtgggaggagagagagaggataaatgtagagcgatgcgtagtgagagtatagacgagcggtatagtcgtgtaggtgttactatctacaagtgtgtatgtatcctccttacatcgnttacatgtcgaccgattgantagttaggtctgatactatagtatgctactgactggtcgactaaatcggtaggtagtaatcagaggagtgaanatctatgtaccagacgttgtatgtgcgtgagttagtgtcgaggagcaatgcgcgtntgtgtaatcacagctgcaagagatagtagatatagataagagagtgcggacctatgtgacagtctccatctgcatagtacttgtaatagtgaatagngtatatgtaatgttaatgcactagatgcttgagatacagattggcgggtgctggtgaatggagaggaggttcgtggtaggatgtctagataggatctctgagctaagagtctaatatgttggtaagtgtgtgccttaactcgttacatctgcgacgcttagtgagtcgctatgcaagacgatcacataaatanttattcatattaacatatacagtattgatgtaatcatgatatagagacatgtgagatcttggcgtcgcagtgatatgacgatgtttatccctctgatgactatgattcgtctgatcgataagtacgacacatagtggtctggtatgtgctgtattgtattcttggtatatgactgactttatca

SEQ ID NO: 10499 - DNA, 345 bp, Homo sapiens
  misc_feature (1)...(345): n = A,T,C or G
ttattcatacctctttttcttctattattctccaatcccccccctttaaagggaacagcaatggntttatcagacataaacatattataaactggatgttcggctcttgggactcttcgctggtggtgcatacaatatatgactactttgaggaccaacaattctgcagccaagctacaaaaaagagaaaagtttaaatgagttatgaaggaaaagaccaccagtcttacaaaattacattttgtaacattcaccaattctttaccaaagttgttgaccactgtttcagaaatcagcaaatcattacatgaaaaaaataaagatgactatacaaaaaaaaaaaaa

SEQ ID NO: 10500 - DNA, 1020 bp, Homo sapiens
  misc_feature (1)...(1020): n = A,T,C or G
cttactatacgatctgtctcgctatgttaaactggacattcactaaggtcgcggtcgtatgtcatgtcatcgtgggcggctgcctcgacgaaatagatgttacgtaccgaggctctgtcgtaaaattgatatcgactattgtgcgaaatcataacgtacgctgtacagcgcggatagcatcgctcgactcgccggtgcgttgtgctccgagcgctgctcgtccgcgtacgtcgcggcagtgttctcagcgcgttcggcgtcgtctctttctggactgtcgcatcaagtgcatttcgtttgcatgtgggctctggtgggtgggtttgttcgtgtatgtgctgcggtcggtcggagcgcggctgatgtgtgccgaacttgcgggaggtgttgcgcgtgtggagggcggnggcgtatgcgttcgggatttctgtgagcggagcgggcggagcggcgtggtggcgctatctctttgtcttcgactttctgtgagtcacacccgacgcctgtcgcggatgagatgtgagggcatattacaaacaaccgaaaaataacaagttataaagcaggtcacatataattttttcatatntacttagtcttccttctanggtctctcaataattatgttttcttcttgtgtgatggtttcattaatgagctctagcgatctgatgtgagtcttgggttcgtggaggtgattttatcataaaggatggattatatatgttgagtaaatgtagatatggaattggtggttgcagacatagtacattattgtatactacttggatggtcgttatctctatatctacactacactcacgaaaactttctgctgctgtttctgggtacgctgtgcgctcgcacgctatctgtctggctcgctgcatagctagtgcagtatatttgtagttcgacctgccatctagatcgtgtcctctatagagtccgcttcgtaccatgtttgataatagtgattagtgttctgaagttnnccatnttattgtttctctttntaag

SEQ ID NO: 10501 - DNA, 1242 bp, Homo sapiens
  misc_feature (1)...(1242): n = A,T,C or G
cgcatacatagataagaagcatcgcngcatgcggtgtcntattcgtcgtatagcacttagaatacttatgctctcattacagtcgntcagtcgcatatcgtcactgttcgacacagacagcacacgaggataacaaatgaagcaaagcagtgagtcgcacaacatcgacganngacgtaccatgacagatgggatgtcgctaagatgagtagagcgtcgctagacatccgcggcttttcgtctttcagaactaaatagagcacattatggccacattgaagtcctattaggtgtagatatgantaaatacgataggacatgcacaactagaggcagagatgcgagataaaatagggtgaggaaatcgggaccacacgagaggtggctattacancaatacgatangatggcggcagaactacaagcagagagcgtggagtgatgacgggacgagaaaggaagaatgttagatacggtgtttatggcataatcgtccatctgggttgtcgcgctccactgcttccgctgacagtcctatcttaccggaccgtatggtcgcgacgtcccagaatagagaagcgagtatctaaccacgcctagagatgttaattgtacacgtcgtgcgaatggtgttgattcgcaaaggcataagacgtagagagaatactccttactctcattancattgttgcacgaccctccctaccgagcactgtttaacatgtatgacgcgaacggggatgatatatgagagaggaaagaaggtgagaatgtataaaaggcgggggggacacaatgatccgacacgtcgatgcagtaatatatacagtaaaaactacttcgtcgttagttcgacgaaaagaatcatgtaggtagagtttggctagctcctatcgtgaagtatctcacgcagccgacgcgtccgagcgcagtagtatagcacagagtcggcggaccgagagtaataggtgttatactattagggtgcgagtcgtgtccaatgtgctaccacgtcactagaaagactacatgacagctgggtaattacgatccgccagtatctatcgtacagggatggtggtaaggcactgagtagcaaggacgagggcgaggtcgctcagccgcgccggcctattaataatgaagtcgggcgggtagaaatgacacatatagctgttaacagatgcgttagcgtcagcgagagaacgagagccgagcagcgggcgacaacgaatcaatcag

SEQ ID NO: 10502 - DNA, 359 bp, Homo sapiens
cctagaaggaacaaattggccccattgccagtagtcgaggtagtgctgatagaaaacagagtgaagtgagagctccccaacctggaaggcgtcacgtggcctaatcacccgggataaacagtcaattctacttaaagttttacataaaaagactggtaaaatacagaggatttaaatataagaagttttttataccacataaaactgactggatgccaaaattttacatttctgtgctgtgcaagcactttatggggaatgtgctttttattccacttttacatgtttgttatgagtctgttttgcaaagattgctccgagcctaggtaataaaaataaaaaatgcaaaaaaaaaaaaa

SEQ ID NO: 10503 - DNA, 933 bp, Homo sapiens
  misc_feature (1)...(933): n = A,T,C or G
tggtgacggtgtgggatagaaggaaaaaagaaaagaagaaacagggtcgagggggacagcaggcaaaacttccaagggagcactgctcaaagtatggaacacatattcaaaagctgtacagattgtataaagaacacagaagatgacatgtaaaacttgagattaatgtgtgaagcgagtgtgaatagaagaccccacactgtctggagagccggattctcccacgtctgcacagtgaccttggagctcttaatccctctaacatcacctcttttttgcgtgagattaagaacctgaagccatctgcctcttaaaactttacactcctgatatgatacctctgatgaacaacctgtagtgaaaatactggctatgatctctctaaactataaaagattgtctgcgtatcataatatacaaaatctggcattgattgataccaatcgacagaattacttgtataccgatcacacttaaatcgaggccaattctcatcactcttcgctcacctgacttcgattactctccagtctattcgtctcccgcaccactcatttactcttccctcaatcgggctcgataacatgttatccccaagcatacttggggtcctagctgtcgaaagcctcttctccacgcatcatgagcagtcagacaggctatacaaacccatacactgagcgcttcttgtttgcacgttcaacacctccccatcttccccagtcttaatcatgataactataataatctgacagcctaatatgccaattgcggtgtgacactctctatgtgattataagactatagcacggcttgactagctcctgcagacctcacgtacaagacactctactggaaccagattttactcattaatcatagtatatgctattattctttctctcatccgtgtacccaccgngcttctctcac

SEQ ID NO: 10504 - DNA, 1249 bp, Homo sapiens
  misc_feature (1)...(1249): n = A,T,C or G
agtattagggtcagtatgtgatcgtcgtgcatatctgctgagnacttgacgtgtgttgtatatatgttaatcgtgtatatttgagcgatgaggtatctctcgtcgtgtagtcgtgatnatgggtcttgcattgtcgtcgtcgtgtggatngcgcggagagagacttaatatacattgtaggacttagaatatgattagtacagagctgtgaagatatagtgcgtatatatataatacgtgtcatgtatgacatctatagaagatganttattatgtactagatatgcactatatgttcacgatgaatgtagatgttctgagtgctggcggacctatctgtgtggcggatagnggagtagagcgaggtgtgtgtgagatggtggagaggatgaggaggcgagaggagttcgataggagatgtgaatgcgagaagagaggtatgagtatatattnttctaactatgttatgtgntgtntgtggagtacgcgcgaggtgcagttggatatatagtcggatagcatacncaatgtacgcgattatgtcttgaaggggttgtatgagtagtgaatgcgcatgtgatagtgagaggcagttgagacgagtggatagtaattagatatgtgattgtggtacgttgaaggtgaatgtgatgatctagtattagttctgagctgtggacgttgctgagatgataactaatggctcggagctgagatgtggaggtggagaacgaggagagactgggtgcggattgagtagtaggctggatatatataatattcgtctattgacgtcctgtggaggtgatgggagttattatgttattgagatggagacagtgtagatgggaggggtgggtgcgtggtgatgtggaatgtgtagtgtaatagagcatatgtgtggtgagacgtgacgtgtaagtgttgattgtgtctttagtaatagtatatgtaagtaaggaagctttattttatgtagggtgagaggttatgtaggtggatgggagtatgaaagggtaggggatggggagcggaggctgagtttattatttgttgggaggagcgtgggtaatggtggtgtggggtactactgataggtttatgtgttgagactatgagagagtgtatattagttatgtttatgatgttgtgtttatattgtagggatagtggcggggagggaggggtagtgggagagagaatgtggggttaggctgacgggtatagggatagtttggtggaggtaata

SEQ ID NO: 10505 - DNA, 725 bp, Homo sapiens
tccagtgttttttggcccatagaggcttccccccgaaatccccccattaattaaagggaaaaaaatgtcctttctaactgattgaaaaaaaaaccgtgccaaaccccaatattctttaacctagaaatagccaggaacttcttcaacttgataaaggccatatccatgaaaaactcccagctaccatcatattcagtggtgagagatacaagcttttcccttaagattaggaccaaggtaaaaatgtacactattatcacctctaattatcacagtactagaagttttagccagagcaattagacaagaaaaagaaataaatgacatccaaattgaaaaggaatgtcaaggtggcacatgcctgtaatcccagctagtcagcaggcttaggtgggaggatcctttgagctcgggagtttgagttgagcctcagcaacaagtaagacccagttccccccaccctcccaaaaaagtaaaaggagtaagtaaaattatctctatttacagatgataagatcttctatacagaaaaccctaaaacctgttagaactacataaactcagcaggccaagtacacatgccaatagtcccagctactagggtggctgaggcaagaggatcgcctgggcttaggagtctaaggctgcagcgagctatgatcatgtcactgcactccagcttggacaacagagcaagaccctgtctcaaaaaaaaaaaaaaaaaa

SEQ ID NO: 10506 - DNA, 1512 bp, Homo sapiens
  misc_feature (1)...(1512): n = A,T,C or G
tgttgtgcctcgatatagttctattattctgtgcgttcgtctctgttacatatctctgtctactggctcgcgtgctancgncgtgtgacgcgtngactcatcgctcgcgccgtgcgtctgttcgtctcgtgccatctntgttgcctcntctactgtgcatctgtctcgctgtgtcggtggcctntcatcgtctcgcacgtcggtcgctgcgctcgtctctgctcntggcgtcttgctncttgtctctcctgtactgtggcatgtgaggcgtagcgttcgctgtgttccgagcgctgttgctccgttgctancttctccggtgctggcgcgcggtctcgtgngtcacgccgctgggtcgtcgtgctgtctgtgttctctatctagcgctgcgtgcatgctctctctctntcgcgcttgctgatgntcgtggcgtgtgtgtgattgagagtgcgctggggcgtgcatgctgtctccgtactgcgcgtgctctcgcttctgcgcgtgcggctgcgcactatctctgtcccgnctcgcgctcgctcggtcgtgcgctcgctgcctncctgtcgcgcgcngncctngngctcgtgtcctgtctcgtcgcgttcttgtctcgtgcatctactcatcgttcctggcgtcttgccgcgtntgtctcgcgtctccagcttccctcgtcgcgtcgtcncagctccgtccggtgtgcccgcctctctcgcacgtgcgtgtgccggggcgttgcggcctctgcagcgggcgcgcgcgcctgtctggacacgcgcctcggctctcgcccgtccttgctccgcctccggctgggtagtctagactggtgcgcgtctgctgctggtcggtggaagcgggagctggcctgtctggagaggttgtgacgaaagggataggtcgatcgcttgcttgctatggtgttgtgggcttatcgttgtttggttctgtggtgttgtctgtcctacgctgttccgctgtgtcgcgtgctgcgtcgctgcgcgcgctgcgctcctcgtctcacgtgtgtccggctngttggcgtngttnnttctgttataagatattgtgttgatgcgtagtatatttattctctattaatgnttgtcgcgtcgttctgctccatgtggancgttcagatcgcggagtgctcttctcttctntcgtgctgagctttgctctcgtcggttagtcttcggtatcgctcctctnatntgtttntatactccttcttcggcgcgctcctgtggacttgggtgtgntgttgtttgcttttacttggtcggctgtctntnaggtgcggcgacgcagcgctcactcttgtgactctctcancgtgtgtagtcgtcggtctcatagctgaggtgataaagattcgtttttttntatattgtnttttttttccttctngttctgctnctccgttngttgntggtggtgtttttntgcnnnnttcttataaagatgttctnttnttntnnttttgtgttntatcctntctctaaagga

SEQ ID NO: 10507 - DNA, 1763 bp, Homo sapiens
  misc_feature (1)...(1763): n = A,T,C or G
tcgtacatgtnggncgnnnnnnggctatgngcatatatactcattantgatcatcgagcagtatatnngactgtcaagatgtagnangacgagcttgagngngcatgttgcgctgagcacgcgctgtcagtccgtngngtnnntacgacagtagtgtagtactcaatcgatcgacgtngntangcgactgctgangtagcggcaactgcgcnnanngaagtaagntgtgtgcgatcgcatatagngacacgtcacacatggtgaccacgatatanactcactaatcacggangacagagatacatannacacagcagtgacgagttganagcggctggagtgcgtgccactactctgatngcagtcgagtcggtctgtcgcgcgccgtgacgtgcatgngcgctcggtccagctgntgctgacagcgtgaatatcactgtcggagacactgtgtggtgacacgaggtacgatggtgagcgtgcggagctgtacgtgcggtactngcgctcaccgtgagtggngggtctcgctncgagngcgccgcagcgcggcgatctcgatgangtgagtccatcnantangatctatctagaattagncgaacatgttatgaggtcttcgtgtacttgtacgatactttgcatgaatccgtcaaagcggtggcggcgccggtgctatagtgcggctgtgtgtactgaggcgcgtgtctgcgtctacgctacagactagctagagtgatgatacacaacgagatatagtantgacacggtagggtgaacngagagacagaggacgcgcagctcgnggtgtgttcgtcactagaggctggactgtcgcgcgcgttcagtctgctntntgttantacacacatatgcacatcgaggagcgatatacantcanaaatctcgagcgtagagtcacacgagtggaatgcgcgtgggcgcacatatgaggncacgatagatttgactataacgatacttatcaggatcacatattataaacaccagacactagaccgcatcatcaacgagagcactctcaatacagacgcatcactcctactaatgattacttaancaatgataggtgtgtggagagattacagaggcgatgttcgtcntggctgagctctgnaggnagcacttagtactatgaactcgcgngtgcgctctttgnttntgactgtgtgctggctcacctgtgngcgcgcagcagtctctggcactctcctagcanngataacgtcgtgtagaactgtcgtaacgatcacctgataatatgtgngacgtgtagtgtgtgatcacactagtgagaagcacgttactaatagnggctcgtactatanatagntgtattgtcactcgaatatcgaggtgagcgtgagtcacgcgttctgtcgctcgctatactgctacggcgcacgatgcgagtacgagaggcgggacggtgagacagnagatatatcatagtcagcacgtacaggacaccacagtatcacgacnacatcatctgagtggnatacatgcagcgagacacgatgtgcagacagtcaggaaggactctcgcgtgtgganctcgcatcacaatgatagatatcaagatacactagtagacaccactaggtagtgcgaggantacatggtagcaggtctgtcagcagcgagaggctgtcgcaaggatatgagaagacgcaganagaggcgacaagcaggatcgcggtgacgcatctagtcgatgtcagaagatgagttgctgctgg

SEQ ID NO: 10508 - DNA, 1323 bp, Homo sapiens
  misc_feature (1)...(1323): n = A,T,C or G
ctttgtgcgtgtggcgcgcggnactatgcgtcacagaacaccgtgactagagatggcccgctgaccagaacatatgcgggtcggtgcacatgtcataacaacattaatccaagattgtgagtctatcgtcataggtaatattggaggagagtcggcgacgacgtcggtggtgttctaagctatacactacgggatgagtccatcgtagncgtagacgangatagatatgtgagagaaattcaccacgcggcgcatatctgatntggtgtaatagttggtcgtaagagctgcgcgactntgagcgttggtgatggtgntgttgtgtctgtggcgcgttgtatcggcctcctcaggtgtcacgtagaggtgcttctcgtcgtgngttgtatgcttgtagcgtgccgtntataagagccgagaganaacaatatagggncacacatgggtgtgctggagtggacaagctgtagagccacatggagtgcggtattatatgatacttagctagtgtgttataggataanntcttaagttgagacgcggtatgtnaggtactaagcatagagggtggtggactagggactaagactacattaatacacacaatatatgatactatgagagaagcaggacataggatatcggtagtgagtagaatgaagtataccgagatgtgtacactgacgagacgtaaggggtgagcgatgaggtcatgtgtgtaaatatcatatattgaaccataatcgactgtgatagtatcaggtaagagattgcgatagtaactcaagtgatatgttattggacagatagatctgcttctagttggagaatacagcattaatggaacgtgtatgcgagggatagagaataatgaagcacggggcggggcaaaatatgaggagatgttgatgcatgtggaatgattctggtgttagggtcctactgttgaaaggtagagtattggggtacctatgatagatgcggtgaaaggacgatagagcgagagaggactactaacggagacagaagcaaaagagggaattatgagtggctcagcggatgacggccgtcgcatacggcgggtgatgcggtaccggtatcatgggacagtgcagaactagcggtcgtgtacggactggtattagcgatgacgacggtatggtacactgcgtgcgataaggataacgtgactaatgaataagtggctatatcgtaagataaaacaatgcgaaggggggtgaaaaatggagacgtgagtttgatgggggtgctggttggagagagaagagggtagtgaaaatacaaggacaaataattatattg

SEQ ID NO: 10509 - DNA, 755 bp, Homo sapiens
  misc_feature (1)...(755): n = A,T,C or G
acgacacaccgcacaccagctgaggagagtcgctcgttctggcacccccaccagtgatgacaattaactgcgggcgcctcgctgcggaggagtccatgaatatgtattttgacctgtcaaaggacacgattactccagtgtcgcagagcgataacatattaagtgcgctgatttctatacgccattggctttatctctctaagatgtccatgacaaccaaagagactccctacataagcacttagaatatttggctgggcataataagtccgggacctactgtgaatagcacatgccaatattaagagacanaatatgttatcggtaggaaagccgtgctatgtgtggttcgcaaaggggcaggtgcactagatttctgatattgatctctggatgtttttttgctgggtgacgttatgctcagggaaggaaagtacgctgtggtgaccctaagctgagggcaaatcaatgaaactacctcattcgagacgatcatgtcggtccatttattggggttatagcttgaactaatgtaacctgatgaaaaatcggttcccatgaacagacgcgagtttacgggtattaaaaagaaaaacaaaaaggcctcttatggccacaaacgtgaaacttggcggccggttggctttaatgagggagaatccatgaccctgcggtccttaactcaatgggctcggaagtcagaggggggaaaccgcgtccggtcactaaaaggccgggcgctggcccttgaagat

SEQ ID NO: 10510 - DNA, 1961 bp, Homo sapiens
  misc_feature (1)...(1961): n = A,T,C or G
actgcttgtttgntnagngtatngttaatnatggnnnngctgctacgagcgcatgcgtcatcctgacnaactagctgntannnnacgcacgatcgtatngtnatcgtcgacgacactgcgatagnngtactacgacncctganatgtangcatgatcgaccagcggagnacgnngganancgatcatactaggtnagangcgacagcctacacgctaagtctgnnatnacatgaccctcgantnannntcgccacccatatcgaggtnanagtactcgacgcttctagntncgcatctcgtgaggagatantanntngantngtcgtcgnagggactcgtccagtcgtcagtatatgtcgttgcgtgatgctnngncgtcgtcngtcgntggagagnanagnacatacgtgtagcggcagggacagngactancctcccagtgcatagcngcgtctgcctgttanntctgacggtgntcgacgtgtactgacctntctantgcctgangangtcctacagntantgncgtagatgngncngctgtactggtgcaacgatgngcagtgtgactgctccgagataggcncaatatcnagctngnangacngactcatgtgaagnggcagtgatctangagagngngngnngnacgtgantnnangacgctgctcgccgcncatgtgnnnnnactatttgtctgtcatncnntncgcgcgctctntgactgngngnacacactacatctcatgctgatctcatctgttntgcnngtcctacnagtgatgntcgnagtgcagaaacggtcgaagcatgatgtangctgacgcggangactctatgagagatggagaggacgatcggagatcgtctgatacagtgactgctnagagancgaccgagcgctagtgacgagtacgagctgcacagacgatcactcgagnngngcactgctcgtcgtgcgtcancacagcgtgcgatgnnngatacancccatatatantnnagttctgatgacatgangatgacncacgtagtcgatcgcagcacactagggactgcgtngacgatacantgaaccatgagtgacgcacgcgcgtagcaaattaatcctgccgcttacacagaacgtgtccactgtatctactcactctnagacactcgcgcncgtagcggcgcatgtaggagcataggngagatgactagtgctcagagagaggtggccgtatgatgtcgtagagcgctcaggcggtgagacgcgagagatggtatcagagagngcagcagcggagatcatgagctgcgaacgagtgagaggtgagngcctcacgtccaactancgatcgcgtactacagacatcacacctgtgttcgtgcgtangagcgcagcggagacacatcgtagatacgcgcgtgtagaagctcacgacatatgacgcagacgatgtcatcagtcataagagcntcactagtgnngcgctaccactgtagcaacgagtaagatcgatcgatagcgngtcggctaagctnacantgccanctgtcacgcgatcatctctangtcagcacactcgcggcgcgcagctctcgctcctacattacgcctccctgtctcagaccctctcgctctgcgatcgtcgactctatacggtagaacgtgaggcacacgagaaccatcatagcgacatgcaggcgagtccagcgcgagcaagnatgagacgcaccgtgcgcagaggagaaccctctgttgcactgcgcacgggacacctctcgcctacatcgatcacgtataccaaccgtgcggcacgactcaccaatctgcacattatatatataatcacactgtgggtgttgtataactgtgtcagcaggcgcctgccgtgtggtgagtgctgcgcccctgtgcggcatgcaacacgctgctggggacagcgtgaccgatgccaatataatattatattgt

SEQ ID NO: 10511 - DNA, 1260 bp, Homo sapiens
  misc_feature (1)...(1260): n = A,T,C or G
gctccgcgcgtacgtcgtgtcgttgcccttgttggtgttgtgtttcttccgtgtgtcggttctgcgcgtgcttcgtcgtctcggggttgcgttttgcgcctggttgttggtcgtcctctcgcgtggctgtgccgctccttctgtcgcgtgtgtgtcttggctcttccgttttgctcgctgtctttcattgngtcgtctgtcactggcttncgctctcggctcgctctgtgctttcgcnttcgccctccttcttgtgctgggtctcgacgccgagtcgtcgcgggcggggcgtgcttgtcgccggcgcggtcgtgtctttcatctccgagcgccgtgcgcttgtcctttgggtgtgactcgcgctactctctcgtcttcccctgttcttntgcggcggtgcggccgcttgtgcctggtcgctcacctcgttgtggttgtttgcgacgctgggtgtgtgtgccgtgctcttccgttgcgctgtctctgctacttccgtcgtgcgctttctgtctgtcacgagtgtcggtctttgtcgctgactctctgtcgtcgcgttcgtgtttttgtggttctgttcggtgtggcgtttgtctgcgcgtcgccgcggctctgcgccttgggctctgtttgtcggttgtgtgtcgtctgtgctcgctatcgtgtaggtgtgtcgtctgctggtgcccttccgggtgtggccgcttctctcttctatgttttgttttgtcgggcttttatgtaggtgcggttcgtatggctcttcgctcgtgtgcgagcggtcctggcgtgcgtgttgtgtgtggtgtcgtttgtctcttgtgcttgcctgttgtctttgcctagtgtttcgtgtgtcaaggaatctcgccgtgtgtactggtgttgctcgttgtctgtgcgtgattagtagcttgtgtatgcgctctgcgtctgtttgtgtttctttgcgtcgccgtagttgtgtgtgggtgctctgcctgcgctcgccgcgcttgttgcgccggtcgtgtttgtgctttggtcctgtgccctctttgtggcgtcgttcctgcgcgttctgtgtcctggtcgcgtctccgctctgtcgcgcgtcgtgttgcggggatagtttttcgtccttctctctctcnttntttgtggtcttgtcgcgtcntcaaagtcgttgtgntgctntgttgctccctcgcaacgcttttctttctctctctttctgctcgcggtcggtgtgggttgtcgtgcgtgtgtgccgctgctgcctgc

SEQ ID NO: 10512 - DNA, 2298 bp, Homo sapiens
  misc_feature (1)...(2298): n = A,T,C or G
atggtcttcatgtatgangtgtgcaagctatcaggacgcagccgngaagncgacncgcaacatgacaactanagcagatcanagngactntantananactcgactagtagacntcangnacgtgatcgnactacactnnacnaagtgctnctccctacnacgcgncgatncatctangcngctcatcagtncaaatatnaatncgnatnanacgacancngtactagnacatncgctcgntagtcaagtcgctgactgcgctgcgcagtanacgtcggtcatcgtttagtgaagatagacgacgtgaggacacgtagtaataatgcatcacgacncatcacngtcgcgtcggtcataatcgntactcgcacntcgacgtgcagcgacacagngngtatacatagtacaccgatgacangacccagatcactgagtntatgcnggccgacgcgacgtacntacactantncactagtacgacgtcactctcgtgcgcgttactacgactgatagacactgcgaagncgagntgctcacnacctcgtacgcntgcgacgcgacgntngacgtactcatacgcaataactcngcacacgacgtcaacngagcgatcgagctactgactatgtatcagcgctcaccggcggactacgatcagntngacactncatcatcacgtacgtatatccacgcgcgacntngactgactanctgctctggcgagcacngtacccacacgtgatantcgagcncgactcgcgactactcanctnactgctnacgacgncgctctcctctcgcaccatctcgcgttgcacggtcgttnactactcacggacgtcgttgagtacgcgacgtacgcatatcgacgntncatctcgntgtgatgctacgctgntcgntatnagancactancntatagaagtgnaggtannattcgaagcaaaganagagcagcgcacgccgaaccaaatcactcacatagancgntnagcagaatcacnggtgagtanancgaacgtaagtacgtacacgaggaatgcaggatnncnaacgatcgtacagtacagnagcagctgcangcancacacgactacgcgacgatagacgcgcagntgaatctgnggantgcagnacgctgatcnacgtnatcngcgacgatagcatcgcatcactcgtactgccaagcggcancanagcagancatgaccggangtgtcgaacanatnanctcttgccgactcgtcactacatcgcagaagctgcncacgtctccatgaactgatgatntactgtctgnctgcaacgtaacgacgaacnacgcatcacgagcagctagcacgatcnagcagctagngtgnacganaaacgatgnatatgatgtatacacatcagctacgntggngtctgngtngtttgntntntngtttgtnngtgtccgtcgctgtcngggtnnnctctntctnntcntcacaaaaaaacaaaaaaatctgtcgtnctgctnctctctnctntcgttnctnntctntcctcnccnttctntcntnctcgnctcnnncctcttnccggtcgcncnccctccnncnncgcccgtnncgtgctgcntnttctcggctgctntttttcncngnntttnnttgtgcnnntcnncnnctgtgtccgtcgcgnnncnngcntcgcngngngccnccccgcccccggnncgcgtccgtgtctctnctctcgccgtctgccncncgcgcgcgcgcgcttnncgntgcngtgtctcgctngcgcgcntctctctgttctcncgtctgcntctgtgtctcntgtcggtgcgtncgtnctgcgtntgtcgcgtcgcgctgtctgtctcccgctnctgncgtnnngtcntntcgtctgccctgcgttgcgcctgctncncncctctcnctccgnccgtcttcnctccctcgcncngcgncgnccnnnnnnnccctctcgcttcnctctnncgctncctcncgngcntctnncgccnncncgnccctcgtcngcncgctctgcngcncngcggtgttttnctcncttcccntcnnccnnctaaaacngngctctgtntntnttcnnncnnntcnctnnngttgntnnctcnnctnccncnncncagggcggnnnnnnnnncnactntctattttattatntatattcttactactntctnctcatatatctactactctctanctccaccntctctcncncncacancnnncnnncnncncnntnntncnnntncacnncnnnatcttctctttcccccntttctttt

SEQ ID NO: 10513 - DNA, 2112 bp, Homo sapiens
  misc_feature (1)...(2112): n = A,T,C or G
cactcaggcgcagtgcgacgacagtatttgctcgctgacactcgcatacgctgccgtacgcgtgcngtacactacattcgcacgccagcgagagcgagaggtctcgtgtacctngntccgcgtccaccggtacacgctnnnnnngctctctctcagcgagtcgcgacgcacaatnggggnganngcagtgtgagtcgtgnaagnctgtcgacgctagcgtgacgatcanttgagtgcagatgtctcatcgttgtgtnngtnnagacgtactttaatctgctgtcnatncacgtcgtgcngtcgtactgagctcgtagtaggnaganagctaatagtctgataggangatatcntcacgtngcgtctaatccgtagnnnctgnacgtcagtcanctcatgnncagtctctcgctcaggccnncgcncacgcntnagnggttgacagaggctatantgntagnactgataggaagtgatgngtgcngtcctatcacctatctganggncgcgtacgattgtcgtagtangnctgacgacattgacgagtgacaccatcgtgtagggtantcgagnactgtagtggcntgtaggtcgacgctagccgtgtcgctcgtctcatgatnntgnnnnnnngncactacaacgcanntgttgctactgaactggcnttcggntaccgcagcgtcccgtatgtcancacactgcttantgntatcantctgccatcctgcatacgntnngagcaccgtgctnctnagtggacctagctgacgactgagtangttacgngcgtcgtgtgtcgtaganngantatcatcctatcatntcatancacacgtcagatcttangtgncggtcagccgacngncgntcgctgtgancatctcctagatanacaatcacctcgncgtggcgtgcagcncgtcgtcncgacctacagctgctacgcagacgatagnggncngncgtagcagctcgctanngcgcgatcancgtatcacgcagananncgacctaagctcagtgtagnagcactcgtctgacgtcgacgtgtgngacagtgtananatatantatgtcacagtgnatgcgtcgagcgagtcagcgtatgtnggcaacnagagtgatgtgagtttactctngtactgtacatgcntcaccttacacgtntcagtagntgacaatctctctgcatgctgtcacagatgatgctgctcagcggttgntgacaacgcgcgggtgacatcagtgtgcgtaggccatgtagatggaacatagtctgtgggcgcatcaacagcgngatcgacgcgtcgnccactatcatgatntatcggtactgangtnctagattgactcaatgtgtcaccaaataaganagacgatacgctatgtgtggaggtcgacacgcagagagagctacgcgtgaagnccgtncagcgngngaacgtatnacgaccactctcgcgcggtgngcgcctcantgtagtgaggacaagcgacatgctcttcttattgacgtctcgtctntgtgtgcgcgatctcagagacggcgcacttgtcgtgtgtgctcacgtgatgggcgtcctgtcttgagatgatgtcggagcggtnggctcgntgtgctanggacgaggtgtcgcgtgtgcgtatcagagtgtcgtcagtagatgaccgatctgcatcagtctgngngcagcanagcgctgtcatatgatacaatacacgacatccgcacgctacnggtagacgtcattcatcacgcnctatgatatcggncgtcttanaggcgcgtnancgcgtatngcncgctatctacgcgnatgacccgcacagcgtagcnggcactgactgagcacacacgctactgtcgccggtcacgtgtgaggcgatgatgtggngcacaactgtagtagagtgcggtagacatagtatcaatacnanagtagtagtagtgtggtgtgtcggctcgatatatagacttggattgccggcgtcgtatgctctaaacgcttgcgtgcggtgccgtactctatctcaacctacgctgtacacgacagctctgtgcggctcncaccagcgcnagantaacgcagatctatgactagagcgctg

SEQ ID NO: 10514 - DNA, 728 bp, Homo sapiens
caggccgaatactcttcattctgagtatttacagatgctgaggccctctttaagttatacgcgccggtccaaagggatataaaggttaagttggggtcaatgcctctccgtaggttattatactcatcgggaagacccatatatttggaatttgtgttttagtaaattagaaaggaatatatgaacgaattttctctaaagggaccttttaagtagtgttggggttcagcctcctaatagcttaaaatatgatgttttggcatgttggattaaaaaagccaaaagggctctctgaccttcctctccgaccaccacaaaacttcttcccaaagaaacctaaattcctttaactgcctaagatgcagaccccccaaggaaaacaacagttttcttcccctccttgtaagataaaaaatgtaaccaaatttgaacagaacctttttcaagataaagattgtttccaaggatcattaaaattgcaaacagaattatttacaagttcatctctgtgcctggatccattcattctctgatagtaatcattgattcctcctcaagagaattcctcttttccttcttctcacaacctgttttacaaggatccaagctcccattctttttgaaaccttgagatagtatataagtttctgtagcttattaagaagttgggtattcattccgaaggctcctgttaaataaatacacgttaaagaaaaaaaaaaaaaaaa

SEQ ID NO: 10515 - DNA, 123 bp, Homo sapiens
catgttcacatcttctgggggtccaactatttgggaagaaactgatcaaaagcattccctgggtttggcatgactggactgagcttgcgcacataaagatcatcctttacaaaaaaaaaaaaa

SEQ ID NO: 10516 - DNA, 1311 bp, Homo sapiens
  misc_feature (1)...(1311): n = A,T,C or G
atctgatggcagatgaganaacaagtatgagacatagatatgtgttcatagttgcacgtccgtattcgtctcacgatatcagatgagtgtagagtgaaaagaggtgctcctatataatacatcctactattgtctttagggagctggagagggcaccgtgagagaggataaaataaaacgcgtaagcgggcagaaggtaggtgtctggacaanaaccacaaccacgctatctcatcgtgtggtatatttaaactctcttgtattatatgtaggacgattatggncgtatctaatgttcgactctgacgactcgtctaaactatataatatgtagatctaagtcgtcgtttagtctatatacataattaactaaagaagacgatttaatatagtgcgtgtgatcgaaggagtaaaacggttcgtgatgagagggggaatcggtgggcatatgcgtgtccccgcatgtatagcgggcgaggggtctgagggggggacgctggagagtaggaggggtacgcggagtggcgcgtgacgngggctgtcgatggcactcgtctgtagcgcacaagagggcacccgggagagaatccttggctgtagggatagatggcgcgtggtagacgtcatgtcgagttgcgggacgcgtgggagtggctagtaaatagttcattcactaagagcactcacgcagtcgaggccgttcagttgtatgtttcgttatattctttaatacttaactcaaatcggcaattagtgcgattaagagtgcctaatagtgctcgactcagaanacctaacgtggtgtggggtggaaaataacgaataactatcgtatgtccgtgtagccttaccattcaatattagactcactctgtagacatgtgtcataatgggagatagaatgagcgaatattagcgtctgatcattaagactaacactgggaccgatcgaaggtcgtgatatactaaagatgacgattcgtgtgagtatactgaatgtgaaaaattatgttatagcatgtntctacatttggcgtatagtatttaatcttgttgttggtgcgaattacgccgcgtgagtgtgggaatctacacactggacgaagnaaatgaatgtttcatctactgatgtatataatcactcacatggaaacatacgaacactagtactggcacttatatacgatcactcaacaaatacacaattttggcggggtgttatatgttagaatantgaatgcaaggagcggggtacagtacggctagcgtgacggagagatgtcacagtcggtagttaagtatatttcagta

SEQ ID NO: 10517 - DNA, 1886 bp, Homo sapiens
  misc_feature (1)...(1886): n = A,T,C or G
cacctccatcgacgtcagatcacttatgtatctgtgatctcacgctgtactgtatacgtacacctctctctcgcgcgtcgtcntccgacgatacagatctagacaaganagatcttaattacacgtcgatcggtgtgcgtatatactacacaaaataatacatccacgcntttgtgcgtcgtcatagcgtcctctacatgacgatgtcgcgagaatactctgtnctcagtgcgcatcggatacgcacgcagtgccgcgtattatgactctgattctctatgctcagntcgtcgcggctctgcgcgtatcgcgacgtggccgncggagcgcgcggaagcgcngaggggtatgatgcagcgcagtgagatgagtcgagtgtagaaggacagttacgatatacgtcagcgactcacaactcangcactcacgcgttcgtgttgcgtcntctatgcaatctcgtgcgcgctcgcgccagattangacacgcacacgccgctgttaccggattggtacatggatgtggactgtntcgtanaatagtatcagtcatgttttgctgagagcgcancgcttagttctgatgtcgcgtagatgtctgtcggagtgcgcacatcgtgcggcgccctgctgcgagtacatggtgatcgaggcgctgctaggctgctacgtactagtcatctcanggagatagtacgcgcgtctccatagctgtgctatgacacgtgatctcatcgctggagcgactcgtgcacgcgtcacgatcgtgantaggtacgatgttcggacgcgtggtagcgtgcgngagntccngtacgcangtggcntggagacgatagtcgctcgtgagagtacatcgacaaatgcgagcacgagtgaacgggagtntagagcgacgacgctatattacgcggatgtggcgtgagctagcatggcgtgctngtactgcgacgtcgcgcacgacgcgtacgataccgactaagcgatgcgtagtcgcgctntgtcgacgcagatatgaccacaagatgaattgagatgcgactcagaanaagatcagacacacacatcatcatgatgacgatctgcggtgtagagatcatgacatcgacgcgtanctagagtgagtacgtagtngnacgtgcnatgcgctacacgatctcgtgcngtgatgtgttcatagagagagtacaatgatagangtacgtgatgatangtgtagtgatcacaacntcatgntatgatagtnaacnatatgancatgtgacagnttagcaagaactacagatcagtgcgcatgcacatatagagcgatatacacngnagacgacgcgcatacgagtctgcgacaggatactcgncacgtactgcgtcacacgcgtgctaggtgatgtgnagctggagtcagtatagatgtcgactaatgcagagtgagtgagctngtngtatgagacgatntagtcaaaagtcnaacanttactacacgtcngcgcgcgacactcactaccgactcacgcntttntagagctgtctatactcatgangatatatacncaacnacacactntatcgangatcgagtctactcgcagcagcgtctactgtccagtagagagtgcactgtacagatcgcgctagctactgcagtcngnagctgccgactcgagacgtgtactcnctgcgtcatgtaaatacactactacagntcgagcgatcgcggtcgcggtgtgtatcatatgtgtagtngngagatatctgtcgctcagtgtatagctctagatctatgctggcgactcgcgatgagacgtagacagagagaacntgtagtgctgcgtagcgtgngcgcgcgacccgggtcgcagtagcatgttgcacgcntgtctagctgtcgc

SEQ ID NO: 10518 - DNA, 912 bp, Homo sapiens
  misc_feature (1)...(912): n = A,T,C or G
ctgtacatgtcgtcctatctgtgtatctgcccttctacttgggatacatatgactaagaganagtgatcattgtctgcgttgacagcatctgccgtgcataaacgtcatccatgttcggaaagaggtgtgtgtattctctcagatctacttcacttgctgagcggcctacttctgagatgaaatgtatccgcaagtctgttactccattgggcggaattagttgtgactaatcggcaacttgacgttatttcagaagttacgcagcctgacaaccggaatctccctccaaattgggcggggaaacaaaactctgcgctgcttctttgacatggctttccctcaagcctctcgacatctatttgctaggctagcgaataataatctgctcattatcacaggcgcgtataaacttaacgcgtatccttatgataccgactgttgcgccactgatacctactcaccgttccacgccttgggccagcctctgttcgtttgcctagatgaaaaattcgggatttgctactcctgcaggaaagcagtgtatgatctggtcctatcctcttcctctgttgtaatgtctcccttacgttccctcttctctctatacccagcgtacgcatttcatctcatcctattactacgccctttcccgtcgctacgtctgtttaaatcattctgccatactttttacttgtctcgactcctacggtgctcactttcatgcacccctcgttggccgtcgttatctgattaaccgtttcacgcgccttacacgccactgcacacatacacgagctctaagcattttggcatgcccgcctttcctcgtgcttgttcttgagaattgccatgatttccgtctccgatacacatctgtatatcgtcagctcagcgaccgtagaagcaaccgc

SEQ ID NO: 10519 - DNA, 1615 bp, Homo sapiens
  misc_feature (1)...(1615): n = A,T,C or G
acaatcgtgattatggctcattactcgacgaccatatcccactactagcanatgtctctctctatntgtcagtgataagtnnctcccattatgcggcgctctctccgtggtggtcgcgtgcgaagganatcggagtgcgggggcactgttagcgtgnagacggcgtggagacgacgcgcgagtntgagctcttacgaggcgtgccggaggtgaggtgtagactgttctcacacagagngagccgtcactctgcattgncaacgaccatactcgcattacacacgcagtctnntcacgccgcatngcgcgacggcgctgcacggagttggtgggaacagcgtacagngnggctggcgacctgtgagtagattcgaggaggagccatatcgggtagagcacacgcggacgagttagtgagngngcgctcttgtgagcactcctatagncnnnnctgccgtgctactccggtgcagctcacgcgacactgatattcgcatgtgacgcgtggagtgaagcttgcagcgacgntagacctcacatgaagaggacacacagtcagtgtgacgttcatgctattctgtntccgctactgtagtgatcgctgcgtcgtcggggngttcgtcgggtngggtacaaccgcgaggagagcntcgtagtagaggngnaccagctgtaangcgtgntcgtctagacaganaaccaccacacacacagnagcatactaagcanaananatcagtgtctagtggagactcttcgtacgttgnatctcttgtagttgatctctcacatcgtgancgttcgctcgncgtntntntaggctcgagtgcgggagtgagcgctagacgactacagtcgtcacctcgtgacnccaggnnnacatactatcggaagtgtgactagtcatcatagcgactntgtgcgagcccgagcgagtgagtagctctatacgcggcactgcacgtatatccaccagcgaacacacattacaacacatccgcctggcgcaccttggtcgctacaacggaaaacgaccatacattgacanaacaggcgagcgcggtgtgggagatatcatcgaggtaggttcggcgacatcgggcanagatctgcaacgatcgggctatggtctgtagggaagtatcccgatcggcgcgtggagacgtgatagtatgagatcagcagtgtagacactccgcgtcaactatctgtantntcctctactgtggtgccactaggccactgcgcgcgcgcgcacgccgcggggccagcgtagtagacattcttgacactatctgcttatggangcgcacgcgngcgtggagtgtagtcgcacatgtcactgcgcaggngcgatccgtgtgcgtcgaggagggaagacactcgcgactcgcagtgccactcccagtagcacctaataggggcactctgtcggctgtccgtgcgattcgtcgtcaccggtggtcgtcgcctggtacacacgctctatannaaacattggacggatgacgaaggaataatatgaggcccgtgtgtgcgcagggccggcgagtaggtctggtcggggctgtggctcatccgtgtggcccttccggtgtgccaggtcgatccggtt

SEQ ID NO: 10520 - DNA, 1119 bp, Homo sapiens
  misc_feature (1)...(1119): n = A,T,C or G
cagagtgcgctccgatccatcgctgacggcgcacgagtcaccgccgcacacgcaattgtgctggtcagctttccatcgcacgtcgcgcactactcactcgcacagaatactacggaacacagctccggcatgcgtcncgcgcgcgttactcagaggtgaagtagaagagattaagtagactactactacacactcatcgacccacagccactcgngtgcggcataaccgcgctcanataataatctcgccgtggacttagtggctcgcgcgcgaccgatacctagtgagaatgggcaggcganctggatnttgacatacgttattggatcgtcttacgatgcatcttcggacgtcactcacgcacgccacagctcatataggtctggtatcacgtgcatctgtgtgtcgctcgagcccgctgcacgcgcgcaggcgtgcatgacttggcgagcgtcagcaatacatgtatctttccacctgatcctcaatgactcataacaggccatacatgctccgcacgtcgagacatactcgtgtgatctcctacatggtccgtactgcgtacagcatatgcttagagcgtctcatgcccgcattcagtcatcncgcgcctccgactaccgcatgcgacgtgatgtctgggtggctacnttgtaataacatctcactaggattattcacacgtaacactcgtgcgttgtatgctcgcacgcgcgcgcccgatcagactttaatctagctataggggacttgacacagagcacgtcctgtataggaatatgtgcctgtcgnagtgtagaccgacgttacgctatagtacccttccagcatatgtgcgcgggcaatacaagaagcgccgtcaccatgattgtcttgtgtacacagcgcagtcctgatcgagtctcctcgagcaatcttattgattgcgtgaacggtgataggaccaatcgtcctagtatgtcctcatgtgaatgcaatactggagtgcttcgtacttatgaagcaccaagcatctgataggacgtgatctgctgcaagtgtttatgcgcttctgtaaacctacatttcttttctagataacagatatgtatttctgcctgcaaaaaaaaaaaaaaaaa

SEQ ID NO: 10521 - DNA, 843 bp, Homo sapiens
  misc_feature (1)...(843): n = A,T,C or G
cggagtgatgtgtgggtgggggtacaatggattggggattgtgggtgcgttgtcgcctcgcgccggtaataagttattatatctagcgaggagatgatggtgtgagagaaagatgtggtggttatgagtatggtggaggaggtgggggtgggaaggggtagggggagatagtggagatcaagggtatgttgtaatagatgtggtaggggcgaagggatggtggtgagaagaagtagcactcaataatcggaaatgtatgtcaacagtctgcaaagtacgcataaaacaggtgaggaaaaaaagtaaagagagtgagagtgtaggagagctaagagataatatgaagagagaaaattgagagagtaaaagatgggtgaggagggaatgaaggaaatggaggagcgggatactaaggggagcggtgattagtcaggactaagtgaagatcggattagaatttattcgtgaaggagacgatattgtactatactgtctgcgtgtcttcgcgatgagtgttgaattgaagtgggggagagaggatataattcgagtagataagttgtgggagaaggaggggagagaggacaggtgagtgagattgatgacgggggagagggtgtaggggttaagaataatgtatgttatttgttagtttattccatatcgatggttgatttttttagcgttgtgtaatgactaagataatgtggaggcccccgttgtctcacatttcccaaggcatgtctgtagaagtggaagtgtagaaggggctcagagaatcctngagttttgggaaaagttagtgcgcagggtgccgtggcatgacaaccacaaactattctc

SEQ ID NO: 10522 - DNA, 1315 bp, Homo sapiens
  misc_feature (1)...(1315): n = A,T,C or G
atcgatgtgtggcggttatgtgggatatctgtggtgcctgcgcgcggatngagacagcgcgttagcgccgtcgtgngcatcggcagtgatggtagcgcggcggtaggaagcgtcgagacgtgagacgtcacactaagcntccactcacctcgatatatacagccatgcgacttcgcagagtgtacaacgntgtagtgctaatcagtcagtgccgcggtctctgcacgtgcgcgcgagagccacagcgacganaacctctaacttctcgtttcctattgacgtccgcagagcctctgctgtgtcgatacgtttgaggacgtgataagttggtgcatcgcacatcgtccnacatggtagagaccgatcgtgaagctgtttagaagtatctngaggtgtgccatttggtctgctctgacgtcgnngccctacagagctaccgcgtacatctagagcgactccgncgcgcgtgtgataagcgatccatagtgctcaggacgtaggagcatgcccgtgggactcgcgtgggacgcctgaggtcttgaagtacgtgtcggggcgtggtgcgcgcgtcgcttcgccagcttgatggccgcgcgatccatcacatgggatggctcattttatctacacatggttagagcgacacggaggtcggttcggccgttaacttcgaaactcgagagcacgagcgactatgatagtggagtatttgaggcgtgaggagccgcggtttacatctagttggtgacgccatggaggagcgctatcggacctcttgagcggccgacggaggtnacagacgatggacagcgcggangtatcttaggtcacactgagagcgggagggtgtcgtttgtggcatcctgtgggatgccatagganactatataaattgcggggggcactatctcacctacagtgagtgatgcggttgcacttggcccactggcccacccactggcgcgctcggcccatctgcagcctcacgtgcatcgctgggctgccctctgctccgctggccacacggggctcgctctacagcaaaccccacggggaccctcacgctcgtctgtctcctgcggtgcgtaagtaccaatctcgatcgagtgtggcgctcttctgcggctggtgctgctcattgccgttcgtagtatgcttttgtgtgatatatctctcgggcgtcgtatacgagtggcaacgtcgccgttgatacacatactctccctggcggtggaattgggtacgttgcgggcgcgggcggggcgtcggcgtgggagtagcgggggaggaaggagcatgtgaggtttgtgtgggt

SEQ ID NO: 10523 - DNA, 398 bp, Homo sapiens
tacatcggagcgtggaacatcagaagtaggaagaaagaaaaagatgtcttctctcttatcctgcacactcacgtcctacttcaaagtgaaaagtgggaagcctctaatataacactgagctggaaaatcagaagtaggaagaaagaaaaagatgtcttctctcttatcctgcacactcacgttctacttcaaagtgaaaaggcaagaatatcttttaatagttttattggctaaaaagtattgtaatgaatcatgtaattgtattgcctcaacatatgctaagtattgttaaattctgctgtatcgagtaatcacctgtaaatgttaaatatactttgtttgatttctacagctgcagataactaataaattgatgtaaattagcaaaaaaaaaaaaa

SEQ ID NO: 10524 - DNA, 1234 bp, Homo sapiens
  misc_feature (1)...(1234): n = A,T,C or G
ctaagtgagactcggcgaactcagtgggtctgacgtgacgcgctgcgttggtcgtcttacacatagcttgtctggctgtaagtgtgntctcattgttagattcttgctaganactcccgagnggttcaaagtgaaaacagaagtattgctaagncagccagaggcatgctgtcgccgaccataagaaaatattgatacaatctaactcgaggctcttcctgtgtattttatagnttatacggttataggtttgngttgaagggcgggctctcagtatgtgctgccgtgtgtcatgctatgtgtnagtggttcacagtatgtggggtctatctatagtcatgtagagaatagttatgtggtgaacgaagacggaggaaacacataagaacgaaactngcaatcatgctttataatatccgtacagattacatgatcgctctttgtggaccgtcctgtaggngagcgaatagagtatagaacagaagctcaaccaccgcgnacagctatgatatcatataatttttcaccgatataagaacatagtaagaaatctgtcagcgcatctcgtgatcgaacatacctctcttgtcgggtctcttttcttcgacaactctatcactatccaccattaacatctactagtgcacatgataagtatccacactttagaaacttacaccacacaaggataccaagttactctaatancaacaacgagaatgtagcggcgctggaagcaaagcgccactattagtcctcgtattggatgctacgtagttgagtgtgggtggattaatgtacacatcaatgggtgtttctggcgcttgctgacgtgggggtgggggagcgattacgtaaaattggatcatagtgggcaactgatacttatcacgggcagccttaagaccacagaggctacatgggatatagaggagagccgagtnggttcatgtatgtaatctgtacgggttggcgtgttgggattgggtgtagatttctcatcgtatccagttcacctaaatcgcctcccctcacttctttagcgagtggggaatcatggtgcgcgaatgaaagctgtgaagcgttggtgctgggagcagtactcatcacactaaagtatagcaagctggggggggganaatgatatactcattatgtctctatcgtcttatctcttttggcgtagtacctctgatcctgtgaatgtaccacagaagacatatataacagtcgt

SEQ ID NO: 10525 - DNA, 1983 bp, Homo sapiens
  misc_feature (1)...(1983): n = A,T,C or G
tnttctgtgcgngtagcagcggaggaaactgcggagagcgcagagtggaggcgcatcccgtcggagcgtcgcctggaggctcgggccggagatagcggaggctganagggccctagcgggtgcggacactgccgcagagctgctcgacgtnaggcagatgcgggttctagtgcacgcgtcgtataagtgggatgactactcagtgtgctgggagagtacagcaggggggttgagtgggagaaataatatctctacgcagaatatcgtagtggagcgaagtcgcagnagccggtgaagaacgaatgtgntgttgtgacggtggtgccatcgtgtacnttgcnccctacgcgatctcgtccatctcnacacctacacttgcatatattgagantgagcccgtatgatgatttagatagaagnagactagaaggntggctctctctagggtgatgatattgtgtagtgggtactcacgatacatgacagcatgtgagatgatactgaccaggccacttcaccgcggcaactagtctagtgcgacatgatggaggacttgtgtgtcatgggtctgagatcctacgcgtgcgtggtctctcttgcgctcaagcgggcagggatgatcgatcgatttccatcactatgtatatgctacacacaccacgcaggctagacaggagtcgatgatagctatctttcgnacncnccgcagctagcgcgacatctacatatgggtacgtatatgcgtgtctctgngcagtgatanattantgcgganccggacttacaggtgangcggcatcagtctacgcagatgnggtagagtatctcgatcatcctgtcggactgacggcgacgtcactcgcangncagcctcgtatgagtaggcgcatagtgtgtatctatactagatccgtgctcgagantgacaacatcatcatgacatgtgcaggcagcgagacatcggatgagtctacgtgatgcgacactcgtatancacatgcctanacaaatcttgtatctagagcgacggtggantacatccatangtcgtgactatcgatcagtgacagaacagcagcgcgatcatacatacgangcgtatcgtgcactctctngngagcgactcacttaagatagatgactatnactctctatgtgatgagactgtatgtcataccatnctagccgncagatcgatgagccggagtctagctatctgatngcatcgtatctcgctagtgantgctnacatcntgctgnangtgtgntagctnagcagctgatgatcagntgtagctcagtgatgactgtataactacagcgctgctgtagcgctatctgaaacgtngactgctgacgtacgatgtatnctatatcattgatgagtagtgngagtgctttgagatggtgcacgnagcgctgatcagtctactagntgactgtcatgctgncagggtgacgtgntangantagtactgcgctgnncngcccgagctcgtgacagctatctgtagacatcgtgntanacgatcacaatngtnactactcgnagataatagtatgancnatagtcgtcatctgcangagngcnagtantacagtcnacnagtnanctatccattcggctgatnnatagatnnaactgngtanagtcagcaacggtgcgctncgctacggcagttcattatcactgcntanctatcntnatnatctntaatncatcatccatantatncagtacgncggcactagcgtgctgcacggcatgtacgaantatatantctagatactagangtgtagtgagtaganagtcgtagctcgtgtatgcgtagcagcagcagantgggngccgnagctcgtgtgctgtngacggtngcaganaatcgagntgtagagcngatgatgatgtngancgncanatgcngctgacgagcgcacgngnangcatcgctcgtcatgtgatgctgtcgagcgtagcccc

SEQ ID NO: 10526 - DNA, 1093 bp, Homo sapiens
  misc_feature (1)...(1093): n = A,T,C or G
aagttcgacataacaattctgcgcgtgtatacatcgatctctacgttgacgcttacaactcctcaattgatgaatganggtgccatnacgtgaggtgtactgtcgtcacggncagcctcgactgcgctcagcgcgtgcactcgcgttaggcgactgcatcgacggacacgcaggacgagatctcatcgagtaggacgtcgtatgcgtgnaaatcacgtcgagcaatagccgaggagtatagcatgtgtagttcgtccctcatacgtgctacancaccaactgtggcacncgactatggtcaacgtcggctacacgacacgactagtaagcgagcacggtgtgagctacgcccgaaatggtactacatcgttaggctttttcgccgtggggggagcgcccaacacacgatgtaagaatgtacagaacagtacgatgcagtctatacatancgtgacgatgcgggcgcggtcctggtcgtgctagtgcgcgcgcgtcgagcatggtaccgtggtgaatccctctgtgctctgtgtgcatatcgctggttctcttttttgttgtctgctgcaggtttaatgggaaccggtgcatcctctcgtggcaacgtattggatcggcacggcatggagaaggggagctgcgcacgagaattcgtaaacgacgcgggagaagtcaaatagccaggagggtatgaagaatggacaccccgttcggtatagaacaccttttctccttctcaatacaccgtacgtccccccctttatcatatcccctatccaacncacctacctttcacacacatttattgtcactctagttccgcctatcgtacatcccttgtcctccccctccctcttcactgaggttgtagtgttctttgattgacgtggtattgtttgatttactataatggtttggctatttcggtgaagagatggacaccccagccagggcggggggggacacgggcagagtagaaaaagaggaggagacgaagagcgccggggaaagaggagaccaaatcaacaacaaaaagtagcgtaagacgcgcaggaattgtgactgccggccccaaaaccaaaaaaaaaaaaaa

SEQ ID NO: 10527 - DNA, 1234 bp, Homo sapiens
  misc_feature (1)...(1234): n = A,T,C or G
cagtgaggggcgggagacaattctgtccgaggtaggacgcaaatagccactatagcgtaacgtaagctatagaggtgagacatgcgagacaagaaatggaacggagggagaagaggggagagggtgggatctggcggtggttgtgcggaccggagcgtgctgtcgaccatgcgttatgcggggtgggaggaccgggcgttaccggtcacgggggaagagaagcaagcacaaggcgctcgggatgaagcggggtggagacggacaggatacgtatagatcgggattatgtaatgatataataagacgagggtggcggagagggcgacagaggcgcgcacgtatactaggtgggtaagatcggtgctcatatcagtgcttgttgttaacgttctatagcaatattatgattatcaaacactggaacaacggtcagcctccactcccacgttgggtcgaagaggacaatcgtagtgatacggagcgtatgggtgtcgcgaagggtgttaagtagataagcggttaaatattatctacacacaatagaaacatggagggacatacaaacacaatacaacaatcatacgccaatcaggcaccaattaactagggagctagggagaggagtacgcaggcagagaaagtgaggtaagatgtatacgagcgtcagtgnagagatatatcgtggcgcggggaggagagaagtgcgaagtgcatggtacatggatcagtcattgatgataggagaggcgcagcagacgtgtataatgtcaccatactagtgactatcgtccctaggagtactcgatggttctacatctggatcgatctaattacatcattatacatacgcagactatcatcaatcagtacgtatcgttatacgatcaacagcggtctctttgttgcagttgagatgggagttatgtgcgtgcgatgaaatcatagactactgtagtggtatacgtctagactatgaccgccgtgaaccagagtcatgactagagagagaatgtcgagagtggctagatcgcgatgtgcaccgcatgtgcgactaggttgagaggtgatgtgcatagtggtgaatagcagagagagagaagataaactaagacataatgcaggcgggctgagcatatctaccangtgctatcgcgtatcctgatggagtgtgtacgtgacgtgggatgaaagtagcgaggcgacacgatcgatcagactaatacaccatacacta

SEQ ID NO: 10528 - DNA, 1497 bp, Homo sapiens
  misc_feature (1)...(1497): n = A,T,C or G
acgcactgcgcgcagcgtccgtgttcatatcactcactactctcgacaccaatctctacgctaactactactactcttctacgttcnttgcccgctagcaattantcgtctgcctcttcactctctcgtcgccattcttggcgctctctgtgtattcnccgacatatctctctacatcattatatggctcgtagagacacgactatcgcgtatacatgctcntatctagtctctacgctctagtgaggtcgatccagtatagatctggatttgcgccagtctgagataacattagagcgcncctccatccagctcgtcgccataaaacnnnnccgtactcgtgtattgagatagtantgagtatacgctgagagccattgaagttgatgagaagagactaggactacgaagtggtacacttccgagtgacatcatacgtcatgtacttgcctgctatgtcctcatcgaacgaccacacacacangtctatcgactcgcagaatacacctgcccttgacgagcgcttagaacacaggctaactccggcgctacattactgttgcttctgtacatacagtgtgatacatcaagctgactaagatagacaaataagaccganaacatcatgcactcctacgccgcgcagctctctatccatccgcatcacacatacgacgtataagtatagagcaagtanactaagaacagtctacatctagcatgatatgcagatatgnagtactccacagtctaacgctccgcatgaccaaactagnagacaccgggcgaatgagtataatatcataggacgagcgtatagagcctatatactacgacacaacgattagaggctgggcgacgagatcacgccgcggttccagagaganatcttatnatgcagctgtgtacaggtgaaagcacaatcaaccacatactattagaatgacgtataaacagtcatacaatatanggtgcgttgggtgagataaatgtgtattatatatgcacgcatatatcatgtgttattagtcgtatggtcaagcggagagatggacgtggagttccaccaatatgatggctaacagtactggcactgcatatactcatatcatagtactctgtgatgaaatcgagatataagagcgtgacggaatatattatagttatatatttggcgattagagtggaacaaattagctgtaaatcttgcacaacaacgtcctactatagaagatgcggtacctctgcttctacatctagcgtcgagagatttaaatcaccgatagtgaaactaagctcgagcaacacaacctccggcacctgctgcaccaccacgcataccgcacgatgtggcggcttaatataacataaaatactaaaaatctatatcctggtccgaaggaaaacactatactcggctgcggtggcatggcgagtcatcattctgtaaaacctgaggaagctagcgtcgcagagcaggaacagtatatactgtga

SEQ ID NO: 10529 - DNA, 147 bp, Homo sapiens
acgctccatagaggaaatttttgaatcctgaagaaatggaagatttagtgattgaagtattcacaggacccagaaaagctgaataacatgatatttaaagaagttacatttaataaagatagacaaatatacagaaaaaaaaaaaaa

SEQ ID NO: 10530 - DNA, 1749 bp, Homo sapiens
  misc_feature (1)...(1749): n = A,T,C or G
ccggcaggggtgaggtagtgagacgtatgaatactctgacgtattgtgctagtcgtcgatttcacagtattcagtatttatttcatcgtactcatatcgtaggcggtggtgatgcgagactacatcgccgcgccacgctgaggcacagcgtcgcgtggaggtggatgggtgagggacgcgccgctctctccacgtctccgtctggcgacgcgacacaccactctggagactgcgacggggagccgcgaaggaagtgtggangcgtctcgcgcggtgctatcatgcncggaatagagggcggcgtgcagtgggancaccgaacaacgcgggcacactatattanggnccgtacttaatgtttatattatggatgtcgatatgtattattaatcagtgnttcttatattgtatgttgatacaaanaatactatctactgcgacggcatagtcgtgagcgcactcacgttgtctcgcgatgatcggctctgacgcgcacctcgcgacgacgcgtatgtgtgtgcagactagtctccgtcgtatatcatactgtggacggcgctgtgggangtgtctgttggcgagagcactgttcatagtatcgagtggatactctaagctcttacacctngtctanacactactaaaagaatcgacaacacacgcgtcagcgcgtcnacactccgttcngncctnatctcagcntgatcgctctcctcttagcgtacagagtctgcgcgagatatctcgagcggcgtttcgacgccgtcgccgtgatgggcgctgtactgttagcatgatgagtacatcagtgatgtaagtatgtgaatacgctgtagcttcatgatcacgccgctgtgcgacgcangtcagagtcctgctgacagagcgcctcgatcgcgaagcactcgctcatgtgcgacacatatgccgnatacgtctgagacgcgatnagatatanganaatacgacatctgatacgnctacgtntgtgtactantcacatcactcntatcncaccgangcagtagctgtggagactctatactcggagtangactcgtctgatgcnagctctgtacgcgtgctgtctctctctattgnttgtntatagtancgntctcactcacactctcgngttcgtcntagtgtacgtctctgnctcancagctctacgatcagtantccgcgcgagatgactagtantgtgctantatgacgtantgacgtctgcactacatatgtancgaccactctcacgcgnacgctngcagtgncgtagacgncganccgcagcagcgttcgcgctgtcgcgctagcacgttagcangatgcactcactcgcagtagcgcttcganctgngtnctgangtgcgtgtgagtgagctgctgtancgatgatgtgatngcggtctgtgtcgnacactcacgtatgtgagcagacgcgtcgcgaatgattcgcacataanagttactggcatgacnaacanttagtgancttgtntgntcgtagtctctctactgaccacatataatatctccgtagttgtagcnatctggnttgcttgacgtatctgcacgatcaactcgtcacacatctagcangacncctgcaggcgcgaggtatattctgagagnttctgcacgatgacatgaccgctgcgcccgatggcttgtctgcgagccacagctcangangcgcgacggcacgatcaggcgatgccggaggaggtatgtcgagagcagcctggt

SEQ ID NO: 10531 - DNA, 1963 bp, Homo sapiens
  misc_feature (1)...(1963): n = A,T,C or G
cgctgcggntntgctgctttctgcatagnatngtcgacatcgtcgtctgtcgtacactacatgtcgtgtgcgtgcagcgtatancaggaatgtggtcggtcgtagcgcgtagngctctgtctaacgatccgggatgantcatccgcggctgcgtacgctggttgtcagagatgatgctcttagtactctgcgctagtcgtattattcgtgacgtgcgagcgcgtcgttcngcgtcggtttnctgcctngtacgtccgtactgngcgctgcgtnacnccngntgtacgcagtcgtcgtgtcgctgntcgncagtgangtcgtgcaggtgctcgcgntcacgcgacgtctnctacatcgcccgtcatctgctctcgtncctntcgcncgngtcgctgactacntcgtctctgcgatctcgtntgcgccantcttcgtcncgtctntgcgtgctctgntngncttgtntcgtntcatgtgttgctcntcagcgtgcgtggatgtntggangcnctacctttcancgtnctcgcatnacnccatttgcatggtcctgccgtatggaagttcggctgctcgtgtgtcctcgctcacgcgtctnannacgtcctcgcgcgtttgnatagctgcttgcacgcacgtcagtacgtanttactantantgatgcgacgggtnggtgtcgctgtcgtngctgtcgctgctgcgntntagtancnctgtgctatncgacgcgnctccgctgnatcgttgcctgtagnatacatgactctctactgcttcagnctctgcgtgtctcgncagtgtcgtactcgtgcgngttcgcgacntcntatnttncgtgcgttgcatntanctactcnctactcgctgtgcgtcatagtatgtgtcgtcttggtgacgaatctgatcgctagacancgcnatacagtcgcgacganntcacgtgctcacngcgtcgctcattantgtagcnttcgcgctcgcngtgtntcatactgntcgctntggctactatgatgtntgtatgtgcatcgctgctgctacgatntctagctgtgatcnctgatcgacggcctcgcatcgcancgcttgtgctggcttcngnctcgcgctcgagcacgcngtagtgctgcgtngtgcgcgctggcgcgcgtcgtcgttctctgctgagctgcgcgcnggcgcgttcgtgantgtgtctgcgcacgcgcgtgtacggctcactgctcgncgcgagcgctctgttagtgcgggattgtgtatcngctgngtgctgtagtgtctgctctctgctgcttacgntccgncgcctcgcgtgctgtgtcgcgtgtcgcatgtgtctcgcgntgttctnctgcgtcgctctgtagcncgttgcgctgatgctcgtctgcgcgcgttcgactgtcgtcgatatgtagatntcgcgtgcgnacttcgcgtcgcattgtctgttggtacgtacttatgttccgtgacctcttccgtagtcgcgctgcgcccgtgcgcgccgtggtgtggttgtgtctattctcncgtgtgcnttcgacctctcgctccgcgcgtgtgtgctctcgcttgtcgttcttctgctgttcgctggcctcctgctcttggttcgagncatactacgcgtctgtcgcgttgtcttgcgtngcgcgtctcggcttggcgtgagcgcagtctgntctgagctgtgtattctatatgctcgtgcgctactttttggatgctcgtgcgagccttccgctgctggtcgtgtccgtcgtgggtggtgccagttcaatcgttgacgcctctgctgggtgctgctcgacgtgttcatgtagtgtttggtggtggcgctgcngtctgtgtcttacacacgccgtgcgggtgtntgtgtgtccgccgcgtggacgggttttttcttttgcgtgcgcgctgttcgcgccctttcttcgtgctcagttgcctcgctgggcg

SEQ ID NO: 10532 - DNA, 290 bp, Homo sapiens
ctcaggatcggaagcttcctgaggcctccacagaagcagatgctgccatatttcctgtatagcctgcagagctatcaagtatttccaatgaaaatttggcatgcgaattgagaggggctgcaaatataaaatactcaacagatttcaaagacttcatgcaaaaaaaaggaatgtaaactatttcatcgatattttttatgttgattattaactacaggataaaatggtagcttttgcatctgctgggttaataaaatgcattgttaaaattaatttcaaaaaaaaaaaaa

SEQ ID NO: 10533 - DNA, 1816 bp, Homo sapiens
  misc_feature (1)...(1816): n = A,T,C or G
tatgtcatgagtatagccgtagagattatctcagatgtcagtagttaagtatgaattattgcccgacatcgcacggagacatacagacgtcgtgcgtgtggcgtctgatacagacgagctcacgagcgtactatgtacgcaagaacgtcataccacactatagacgacagaactagacacganatcatatagcacgagagcgagtaagtgagaagaggatgagtaagagatagtactctagatctgtctcacatgacatgcgatgcnacgcgagattgacgtgtgctcgtanctctantaatctatgtgattacagagatcgcgctgcgcagtntatacatntgagtgagtgtgtgcgcttctctctacatatnagtnagcgattgagagagtgatctacgtagtcgacactcgactagcgtcacacatgtatgacgatngctcactntgtgtgtcagnacgtaagaaatcatatactcggacagngagganttaagagttgcantagatcttacatgcatgaagatgatagatagagagcacactagaagactacactagattgagctctagtngtgcgtatagtgagtggagtgaantatctatcnccgccgtcacttgctatgcacctaccatcaatgctccaanagcacgcaagacagcctaatctacaaccacacactagactatctacgacaaactcatacgatacgngcgtgcacgaagtcggcgattagccacgtgcatcgcgcagacgtgcctgtatcagagttactacgtctcacgcagtgcgtgtgcgtgcatactcctgtccaagatgatganggtgcatgtgngacgtacgttccgttctggtctacgcgcgtagngtgcggangngtgatacaacacnccgcacgatcgcagcgcacatactgcatngcgcgagggactgacgagacagcancgacactgcgagcgcgcgtcacgcgcgaatgagtctacgagtgagataactacagtcagntgaagacgcactgagtcataccacacgacgatcttnctgtcgagctcgctacatatcagttctgttatagacttcaactgtattatgtgatgaggtgaggtgctgccaactgcgggtgcgtagcgctgtgtgatgagttacggtgtgcagcacagatagacagcgacagcgcacgagacgatgcagctagcacngtcaaagcgtgcgcactgatgagagggtgtagctaccaattcagcgggtcatncaccacacagactcaacacactcacacacgatgcactggccgtcacacactctagctgcanctacgctcactctctcgctcacaatgatgatgtcntacggactgacgactgtcctatatcgacactcagatgtgtgtgtaggtagctagtcgtgcgtgatgagagtacgacnantgtgacanagangtcgagnacagtgagtaagacataccagatgatcgatgatcctagatcgagtgctcatcgtgcgcggacacaccgagacatntnagatcagctgcgcgacacgctcgcngcggagaccacagcttgtngtntgatatgaatatnattatacaactantgttactattatagagcntcttacgctagctgtactatgagagagtacataacatagacaacaacgaacagacggaccgacgcgcgtgccgatacgatgagcgncgtgcgcggctgcgcaggtccgcggagcgcgatcacgtcaccagcacctatagtgatctcccgagtgtcttcgncctatcacgcgtgggctgtctcaatcatcgtcgtcatccgt

SEQ ID NO: 10534 - DNA, 1195 bp, Homo sapiens
  misc_feature (1)...(1195): n = A,T,C or G
ttcggttgtccttctcctatttcgaacccatcctccgcgtcgctcgctaccacaaacattgaggcaaacttctcgttagcgagttcacctcttcatgagagcgacagctcggcagtngcatagatgcgtgacacgccctcgccattagtgcagaagataagccatcgagcccctcgttttctctncgatttctctccgccctttctctctcaccgtctcgcgttccagcgacctcttctcacgtgctccctccattgcccgcacatttgttgatgtncgtctagcccatcgctgttaacattagccacacatctctccgtcatgtttctcgctctccgtagtggactctctctcatctcctctcccgcacggactcgattgctacatcccaatccatatcgcttcgcatcttttgacccctgtctactctcctcccactcgcttccattctcctccacagtcacacatcccattctccttcaactacacctgctttccgcgtcctttataccggttcttctactcgttcgtcttcttcgtcgttctcgcgtcacccttttattctagtggtttcctatcctctcctccctcccttcacgtcgctcgtctcattcatcatttttctctctccccctctggccccttttcttttctaattattctccactctcccacttgtctctagttattctcccttcctgtcctatcctatacccctgctgccacttcatctctctcctcgtctcgctcgctccctatcgtggtcctgattccctgctatnaatgtctgtcttttcttgcctcgctgtttcttaatgtattctccgctccgcctcgtctatatttctgtctcccgtcacccgctcctctatgtctcaccgtctctcatttactcgcatttctgtgtcttcttagctctctctctgattatttatatctctcttgcgaatctccctcgcatccttcgcctttatctccctctctctcgctttctcatcgcagctcatcgttccctaatcctcaccgccctcacctcgctctcgctgctgtcttcagatctagcgcttctcattttattctccgcctcctctctctcatcctcttgtctctagctcatgtcgtttctactcccgtcgtcctgtctgtccgtctccatctcttcttttctcctctcctttctcatattcttctattt

SEQ ID NO: 10535 - DNA, 1486 bp, Homo sapiens
  misc_feature (1)...(1486): n = A,T,C or G
cgcgcgtacgtgcgctgcgccggatgctcctctctcgcgtgcgcgacattgctactctataantgcgagtactctctactgcgatactatcagactgactcgcgagtgacatttgttgagagtatgcgntagnacatatattatgancnanacgtgtctatgtgattacgatctgcacacgacgcgccgcgcgctacatcacggacgctcaatcagtaggtctagtggcggatctgtgtgaagtgatgtgtntgtgatgtcgcganacctgaatatattcacttcactgacagcgtcgcagtggatgtggaaggtataagtnggacgtcgaaatgacattgtgtgtgatgacgagggtcgtgtcagagagagtgagactgtgtgntagtcataagtgggtcataagaggtgagaggagcgtgacggnttgactcatatggatcgatccgcgataanatacgattctactacggcgcttgcacangaagagaatgacaagacattctgtattgttgactaccgcataggtgtccactacgagcagagaggagtactgctatagcgctgtgttcttcgcgtgcgtggcagtcgtacaataatcagtcacgtagcanncgtcagacaatcaatcgcgcttaccaacgacatacagcgtcggtcgctcgactctgaacgccgcgttatgatacatatctctagtgatcaacagacgacgtccatcggcacgcgcggcgcagcatggattaagagcagacgacggagcagtcctctcgatggtgctagcgcccggtcgcttggatcatgtgagagtggccgagatgcagtgaaggtctggacggttgatgatatgaggtgagatgtcagacgatgcctagtcagtgttcatgcggtccaactatctgcatttgtggtcgcgtttatcggcgcatactntgccagtgtgcnatcacacggaccttcaataaacgtggagcggcgcgggcgtggaatcacgcgagacagggtaggtcgctggcggcgtgctgcgatcgctgccgggtgtgtgtgtgtgtcgtgaagcagtacgagttcaactccctacggcttagaacgccgtcaccgctaatttaagctcaatgaaacatcatatcgacgacacacagacataactgtaatgtcgatacacgtgtgcagtacacgagatagcacggtgttcacagtatgatgtacgtcacagctcgaaatgatggaagcggacacatcgtgattctcttcgtcctctgctgngttcgtcatcgaatgtcgactactttctctgacacgactcgagaaactaatatgcatcagacatatcacatgtgatcctctgtataacgcttgttcttctccaaccgttatcaggggcgcgcgagacgtcggtgccgcctgtcctatcatgggagtgtagtgggcagcgggactttgtctcgcggctggctcgcgtgcggagcgacgcgaggtcagatgt

SEQ ID NO: 10536 - DNA, 392 bp, Homo sapiens
cttcaggggcctggagtgattcagcagatttctggctcactatccatggggaaaaggcttttacctcgttcttcagctccaaaaaatcaagagaaagattccatttgtcctggttgaaccaagtgcccattcctaaaagcatcatggtattcaggaagggtcttactgtgttgcccaggctggagtacggtggtgcgattatggcttactgcagcctcaacctcctaggctcaatctatcctcctgcctcaactgcccaagtagctgggactataggtgcatgtcaccacactcaactaattttttaaactattttttagagacagggtcttgctatgttgcccgggttgagaaaattaaaatataaaaattcaagtggaaaaaaaaaaaaa

SEQ ID NO: 10537 - DNA, 188 bp, Homo sapiens
cgcccccacggctcttccagccacctccctacaccccctcctaccagcactgcaacgcctttacttctgacatgattgaaagctacctggagcctccccacaagcagatgcctgtgctatgcttcccgtacaacctgcagaaccataagcccaataaacttattttctttaaactaaaaaaaaaaaaa

SEQ ID NO: 10538 - DNA, 185 bp, Homo sapiens
tcacgacttacacccactaacacacctcccgaagtcttctagctagactgtcaacgcctttcactctctgccatgcattgaaagctacctggagcctccccagaagcagatgcctgtgttatgtttcccgtacaacctgcagaaccataagcccaataaacttattttctttaaaaaaaaaaaaa

SEQ ID NO: 10539 - DNA, 922 bp, Homo sapiens
attagtataactatttccgtaatatcgaactctaattctagcaaacggaacctgcccatttcgtacatctcttaatgagtaaaatgtccaacactaagcactactgcctacgtcacacgatcatcactttggaacattcttctacctgcatggggagaatgcccttgcgtaggcatcaactcctctgctcgcacctaatcagcctacattccagtaaccgttatttatgaccatatgcaacacatctcctctaccataagactaatgatacctgattccgatcattaagactccaactctttaccagaattaaattttttctaccttgcaccaattaaaataataatgtactttccttttctttacataacataaattctgtagtaccatgcaccatagagtaatattcattacgctcccaccgcaccaaagcagatcttattataattcccccccacttctccaactcctaaaattccgctcaatcgccaccccacacttccatatcttttacccactatatatttttttccatcgtctatctccgtcgctatcacttctacgcattatccgaagacattcttactccgctatacatcaaagatatctaaactatctcttatatataaaaccccaccaataaccttgccgaatctcagactataaacactaatttgtgttactcactgctatctctcactacttaatattcttctatttccccctcttccaactttataaccgatttaaactcccacctctcactttactatgcgctcgaacgtcatgcttttttcttctccattatcataatttttcctctatcgactctatatatcttatctataattgagtccccgctccttctcaccttgctctactacgctcaactcgtactttctcccgctgtcatcatgatatg

SEQ ID NO: 10540 - DNA, 1211 bp, Homo sapiens
  misc_feature (1)...(1211): n = A,T,C or G
cgctcgttcgtgtcgntctatatggtcgctctcatccgtantctctgctgtcgggtncgttctagtattactcttggttctatgtctggctcgtcgtgtacgcgcacgtccttatctagaggcttttagcggaggtatagtatatgcatgtgcagntcgtgcgtagctgaacggatgatcgggtgcgtgcgatgtaagacgcgagcacatgacgacgacgcgcgcgcctctggtaacgcgtagcgtcacgtcatacgactcatttgtgctgctaggtactcgagngcggtgttngtgcgaactgcgtatgtgtgtgatggtagtgcgcgtgatcttnagtcggttatagttgcgagtgatgttattgtgtgtctattctatcgtaatacgatagtatagcacggctgaggaaggagagcctggcaagagacgctggcgaggggacggggtgcgggatcgagatgtgcgatggacgccgctactgccacccccatcctccgacaccgccttgttcttcggcctacagtgtttgcgagtgcaggccaagtcccttcatcacgctgcctccaacacgacgcgggtaccacctcactacttcacagatccgttctctgggcccgtcgccatctcagttgtggcgccctctctcagagttcgctctctttgctgctctctctatgaccatcatttggccattattttttctttctcgatctttcatagggcggcggacatgcgttggtgcgtgcgatgtgccgatactgtcacctccaagcacgttacgagcctattgggtagtgggggggcatcacgagtaagtgggcgggtcgcgggcgggtttggtgttggttgcactgcagtggtgcggggcccttgggtcaatgggctgagagagctgtaggagcgtaacctcactctgaatcctataccttcttgcctctatggggcttttttatatcgtcttgtatctgcgcgccttgtcacctactcggtattggaatatgagcactcgcccgccaggagtatatctgttcatagcaaatacaacagcacgcacggtggcgtgggtcgtaatgggtacgtgggcgggtggcggtgcgaggcgggcagataaaaagaaaccgggggatgaaatatatactcgcagcgctaggggcgccgcgttctagcgtttcggctcgtcgggcggtgttggcactcttgtgttctgc

SEQ ID NO: 10541 - DNA, 763 bp, Homo sapiens
  misc_feature (1)...(763): n = A,T,C or G
aagtgatttagtctgcctggcgatctagcttatactggagttatagtacggagttgaggtgattgggattttataatagcattgatttgcgggatgagatatagaatgggggttaaggattaaaagaaggagagttattatgaagtgtcacacactaacttacggccggccgaaaaggagggacgacacgcggtggcggcgcggtaactaagtttatgagaaacaanagattctgtttattaaacatgattctttctagatacctacagggtgaaccaacgtagcgtaatacatgtgtgtagtgtgcgccatagaggcctcctcaagaatttgtataacgtagaaaaaaagattattcacacatcatgggtggagaagttaatggaacgcagttcaagcagggggtactaggagcagtcttaatacatggcttgaggaagatgtactctctataggggtacaggaaaggtaaacacgcccaatctgataccctcttttcattagtagaatgtccaacattaagcaatactgcctacgaacaaggatcatcacttggaacattttcccacctgcatgggaagaatgcagtgtgttgggataacctttatgcttgcagtcaaaagcccagaattcaagtttgatcatttatgaccttatgcaaatcatttctcttccagaagactaatgataatagtatccgccctgatgactcagagtctttgttagaattaaatgtttctcccaagtaaaaaaaaaaaaaaaa

SEQ ID NO: 10542 - DNA, 900 bp, Homo sapiens
  misc_feature (1)...(900): n = A,T,C or G
gtagnagttactacccgctgcgccttctctgctaaaactggagtggattttttgctgcttgttattatgcttttgatcaattggctattcctgagatgaatgacaaatttccttgatcccattggatatcaattcatactataatatctataatagaatgctgacactgataaaaaataaaaacccaactggaaaaaaggaaataaccaacaggaaagaaaaaacaataaattataattgcaagaacagaaatttaggaacgaacaaaaaaccaaacaaaaagaaagacagctacacgagaaactataaaactaacaaaaacaatgcctagctcggcgcctggacacagatatcgagcggggcatcccgaccgcaccacacctgtgggcgcgtccccccgcatcccccacatacgccccccctcgcgggcccctcggcatacagaaaagggacgaggcctcacagccaagcctacaaacacaaaacaccaggactggtgggactccgcgagagaacgctgcggccacttccccttacaaagggcccactccacgatacgcccgccctgactccctgccgatcgacaagcccgccccccgaaagcggcctcacctaactgcacggcggccatcccggccggcccacaatccggcgcaaccccacgacaaacctgccaccaacaggccgccaaagcgctaaaccctcaaacggcccgttgtaggccgcctcccgcaggcctccccccctgaaggcgcgcaaaaatcacccccagcgccagggggcaaacgccccccgaatatcacaacccaccgcttgcgcggcgagcaccccccgccgcgccctgcgcgcccgtgcgctcacggatacctgacggttataactgcggaagagagcccttat

SEQ ID NO: 10543 - DNA, 1388 bp, Homo sapiens
  misc_feature (1)...(1388): n = A,T,C or G
cttgctctcantgtcgctctctgtcntccnctctctctgccggcatctctanatgcatctctagtngtgangcgtgcgctcgtgcgcgctcgntcgcgcgcgcgcttttcgttcatcctgcagacgcgtgcgcgcgcgcgcgcctcgtcgctctgtctcgtctcgatctctcngctcgtgtggtgtgtctntgtctgcatcgctcgnttgtgatgcgcgttcttcgcggtgttctgtgtcttctattgcgattagttatgtgtctgttgttgctgtggcgcgttgacgtgctggctgcgggcgtgccgcttactggtctcctcgtcgctgtgctcctcgtctggcgccgtgccggcgccggccctggtgggcgtgctcgggtgctgtcttgtgcttctactcacccacgtgttgccccgctggcggccgtgggtggctggcgctcggcgcggtcgctcgctgctgtgtgcgtcgctgctggctcgctctcttgtctgctctggtgctgcttaggtngtcgccctgcgttcgntctctcctctgcgcgcggctgcgccgcgcgncgngcggcgcgtcgcggcgggcgctcttgcgctcgccgtctggttcgcccgctcttcgttcgctgtcgtccctcgctcgtcatgaggcgccgccgcgcggtcgcgtagtgtggtgtagtnttgtggtgtgtgcggctcgcctcgcgggtctgcgcgtcgttctggatcgtgctcactgtctcgtgactctctacttcccgtctcttcttctcgtctcgncgcctctcttcgtcctctcctctcntctctcgtcgtcgccggcttgtcgctgtcgccgtcctctcctctcgcgacgtcgctccgcctgtcgtctgcccctctacttcctcttttnccgcgctctgtctcttctcgcccctgcccccttcgctcctcctccactgccccgcgcgccctccgccgccttcccccccccctctcgctctcgcggcccctccccgtccaaaactcctgtccgtctcccccccctccctccctccccctcttccttcgcgtgggcttgcgctgtgtccctctcgtttccccgtcctcgtccttgtggtgtggttcttttcggcctcgctgcggggggcgcggtgtgtttcccgttctcgggctgttctttggtggtccgcttcgttgtttttgttttgttcgcctccccctccctccctcgaacccgccgccgttcttccttctgtggcctgcctgcgcctgcccgggtttcttgcccccttgaggcctgtttcttnnttggtttctccctncaagtttttctctcttctttctttcttttccctcctctcccatcccctcttctcctctnctcnncncttctctcttccc

SEQ ID NO: 10544 - DNA, 1430 bp, Homo sapiens
  misc_feature (1)...(1430): n = A,T,C or G
aatatagtatgtgtgncatgtcaggatgcagcgtcntcagagcngnagagatggctacgtagcacgatgaataagcgtggacgatgagatanaggcacangacgagctgtgancacgacancgatgagtanatgatcgatagtngtcgatagagcctcactagtattgtgactcactatagacacgagtgcgtagatggcgctcatgcgtgaagtactgtaagtgtagcgacgcgaaactagtatcatcaccaacaggcgcacagtgtcgtcaatcgagatagagtacacaccaacatcantttctangtaactacgtgactatgcgacagtatagtgtgcgtcaactgtgtgcatgcggtgtnactagttggttcaggatntgacgagttctatagacngcacatcacacgtatgattctggcgcacaccatntagatacaactcgcgcaatatattctggtcngttagacgtgatagntacgcagctactcatacgctgttgtagcgacatctacggtcgagcgaggagatgacactgagtcgcgactgagaggcagagatatgtgatcggtgcggatacttgttgcgattgctctggtagtgtggtcctggggtgctacgtcgtacgcacgtgtccttacacgccgtctaccttagctctgatcttctatgtgtaggtctgctagtatacatccgacagcgacctcatacagcatatcgacgactcctatactcgatagtgatacagcacactcagtgcgatatgggtagatgtgggatcagcatctaagtgactttgatatcatcacctgctagtgctatgtttcgagccgccacgctactcaacgcgttccggtcgttacagtggagagacggacggaggagtggcatttgatttgtattgtaatttatgtataatgatatatcaagtcgtggggtgggtaatatacattctttatcgctctatacctcaccgaccatacctagcaaattggataaccgattcatccgataatgatgcgtaatctagatcaggtagggataaagatcgtgcactgacatcactacatacagagagcattgcgcattcacaggacgtggtgacgcgtattcacgttagcagcgcgaggtgtgtcgctagtacactcgattgagaatgtagcgtttagtgataaccaccaatnaacggtgccataaatatcatctgaatacagtatgtgcattcagttggcgctcacggtacactctacattcagacaagttacgtgcccatataatatacatatacaacaacatacaatcgagtggcgggagtaaaatatacagatttcagatattagataatacggtgggtatctgtctagtctacgccaatcatgcgtgctgcgccacagcgcactgctccactgcctaatagatgacatcaga

SEQ ID NO: 10545 - DNA, 1289 bp, Homo sapiens
  misc_feature (1)...(1289): n = A,T,C or G
caatgnagcgtacgagaggtgtatanacaactacgactcacntcacgcgagtaatagcacaacgactgatgtccatctgantnagatgcggactcataggtcgctcctctatctgcagctgaccacgacgcgatagcagtgtagtcgcgagagtacctgagtcacngntagtcactgcnctgcatacgcaacgacctcgcactacacatacactacagttagcgtacgtantcacgtgcgatacgggagtcgaagtcgtcgcagataggtaacgacactnctggtgcgantacgatgacagnangagcgctaacgcgcagtatgacgacgcgggtgaccgccgatcagacacagcacgcgtggcctttgttatcgtatggtagagaggaagcgcattagagagcggactggcagtgcgacggcggttcggtgtgctcttagtgtgtgactgaggcnaagaacagagggatgacacactatgntagtgctatctcactcganggcgactanaacgtagattcacacgcagnnaacactacactaccgcgacttgtcttctctgtgtcgtagtggcacatgacgacgtatgaaggattgttgggtgagatcgacggcaacttggcattgcacggtgcgctgtcgcactgatgatactagtcgaacaaaagcaacgcacatctagactacagtatgtcgcgaagcgagataaagatgacatacacgagcgcgccaccaacacatatactcgaatagacgcagtgcgtagacaacggggcgagtactcacgtaacgaaggctgagcgattcggcgctgcacatgcggatctacgactatggcgtttgaaggtggaactgcacaacaccgtcgcgatgcgccattggaccgatgcgcacagggaatgaacgcgaagtgacatcattccaatctcgggggtgagtaataagcagtaagcggaggctcacagggaggacacgaagcacaacgtgtctagaccgttagtggtagttaagccgcggattcggggaatagacatgtaggggagagtggtgatatgcacgcgcgggctagctagggcgtcaccacacaactcacttatatccggagacgacgaagacattaatgcgggggaggttggactagcggaccgtgccccgacgtcatagaagacggccggcaacgcgcaccgctcgcgacatgctgccagttgaacaacgaggttgggaggatatggggacctgacagaggtgagattgggtgagaggcggtggagaggcagagtgtgggttgt

SEQ ID NO: 10546 - DNA, 1762 bp, Homo sapiens
  misc_feature (1)...(1762): n = A,T,C or G
cggtntgcgtgtgaagtggngagagttctagagtagtgacgcgaggtctgacggcggatgtggangatgagaagtaccaagggaatgatataattactcgcacataggagatagtgtagantgagtgagatgagctacgtcacagtggtatcgctgacttacatcgtgtgagagtgatgtgctgagangctgcacgcgntagtggtctatagcgtctgtctccgtatatgctctcgcgcaatcgcgcagcgcgcgcgcgcgctgcacagacgactctcgatgtcgatgagngctacntacatcacttgtgtgcgaactgatatatctgtgactggcgtatagtcgacantcacatcgtcgagcaggcgcggtagtangagggaaacagacggcggtgtacccgacgcgcgatcccgatcttcaccttcatncgcgcntacagtgcacggatgtgcagnagagcactgagatgatcgtctgaatcgtgcgtgaggcaccgcacagtaangcacacggatatgcatacgatcacgagcactgacgtagactgcatagantgcgcgcgttgtatcgtggagtcacgtctcatcacagctagatagcttagtcgnananatagattagttctaangatcgttacgtagtagcgcgagtgactgttcgctgatctgtgctncntcgcctcagtggagagtantcagcatatgtgcgtacatcgagtagtangcgcatgacctcttcactctctcatcagactaccaccgagaangtgtggccgtctcgactgattctcgatgtatgtcactgtcgcgtgtgatgtgcagtatatggattagcgagtatataatcatacacatatatatatatacgatacatcattcgcgacatagatgacgaaagtantcgacacgagtagcttcgatatgagttgtaactatggtngcgatgtgtgaataggatactntacgatatcgcgcgtatagacgtcgctaggagagagngagaatgntttaatatcantgtgctgtgcaatacatatganaacgttgtagagagtgtcggactgttgtgccagtggctgctgtgtgcgtgcgtcagctgacgtcaactctctactcgtggtgagtgtggatgagattatatcaggttgtatgagtcgtagggtcagcatagggacgtggtctcgactgntcctctgagtgagtacgcacagccgtatcagcgtatctgccgtatcactacgacgcacagcatcatgtgtcgactcagcgtagtactatactcacgtgaccntccacanttatcgatatcgattctataagctaantagagattatactacangatgatactaggttcgagacggagtcgtcgctggttctacgagttactatccgtcggagtcagcgtgcganttcgcatgtcgtgtagattctnatcagtgcngttacgtgtgtccgcatcacgcgagctactgcatcgggtgctgggacatcgagcagtaggtctgacatctacgcgtgtaactgcacagtgcgctactatcgatctcactactttacgtnaacatctgtgagggttttggcgcttacgtatgccagagacatcagacccatatgactgcgggtcgcgtcgagaaacgggcgctcgtacgtgtagtagtgagaggaaggttgtgaggacgcggtgcggttaaagaatgaagtgaaagagtcggtggagccnctcgcgtgtagtgaaggtgtatcttgtgtntgttcta

SEQ ID NO: 10547 - DNA, 1815 bp, Homo sapiens
  misc_feature (1)...(1815): n = A,T,C or G
ctgtaggtcatactgtaggtcatcgtgtactctgtagtgatgtgatgcagagtctgaagagtcttctanacntagatgtctgcttagtatagtagatctgtcactgangctcagagtgctacgcncacgctcagcggtagtgagagagcgcnacattatgcgcgcgttaacacgcgtgctctagtcgcgcagcgacgtccagacgacgcgtccgcgcgccacgcgcatgcacacactccgccnacataactaacatatacgtcggtctccagagcaggttcgactcgacgtactcagtatactattctgcgtagtcgtttcgccncggcgtcgtccacagtacacacgtgtgttnactcncacttctcgcgtactacgatngngancatatcttcgancgcngcagcgcatgtgctgggaacgtatgtgntacgggcgataagtanttantagcgtcgacgttgtgtctanacattntcgtaccctgangtcctncntgctgttgggcantggagatatagcaccacactcgtacntgcgcgagaanagtgacgacagatgttgatatagtcgtataggcgcacgacacacactcgcgacgcgccgacacaactgcagcgcccnancgctgtgcgcacacgactgcgcgcacacacaccacgctncgcnctcccgctcacgtaggttagcgaatcgcgtcgcgncgtctgacgtatgatggttgcgtcacgtntcggtgngagagtctacttgtctcatctcagcactctcaactgtacgtatcctatctacgggccgctacaagtctgagcatcagcgagtagccgcaggccgcagtgctactcacagataggttactgagcggcgacaccccgacgctacatgcagtctgcgtgaccgcgctcagcgctacaactgcatctacgctctcgtcactcgcttctgtcgagcgctccancatgcgtatcactcgctgctcatcagaccactgagcgcatcatcgcagtgtgttngatgtaggcatcactgacgagtgcgagctcaatnctacggcgagacaatgtaacgagagccgatcagagtatgacggcacgcgtgtgcagtctnctggatatggtcacgtgctcggcgtcggtatgatctctacgacacgctacacagtatcacaacagagtgtatgtacctctatggactatgcgcgacgaagaggcgtcgcggttagcaatgtaccgtctcgagatgtagacgcgtgtactgtgtcaggtacacccactcgacgctgacgcactctcctgctgcgtcgcgcaccagcanctaccagccgtctgactnactgctagcacagcgtgtaggaccgccgatagcgttgtgcatagtcattcagacgagagcgacacgtncactagtaggcgagtatgtgagttgatncggngtaacacgcgcgatatgcatatagcgtcgtangtgtgacaactngctgtacacantgagatcgcctgncaacgcgtgtgcgctcgaacgcgacgcatatgtgaatcgagtctgacgcatgtgaccggtcgcgagaaantagacatgatgtantgagcgcgcaacgcgtagcggtcgcgcagacgttagacatctagtctgattgctagtgctgcngatcactcaacgnctgatcgtatactgcgtagctnactcttcatgtgtacgctcgtatgtgacgtctcatcnctcagnctatctgcgtcgacgcgtagtcatcacntgncagcgctgtngtcgacacgcgcactgnatacantagtcacatgatggacgtangtgtat

SEQ ID NO: 10548 - DNA, 1386 bp, Homo sapiens
  misc_feature (1)...(1386): n = A,T,C or G
ttggtgtgtgagttattgaagagtatcttcgttatcgttcgcgattaaagtaataatatataatagtgaccgatctttcgacgtgccggtgtttctcatatgtagnttatctcactctggtgtatgttacgtgatctaagtgagacaccatagcaaatcgactacttcgcgtatactaattattaatcaacctctatgaagtacgaacaaatacatagtcagacaagaagaaacagtagccagcagctcacgagtttcattcgcaacacgcagcgtggacacactcaggctgaaccgcgtccgatgcactccatgcatcaagatggatgcactgactacgcaaccgacgtacccacttccatcatttattattaatgatgaaaatatgtgagtgtcgccgttttttatattatctcatagtatccctcagcaacgcataaatcgggactcagtcagtttcctgatatataatggatgtgatgtttgagaattgagtggtaattattcatagagagctagccctaatttacgcacacacacgcactacatcctctccgccttgcgactgcatgtgcctgcactaacacatcagtcgtcctggttatgactgtactaccatactgatccccatatgtaacgtggtgccagcactgatcagtctcgatttatatggtgcatcgcgagacgtcgagtagtcgacagacaccacctaatgcncgacacagctccgacacaaccacagtctacantccgcagtgtgcacggtgaactccagtgctaccactaccctatcttctcgctcatacaccattctgctacatattactataacgttactaggatacttgtatgacgatgtatatgtgaactgaagagcgaaacgtggctcaacacattgtcgattgaacatactaacactatgattgtatacatagcttgtaattatatacatcaattctacgtgagtagtcactgtcctgtgcattataatgtgacactctaatcgtacgtctatagtatcgtatcatcacgttnatgctagctcagcagttgactctatacgtggcgtagtgctctggacaggatacgagacgtatcaatagatgataaacgcagcgnacttgatagcaccacgatagaaatcaattcgcggcaacacacgcggcaaagtctaggacacgtaagacgcaaaacgtacagtncgcgcagcgatatcgtcgaagcgcgcggtacacgctcagatcaaacgcagtgcagtgtagacaacgtaacattgacgcattcaagccatcgcaaagcacatctatactcgcgtatctagacctaagcgatacatgaacgtaatagcgcgaccgaagtcgcactatactactacttcaatcaatt

SEQ ID NO: 10549 - DNA, 901 bp, Homo sapiens
ttttcaggttaacttgccaacaaacaattcggatgttaatacaattccctgtttgactctacccttcatgtcgttggagctaattaaccacgcttgctagcaaaggggcaagtaagagctcaggaggaaagtattctctgttaggaacaaggattctcggattctaatctctacaaccataatcaaatataccaaaggaaagagacccacaggacatacgacaccaatgtactcagatgcgtacgtccacaaaaaccggctctcacatgacgctaggacgcgagagcgcctctcacgcatggaaccccaattacttcccccactgtcggaaatattctcccacactccgcgccccagcctctaacaccggaccatctatagcctggccacgcgtcaccctccctgtcaatccactacctcgcgaaactcacaccgagccatccacttcccgccactaccactcaaacacccccctctcttactttggtacctgcctcttcccctcccccttacctctcccggctcgcgcctttacactcttcccctttctccctcgctcccgctcccctccccctctacccccgccgccccacccctcttccactcctttctcccagtcatccttaccccgattcttcccccgctcccactcacgctttttcccccccacttttctctcccctccccccgcccctcccctccttacttccactctcctctctctcacctgcgctattattccccccctcccctccccccttctacctctcttccgattttccttatcataaatcccacaccccctcacctcccccacaccaccttcgtccaacccatctccagcccctccctcccctattctcacccatccccacaccccaccccaccaccccccttcacg

SEQ ID NO: 10550 - DNA, 1613 bp, Homo sapiens
  misc_feature (1)...(1613): n = A,T,C or G
atctcggcnacgcgcagcatagataacacatatcgnctaggatatatcgtatancaagacgatatnagtagtctaaaactctaactatcaatcattatggagngaacacgtcgatataacagcganacgcggatatgcgtatgtacanaantactgcggcgtgacgtgctaatcatgatnagatgatgagaatgataccgtcggcgacgacactcatcctcantcaccacactctatgatactatcatacatgccgctgagactagcactgacagacgaatgacatgataanccacatatntatacatcacctgagcgtagtnatgcantagctactantactgagtctgtctatactacttagtatctntcggntccgtcgctcacagtagacgtgagcgcgacanctgtgaatatgcgcgtactcggagtatgcgtatatagcatgtagngtattacagtctctgtgcggagacatgcgccagacgaatacacgagacacacgnccacagctcccgagcctagcgaacaggtcgactatatcgtcgcattgctacggacacaagcatattcgtacgtctttattattttcatcacctaactaatctcatnccgccagagacgatacgcgtagtatgacgctactgctgcatatcacgatagaagacacatcatattctatacacctcgctaatagatgagacgaacaacaacgaccatcatgaaccagcaagttgaagaagtcagaaagattgactcaatatagccaccacagcgcgtgtaagcgatgtgcgtgcgagaggagcagctgtgtatatgttacgtgactctactcgtgctgtagttaggtacgactatatcatgaaagactgatagtcgagagtaatgctcgcgcgcgctactatacgaccaacctctattaccactcctatagcggcgatcgagtaataagaaataaatactantataatgtattacattactatatatacagccgcgggcgtaaaatatatgaaatgacgcgcgtgtgcctcggcctgagatcacgtcagatcgtgtatacagtctagtatcgataatatgtcatcggtncatggaatactgatagcagatggcgcgcacgaacgtactctcgccgactgaatatanatgtgatgtactctgtgtagatgctagagaccaactcgaatatgccgactcatagcagcctgacatcctctaggtctgtcatcgtacacacgactcataaatagtaatcgaataatactataaatantggtgagaagagagtgagcgcgacgacgacactcgtagataagcatacgagagatactacngtacgcgctcgcncacctgcgctgtctcgaagcatagcagctatcggtcgatgaatactgtacagcgtacngtgctatagtccngtactggctactactacatatcaactgacacagagatgcngcgcggaaagaaataatgaatatgacacgacatctatatcgnactacatgcgcgtcttcacattcggacacacatacagcagacagagcgtcacgcacgagacgagtagatgcgtgctctgcgcgacatgtgtcagttacgtcttgcgtcga

SEQ ID NO: 10551 - DNA, 846 bp, Homo sapiens
  misc_feature (1)...(846): n = A,T,C or G
ccgtcccctgtgtcttgcggagagctcctgggttgtgtccttctgccgaggacgtgttggtgtttgcagcgttccgtatgtcctgccgcagggccgggcggacgctgggggggaggggagcgggccagcatgaaggcggcgccgggtcccttgcttcacccgcaaccggtgtgttcggccagtgcgcgtggtgaagtgcgccctctggggtgtgggggctgcttttctcctgcgtgctagtacggcgggccactaagcctcgcggacctccagttcttgggttcgcaaaccgcatcttggtgttttgattcttccaacctgtatgctgccgtagcaaggaaggggggccccagggcccataggccaccaatgaccccggagggtaagagctctaagcgcggctgtcgcgagggcgtagggatgtgagaggcctctgaggcacggattcgtaattacttcacccgctgtgggaatatgttttcagattctgggcatgggttattaaaagtggaagctataggccgggcgaggtggcttacacctgtgatcccagcactttgggagactaagcggggtggatcacaaaaaacctctgctgtcgtgcctctctttcgcttggcgtggtggcgggcccctgtgttccccgctgctcngggggctgcggcgggcgcttcccttgtcttcgggaggcgggggttgcggtgggttgtggttcggccggtgctctccggtctgtgctgcagagtgtggctccgtctcgttctncccntggggnntggtttcgcggctaaggcggggtgtgttgctccaagtttttctttcctcgcgacggtatcctgcttggtt

SEQ ID NO: 10552 - DNA, 1227 bp, Homo sapiens
  misc_feature (1)...(1227): n = A,T,C or G
cggctgctctcctctgcngtctgtngactctccatatctgcggnggcagttaccttgtgcgtgttcaactnagacctcgcngactactgtctgcgtctatcnggangcacacctagtgatgataggggacgctgcgtgtgtgnnaaatgagctgagatgcgtgtgagtgtttgatatgattctctgtttgcgtactcatattnctttcgtgtcngcctcgcatctcttacgagtgcaccacgtggngctcctttctatgcgnacaatcaaatcaaatcgttgtatgtggtatctctaaggactatctaganctcgacatcctctctctcnctcctttcttgttgtgtttgtatcattgtgncacgtcgcgtagtnatactgcgagtgngngatatcgtggattgtattggtatttaagtttcgagtgtcgctgtgaacagcgttaacatctgtgctggttgnnagtgttcatgtgtgtgtttgtgccacatatatctgtgctaatggngttaggtaagtgatctcgtctgagcttgggnngcctactatgagactatgtaaatagtagcagtgtgagacacttcgtgggcctcataccacgnnccgtagccgccgagccgatggggtgtgcagaactctatgatggagtatatttaaattctttggacgattaactcacctaccccgtgtngcatatttgggctcgcggcggcgattccctcttgggtcttctttgttggttattaggctgngttttttattcatgtttgcttgtgttnntctatgtgctttcgttattggangtttcaggcgccactctcgggtttttctgttctgcatcttttgttttnngccctttcncacttccaaaccccctatttnttcattatatttttcttttttctcttntcttcttcttctccttctcctctcatctttctnnncctttatctttnctttttaacccttatcctccacttctccttctttcccttcacctnnccatacgatcccctccctcctttcacttaccctccctctttctttnnttttantcctccattatnttnccttcctccttcatctnnnnttatttctttnnctcttntatnnccttattctcttncctatntcttnctcttcnncttnnccttaatnnnnnnncctntnnncttttctccttnnnnttnnccttctttnnnncnnttnnnnntnnnnncccccttt

SEQ ID NO: 10553 - DNA, 1924 bp, Homo sapiens
  misc_feature (1)...(1924): n = A,T,C or G
cacntcacaggctgcggcgcgcntcgcgacgaatgaccagaccgcttactacttccgacnanactcgcatctatatcactcacactcacactcctacncactccctcgcgntacgagcactgtccgtactgtcgacgtcgagcgcgtcncacacaacagctcanatcgntcgacagcgcatagactgtgaggaggagagatacgttagtgcangcgcgctagtcncgtctctcactatctctgccgcggtcttatgcgcgcgctgcgcgccgcgctctgtcnccatcagccatcgcncatccntctctntacggtnttagacgatgtcggagtgtgtgcactgantacgacgtgcgcgtcggagctgtccancgtctagntcgccgtctctgtgatcgtctctcggactnactggttcgtagtntctatctcgtcacactctgtcatcttcgtcgcgctctacatctcgacgtctcatgtgtagtcgtgctcttctgactaatatgctctacgtatgctagcgacagtcanctagcgtccacagtctgtgcagatgctgatgtttactcgngatcgacatgcgtcggcagcactctctctcgtctgttcgatatctgagtggcgtctctacncctcactcactgcgatcagtatctgtctcnccgcgcacagccatatactacccagtcaccacgactacactacacacaagatcattcgtttgctcgtgtagccgcactcactctcgatactcctcgccagcacttcgaccctaccgtctcgctaataattgtttggcttagcgatagctcggtcgtctggtaccggcgtgactcttgtgcacgcgacgtcgtatctacatcctgcgtaggtacantcatctgtgcangacgcaggcatcgcgcgcgaacgcgatacgcgcgcactntgcacacacacatcgtacntgcgccagtcttcatcncnacggcancgcgcgccacgccntcgcgtccgctacagccgcatcatagtgcacgagctctctacccacanacacatcaatagtagtcntncacctactatgttctatcgnactgtctgctcgngagttcacacagcgaagtaacgcggcncatgtctgacacctcgtcgtcgccgcgcctctcntctcacgtatanctcttctcatacnaactcanttcgcancttcncatcacgacgacgtcntnacgcgcacacatcgactaccaagaatcgtcactagtcggtactgcgtanacacatgacgatacgtcgtgacgtcacctgcactnngntcagtgctgctgctgcncgtgcggctgtatgtgcgcacgcttcgcggtcgccagtaatngcatgcngactgtnnaaangacatngcagnactgatcgcagctgtcantactagcgacgacagtcgntcgcctgcgcactagatagcaagtcgactgnactgngacgnatatggtcagtgcatgtgctcnctatgtntatgaagtntggcatgacgtctantgatactgcgctcactacgntgaccaccacntcacgtctagctcagcatcgatactagtnatcactatcaggcgcacagcgcgctctgctatgctaccctgcagcgctactgcatcgatcncgatngcnatnattgcgantaggcagtgacggtctgnatcatactcgncagctctgatatcaactatcanatacnatcancatctngtctgtctgagcagatcgtngtatatgactagtgntgcgnctatcaggcagcgcgatcgcacgcgcgcatngcacatcgcggtcgtctcacgaccgctnctcagacacactgtcnttaactnctancctcccgcangacatagtacgcgctcccggtcggtcgtagcagtacgctctagactagtactatcatcgagtt

SEQ ID NO: 10554 - DNA, 743 bp, Homo sapiens
acctgcattgttcaatgggattcactgtgaattatgcttgttaaaagtctgaacgttcattgtgatataattccgtcagtgttggtggactccttaatcaggatgacagattcatataaaatacatttgtctcttgccttagccctcctcgtttgcgcacacaaccaatggaatatctcgggggcgcgggaccagctttttttcttccatttatcctcctcacagatatgtatgagctatatcaattaatgttccgcgctttaacaagaccctttaaatggtgcgtattccccaacacaatgtgtgtcagtacagttcctccatagggccctccactcagcttgtaggcgcactgtggtcatatgcgcccatcatggccagcccagggcctctccttcaagcaatacctccccaccaccatctcatactcctatagcctagtcctcatagtcaatagcagatatcatggtcaaggatttcaattgaagtacttgcatggagatcatactacagaatccatccacagctaaaggcaatgctccatacccaaaaaaaaacctaggatccatcttcagggaaaagtcttttcttacaaaagtactcataaaataggggaaaaatgaatgttctactagatttgcagatatcaacacacgggcaccagacacttaaaaagacaaagaaatttgacaccccaaaggaacataagtcttcagaaacagattccaaaaaaaaaaaaaaaa

SEQ ID NO: 10555 - DNA, 316 bp, Homo sapiens
catccagcggtcaccttccgccccaacccttcctcaggcttgctgagttgtgaagtacccgcgtaagctcaagtcaagataaataagatatgaaactacaaacatgagcatcttgactcccctgcacttctcacccatggtgcccctcctgagcagtgattcccaccctggtccagctttgatcctacaggaatgaacgtgcttcccaccttcagtgagcttctccttttgctccatcacttccagctggagtttcccatccaacctgttttgaattaagattaataaatgtatttgaaattgaaaaaaaaaaaaa

SEQ ID NO: 10556 - DNA, 1229 bp, Homo sapiens
  misc_feature (1)...(1229): n = A,T,C or G
tttttttgttaaatcgcccacactgnaggttanccatggagnaagctnagcccgtnctaccaagccagcgaagaagagctcctcaccattaaaccangctcgtgctgccctaccttgaaccttggaccttcaccgcctcccagagacagcgcacgaaaataatattcgctggcttgttcgcaccacgtcccaacaaaaaaaataaaataaaacattggctctttcctcggctctacagccggaagggagcctcctgccggccgcgtctccctttaaccgcagggttcagtggcattgaaccctcgcctcacctgcactccaccgcagctcgggnccgcctcggaccgcgggcacagcaggccatccatcctccacctcacccagggccggccacatacgcggactnatgtcgccacctaccgcacggggcatcaccccactcatacaacaaataccccacccccacaccacgcacactccacaacacggacaagtaactcccaaaacnctacgaccccatatcagcatgcgcctcaaaatccacatcaagcccactccgcgactcattcggccgtagctcccttccagccaccgnctcgcgccccgcggctgtgagaatgcactttatccacactctcacaatacaacaccatctacacacagcaccctaactcagtcatgctctacgacatcccactctacacgcaactcacccctcacctaccacactacgactaacagaccccanacgcaccccttcctaccggcagtaacacctcccgccaacccctcacacgacgaccactgcaacgctcagtcgcgcgatcacgagtacatagatcgccgcgcacatcgatatcgcctcaccatcccatgcacgctcgcagcatataccgccacacccgccacgcactcccctccccgccacccaaccccgataatctcagcacaacctcttccctcacaacgcctcaccctcgcccaaaccacacacacacgcccgaccagacaatcgctccatntatacgctatacgctacgcggccctagttnatactactgcctatctgtatccctcccaccacactacacagacctcaagccacgccacagtgacacaccgcactacacccaccacacttaccgccgtccgctctcacccgaatataccactataacgcaatcccaatgcttagctaccacgacatatctagtcaccacacaccaccg

SEQ ID NO: 10557 - DNA, 1406 bp, Homo sapiens
  misc_feature (1)...(1406): n = A,T,C or G
caccccaaccaccatcccactgcgatcccactaatagcccactcaagaactgccaagcatntgcagcngcaattccagactcgaccccagcatacagaacagtaagaatcacatctcctgtgtcgaaatactcgagacaactcagactnctcgacacactactactctatagcgaagaacctctctcgcatgatatactcttctcgatcataagatctacccatgcaatcttggnatacatctagagatagggcanacacgtcagatngaccctactccctcaccatacacaatacaaatcacacaccgaccggcccccntcatacctggtcgtacttccactcnagcgcagcagcagcacttcatacacngcgtcactgcactactctcttctcacatcatcaccgctagcgtgcaacacancgtcacctccgcatnccctctccgcgtctnctcacagcatctcacagtctcgccncacctcctcgccgctcaactcacacagacccngnccgcctacccacgctcggcgccactcatcacttcatccacgtnacacccgcgcctaccattgcacgaaacaatcgccacgattcacacaacatacacccatagcagccgacgccatacagacacaacataacgcatacangcaagtcgactcgnataacagccacctaccaaccagacctcgcatcagaccaccacgctacacacagcatcacacctacgacgcatagagcntccactcgcgacaccaccgccagtcacagatacacacatactcacaactaaaacacanccctntccaccaccatcactactccacaccaccacccacacaccgtcaccaccctacacatacccccacatatatcccgcacactcccacctcaccaccgtcagattcacacatgtcacacacnacctccgccagcgcgcactcactctcacccaccgcactcaccccacgccgcacaccaacccactcaccacccacacaccggcaatcctccatgcccaccacgcatcccagtacagttacctatagcgtcgcncacccctcgctccataaacccatcacaatatacaaccccaccccatatacatactaccactaaccactacccacccgcatatctacccttactccccccccacttccccatcacataccacataataaccaccaccacacacaacaccagcctccacttacacatcacaacccatgtctagcactgctcgcccactctcccccgactcaacccccaaccactccactccgcaccccacccactaaactatcactcacaccatacactaatccacacaccaccactccatcatacttgaccataatacacccccctcacccacaataactcaccctaatacccactact

SEQ ID NO: 10558 - DNA, 426 bp, Homo sapiens
ccttccagggaagcgcttggataacttgtgatgtcagaagatctcctctcatgttcccagctactgtcctagaaaccaatctacccgttccattaagacagacctctgggccggctgcggtggctcacacctgtaatcccagcacttcgggaggccaaggcgggcagatcacctgaggtcgggagtttgagaccagcctgaccaacatggagaaaccccatgtctactaaaaatacaaaaattagccgggcatggtggcagatgcctgtaatcccagctactcgggagactggggcaagagaatctcttgaacccgggaggcagaggttgcagtgagctgagatcacaccactgcactccagcctgggcaacaagagtgaaactccatctcaaaaataaaataaaactatggcctcgttggcctca

SEQ ID NO: 10559 - DNA, 1518 bp, Homo sapiens
  misc_feature (1)...(1518): n = A,T,C or G
ctggatanaggtccagncgtgcgataataggagagactagangncngcgtatagagangacggacgcgacacgacgcngntgcgntgacgagagatcactgtctcactctagctancctctcgatctntcacgacacatggacatcaggcacgctctcggcgcacgcataaagnancacagcgtanaatcgcgcgcagagcgcgatactagtggactgagcagcnanatacgatacgcatactcatactagagagntgntcagacgacagtcgtcacattatgggcgagatatagatgcgacgcgatcatgatgcgactcaacttactacagcgtagccgacacgcatgtcgtacatatgcgagatntaatcctcntgtagtagcgtagctgctgnaggagcgctcgagtagagacgatatgatagancagcagagatagatcaacgagtacaaganagcgatcacgagtagaggcgctcgagcanagaagataggtggagatacgatatgactcccanggtgagagtgagtagacctatcacgacgataggtagcatcgancagaccacgtaacaccacgcgcagacggcaggtncngcgcacacacatcgcncgggcgcgcactctcgaggtacgtaacggcggactcgacccgtgcgccgccacgccgcgcgaccgcgcgcgccacggcgtcncctgtctcagtcacgtatcagcactcgacgcactgtgcgctagaggacacacgacggcggccgcacgccacccggcagacgcgaacgagcgactaagatctatggtgtgncagatattgtatatcaatgcaatgaacgcacattcgcgaagagtacagggaaaaacaataaaagaagagagtggaaatagccacgagaacaaagagtgaatacgatgtgtgagagagagaataacgaatgagaaacggtagcacgagcgacgtagtgatgatgtcactacgccccccactactacattcgtacagcgtctcccccgacgacacttgtacgaccgtgtttatcgctcgtaacatattaccaataaataacatacacacatcccatctcaccctctcttctctacgcccttccttgtctttcgccccatctcactcttatttcctgttccccgcggacgcagatctactttcccgccgcccaacacaacttcacctctatataacacgaaattcaatagaatacaaaaaaaaagagggactagaccgaccagagcgaagaagagaataaggtggcgtgggaaggcgcgcacaggacgaacagcgcccccacgtgtcgcagcagccggaatgtgaggtgaaaagagggaacaataataagacaaggaaacaacgagaagaagacaggaaagcaagaaggaaagacggagtgcgccctgctgtgtctcatcataaaaaggacccgacccgccgcctggctnggagtgtgtgggtgtaagngnggcgtcgtgttccaatcaaacaaataaaagtaaaaaaaataaaa

SEQ ID NO: 10560 - DNA, 999 bp, Homo sapiens
  misc_feature (1)...(999): n = A,T,C or G
ccgatggctgaatgattgttttgattgcatgggagggggataattcgnactagtcattttgnaacctggacctgtttggagcatctgnaattatgggatatgatggaggaagctttannacatgagtaaaactatatagctcttatgtgangtatcattgttattcggttttatgtctctattgtggacaggntagcgcttgatgagtggagttggatgtnnnttagcacgttctcggaggaggtagaggagtgtgtgaatatgtgtgnagtgtatagggaataatgaattaaagctggganaaatactccacatgcgaaggaacggatatgatgaatgtgacggagaaaacgagagngaaagagacacgtgtgttagtatagagaacattgagtggtgatggagggacgggtgggagcggcgaagagggaatgatgcggtgggcgggacggggggcagggggcgtaggcggggaatggatgaggagncttatgagagaaggtgcgcgggtgggatgaattaactatttttcctcttngctatgtgcttttccatttgctgtcgctgatgaattgtaatcatatgagctagctaccaagtacatnccgatactttcactattttatggattttcttgaataanatctanaatgtgttaactatgtcaaganccattgttagatatactaaaattatnnagtaaaatttacataaaacatccacatagactactgactagtgttctactgtcgtaatcttnccgtatgnatagtaatatancccaaacatacaagaccttgcgtgncatgctgagtgttccttctctnnntgtgttnctcatattcttccctttccttaccttttccacacttcctccttcntctnncncccctccttnctctncaacnccgctgatacttncttnccttggnnnttnnnnattcttcttttcttntnnattattnnnnatttttctaattttaatttaatataatctat

SEQ ID NO: 10561 - DNA, 375 bp, Homo sapiens
cttagacccactctcaaagctcccgtattccacgttcccacgagggcttttccgacgatgggtcttctctaaatcaaagtggctacagtccaaagttgtaccaaagaaaaattcaccagcttccagcaaagtctcagcagtatgattgaccttttcttcctgcatgtttttattattgtttaattgtcatgtctgtcccagttaggtgacaaacatgaggtaggaatcgctttaatccttgcgtttttatagtacttcaaatgaatactccactcagtaaattgaaaatcattattatatataaatacatatgttaatgcatgacctggaagatcaagtggcagaatgaataaaccactggcctcgttggcctca

SEQ ID NO: 10562 - DNA, 2234 bp, Homo sapiens
  misc_feature (1)...(2234): n = A,T,C or G
aactaagagangaagcangagtaagagagataagtcgnatcgtgacganacgaggagcgcatatnccgatacancgctntaggaactgangacgtctncgtgatgcaggtacnctcgcatgatcgtaagttctctgcgtctactcnatctntacgtaatcantgcgccgtacngtctactcgctgtcgtagagagatcgaactcgtatcagtctancgcntganngnagananatcatcacacgacacgcntagacgncagatcgctgcgtccngnggacatacgatangtagacaccgctgcgacatncttcgtacgcgatgcagtcctcacgagcanggtcacgancacgctgcacgnatnactaggcctcatacgtacgtagtctgacgtctatgttggagtgtagtnatcgatcancgtgtgacactatgagtncgatgancgngantagtatagtgcgactntgctacagtnganncnngactaatacngcgtatctacatnanctntacacnagtgactgcagntattatagttgatataccgtacgtgagtnnctagccgntctcncngcnnatcagcgcgtcgatcgngcgctatgcggttgcgccgacatactatcgtanattagatatnantagcgtacgtgtngcgacactgatctatgtangaancgtcnagcnctgacgtcagcgcgctgcgcgcagatgnctagttagcgactcatcgcgcatgacagtgatnatactatatgatggcngcnntagatgttgatatncgctgngatngnatcantgctgcaatanngancgacgncagcgcatcgacgagcgtcgagcatgcanatgcatgtagagtgctagtngctgggaatgggtatgtatgtgcgactgcgtagnangtcggangagntgannatgcagncngancgacagacgggngtagngatcggagnggtgatgangaccaggtacnancacagcatantnctgcgcgcgngtangtcacgtgcggtcgactgatcgcagtcatngtggtcgcacgnangcgcgtgngcaggagnagncgtctcnagtagcagaactgnctcgtacgangcgcgcagcgaatggatgtgctgctgnagtngatagtantagtaaagtaacgaaagatganttacagntgcgntacctcgnntcnatntgcnagccgntctgcgtccgactcngccgnagnactctctnacagcagcgcnctgtngcntatcncgcagtcgcngcgnactccgtacctcgtcgactcgatcatattcnacctacatancgatactaagtcaactgagtttatatnantgaanttatatatnntncatatntnctanncagntnanatatncnancnnactnancnnacngnagagccatcncgtngatcctgctaccctnatnanctgtnatntcatgtcgcggtagatgcgctnacganatnantagcnaaacactgatcagancgctgatgcncgtcgacncngtgcagagcatactgnaactgcgatcagtgtcgcatagnataancacngncgtgganactatagtncgactcgnacagcaacgagcacatgacagccaganctagcatgaaganatagcagncgtgacgactacgctgcttgacngngantncaagaactgnanacnatgngtngctnacnntactgactgatatganntagantnagtnatagtgacgatgatngngatgagcgctacgtanaatnctgtacncagnnagatngacatggagncgncatggngcngtnatgagagtanngacgtnatacgacgctcncncnactctctagactgacgagtagcagtgaangncgagcatgagaaactcgtanagctagtatatgctgcangcctcgacnangctgcgtcgngctggtngtantgcngngctggtncnggtngtcggagtngtctncgctgnntgtgatnntgcgcgtggatgnggtgnnntnagctcgctnntancgncancctgtctactntactgntaatagaatggaggatnntnctgcgtcccnctngtncgctggttggtctgtggtagngcttgttgtgtcntganccagcnntcntctccggagtcntctgcctgctgcnactcgcgcctcatntntcntnnnantgtntncganatnntannnttanatnnaaagnataaannnnannatnaatggatga

SEQ ID NO: 10563 - DNA, 234 bp, Homo sapiens
  misc_feature (1)...(234): n = A,T,C or G
ctgtgnagtacgaattccatgaacgtagggactgtgacttctgagtctctagccaagcacctgccacatggattcctcatggaaacttgacagaacaaaggatttattttttattaggttaaatctgcttcttgggtactgtttgcttgctgcccattaagtctggacatctcaatttgaaaaaaaggcacttggattaataaaaacttggcctcgttggcctcagcgtgtatt

SEQ ID NO: 10564 - DNA, 260 bp, Homo sapiens
ctatgggtactctggatctgaagtagggggtcccagcgaagtacagacagctgtgtgtctccatagcagggataagccctctcaattgtcccttcctgcaaatcccctttcctgatcccaaagccgcaacagtggaaccttctggaaggtggatttccaaggattgtccttatcctaaaactgcattcaggaaagacacattgacatgactgggggcagagatgtgtaatgcttataaaggtatggcctcgttggcctca

SEQ ID NO: 10565 - DNA, 905 bp, Homo sapiens
aataagtaacatacatcaaaacatggcaccggtgccctcgttcacgcctcactacaaacacacctagaggacctagtcagagcggcagcgtacgacggataaggaatgacctggttaagtaccaaagacatctagacaactacaaaccacctgtaacgtcagttacgtaaatgaaaggatcacgagggggtggcgaggaggaaggatagcggcggggaaaacgagagttagacagaaaacacgcactgcatgggaaattagtcgacaaaaccaagccgtgtgtcggagacaaaagaagcatgaatcaagccagaagtcgttcacgggagcgatgttgcgaaatccggaataaagtcgaaacgtatagaaagagggagcatcttagggacgacaagggaaaggcgacgcagggaagaagtgtgagggcgcgcctcccccccccgcgtcgtcttgtcacttcgcgcgccccacagtttgatgcttcacataatagttgatcatagataatcgcggtgtcgcagatagaaccggcggcctgccaccactagtcctctctaccagaaaacaacaatcctaaaaaacaagaagagaaagataaatacgaaccgaaaagcgaaggaacgagaatgtgacgaatattagcaatcggtagatgctgattgggtatgtatattctcgtgcgattgtcttattccaagaaaaaatgtgatcacgattatcacgccaagagaatagtgaatagagaggtaagcaaggcgtcagggtttgatagggttgttgatgttagatgtgggagatagagatgtgagggagaagtatgatcttacaccacacacgaagtgaaaggaaaggggaaaaggggggctcgaagagagcgccgacaaggaggagaaaagaggaatgag

SEQ ID NO: 10566 - DNA, 417 bp, Homo sapiens
  misc_feature (1)...(417): n = A,T,C or G
gccatgcgttgacataacttggatgctaggaggactcacctcatgttcccagctactgtcctagaaaccaatctacccgttccattaagacagacctctgggccggctgcggtggctcacacctgtaatcccagcacttcgggaggccaaggcgggcagatcacctgaggtcgggagtttgagaccagcctgaccaacatggagaaaccccatgtctactaaaaataccctantagccgggcatggtggcagatgcctgtaatcccagctactcgggagactggggcaagagaatctcttgaacccgggaggcagaggttgcagtgagctgagatcacaccactgcactccagcctgggcaacaagagtgaaactccatctcaaaaataaaataaaaccctggcctcgttggcctca

SEQ ID NO: 10567 - DNA, 328 bp, Homo sapiens
  misc_feature (1)...(328): n = A,T,C or G
ccctgaaagtacgagaggtcaggcctaantcctcaaagctggagcaagaaactttttagtctttggccttaaaatccaatgctgtttccaatacttaaaaaaagcagactgccttgaagaagttagaaagtccggagacagtttccagcttcatccgtgtccctacaaaggacatgaactcatccttttttatggctgcatagtattccatggcatatatatgccacattttctttatccagtctatcattgatgggcatttaggttggttccaagtctttgctattgtgaacagtgctgcaataaacatatggcctcgttggcctca

SEQ ID NO: 10568 - DNA, 304 bp, Homo sapiens
  misc_feature (1)...(304): n = A,T,C or G
tgtcaagaacgtactaagaacactagcaaggccagcaggggcgcttagtgggaactagatcctcctanaggacatgacgaagaaaagacagggcaggtatggaatccagcagcagttttcctgggctgcgatggaggccgggtctgtgattcttctgagagaaaacaaaataaacaaataaaaactggagaattattttcttatgagttagaatctgaaaagaagatggactataacaaacatttgttttagttatagcaaaaagattaactgtacaatgggtaactggcctcgttggcctcaa

SEQ ID NO: 10569 - DNA, 1247 bp, Homo sapiens
  misc_feature (1)...(1247): n = A,T,C or G
gcctataatagtattaagatagtacattgtcttacacatggtgtcagtggcaccgtagcgcgaatggaatacctatcacgacgcatgagcacgttacgcaccacgaggaagtgatataacaccgtaggaacgaatgatattcgaggatcacacagtcaaataccgtctatgagcacgacctccgtacaccacaattgtatatagatacattgagcacacgccatcaatgtgagtggagatgagtagcaccggacggccgtcgcactggcgccagtagcgtgcgcagctgatataaacaactggtatatgtcgactcgagcgtacgactacggcgagcggtcgagttagtcaaaacacagatgtcattgagttcttcattaacgtcttcgcgtctaagattccggcctgtagttctggtgatgacgcgataacatcgagttctacggacacatacttagaccacgtttgtatagatcatatctctcgcgccgccggacgcccaactctaaaattcgcccatctggcattctgttgactctgtccgtctcctccagctagagtcatctctttacactctcaagcgagttattgacgtctacaagttgattgatatatagaataaaggatacgtaggagcatgaatattcagatagtgtgacggtcgcacgccagcaaacacatcgctcccgtctgattcgatcatgttctgaacagttgagagacacaggcaagtatatctgcgtcagatgccctaaacacctcatttgtcgtgtggcagtagatctagtccgtaaactggacgtaatctatgtagtacctctaactcaaagccacctgttagcaatacacaaatcccccgctgacatgtgtagtacatgcgacagatacaaacatgtgctatactcagtcgatgttatgccgacgtaaactcacgacagaccatcgaccagaaccatacccaactcccctaggctgcacccgctacagtgatactgccgaccctcaacacaagtcacaccatgacacggacatacgcattcaatcctctcacttcggactacttaccataacaatagacatgcgcggagtactgagtggacagtgtacaatagactgcttctanatggcagtccagcagtgtctctacactgccgtcggcgtctcgagctcatgacctgtatatgtntgnccnacgtntcatcgacgctcagatagcgatcacgccgtgacacgcagctgtgagttag

SEQ ID NO: 10570 - DNA, 369 bp, Homo sapiens
cctaggctatccagaatgcagttttgccaactggatcaccaagcatcctccaagcccttggtacaaagaatggagaagatgaccagagagagtgtgtgcctgttagaaagaagatagacctaactcttctggtaaattgctgtgaatgaagctgaaggcaaggagggacaagagagagagagcagtgtatcagacacaaaatgccctgctttctctctgctgcactgaaatcatgaaagaaaatgtgttaaataagtagacagaaagcaggaagctctcttttctgcttctgacttcagagaagacattgttgcatatttctctcccatgcttctgtatcagcatggggcagcttgtatcagaataaat

SEQ ID NO: 10571 - DNA, 1064 bp, Homo sapiens
  misc_feature (1)...(1064): n = A,T,C or G
tctattttttttaatttttatatttttatttttattttatacatataaaactttttgcgcgtagctaatttaaccttttaacgatcaaaatatacctatcacaataatagaacctatgtattttaatatttttcaccattccctcatcgctttttcgtgtatttttgctctgtattctgatgcggaattttattttattatactttaaagtttgcccctcctaaacaattacgttcctatttatttgattaatcgcatcgcctttattatttattcgatgtccgttatgctgtaataatacttgtatactcattgattcattaatataatgcgaacgtaccttataacagggcgtctatttatccgtccgtctatattttttttttattatataatacgcattttaattcatgtgtgcctgagttgcggactctatttatgatcttctccgcgttttatataccatcatctgtttttctgctcgccgtctgtgcattttatttttacgcgangtaatattgcctcgctgtttttttccttttaacttctctctctctcgctttgtgctcttatctttttactttagttgggctacagcggtggtagtttttttctatcgttacctacgccgctttttccttgccttctcatacttaggcatctcctttatttttcctattccttaatatgtatccggctctttcttgcgagtcctcactctaccattcttaatctcttatattttctaccacttctatatagtttgtattatggatgcccgttattatcgttcgacttaaattataattagtagttcctcatttctactattacgattatcgtctataccatcaaataagtagcggcgtgaaacattattacgtagtgtatcacgatgactcaagtacatttcaaccgcctacaccaatatcgtattcgccccttccctaataaccgaattctcctctctccatttattatctcatgtgcccatccgtgcggacttattattatttttcttctattttgtttaaccattattttattcgccgtttgatactcta

SEQ ID NO: 10572 - DNA, 991 bp, Homo sapiens
  misc_feature (1)...(991): n = A,T,C or G
cccaacgccgcacagccaaaaaaacaaaccttatagncccaaacgccaanaccttcacgggggaacgcagccgaaagcgcgacgccgaacgcgncagaatttctnacgacgagccaaggccacgggggacaaccggactncngacggaaggcgccggagagcggacaccatgaccgacnagccgagagaggctccaaacagcaaagcaaacaggacagggcgccggacaaagcggncggacagagccccagagaactgtttttgttaaccagcgaacgaagagacccggaaaaanggaccaaccacccgaggaaagaccagaacaccaaaaggaggaagaccatgccacgggggcgggacacaaggccaccacagagcgccagaacaacggaagcgaacaccaccccccaacagcaaaaccagccccacccaacaccgagaccaaaccggcaagacaacacaacgggcgagagcgcgggaagcccacaccgccccaagagcgaaagaagcaccaggcgcgccacccgggaaaacccacgacacnagaacagcgaccgccccgaagacccaacaacccaacccgccacccggcgccggcggggaacgcggaaacacacacaccaagagcaccacgcaccacacagcaacgcaccgacgaacagcccccccaccgagcaccgccccaacggacacaaccgcgccacaacacaagacccacgggacagcgaccgccgccaaaccagcgcgccccaaccccgacacaagaccagcagcaagcgcgccagaanaccacgacaccgggccgggcgcaaccccgcacagcccacccgccaggcaagaaggggagcgagcagcgacccgcgccccacagccacgcacgcacaccaccccngcacacnacacgccacaaacaccagagacgacacgcgaccccacacaaangcgagccacgaacagaccacacgcgccgacacagccgaacccacgccgg

SEQ ID NO: 10573 - DNA, 885 bp, Homo sapiens
  misc_feature (1)...(885): n = A,T,C or G
cggggnnnnggantnnannnnaagtcgnnnnannaaatgtaatnaattcagctcagtaacatgntnatatccctcgctccccaaaacacaagagacgatcaaacgcgaaccccgcataaagtaaatagccacagaggccccggacatgagtggggcggggggaagaccataggcacgacgcaccccgccagggggccgcatgcgggctgtagccgcgcaacccgcaccgccagaccaacacacccaacggccaaaagggatgatataccaaccctccaacggcagggagggggaaggggagggggccgagataggcttcagtgcgacctccaggactcaaggaggagaggcgagggggacgagagcgcagctccccccccacgcgcgccacccaccaccgccccaccggcacgcccgccgcgccggccggcgcgcggccgccgccccgccgtcccgtccgcggccgcggcccgccgggcgcccgacgaagtgcgccacaacgccagcagggtgggcacagtgaacactgcaacgcaccgtgcagtgcactcagggtgggtccgcccgcgcgtgcgacggcgaggcgggcgtggggaggaggtgcggggggggcaaggaggcccccggcccgccgccgcgccacaccgcacacgaggcgacccgccgcgggagggcagcagccacgcggcgcagcccacgaaccnaccggccgttgccctggggcccgcactatgggtagcgcgccccggccgccccgcgggcacgcggcgggagcgcgccgggggcgcgaggggggggccaccgcacgcgcgggacgggagggctcacgggaattcgcgcggccggcgcccccggaccccacaaacacccatgcccgacagtgag

SEQ ID NO: 10574 - DNA, 1579 bp, Homo sapiens
  misc_feature (1)...(1579): n = A,T,C or G
cagactcagtnatanccatntctctactcaatcgtantagagagtcagcgactattgncgcgcgatctatctcanagaantcgtancaatatgcactgtgtgtagaacgnacgacgacagcagaatcatcagtgcacctntaccacgctctcgtcnccaccntcgcggtctcacttgcatactaatcgtcgcaacacacatcatgcacgtgccgtgatacttcatactcgtatattggcatcgtggagcgtagcgtcgaacgctatctcgtatcacatacatactctctcactcttacactcancactctatctcgacactacatgagccgctaacgtacaactaggtgcgnttatatgtanatcatataacgtaactcnatgtatncagttcgagaagatgatgcggagtaagactacgctatccagatgcacgacgtgaccttcgtactacagtgtgattcgcacgctgtcgctatcctcatgtgtgcactacttcgtgacttggttggaggtggtgtgtgtggtgctcgatctgacgncgtgtactgtcacacgcactcgcgcctgcgtcgactccggcgacggcctnctcatcttagagcacgtcccacttagtctgtcgtgtagtncggtggtcatccgattcgatgctctctcttgcccactcgcacgcggtagcttatacttatccacaactagctgatatacacgaaagatcgctatcgatacagacgcgtgacgacagaaagcacgacganaacgcgctcggcgcagacgcatagcatgagacgaacagacgtgtcaacgcataatgatgagagctacatacacatatatatatccagatggcacatacgatacgccgtccagctactcgtnctcgacgcgcatcggacncgacaatactgactgacaacnacgccgcaccagagacnacacgcagcgaggccagcgncgcgcacgctactcgccccatgccgtgcagatgcgactcactcctcactaacgatatntcacaacnacntaatatgcctcttcttatgcgcgcggcgtctctgtactgcgtacttaccttctaggtgtgaantaatgtgtgnctatttatgtgaaagacggcgacgcgcgcgtcgctgtaagactagtattcacctactctgactcacgacacgcagcatcacgcgcanaatgangagacattctatgaacatagtgctcagatctgctcgatccacgagagctaataccatgagtagaggccgccggaggtgaccgttgtgctgaggacagagtaggtatgntatcgagcacggtcgacgatctaccgagcacagcgtgccgctcggactattagtgntatagtcgcatgngagatatatatangaagagtagatgaatgcactcaaagcagactatcgggtactatgataaatataganattggtntatgtgtactgtgtgagtaatagtatgntggngncggggagctcngacggnagggacgtgtnagagtagagtgagaaatnatacaacgcgcaccgaacgggactgnagatagaggtattgtgtatattattaga

SEQ ID NO: 10575 - DNA, 468 bp, Homo sapiens
  misc_feature (1)...(468): n = A,T,C or G
tgctgtgctacctgaccactncgggccttggacataacaacttcaggctttttggccttaggattccaggacttacaccagcaactccctgggttctcagaggtatttggccttggcctgaaagttacacattagctttcctggttccaaagacttcggacttggactgagccatgcttccagcattccagggtctccagcttagagatggcctaccacaggacttctcttcttcccaatcattgtgtgagccaattctcctaacaaattccctctcatccatccatctatcatctatcttatctatgtatctatctatccaaccatccatccatcttattggttctatctttctggagaaccntaatatactaggtaaatttgaaaaacataaaagattttactgcccagttgacctaatatatttcttactttagtcctctgtgacaataaaaccatggccttcgt

SEQ ID NO: 10576 - DNA, 179 bp, Homo sapiens
gcgaccacaagtagacaaaaccaccatccacccgcttaactggtaatcaatgaatcactaggtttaaagtgagaaacacgggaggaatcaaagatgtaaagaacagtttctccccaagaagaactctgaagatgattcatccttccacagccagatctcttgtcggaaaaaaaaaaaaa

SEQ ID NO: 10577 - DNA, 1419 bp, Homo sapiens
  misc_feature (1)...(1419): n = A,T,C or G
ggggggaaggaanggngganaggnngangggggngagagggagggagggagagtaagaggggagaggagagaaggggggagggcgcaagcgcctagaggagnttggcggggagaggagtggcgtgttaagcgtnnnatgtagtccgctgttgcgtatgtgttcggtgtgattgatatgggaggtggtgtggcgtcttcatgatagagagtaagcgagaaaggaccgagcgagagatgtgcgctcagggtgccgttgtgtgcacgtctcctcatcgcgtgcgcgtcgancacccgttcgtcactcgcaggcttcgtcaggcaatgctcacgcgatatcacttgataatagaggaagagaagataggccgcgatcataccacgaaacgatagagtaagatatgagataatcaatacgacaatanctaatacgacagttccgtgggaatgattataacagcaagagctcancatcctgctctattaagcccntcaatctaccatgcactagttatttaattatgtcatngcgtatgtagcgatgtgctgagtggacgatagngacgtgtgggatgggacagtggggtctcgccactgtgtggtttagttgtctcctcgcgacccagtcgtttcgtgtcttctacatcgttgtcgatcggccccggccgactcgggcgtcctggctagtactacgcgtgtgtgcatcgagccgtcgaggattctcgtttctctctcgtttgtttggttctctttactatgtcttgtgttaaagtcagcattattacatgaggatantagttaactgttgtgagagctagagaagcgtgntggaacggaggantgttaagaacgtggtggttgtaaggttgaggtcgagacgcctatctgagatgtggataatatgaaggagatagactgtagatgtgtagagcgaccagcacgttggtgactgtatctgcgcactatatcacacgtcgcgcgctcgagtaccgcatctgtcgctcgatctcatctgtccncgtgcgcatcgccgcgtgtgtagtttgacgcatcgatgtcgngtcgtgccngtcggcactatgtgtctgagcacccaccaactcacctgcccacacttatcaccccgcgtgcgtatagtatataatctacgcctcgcgccgacacgtcgcctacgcgcctcggcgncgtcgcatactatgtgcgctacgtacgcgcgtctcgctgacggatcgtatgtgctcggtgtgagtatgtgagagagngtacgtctgtgcagctgtcgcgtttcgttgttctcattgatgtcgtanctctgtcgtgncgcagctganctctgtaggcaatcgcgtacanactgcgcgcggtcgtatctgcgactacacatcagtggtcgngnatgtgttcgcgcacgtagctgtgact

SEQ ID NO: 10578 - DNA, 237 bp, Homo sapiens
  misc_feature (1)...(237): n = A,T,C or G
ttcgtgggtaacttcggcgagaggctcnagagcccaagctgagtctcgtccttctaaagcccttcactaagcattgtgttgttcagtgaatgttcctcctctggattcacattactactcactagcacctcatttgacggtggatgtagactcatttgcatgcttatttcctgttttatgtttatgccgaccttcttaaataaaataaatccttggcctcgttggcctcagtttttt

SEQ ID NO: 10579 - DNA, 312 bp, Homo sapiens
cgtatgggtacggtgcctagtttgtggccaacaccactctgggtattgctgtgagttattttttaggcatgatgaactttgaaatcagaagacttggagtaaagcagatcaccctccatcatgtgggtggacctcatccattcagttgaaagccttaagaaaaaatactgagatccacaagaaggaactctgactccagaccgcctttggattcaagattgcaacatcatctattctctgggtttccagccttctggcctgccctgaagattttaaacttgtcagccccccaatttcatgagctaattcctt

SEQ ID NO: 10580 - DNA, 341 bp, Homo sapiens
ctagaatctcagcagtctctgatgcctaaaagaacgctgcgtatttgcctgttttgcctccataagggaagtgtcctgcccaccacgccttcaaaaggaatggccttcaggccttgtccttggttccatttgaccctgtcctggccacagccagctggactaggggtgggcactcagcaccagcagccaagccaacagccggctggagactcatagtgtggcccagaataaagtcagggctgagtcaaccagactctatcttgggaatgtgaattgagaaatatagacttgagatcagtttgttcacgagacacaataaagggctggcctcgttggcctca

SEQ ID NO: 10581 - DNA, 727 bp, Homo sapiens
agtattggagaccctgccatttacgacaacgtggatgtatctgcaggacattaagacaagtgcaataagcaagacacggaaagaaaatatagcatggtctctcttatatgtggaattttaaaaattaactctgaatactttggattaaactgatgcagcagtcatccaagagatgtccacatatgtactcctgttaatgttagttcctttcatccaagccatcagaggttctccctggatctcatttttgggctctgaaaaatcaaatctgtccatggcagtgctagcatactgtctattagattaaatgaagctgtaagcatctttgaagtacaaatgatacttggaaagtaaatgaaactgggaatacttgcaagtaaaatatgggaagtcaaagagattaaaggatgagaaccagaaattgcttatggccagtgtcctgagtaagcctcagaatcgcatcctagaagcatcaagttcttgtgttaccctatggatctaaaaaacggcttccttagtttgatgtagtctgcagacatctcatcatcacaaaaacttgaaagcacttacagcactaagaaactacctttgcagattgtaaaaaaagatagaatcctacttagtgttttgatcacacctgcctatttccccaaggttttactgcagggttaaagaatgaataagcatctagttatatttaataaacccctggcctcgttggcctacg

SEQ ID NO: 10582 - DNA, 1633 bp, Homo sapiens
  misc_feature (1)...(1633): n = A,T,C or G
cagtcggtccgcctcgccccgtactatatgattcagtcgaagcgcggcacgcacctccaatcagcttacgcgtgatgcacacatcacaccgccgccgctaggcgaccatcaccaggcggggcggcggaacgactacacgcgcaccagccgcgcgccacacatgggtacggtggagtgggaagactgccagccgcaccgaccggagcaggagacgctgacgggaccccagcacgcccccagggcatctacgccattccgcagagtcaacacaccgcacgcggctcgggtgactaagcaccgagcacgccaagcagaaaacgcacgcatcaatgtccagcggccaaacggaggtagtagtagagccgagccgcgtcgcgacctggcggggcagtcgngagttatatcgtggtcctactntccgcgccccatccgcgcacacgctctgcgcanttccaccaccatacgccacgctgcgctgcgcttactcgaaancttaccgccatagtagcgccgnagtcgacgcacgtcgtacaccactcgccaatctcgactctcacgcgatcgtcgcgctacgatccctcctacaatcacgctcgtcagcacactgcnccgtcaacgacgagtanacgatanacaagatgctacgcgctacaccananccgacgcgtaccacnaacacactacangatacagccgcgcgcgagacgagcgcgctcgcacacgcgtcacatacgtcgcgcgtgngcaggcggcagacgcaggcncacncgactgnaatacacatccagcaagcgtatgcaccgtgctcaancactcacgcacacatacatgcctcngcggctacntctacaccctcgcgctgccgacagccatcgacgccgatcgacaaaaccagcctcttctggcgcacgacgatgtacgcacgttcatactgtattctatattcatatatcgttataccgtgtacacncnctncttnntacnctcattcaccancctccccccttctctcgtccngccattcgcgctcgattcgctcgcncacgctcaccgacatcggcacntctgttatcttntcgcttattatntctatntccgacgcctaccgcagccccaccatcagactctgtaccaccagtcacttcatagtaagatcacagcactaccgancgcgatcaatgncgaaccgtgtgnacgatacacnacgatgaagtaaggtgatatcgcgtagatntcgcgtgnatgagtagtcntagcgcgacgctgcagcacgatacagcgcagtgntggagagaatcgntgtggnacagngacgcgtaccganattaagntgactaggagtgantggggagggtggtnatgagtgagcgaagtacccgctcggcgcgcgaccgncgacacagagtccagcggaatcgtaacgctacgtagccgactgaatagcagtgtctgtcgtccgcgtagctctcnccgcgacagtnnantgctcgctaatntacgacatctgcttactcgcggacatgagcggnnggngagngnngtggacggagatgcganaggnngatgngggtgaataganccgcccaggtaaggagtaggagagnagagaatnttgtgatattatgtggaaatg

SEQ ID NO: 10583 - DNA, 971 bp, Homo sapiens
ctctcagtccgacggacgcacggcacgacgtcaggattactccacagttgacctctgacagcaaccaggactgcagttgtgcacttctatgtagattctgttcaacaaagcaccgatggaaaatacagcatttacaagatgagaaacccgagtacacagaggatcaatctttggtataacacgagtttcacaaggctaactgtggcatttgggatacaactctgggagacattgaacatatatacaagaggatcctcattaggaaaacacgacggcttgggacacactggctctgttgcgccatgcgagatcgctgcccatacacccggtatacccgactagagtgctgcgcggaagccgcgcgctcgagctcacccgtagagcagatcactttgatcaccgccagggatatactctctttaaggtccgcttggagaccacctctactttcatcattcgctcttgcgcctatggaccctccggtatgtcaagatgagcataagatcatctcccccgtatgtcacaagcgggtgccgagcctcatccctacctagatactgaactcaaatgaaatcaactccataatatgcgccgcaggagcccccagcaccactttacctgtctcatctcgtacctatggtcgcccacattcatttcccgcgccagctcgtcgggtaacgtgtgcggcggccgcatcttaacgtatacgatgctctacgacaccgtgtagtgtgcgcgtagcaccatcatctaaccacccgatcagcatcgcgcgtatagtcggagcggcattgcactacggcgcgttgggcgcttcacacggtcgcagcgacgcgctcacctccagtataccgcggtcccatctctgtatttcgatactcccttatctgcgatatagcattttgatatctaatcacaccagcgccccccggactaatatatatctctctctcctgcgtacaggtgcttcg

SEQ ID NO: 10584 - DNA, 1534 bp, Homo sapiens
  misc_feature (1)...(1534): n = A,T,C or G
tggggnnnnnnnnnnnnnnnnnnnnnnnnnnnnnaannnnnnatgcggtgnnnnagnnntgcnnnngncggtggnnntcnnanncntnnnnacaccagatcgtgccnncgcntatagannaancacctccccttcatactgtcaccncctgcgnnagtcgcgcatgttgattatgtgtgtaacaacgcttcagtcattntntcagacgntcgcnnttagttataggatctatagattgagtgcactcntctntgcgataatgaanacgtagcgtagtgcgcgtcgtcgtgctcagtcgtgttgctgcggtctcctgcatatcacactcactcctcgatacatctctacttcaatatcagcgcagcgngcaccgatctcatccgagattgcagcgagtcggagtagatagtaccagatgatgtctacgagctcgcgcaatancgcaagcgacgtagatgactagacgttnnccaccatgcgtgcctcttcntangtcacttctaancacgtcagactncncgtcgtgtgtaanntatgccnnatccnaactacgtgntcagcactgtagcgcgacagcgangacaatttgaatcagaannntnttnanctancctactctcaaacgttccgtaagacgaatctctganttctcgntagattgcagtnantgactgcactagngtnntctaccatatgtgtagtctctgcgtgtgtgatcttatattatctctctnatatantaatcatcntcgctactagctnttatcataatctgatagtagttatatatgtgcatgcacacactgcgcacgtgtcccgctacgtcgatgcacgctcgcagcntcgcgccacgaggcgtcacgggtgacgagcacatacactcatctcgtgcgacacacacttgcgtcgctgacaggttctatngatagtatcgcgatcntaggtntagagtaatgtatactagtgatactagtgtcggtacgcatatgacantacgatcaagtgataactccatcaagactatattattantcgtactattgcaatgctccgatcgaaatgtcacagtcatgattatgtgatgattatagagaccaagtcacactgcacaagttccgcattngttncgccgactctccacgtatcatcgtaactacttgacccctcgtctcgagtactcgtcgtactcgcgctangtcaatcgtcaatccgtcagaccggaacgcaccagcaaaccagtcgcctccctcactaacgcgctccgagtgcatgacacaagtatgaatattataacctggtggcgacgtcggccactacagatcgcacnctctgagtacagacgtaanggcantatccgcgacatgtcagcacgagtatatgtnatacatgcccatcncgcagaaggatcaagagacaactatgagtagcacacccncgacacgcagcacagntcagtgacgccgctccnctgcgcgcgagtcaccgacgcacgccncgtcatatcgccgtgcataacgcacacgatcatgtgtcg

SEQ ID NO: 10585 - DNA, 417 bp, Homo sapiens
ctgctgggtactataacttggatggtagaagatctaccctcatgttcccagctactgtcctagaaaccaatctacccgttccattaagacagacctctgggccggctgcggtggctcacacctgtaatcccagcacttcgggaggccaaggcgggcagatcacctgaggtcgggagtttgagaccagcctgaccaacatggagaaaccccatgtctactaaaaatacaaaaactagtcgggcatggtggcagatgcctgtaatcccagctactcgggagactggggcaagagaatctcttgaacccgggaggcagaggttgcagtgagctgagatcacaccactgcactccagcctgggcaacaagagtgaaactccatctcaaaaataaaataaaaaactggcctcgttggcctca

SEQ ID NO: 10586 - DNA, 943 bp, Homo sapiens
ccaccctataccagcccccccaacgcctcaggtcccctgcgtttgaaaatgcttcgttctgcattcaagaaccatgatgactattgtgtttgttctacctttttttttaaatctgctgacaaagtgaaatatggaatactgcattcacttatttcatcgtctggctcacactggatcgagttatataaagtcggacatggacaaattacaaaaacccgaacaagccaggcccctaatattgttatattactgcccacactcttcatctgctccacaccatcatcgtctttgcttctcaaatcaacccccgcccgctcttctttttctactcccccctcccaagccaaagccacccattctagtaaccacaaagcctcatacctccaccaactctcaccatacatctccagccgcccttttactacaactaccgccaaccctatacccccaatcacccatagacaatcccttataatctccccccgacgactcacccctcccccacacaaacgccccccactacctcaccatgccacaccaccaaaaccctctatcacgtcaccctctaatgccttatcccctactcgcccgcccccccaaattacaccccgctactagacgtgccaggcacaacgcacaccccccccgctcccgatatctatcatccaaacctacacttaccacccccagcagcacactccccctccctccacgctcccttccctagcaacccccctagcagcacatccgcataacgtatcttgagcaccgtccccacccacgcctctcgtatacccatctccctccgccaacatctccaccctcgattaccctcccatcacaacttctcagactcaacccacactatatacccaacagcctccctccccactctcctctccaccatcaacaaccccccgcccaccacaacacccccaccctc

SEQ ID NO: 10587 - DNA, 917 bp, Homo sapiens
gcgctgagagacactttggttgccgtaaaagagaaagaacgctctgtctaacttaaacagagaaggaatttgttacaagcaccacaggtggctcacaaaattgtctgtgtgtggtaagcaggtgggaaagaagagattgaagtcatgggcaagactcctctgccacccccacaagaacagtgtggaacgacagctgaccctgggacatccctgaggacacactgccgtcgtctgtatgctctaccaccggacactccctcgcacgtcgcaggactcttgactacacccctcaccgttctgctccagtcccttctctctctctacttctgccaatgccccatccttttcacgactcaacacgcctccatatcctcaacaatacactggaccccacaccgcgacccgagacagagtataacgtcaacccaccccaataataccccaagttcctccccacctcgaccggcaccacaccctcaccacccccccccatccgaccactctcgcatactccactactcccttccgtcaccaaacaagcagcttcacaaagtcgacatacacgcacacccacctcctccacgtccaccttacatacccccctcagtctttgcacgccctcgcccccaccccacccccgccccaattttttcttactacacccaccacccccctatgcgcttctctctttgcccacccaccgactcaccctccctttcccctcctctcgggaacatatatctcctccgcttacttcacaacaccatctctgtcgacttaatcacccagagaactcccccctgtattcgtgtcggtcatctcttctccctctcccctccgtattcgctccacacgcctccccccacccccccgcccccctcacgatgacgcgaccccccccctaccccgacacccgc

SEQ ID NO: 10588 - DNA, 924 bp, Homo sapiens
ccctaccacgcaacaccacaggcgaccgctcagtgcaacggctagaccttcgcggccccactacctgcaaagaactgcgcatgtcatttttccatatgcttggaaggagaggagaagcacctatgtgcgagcactagccatctctactaaaatcgattaaaataaaactatggcctcctcggcctcagcggaggagcctctgaggacgcttccctccaaagagggaaacaccatgatccaccctcacagacttttttttctcggccgatacgcccgccgaagcggcatcaataactccaaaggcggtcaaaacgcaatccagagaacacgcgcgaccagagcgacagaacataggaaccccaggacaccccacggccagcaaccataccaaagacaaccccacgcccgcccaccatccaatcactacaatcgaccagcacccgcaactccccgcaccacatcccagcagtcaaccctacgaaacaccaccccacgctaagagatcaccctaggagatatccaaaaataaccccttattaaaccacgccacgggcccaaagacagtccgccctcaagcctaccccccccgcccccagattcccacccaccgtaccgctacatccactacccggccgccacgccttctccaaacctaagcatattcacagacccccacccccccagaggaacaccggcacacgaccccctcccatgacgccaatgcccaccccccccggtagaaatacgacaacaatgaacgaccaggtcaagataccaacacacccaaaaccgcacccctaatctacacgtcatagtcccaccggcgtactcccgcacgaaacgcgccgaacatccccagaccccaccaacacagcgacacaaacgcaatcactaatacaccccacgaccaactccctcagcgcg

SEQ ID NO: 10589 - DNA, 1346 bp, Homo sapiens
  misc_feature (1)...(1346): n = A,T,C or G
ggggggagaggaaggaggnntggngnggggnnnnagaggagagaggcgaagcgcgccggcgacgagaaagaggagaacggacggacacggaggngcgcggggcgcggcgcggggggcgcggagacgaccncaacgctccgcggacaagccgcgagggaagggacagacacagccagaacctcaaaacagcagacacacactcagaacaacggcccgcccgaaggaaggagcgagaggggagggcgggaggcggagaccgggactctttgagaccggagagaaggccagcagagcacagaagggaagcagaggacgaagaaanaaagagaacgaaacaaagagaagagtaagacgtggaacaagtggaagcggcaaacgagcgcagcggcggcgcgcggcgcccaacaccaccacccaacacacacgccagcgacgaggaacaaagacgaaaaggaccacacacggacgagggaaagacagggagcaaacaggaggcgagagcgcacacagagacgaacggcgcgcaacccaaaaaccaaccacacaacacagacccacaccaagcagcgcaagcagagaggacacggaacggagcacaagagacacgaccacgagcaaggtaaaaaggnccgtagacacacgcgggagcgcgacaacacacaccaccacgcgaacaaacacgaggaaacatgccgtcccgaagagcgagaggcacacagagcgacgccgcgccgcccgaccgccgcgcacgagcggcngccaacagagacaacgccgagacagaacacaaccacgcgggacgagccgcggcgcgaaccagggcgccagcgaagcgcgaagcccacactcgacgaggaccggccgcaggangatcacaggagcgcaggcagagcgaaacgagcgcccagcgtaccacgacgtgccagagtcgacgacnccaccggacgccgaacgaggagcagagacaagcagcacatacaaaagacgccgcagtagcgacagacgacgggaggcaggaagcgacgcctagacgcgacgcaacggctaccgtgcgagnnacgacggagcgggngcgcggagcgccggccccgcggagagagtagaaatggcaatacggcctcacggagcatcnatagcggaaggcatcacaggagaggaccgaaagcgccataccgaacagaggcgaagcgagngagacgaaagacgacgaaccgagagagagcagacgacagcatgagagaggagcgcacagcgagccgcagcggcgccgaacaacgcacgccgcgcaggagcgagagaacacgcgcgcgcgcggcgcaagggcgaggaagcgagagaagcggcgg

SEQ ID NO: 10590 - DNA, 910 bp, Homo sapiens
  misc_feature (1)...(910): n = A,T,C or G
ctcagcgatacattttcccatgagtttgaagtgtcaaccgcgagcaatgctgctgcctcttcagggaccatctctcccgttctgtcatctctggggcaactattctaccctgctctccgcacagcaaagcagtcatgatgacttgttcatataatgcagcatcaatgtctgcctttaaagcctgcacctttctcttcacctgcacaccatgctacctttggaccccatcaggaagaaaagattccatcattcgcgcgacgatctggcacgtactcacgacagagccccccctctacccccaccaacaccacccaccccctgacccacctatatatcaccccctcatcccccgttccccccacaatttatctgccttcaacccacctcccccaaatcctcatatccttattacgcattccaccctctattaacccccccgacatctaccgcccacccccctacccaccctaccaccccgcccctaccccaccgcgcaatattcacactttccctcttccccccataatcacagaacaactgccctcccacaccccgcctccccaccccaccccccccctatccaccactccttctaatatatccctacccaccctcccactcccctccactacaagtccacactcccgcatctctcccctcaaatcatcctcacacacccccacccccccattcaccccctctccccccagtcgaatcacactttacatcatcccatccccccccaacagcaccacaattccccttnatacccccgtcaatatcctacccgcacttccacgacctctttcaaccccccctcacccccccactaaatacctcacccccaccccacccccccccccccgcaccatcatacttaccccctccacacaaccactctcccctcccc

SEQ ID NO: 10591 - DNA, 1141 bp, Homo sapiens
  misc_feature (1)...(1141): n = A,T,C or G
gacttcagacattgcgtcattgtgcttatagacatcggctggactgctaccgaggccctataaatacaagcaactatgaacactcttagacaacataggactaataacggacatggcagcgggtgcaacagaagnngaaatattgatatcgcagattgntaatctcgagtgnatcttaattgcatattggaactttagcggcagtgcttggacctggggggaacatggccatgaaccgtggacacggaggctcgaatcgctacgcggggagattaggctatgttgganctcagaagttatacaaatgttgcgagaactagagacatctgaattctgtggtacataatatagtcatgaaatgaggatgggactaattaagaattgtgcataggatcatacaatgggggaaaatctgaatactgatggcgtgagatgacgaatagtacacttgtatgagtattggtcgtagtactaactgtgctcaaagtttntgtcttgccccatcntctctagatggtggactgtggggnacggatagagtgggcccactgctggagtacggatgggacgaccggagaatattcctggacatgtctgtctacttcttagccgtctgcactagagacaaagtgcaacggccgtgggaagatagaaattataacatttgtagtaatttgattatgtgttaccacgnaaatgtcatactctactataaagttngaaaaggactattgttatagnagttgttaccgacgtttatatttgtaaagtgctatcagattatgcaatatcatggagtnagacgaacaacctatcacaaaaactagaaacgtcaatttcgcaatattcctaaatctaaataataaacttaaactataaactattttataaaatttacataaaacatttcatgtaacaattattnntttatnnttattttcctaatctattctatctactattntnatctcttcctctcttnttaccctctcnctgactcctcctctcatcccactctnnccgcttgntacctctnnncctnncccttctcnnnntncnnnnacctnnacttccaaatattatattntttatcttttnnnnactattttaataataattaattattttcatttaaaaaatc

SEQ ID NO: 10592 - DNA, 976 bp, Homo sapiens
  misc_feature (1)...(976): n = A,T,C or G
aacaacaattnacgccgcccnnnaannntttgtgtggtngaccgcgcccccctgnctgnggagcgtgcacctgctactgacccaaactgcaaaacgtctcattcattcccaacgcctgcaagcagcatccaaaggggaatcaactctaaaaggaaccagaccaacgcttaccaaccccttcattctgcttccctctgtgtgaggaaaggatagaaacgtccaggacataatcatacaggctcctcatctacaaaactccactatctttttcgcctacacggaagactgagaactgcaaacaggctggggtcacctccctgacatctgacactccccaacccgacgttagactcagcgcctgggggtgaaggacgaaccccactgaactaagagactacaatgatcctcttggccagacaacaaaaaaaaacgaagctggactaaggaggacccaccccacgaccccctgaggcccgtgcccttccgtaaggagtcactaaagaccccccctcccccacacccgtccgcccgggagggctcagcgccgccgagaccgtgtcacctggccccaaacgcggaccactccggcagcgaaccaacccgcggaccacccaccccaaaacgacgagcaacaccgccacccaacctcacagaaaccgcgcaggagccgcgcacccggggcctccgccccagatcccgaccccgcaccgatataacaacatcgcacgccacccactaacggcggcgacccctcactgaccacaccgacccaacagaacactatgagacacacgccacggggactataggcgacgaccacacgcacaccacacatcccacccccccaccatacgccaggcctcccaggtcagataagggcgcgacggaagaagagcgcccgcgaagagagccaacggcgagaggagcgcaacagcggacaaccagccgggtaccatagagcaaccagccatgcctg

SEQ ID NO: 10593 - DNA, 1138 bp, Homo sapiens
  misc_feature (1)...(1138): n = A,T,C or G
attattgggcgatcctatcgatctcttgaaacaagagcttcagtggcgtgccctccaggctacaggcattacaaagtcatattccaactccggcacaacgttgtatcagcaccgggcgtcgatatgtcagctcaagcatatagagggcgggaggcggctgcttccttccattctgttatcctcggatgacgccaatagcgacaatgtttcagtgggagtgtgctctcactcgggctaatcgtagataaactcactcatcactattaccgtgcgcgtcccaaaatgtttctatccccgataatttcgcgcggtgcgacgcgaagtctcctactgtctcttcttcctgactaccaccgcgggggggcctatctgcctcgcgtatttcggcccccgagatcgatcgtcacacgtcctgtgccccgcccgtcgtccgtcccctccgaagtacccgattatctcccaccggcgctccgtcacggggtgttaacaagagttattttatctattacccacgcgcgccgccatatatggatctaattttctctcttcattcctcaacgatcgttgtcgttctcgctcctctctgccccaccatgatttgtgttatgtgtttccccgcatgttcgttcgcttaccttcctcccccttttgatcactcgccgtactggcgtgtcctcctcgtgcgtcttaatgtccgctatcaacttgattccccgatacgcgatagcccccccagcctctcactatactagcatcccacccgccccctgccgcgattatttatcgcacgtgcactagtcttactcgggtgtggccgccaggtgtcgttacctttagcactcngatatgtgcgcgcgaactcctcagagattanatcgtgatggtatactatatttacatcctctcacacttcacatacgatttttaacgagtctatcgtaggatctactcacgcgttgcatcttagcctcgcggttccgaccgctaccgcaccacagcacgatttcctgttccacggcatgaacgagttgatcgtgctcactcgcgcagccgcgtgtcgtcatttgagttgccctcagcacacccgttctgttgcttccgtcgcaccctccccagcttaggccgtctctcctcctat

SEQ ID NO: 10594 - DNA, 937 bp, Homo sapiens
  misc_feature (1)...(937): n = A,T,C or G
aaatcgtcagggacggaccaattatagaaaaattaggaaatagagataataggctggggatgggagtatttcgcaagtggacgtcacagagaaggaagcgtcgaacaagaggggcgggggggggggtaatatgcaaagtagagcaggagaaattaggaatatgtctgcggagtactggcgcgtgggcgagcgcttatggaacgaatgggttggatttgcaagtgcggtctgaaggggagatggggatgtgaaatatatgagagaacgagacgagagcagcgtgcagagacgcgcggaggtgcgagatggataatcttggaacatnaaaatgatctaacgtggccgcgggtatactattaacatacggacagtgatggctagtaaattggggtcggtggtatcgnggagatgngaggaaaatgtnaatgtgaaaaaagagaagatanacacgtatatgataacgcggagcacacataaacacctaaatcactacaacagatgcatgacatgacctctatgcttctcatatataccattactgattcatgagatacgtcgactgaggggaataagcaactcttttgtatctnncatcttcatcaaaatcttctactnaatatctaccatctctctaccnactcttctcttcttacatcctctaatcatncccccctattnnctttatactcctacactnacacaaacatnnatcaaaaacaccannaacactactaatatataacacaataaatacaacaacaanttctccaccaccttcattcctttttcttcnctctctcattcctctccnactctatttctcatgcccnnagttatatctccncaaactatttcacctttgatttcctctaacntctttttttttcctttatactcntcctccccatttctcnnnctcttnctttnncttctcctt

SEQ ID NO: 10595 - DNA, 662 bp, Homo sapiens
  misc_feature (1)...(662): n = A,T,C or G
tagatcctcctcaactaaaatatgaaccacaaacacacagagaacaacctgttcaccactcctgggtncatnattnnagggtgaagggtccaccaaaactacaannggtccatantatttttttttttgctgcctcaaagtccccaaagccttcnagcaaaagtggcantaaatgggttccaatcagccaatgcagactttcactgggacaacaagaaagcanatcttctgggttttgatggagacttgncantnnggacattcanctaatacaaatataccccntcanancacacttncatcttttaccttcccttttccccatgcccccaaactgcttaagtcttctctgtccctttactgctgctgcacagagatgatataaaagaggctctttggctatgtgcattttgcttcctcttcttttccagattacagtatgaaactttattttctttgtacaaccttaaaatttaacttcatcatccgccaaatttgttccttccttttcggaagatctaggggaaaaaaagagcattcatcacangtttcctaaagagaaaagacaaatcggtttccatttaacacctaacccaggtaaaggcacctttaaattacctatttaaaaaataataaataactttattttaaaaaaaaaaaaa

SEQ ID NO: 10596 - DNA, 1449 bp, Homo sapiens
  misc_feature (1)...(1449): n = A,T,C or G
cgaatgacagtggagtgacagtacagtcagagtgcgttgagagcgaacgaggcgactgcgggttcggactgcgaacgcgtctgtggacgtgtgtgtgactcgcaggagtggtggcgtagagagggtgcgtgtggacnatggcgtgggatccaacacagatctggagcaaagcgattcgtggcgcgagagtgacgagtgtgggcgagggtggagtgngaacgcggggcgcggcgcatgagnatagtgatcacgttcgtctcgacgcgtaaagtagcactaagagggtggtgcgagcgcggtagggcagaagaggagagggaggagcgcgtggagagacactaaggatgagtcgtgggagaggngcgcggcgggtagctagggagcgaagtcggcgacgcgaggagtggnaagctgagaggaaagcgacatgaagtagacgaggcggcgtggtcggcgtgtggagtggctacgtatcaccgtattgcgcgtggacatctcgtgagagtgttgtgtctggtgtgagctggcttggcgatgtcagggtcaagcgcctccgganagcgagcgtgtgtgcgaatttagagtagtngacagagagctatacgacagaacgagncggcagtgcgaagaagcgagtgcgagtgggcgcacgtaagacgcgaggcaggggcacagatcgangtncgcgttctcttctgaannnactacggcggtctacttgcgcgacgggccgtgccgcctcagtagnngcacaccgtacgcgtanacgcgtgntttacgtcncctcgctatcgctgtgactgngcccgctcgtcnnncctcggtgtctcgcggctcccgtctctcgnnncactccggtanctgtcatattgacgtggatgtctagtatctgtgntatacgantntgcggnnnnntccatcacatnacacatcancacatcatactnacatnanaatacaatcacttcacacacataaacttaaanaacatacacaccaccacaccaanacctctctatcaaactactcatnnncccttccgcgtcttgnnccttctcanatccaacaccncnctcgcnaacatcaccgctctcnnncagctctncctcagttcnttnnncactcgtccttctctactctcctnactcactctatcctctactcttctcctctctncttccctacanacactcttaacctctaacatacactctctaatacatncatcaacatataactatcatcacaacactccccaatactactacactcactcacatgggcacttccactctcacataacaaacatacacatanctcacctcnggggacacaannnacacaacaananacncnnnnaacncannnncnatacttccatancnnactcannacnncacacaacctacctnccnnnnccnnaccnnnncnnnnnnnncccccccccaa

SEQ ID NO: 10597 - DNA, 846 bp, Homo sapiens
  misc_feature (1)...(846): n = A,T,C or G
ttatgcttatatcccctttatttccattatcttagagtatantctccatacactacttgtcagcgctgtaaataacatntcatacataaatcaaatcattttacatcctttctatataattttcttaatatcatacttcacataattctcctaattaacaaagtattcttaaaaaaaaaaaacaaaaattccctccttaacctcaccgggggaactcttcaaccacttccctttaataaaaattaatacataatcctccctcactcactcccttctctcnatcattcatctacnacccaccctatctcctcactctaactccntattaccnttatccacaaactcattccactactcacaaaatacattntnatcaatacccctacacaacccatcaaccctaaaaacccccctttcctccccttttcatacccttcccccccttccnaccatcacaaaatcctccctcatatccaacacccccacacccccacataactttataaatccctcacctttacccctaaaaactcacccttacctcttcattacaccacccttccccttacacaatacctatctcctttatttctctcaaacacccaactctctcttattctccactctttctcaccccacaactcttcccttctccattccacccctctctttacccaacccccctccacccacctctctcctttacctcctctttttctttcccccccatacctcatttcccatttantacctctttcccacatccacatatattatatcctctccatattatctccccctcacccccccctctcacctctttctctccccatcaaccatcctaac

SEQ ID NO: 10598 - DNA, 832 bp, Homo sapiens
  misc_feature (1)...(832): n = A,T,C or G
ttttctcggtcctcgcgctgctcttgtgctttcttctcntctccctgtccgctcttcgccgttcccgcgtgtcggcggtggtttcgccctccggctcgccgggtacgtttcttttatccgcgtctgtctggtcgcggtgggtctctggggtgctgtgtttctgcgtcttttacttgcgggcgcgttcgtctgttcgttcggtcctgcgcgtccgttgctcttgtgtgtgtgcgttgtgttgtttgtcgtcccccttcgccttgtgctccgcgcggtgtctgccctgtgttctgtcgctgcgggtcttttgggccgttgttctgttccctcgccgctcctcccgccttctcctgtgtttgtttctggccgccgccctccctcgattccggcctcatgctcgccctcggggcgcgcttttttgcctctcttttggggtgtttggcttttcttgtggggccccccgtggtgcctcggtcgcctcggttcgtcgggttccggggtgggtctttcgttttttttctctgggggggggcgggtgccccctttcccctctccggggggcgcgcttttgtggcccgctcggtcccgggttgtgtgggtgctgttgtttgggtgggcgcccctcgttgggttggatatctgtttgcgccgcgggccgggtttccccccctgggtataaaaatgccctggtgtttctttcttcggtgattcgtttttcctccggtttttttccctcttttgggggtttcttcgcccgctggccccttttgcggggggggtagggttcccgcctccgtttctctttaaaagaataactaggggttttaatact

SEQ ID NO: 10599 - DNA, 807 bp, Homo sapiens
gaggcgtattggtttgtgcggccgatattacttgagatatagtacatttgctatataatagcgcttctgcgctgtgacatcctcccttcccccctcacccgtggaccgctccgactccactgactcggagggaaataggagatggttaccatacctgagacgccgcgcaagaaccaaatcacctgcatactgtacacccgcccctcgcaagcgctcgaccggtgtgctcgcgcggcctggcgtcgcgtttcgtgccttttcatcctccgactgtgttgctttcacaaaccagcacaacgtcaggatcccacacaccacggcgcgcgcgccgccgacgcacacacactcatacacgatctttgacgatttgaacgtcgtgacgtcttgtgttacccactagggtcgtgtgcgatcagatacgcgataattctgacttatacctttcacgcatcacaaccagactggaacggccgtgctgatcgcactcggctgagggccggggcgccggcgcacacccgcgaccgcacccgcccgggcgttgggcacgattacggcgggcgcttcgtgcacagtgagcgccgctcaaacatgcggttcggctgcttgtcatcctggtagtgttgtgctggtatgtgctcgtcggtaccccgtcggtgatctagcacgccgcttttcacaaaaaaaaagagcctctctcctaagcgcaagcatgcccttctccattagctttcccctcgttcctgacatctcacttgcactgccggcccgccatgaatgctacgttgagtcaagtttttgagccgtgtc

SEQ ID NO: 10600 - DNA, 1344 bp, Homo sapiens
  misc_feature (1)...(1344): n = A,T,C or G
cgtgtcgctcatgtggtanacgttgcgcgtctatgatcttcttcgngagtcgtcagctgctgtgtggtgtagtgagtagcctgggtcttgtgcggcgcgtcgggncctccaccgcggaggttgaggcgtcgttgtgggtnaacttgtcgcctcatgagtctagctggtcgtcctaggtgtgcgctagggatagagcgtgtattgnctcggtgcgccctgtgaggcgtcgctgggngtcctgagacacgttcagagcgtgtgcttgaggagtggttaagcgtggtggttaccgtggagcgcgagngcggcgcctataccgtttgtgcgttatganaatccatctagnangnacaatctcactgacggagctagaggacaggcctgtgatgtgacgttcgagcgcacgtacggtgatgncgntatcgctggagcgagtagttcgtgcgctatacgcaccgtggtcctcgacactttcgcactagtcgtcgggannacgctggtgcgtagaatacactcagtttagactccgtacctacgtcgcgctggagtctctggtgctntcgnnagttanctgtgcatactttcgtagtgatctgtaggnngtactgtgagtggtgtgcacatacgngtgctgttgtangaccttgcagtannggcgcttgtattgtatgnnagctcttacgtacacataaccactgcgacactcatcctcctccgagncacattaagtccgccttcccgctattacaantncactactactctcatacactctcgcttccgcagngctacancntgtactccacgcatcacgttatgacatttctanagactatcatggttncacaattacgatatcacacaatctatgcatcannnttctattcancacataaaattactaatcaccctaacctcatcccactctcatcactcaccacccaacactacacaacctacctctctcctattgtatcaatattnntacattttcttcnncctaccgccatcctcttctctctctacttctctctcggnacatacatactattaaattnnaactctctatactataccctanttcttcttncactttctactcacatacaattaactacccctnttacactcacaccaccacaaaaatacacatccacaccactatatatcaaatttaatactcacatataatntcngcttatctcccatcctancaatctctcttctcctattaagttctncttncctaaccnttttctcctttnccntctttctccttccttnncttccttnnnctctcctcttnnnntnncnntttnnnnntntttttttttccnttttttt

SEQ ID NO: 10601 - DNA, 927 bp, Homo sapiens
  misc_feature (1)...(927): n = A,T,C or G
tacgctattcacagcggtcaagattgggaagcaacctaagtgtccatcaacagacaaatggataaagaaaatgtgataccgggaccgaggggaataccattcanccataaaaaagaatgagatcctgtcatttgcaaatgtgggtggaactggaggtcactatattaaacgaaatgaaacaggcccagagaaacaaactacacatgttttcttttatttgtgattgctaaaaactgaaggggggggcctatganttttatanattccctatataaagataaagagtanaatcaaccttcccaggaaacataatcaggctttggcaggggagtggggactgggtaaatgggtataaaaatatagttagctagaatatatacaatctagtatttgatagtgcaacagggtaactataatcaacaatagtttattatacattgaaaaataactaagagtctaattgcatttgttgtaacacgcgagaagggtaaatgcttgaggggatgggaaccccatttaccttgatggaattattggtcggggggtgcgctggataaaaatatctaatgtgctccataaataagtatgcctactatggactcacaaaaataacatttaaaattgtgaaaaattggcattttattggggcttttctattaaatggtaaaggattttaggcctggataagtttttgcccaagtaagttgaaaagagaaaaagatggcctcttgggcgtaagtggggaatctggcggcggttcctttagggggggtaattaggacctggcgattgactctggcttggggttgagttggggacggtgtcactctcagaggggggattcggtttcccggaagtgggaagacgcagaagaagtgtaccaaaggcctgaaggcgggaaccggaaaggcgtgggtggggtttcag

SEQ ID NO: 10602 - DNA, 1484 bp, Homo sapiens
  misc_feature (1)...(1484): n = A,T,C or G
ctaatgcgccanctagagatgcacacgagcatagatcacacttncatgctgcactatacaacgtatcgttgcgatattactcgtgatcgtcgctcatcgtctatatcactcttcactgcggtggtacgctgcggtctgcggtgccgctctcgtcgctgatgtgngtatcgtctctcacggtctctctctctgctgcggtcgacgcgtacagtactgcgccacgcangacgatccgagtcttgtacgatggtctgcggcggagtcgcgcggtaatctntcgcgagcgcgcgttgaggcgcgtgcgatcggcgcagtgcgagagtagcgtcatgtgtagtcgcgagactgaattcgagtactcgacgtgctatgtatatatgacggaatcgctcactcacancgacgtccatctcatacttaacttcgatacntangctacggtcgatctcagcgccgatgtcgacctatgctgacactgcacagcgcgtcgatgtgtccactancgtgtntagatctaggtcgatggcncgcncacacgtgcgcacgcgagtacgngtaatnataactctctcttctcttgtctacgacganctctccacgcgcctccntctgcgcgagatgnaggtcgccggcttcggctctgatacctacgacgaccacctccactngcgctcacagcactgcgtatgcgatcatgcttctgactactatgagtatgccagccgactccatcacgtcccatctcgtaacatcacacctctcgcgtgcttctcgctcgtcatcacaccgtccgccccgatagttgttgcagccctgcgtccgctcatcactctttactcgaccccggataacttccaccacctgaccgtgtctctgttgtcactctcctagctcttctctcgtcagtttatagttacgnatgatgatgggtcgtgcgcctaactcttgacaccgcattacactcaatcacatctataaacatcatccaccgcgtgtgacgatatatcatatactgcatacgtcacgctgtatcggtcgcgatcacgcgcgatgacttctataccatcatatgacagctacagtggaatgcatatgatatgatacactagagtacgacactagccgactcgccganctacgcgactgacactcgcctacaccacgaacacactctcacagacgacgtctcgcgagtgtctgaatagtcatgatgcgcctgcggcgggtggtcgtagatcacacctcgtcattagagtcacatactgcatntattattgtgatatactcccctctctatatccgatacacgatttcacactacaacccacacaccactacaccacaaaacacatcctgactccctatcttaaatgtaatcatcaacactcccgcgcgcgcatattgctcattctggttacgcagtctgttgcttgtccgcagctaatacgtcatcgcgatcgtctatgactattttatatctgtcg

SEQ ID NO: 10603 - DNA, 179 bp, Homo sapiens
acaggggcccatgtcgcccgattaacacaaatcggtgaactcacccagagtatggttaaaccaaacacaaaattctcaaaaaaccccttgggaaaaaagaccggtttttacctgtatccacctaccttcttcgaaataatattgtagaatcgccagaaaaatgtcgggggtatcccatc

SEQ ID NO: 10604 - DNA, 315 bp, Homo sapiens
tagaggaaagcacagtaaaggttcctgctcaagttttccccatttcctctgcctcctgacaaaccccagtggttgcccatggggcgggggtggtggccatgccttctgtttccagggatctatggagttttgctctgtcgcccaggctggagtgcagtcgtgtgatctcagctcactgcagcctctgcctcctggattcaagtgattctcctcatagtacaagtcaccaatgttagaagggggagggtgttctttatacattaaaaagataaaaacaggatattataaataatttaaaagataaaaaaaaaaaaa

SEQ ID NO: 10605 - DNA, 899 bp, Homo sapiens
  misc_feature (1)...(899): n = A,T,C or G
gtcaggagttcttaattactcaaatgactggagaagagctctttgagatgtggaaggtaataaatcccatggnggcttattggtggaggagggggaggaaaanaaatatttcanctccttaatcaaaacttactangcantctgggggcatcacagctttgcctttgtattttgttggcttatactgggataaaaagttgattgcagaaggacctggggaaacagtattggttacaaaaaaagggggggggggnantgncccttanaaaactttataaatacacanaaaatanacngccntnnaactattccaancccaaaaaaacctttaaancaaaaaaaacatcactcgcanctannccgcatggatncagccacctgagacttgagagcgaaagtgagataaatgtgaggggtgtgtcaagccagacgtttttcacaatggtaaagaaatagatggttgggggtgtgggttttactggggggccgaatattaataagtggtacccaggggaaaaaaaaaagaaaaatggccttctttggcctaacggggggactctgcgggcggttccctttagtagagggtaattctgatccccgttactgacgtcggacactcgggcgtccggtgtgcaagcgggtagtcccgtaagggcggagatctggtttcaaagagccgcgagggccgagaaaaaaaggtaggcagaggccgcaaaggcggcgagcggaaaaagcgcgggtggtggggttttcgtagcgccgcgcgggcgaggaggctaaagtctcgtgatgcgagggggggaccatcggattaaaaagccggggtggcctggagggcgtggggggggggtaggcgtggtggaaggacggcgggtttcgagggggggggttttagggag

SEQ ID NO: 10606 - DNA, 1502 bp, Homo sapiens
  misc_feature (1)...(1502): n = A,T,C or G
agagctcactatgctgtcgangnacgtagtgacacactctggactgattgggtgggagactacgagctggcgcgcaacgtgagaacgagatagcgagatagccatctcgcgagagtgcgatgagatgtgagagtactgtagtagctgntgatatntgacgtagctgagctagtgancgcatcatgtgtgcagtacaggtggacgaaagcgtgtgaaggcgtgagtgggtcgtggtagtgcgagcagttgngcgatatgctgctgtctngtntgactggtgtnatcgccacatgggatcagatagaagcacagagagtgaggtggcgcggagcgctgtgagattgnatgcgtactgtgctgcttgacatataaatggcatgtacgactnatgcgtgtgagggacgtaggtangaanacacgttcgcagtgngacagtgtggcgagcgtagcgatattggacgacgtcgcgtggtgtcgcgagtgactggtcgaagtagacggggtgtgntgcagacgtgggcggtgaggagcgaggatgagcgatgagtaggatgacaggcgcggagacatctcggattaagaatggagagtngngcagcgcacgggagcgaaatagatggcacgtgcggaggagctgngacgcgcgagggagagtggatgangggaacagtgcgtagagacgcgagagagtagtgaggagtacgcgtggcagtgcgatggcgtcgagcgtattagtggtgtcgtgangagtacagtcgttngcgacgtgttgtctagtggacgatgtgggggactgtacgcgtagngagatacatgatgatgacatatagcatgcgttaacactctgtttggtctcttgtcgtctcgctgganggacgacggnagcactcctactgatgcgagcgtcgtnnncctctcggcgctgctgctcggttgttcatctcctactacaaatatggccgtctcctactactcgtaattaattaaatttatttattanatatattaatacatactatgtaataatatatanaacattatcataanacatattaaattagactcatatctatactanaccatgtattcctataanctaaatgtaattaatgtcacgagtaagaccacaatccacagacactaagacaagtgtactactaaatcagttatacgtgctgcnagatcctncgctaggcagtgcagatagttcccaatatctattattcntccgtgcatacaccancgtactgaaaccacaaatacatctacaactatgcantatctnatatacacattacntgactgtcaataaacaacataggtgtatcttaatatctatcngtatgagagctcngcctgtntgcgtcatgggttactctctacactncacnntnnctctttncattacctttnntnctctctctctccttnnctntnnnnnnnccttcttctcttttnnnnnnnnnnnccnnnnnnnnnnnnnnnnnnttcccnnccttttt

SEQ ID NO: 10607 - DNA, 1096 bp, Homo sapiens
  misc_feature (1)...(1096): n = A,T,C or G
ctctcgcacgctccaggtcgacgtgtactcgccattggaacttaagggaccagctaggcgcatagggagccgcgaggggggttcagcggggtgcttatggagactcgatggatacagtgtgacgcggaagtcagtgggcgtaccgtgacgcgtgtccctggttggggtagaaggancccacacggtgtggtcgaggcggagcgaattaatagttcggaagtcatgagggaggagagggggtcgctacttgcaatctcgnataatatagacacctcggtatcaccggtgacgtcagcatctgaaanaacgaaatgtactcttaanacacacaggagcagagaggcactcgtcgggcaccgctgggcgcgtggggatggaatctcgccatcactngaccagtgggaggaggctaaccactcactctcgtgtctcactattctcatctataaagccactagtcaagctcacactgggacacgggagagagcggtacgtcaagacaactagccatgctacataaactcagtggatgtggatataagaccccgggtattcttattaactacagcatagcgatataatgtggacctgttacgcttcggatccgccccaacgtgcgggacggagtgaggtctggcataactcgtatcattaaaccacccgttcggcgtggggcataacaagtaaggtgcaccggtgctgtcatgacgcgcgnaaacacagtattatctctccatggtctcttgtgttctagttcgacgtcattatggtaccatgcatgtgtaatcaatgtgccatcgcggcctcaggaacgttccggtctccatcgtgcctggaatacagcaagtagcgcatatggaggcggttcgaccccgtgacattgaggtacattagtactacaatagcgaacctaatgctctctatcatacctgcacccgtacactcatctagccgactctaacatanacacattactaaaaatagcgtgcggggagagtataaacgtaatagatccacgtgtagacagagcgcacgttcgttgagaagcatgccttgccgggtgagcgaggcgccgccgtagttatattgtacattg

SEQ ID NO: 10608 - DNA, 1141 bp, Homo sapiens
  misc_feature (1)...(1141): n = A,T,C or G
gccgctggcggtgtggctgttctgcgcctcgcgattctgcgtgcgtctggtggctgtgttctccttctttcgtgtcgtcggcgcctcccttcgcttcctgttcttgcgccgcgctttgctcgccctgcgccttgtctccgttctcggtgggcgtcgccgttctatctctctctgccgccttccgctcgcgctcgcccctctcccgcntcccttcactcgcgctccctctctcttggcgccctgcgcgttctcgtcttcccttcgtcgccgtgggcccgcgcttcttttccgtcgctccgccgctcctggcgtttctgctcctctcctgttctttcgcctgtcgtgttcccgttctttcgtctctgtctgtggtgggcgcgctctgtgttggtgctgcgctttctctgtgctcgcgttgtggtattgttctgcctgtttcgcggtgtctgctgctctcctcggcctcctgtttcgtgtgcgcgtttggctggtgtcgtctcggctttggcccgttgtctctctcgcgcttcgctcgccggcttctgtgttgctgcggttcgtgcgtttcggtcgtggtcgtgtttctttttttcggttgtggtggcgtgtttgttcggtgtctgcttcggctgggctgtgtttcgttgtgttggtcgtggtttgcgttgcggctcgccggcctcctcctttcccgtgcgcgttctcgtcgcctcgtgcggctccttcctctcgtgccgttcttctggtcgtctcttcgttctgggctctcgtgtccgtcttctcgttgtcccgcgtgttgctcgccgcgtgggggcgtgtctcntctctcccgcctgctctcgctgcctctccgcctctttctggtgttctgctgttctcgctcttggttggtttttgtttcttcgtgcttttgggtgcgtcgttctctgctcttgcctgttcgccctcgcgccccggcggtgtttgtttctgtcgcgcttctcgcggcgcgggttgtcccggcgcggttgcggtgctttctgtttgttttcttttgtgtctgttctttctctcgttaaacttctgtctcttgttttcccccttaaccctttttttcgccgtttcgtctttcggctgccgtccttcctctctcctctcttcg

SEQ ID NO: 10609 - DNA, 962 bp, Homo sapiens
  misc_feature (1)...(962): n = A,T,C or G
cttcagagaacatctgagacgctctgctgtaatttgcacattgttttgctacctaaatgtcagacacagcacatagaattttcggcctggtgctgtggctcacacctgtaatcccagcactttgggaggcggaggcgggtggatcacgaggtcaggagttcaaaaccagcctgtccaggatggtgaaacgctgtctctactgaaaatacaaaaattggctgggcgtggtggcgggcgcctgtggtctcagctactcgggaggctgaggcaggaattgcttgaatccgggaggcggagggtgcagtgagctgagatcatgccgctgcactccagccctgggcgacagaagcgagacttttgtttccagaagaaacaaacaaacatacaatcaataaatatactacccacacaaaaaagaataaaacacgaaaattaaaattctttttaatagcataaacaacaaaaaaaaatcgtctttccttggcctcaagctgtggagctactgaggcccgtttacctttatatgaaggcntcattaaatgatccctgttctcaatggactcactcgcgctttgcacgtgtcagcattccgaatgcgtgactattcccactcttagcgcggtatttctagtaatctaccgtaattcagcggattcccctagataaatctatctgaacatatgcgcttctaaaggccagaacacgtaaataagtcttctgtcatgacttcttttatttgtcaactacatctgacaaacttacttagattgttcctcactttaaggaggctaacatatcaagaactttataacctatctttctctcctctaactgtctaaccatcttctctcatcatcctccttctttctgatatcacatcactatttactcttgatatctacattataaatagtactcaacagatganacccagatgttccacttatacttgtatgaatatg

SEQ ID NO: 10610 - DNA, 1644 bp, Homo sapiens
  misc_feature (1)...(1644): n = A,T,C or G
atataagtatgtactgtgaatacatncactacttgtcggacctcgtcgttganangagcgtctcacagtgagtacaataaacatagcatatcgacgaggcgcgtcagcactcgtgtatgctctctctctgacgtcttcacttntactatgatcgctgctcacgcgcgtcgcgcatcggttagagagcngggcgatcattatataantgacgtgtatcgatgactacttgtatagtcgttggtggcngattcgtgcggtgancgcctatatcgaagcgtatgcgcattttatagantcgtccgctcgggcgcacgnggcgaggcatagaggnagtgnaacgaccggtgntgggcgctgtcacgtgtccttactatgctgtgtccttgcacgatacatctctcagctcagnactagagtncagngcacagcngagacactgcgtnangnanaaggagcacgaccgcgangagcgacgtganacgcacgctgagtgtaggcgtacgttactatagcgatgcatatgtggcacacnagtcatgnacgatatanttcctgctgcatcatctcgcaccttactattatatgcactgatgtgggatatgtgtgatcggccacttaatgtctagtgtgggttactctcggctcagtatctctaacgtgtatgcgttctatatatactacgtcgtantcgcatcnatcntcgtggcgacgtctcgacngntgacgcgtatgatncctctgngtcgatagggcgatcgagnagtgcacagcggtgcgtgcgtcgtgcgacgccgcagngcgtnaatccgaggtngtgngactgtctggtgcggtgngcctgttacatnagcaatgcgtgtcgctgttcgtgcaggacatcgctgtgggtccacagtataaactatcagacgtaccagcagntgcgacatgatcgatgatggctgttangacgtatgcagcttncagngcgtcactgatancgatgagatatctacnactcgacgtgcagggntgcggtctactcactcgctacattgctgtcggcgacgctactngacngctctacttcgctcctcgacgacnactngatctctcgtagtcgcgcacatggancagcatctacgtgnacagtctagcatgatcagngcgctgctatnagtnatcttgagctatggagctanatgctgctganacgantgagtgacgcagtcgtatcgattaacgattancgncgngatcatgagctgcgnanncagagatcacgtacgctgcgatngtgatcgagctctagtgctattatcagtgagacaanttagtgctctctgcgctgtactactcgctcactatccgtgagctacgtctgcggtcatcctatggngcncnttgtgcgcctgttcgagtngcacatcactatcntgacagcatctgngccgctcatgtgtcgctgcgatgctcttgatcgagatcgatcatcagctacgtgtgacagtaccacacagctactctgtcggagcgagtcagaatcctgcaggctgttattgtntcgtgtatngngatgttgtgatatctgtcgagtngagatcatgagcgtcgtcatggtgaccgtcgtcgtcactatgtctcntaccatctcgtcntatgctc

SEQ ID NO: 10611 - DNA, 448 bp, Homo sapiens
ttttagtgttacgaataaaagcctagttgtttcagaatacgggaaggcagccaataaatgtcaccctctgaaaaacaaatatcatcagaatagagataggatgacattaactgacttctgaggaaataacacattgacgtgatgattgtgtttcagatattttgcagaccttgcacttgatggatcagctggcaccacccagattgataaagtggctcatctgatcttgtggcctttacccaggagcggactcagtgcaagaggacagcttcaacttcccatgacttcatctcctacctaaccaattagcactcctggctcactggcttctctctacccaccaagttgtccataaaaactctctgaatgctcggggatactaatttgaataaaagtaaaactcttgtctcccacaaataaaaaaaaaaaatggcctcgatggcctcac

SEQ ID NO: 10612 - DNA, 151 bp, Homo sapiens
  misc_feature (1)...(151): n = A,T,C or G
ttaggtgactcacaacatgaatgtggccatctgcaagccaaaaagagagcctttaccagaacctgaccattgctggcacccgaatggggggtgatccaacctctanaactatgagaaataaatttctgctgttcaagcaaaaaaaaaaaaa

SEQ ID NO: 10613 - DNA, 918 bp, Homo sapiens
  misc_feature (1)...(918): n = A,T,C or G
aaagaccgggtcttgctatgttgcccaagctggtatggaactcctggcctgaagtgatcctcctgccttgatacttggggtcgggggggtnaatcacacaaaaanttttaaaaattaaccaaatcattttactaaactgcagaatgggaagtagaaacatgtgttaaagtttcttttctaggaatcattgggagttggagagtgaagacaaccatcatgataaaatactcacaggggggggggtgaaatnagatggaaccattaaaaaaaataattttcaaaaatantnaccancgaaattacaaatgtgatgaaaacgagatactaagtagtaggctgtgatccaaattaaaatatgcctacaaagaaaaaaaaaatatgtgaataatgcgtggggggggaaggattaatggaaataaaccaaaatgtttaaactgttgcaggaggaggggggcgagaagaagggaccggacgtacgtgggcgaggggcggcggggggagaggggagggagcagtggagagggggctggggggccgcagagggagaatggctgggggccgttcccttataggagggggaggacaaggagcgtgcgggagaggatgcctgagctcgngcataaggggtgggggagcgggtgtctgttatctagaggggggagtgcggtttggcccgaaagcggggagtcgcgggagaagaaccgggggcgagaggggcgtaggagggccaggacgcgaacaagggcgcgcgcggggggtgtttncgtggggccgccccgctggaagcgcgatgaagggagggggcgaggagcagtggcgagagccgcgaggattggaggggcgggggggtggcgtgagaggccgggcgggctggtgtcggcgcccggcgggagcagaacagtagcgggttcggtgggg

SEQ ID NO: 10614 - DNA, 1559 bp, Homo sapiens
  misc_feature (1)...(1559): n = A,T,C or G
cgatatacgcacgacggcctcagantacgatgngcgctctgngaccgccgactggtggagcgntgtgatatggacggggtacgcgaacgtctgtagcggaagtgtggtgtgcagcggggtgagaactgctctgcgctgtgaggcagtacgtgcatgctcgtagagagagtgagaagcggaggatgtgtgtgatcgatcgcncgtgatgctcgcgccgcagncggtcggaatgagacgtagtaatatganatagacgatactcgaacagaaagcagagcangtcgagcgcgtgagagtgcgagcgctacgnaagcgcacagtcaagnatcacgaatgantctgagagtcgcagcgtgcactagtgtactatcgatgatgggcacagcacgnacgcacatgtagntactcgacgagtcgctgcacatgtggagtatgagcnacacgctgcagcggatagtcgatcagtantngatntagttacgagagacaagncagagcgagcagcggacgagacgttagagcgacgacgacacggagnatgagagaccancggacgaaacgtcgagcatagcgcactacaaagcacacaacgatgagatataggagagtcgatagacgacgcatgtcgagaggtgagacgcagcacggacacacanggacgagnanggagcangtacgancgagtgagagtgatagcatagcgagnnggnnngggnngtagcgtncagaanngcgcgtagcgagtagagcagaacgagtacgcctcagaacacactcgcgagtataaagtactgagcagacaaagatcaagaccatgtgagactagaatagacatggagagagaagcgacaaagattatacaataataacgccgtcgacggtcataagatagtagaaaatgtaggngcagcagngtggtgatgcggcagcacgcccacgagagcgagagagggggatcatagatctcgtcatagagcgatcgaggctcggaagtcgtganggagtagcgtangagcgacgagactagagtgcgtctgacggcgacgatgaggagtacatacgaaagagctgaaaggagaaganacatagacagtcatctacgcggggagcagaaataccgcgaacggcaagcagcgatcggttcacaatatagactcacgaccgaggtacacaagcaagaaaatatagtctcaagagggaccgcgaacaacaagaaccagaagtgtgagaggtgggagacataagataaagaagaattatgacaaaagcgccacagaacgaaggcagcagcgcagaaagcacatgcagcgatcagtgctacgacagctagcagaaccgccggcttccatggtggtcacacgcacgcgcgaggaacacggagcaggacagcgatcgggaggaacgcacgctgcgtggagaccagatgtcggcgcctgcacgctgatgcacaaaaatgcagaagagggcgggagaaaattggggactaaatacattatacggaagcgacaggtgtgcaaactagaaacgagcccgagaccaccgccagtacacattaacat

SEQ ID NO: 10615 - DNA, 994 bp, Homo sapiens
  misc_feature (1)...(994): n = A,T,C or G
accgcgtcttgctgttcctcccgccgtccgcgggccgtgtgtctggcgtcgtgtgattctgtttgcgcgcgtcttttgcctccggtagtgatgcgtcggccgccctctcttctcccctcggcccttgactttctcttctctccctgtgtcatgggttgtctgcgccttttctcttttccactcntcgtccgtgctgcgctcgcgtcgctcgccgttggccgcaccccgctcgcctcggtctgttgtcttataaatacgactgtggttatatgcgccgcctcgctgttggctctactctttccggttcttgctgtgttgttggtctgttgcacgttgtgtctctctatggtgttctctttttgtctccgtcgctccgtctcctcccccctcctgtcgttccttcagcgcgtgctgctagtgctgtcttccgtcgcccgttccttgtctcatcctcttcggtgggggtcttccgcagtgtcgtgtctcgcgctgtgttcctcgcgctgctgttctggctcttcgtcgggagtcggctttgcgtgttggggctgggtggctggcgcgtgccgtgtcgggggttgcgcggggtcccggtgtcggtctgttagttcgtctgctgttgactgtgtgtcgtccgtgctcgcgcttttcgacgcttcatcgctcgccctctcgtcttccgctgccgctcccgcgcgcgctggaaatctctcgtacccgtggtggctcctcccccctgtcgcccgcctccccccgctcgtctctgtcctcctgtctctttgtatttcctcgcctgtgatggtggttaggttgttctcgcgtgccttcgttctgtatttcttttctctctcggccccgcgtcgggcggtcgtgcttttgtaatatgactaaagatacaaaaaaaaaatggcctcgttggctacagcggtggagctgttcgcccgaaagtttttccttttcttttgtttccagtgggtggtggttcgttcgtttt

SEQ ID NO: 10616 - DNA, 958 bp, Homo sapiens
  misc_feature (1)...(958): n = A,T,C or G
aataaaaaagaaaaaaaaaaaaaaaggtcactttacaaaaacaacttctctggcagcctctactaactaaaaatagctcccccttaacaatnannaaacaacnaancgggctnaggggctacaaataaaananactaaaatctnccaatnaccaatganctnaaaaaaaatctcancctcaaataacactncacatccaaattacatcttntttcaccctttcaaacaccaancananaacccananaacacatttcaaattccttactgaggacttnaaaataataatcttttttttaaaaaaaaaccacaaaatnntttttcccttctttcccctaacctaataaccctcttcccccctttccctttaataacgtttaattcaatatcctccttcacttactcccttaccctcataattccacttccacaaacccttataacattactcaaaaccgctaatacccttttccacaaaattaacacataacccctaaaaaacttcttatcaaattccatcataaatccataaccctaaaaattaccctcttactaacttttatacataactacccccccccttaaaaactataaaaaaatcttaccctaattcaaaacacaacacaccccccatcacctaaaatatcacatccttcccccctacaaaattacctacaaacctctactttcctcaacttatatatatacaaacactctacctcttttcactcactaaaaaacccaacttaatttatacattaccctaatctatacatatctcctatcctatccttttactctccattttatctcaacccccccaaactcaactctacacttatcaataatatctcctctcatccacacaacaaaatattaatcctcctcacatctcttccccccatcaaccccaaatataaccccaacacaactcgatccctactaaatactaataacg

SEQ ID NO: 10617 - DNA, 363 bp, Homo sapiens
  misc_feature (1)...(363): n = A,T,C or G
cctagaacccacaggnatatggctggtggagaagagcaccaggcaaaatgtggccagattcctctatgccaagctgagtttctatctccatctcactggggttttgacaagagaaaagcgaaacaatcacttctgatctctaatcctttcctcttactcctgagcctcaacaagagttttcttccttattctacgtggttagaatccatgtcataatttagataaacttaatggcttttttgtataaattctgcagtttacagtcatgcaagcttgtctgatactgctaagtgtccagttgcaagcattccaacaaaatttctcccttaataaagtaaaacttcttcaagaaaaaaaaaaaaa

SEQ ID NO: 10618 - DNA, 137 bp, Homo sapiens
  misc_feature (1)...(137): n = A,T,C or G
tccttgtgttactacaaagggcngctanagaggacgcaacagtgaacaattcccagggaagatcaaaatttgcctttatgatcctgtaaatctgaaattaaaatggtataatgatgacgatgataaaaaaaaaaaaa

SEQ ID NO: 10619 - DNA, 314 bp, Homo sapiens
  misc_feature (1)...(314): n = A,T,C or G
ttacccctcacaacccccccctccgttatccccaccccagaacgccccccgcctctgtgagnactgnagcagnaaccttcgaaggaggcaacanaaagaacgacgaggaaaatcaggatgacatacctggaagaagttccaaaaatgctataaagattgtatagttgaaatcactgtttattcaaaaatgcgccttctgatttcttcagaatctactgaaactttctaaaacctgtctcgaaattgatctcacatttagatacacgctatcaaaataaaccgtttttttactcgcaaacacaaaaaaaaaaaaa

SEQ ID NO: 10620 - DNA, 807 bp, Homo sapiens
  misc_feature (1)...(807): n = A,T,C or G
ggtgggggggggcggggggggggcggggcggagcggcggcaagtctgctgaggtgcgagggtggcgtagggggtttctggcggtgagggggggggcggggggcgagaaggagggtgcctgacgtttagctggtgagctggtctgacacggatataccgggtagaagtgtcgctcgcgcgtgcgtgggcgtgtagtgggcaggtgagcgagaacggcgcggggaagagtggacggngggggggagggcggaggatgagtgagagagaaggaggtggcggggggtagggggcgggccgcgtggtgggtggtggtcggggatccacgactctgggctcttgctgttgccgaggggtgagggggggggggggtgggaggtgtgtgggagggatgtgggacggggcgagggggtggcgttggctccgggacgggggggggtgtgcgggggctggtgccggcgcttggggtgtggggcattgggaaacgacttgcccttcccccctcgatgtgcgactcgcctcgggggggcttggggttggttcgtatccgcgatagtgcgtnacccaaaaacatcttcgttttaaccactctcactactatacacctccttctacacctctttcccttccctctatggcagcactcccagtgtacttaattgcacttacaaagtacattcatcccattctcccatcctaaatggaaaacatcaactttcctgatggtgagtttgtcagagtccattcccaagagtgggggtggggaggtgggggtggagaactgttgtacaggctggatgnactnntaagg

SEQ ID NO: 10621 - DNA, 1055 bp, Homo sapiens
  misc_feature (1)...(1055): n = A,T,C or G
agcgtattaacctctactcttantcgaatgaaaccaccataaaccaatactcangaatagaactactaaacatctagaccaatcatgngccatctgggacctctatagcctcatacggtggatacctngcnnnacaatgtgatctcctgtttgcgctcttctctggtcatcattgagacattgacatctcgcgttcacaatatgcttcgagntgagaggtatactagtggcacttatgctttggtgtggccaacactccgacgacacggacgcaatctggatactccgtttctcccactttatgccccacagaacctctatggtgacacccataaaactggcactcaatcgccagaaccaaaggagacaagacccaccgacggggtgagaccctcttaacgaatgccaaactcaacctaacgcggtcggccgtactcacctctagttctgaccttgttctggcctatcagtatgctcctgtagcaccctcccgtactctctcgttagacctcccgcgtcacacaccctccccggaacgacccaccctatcatgggcttgggaattcataccataccatgcccgagcaattaaaaaaaacctacacaatattctatccagctcaggagagctcaccctctgccacgncagatacctatctatnacctattaaccaataaatcacatccatcaacccctcccctacccacaaacacttnccaacaaccacaccaaacacaaaaaaacgaacaattaactccatgaacttatacctaaccttnccaatttaacaacacaagnnactctaacacaacatgccatcccctcccacttacgagttnncctctctttnntctctcncccccctctccttcccaccccctcctccccctcatntcnctacctccctctcctcccccctaccccncctaccaccncnctncnaannccccctnctaccnnnccttnccactaannnnccnnnnacttncctttaatnctttttnattttaannannaacttanattaaatattcaatataaaaantaaaaattc

SEQ ID NO: 10622 - DNA, 1546 bp, Homo sapiens
  misc_feature (1)...(1546): n = A,T,C or G
gagagagagagagaaggagaaggaagaaggaaaagaaagaaggaggagagagggaagagagaagaagagagatggagagagagagaaggaggagggatgaggaagagggagaggtgagaagctaatgagcggagatggagagagcgagaggaagtgatgaggcgaggagagtagagagaaagatgtgagagacgagaaggaagngagggagagacaangaggagngggagaagaaggnatgagcagataggagtaacggggagcagagagcngaagaaaggtaacagagagtggagaggagagagaacagcgtaagtgttaaagagggtgtgaggtgagagggacggagagggaggagagtaattgaagagagagtgagcgcagagcgagngaagagacngggagcaatcagaaagtgcaacaagnagagaagaaagagacgtagagatgagacgagaatgagagagaggatagagagatgacaaggagcgtggagagagtcgacgatagagantatagnaaaggaagagaggtggagagagtgagagaggagagagaagacgagaaagaggggaggaagcgagacgagagaataagaagagaggagagagagaatgtnagaggatgagaggacgagagagagtggagacgcagataggagagtaatagaaaggggcggaggcgaggcgaanagtagagacgaaggnagatgtaaganaggaagagagangagagagagcgcacgaggagatggagcagatagagagnagagagatgagagagatagagagaganaagacagtaaagagagacagagagatagatgaaggaggaagacaagtatacgcacggaaanggagagagcgaggaggagagagagaggagagacgaggagagagnagagaggagaggagaaggagaagagaagagatgaggaagagacaggagagagagagggaagggaaggaaaaggaaagatgaggaggacaagaaggagaggagtggggagtgaggaanaggagagagaagtggaggagtagagagatgaggaggagagagaagagaaggaatgagagaggagggagagggaggtaggagttatatgggagngacgagaggagagagaggaatggaggggagagaacgacccacaaacagaggaagagggagaggggagggagagcgaagagagaagaagggggagggagagagggagaagaggaagagagaggagcagaggagaaggggaggtgagaggggggaaggagggaggggaggaagaggggggagaggaaggaggaggggagggggaaagggaaggagaggaaggaaaggagagggaagaggggaggttgtttataggaacggaggagaccacaaggaaaagagaaggagggggggagggnagggagaaggagaaaaaagaaggaaaagaaggngaggggaaagaggaggaagaaggagaaaagaggaaagggaggggggagaaggagcggggaggggggggggagggttgacaggaaagaaaaaggagagaataaaaaga

SEQ ID NO: 10623 - DNA, 338 bp, Homo sapiens
ctaggttttacagactgagaaacttggattcatggacatatattaccttggtcaaagccatatgggaaataaaaagaagaggactctggactccacagttgtctcccatataataagaaacaaggactacatggtttctggtggtctacttgcatttgggaaagaaggaccagtaagacagaatggccacagcatttatgaaggacgtgctagggtgatgtaccagaaaccagcagcaaacccacactttctgtcatgtgaacactcatgatccaaaggagaacacagttcattttaaaaaacaaaataaacaactcaaaaattcaaaaaaaaaaaaa

SEQ ID NO: 10624 - DNA, 219 bp, Homo sapiens
tttagtattccatcatctgtcccttttatcaggactatcttctaaggccaaggaacaaaaataaatgagggcagagtattcgggagatgagaagaaaatagctttgccaagttgatctactttgggacagaggatgaggaactacagcccatggaccaaatgtcactctgacccatccattgtttttgtcaataaagttttattggaaaaaaaaaaaaa

SEQ ID NO: 10625 - DNA, 945 bp, Homo sapiens
ttaaccgccggaatacataaaaagacccttcagtaaacaatggactgctgatgaagactctgtccaagacacactgctggctataggccgagttgcatctagggtggggaggtcctgattcctggcctcatccctttctccttttgcatgtgatttacatacaaatatgtatagaaaaccacgacaggttttattctaaaagtactatacttactatgtgggacagactaagattttgtattggtctcttattaataactgagggggggtcgatttaatccattttacagcacaaaaatgatgaaaaatgtggcgcttgttagcacccagcgtgtgaagctcgtgtgcgcgcgacgcattgaggggaggaggaatcaatgatggcctacatatataactacccagggcccggggagtcgatgaggagataccagcgatgatgtgcgccgggagcgcggtttccgcgggatagacggacggtcggtgatgactcgtggctgaggagtgcactacgcgagaagacgcgacgccttcacacattaataacgacgtgaattgcggcaccccccctctctgttaccagtcgtgtttggaccggcactacgatgcgggcgcgcccgctaggtgtgacgaatattcccggcgcccgcatgccctattagaccccgcacccgatcccatagagcgtggaccgagaaccgaatgagcgaaccgagaggtaaccaacctccgtttatcatcgcgagcgggactagagatacgggattcatcgaagtgagagcgcgcgggtcgagtttccggatgactgggggtaagctaacgcacggggaagcgagcgcggcggcgacttgctgagagcaacggaggttgaggaaacgcacgagcgggagatgcgcgtacaaggaatgtgatgggatcgactgtctgttgatgcagttaggactg

SEQ ID NO: 10626 - DNA, 1099 bp, Homo sapiens
  misc_feature (1)...(1099): n = A,T,C or G
ggtagtggcagagggacacaggataaggcacacgcggngcatttattcgaacgttctacctatatactcgatcatcaatnncgcacgttagacatattgcacctctgagtggaatgtaagtgnatctatcgtaggctcggttgacatatcgactgacggctagntactactccaactactcacggacgatcctcatgnccagtcangacgaaacagtggcgtgagatagaatgcagagtagacgatgaatgttatggctagagaagtgatctgagtatacgtggntcatgttcngtatatgtcatagctgaagtctgctgtagacgcggacaggtgtagaagaactatttctgtgtaggccgcagaactcgaagtagtagtaaacgtagtgtcagtataaagtggtatagtagnggacatgtgccacggccgtgctccccgcagagccattatgccaacacggaacgagagagaaagaaatacgaaaaccgtggcccaggcacacactaatctcgtgggagagatgtggctatcgaatacaattatcggnggcatgccctatacgagctttgggtcgtgatcttctggcatgaggcgtgcgagtacatgcgcggcgtatccttagatgggagcgatgaaatggactaataaatatggattttgaagtaaaatgaagaaaggaccctctcgacgtgaactattctctgtctttaaattatttatccttatttctatcttgtttttttactancatacctnnagcacccataaacccaccaccacaacctacctttnacaacttgactcataactcttcctttaactaaatatataaactccggcccggcattcttctgacttatcttgcttgtttcgctttcgctttttttnntttcctccccccacctcttcatccctcttccccttcnctcatctcttataacttccataaaattccacaancatgcgtcctccgtcgcntcaaaaacacgtgtgttagtnnttttcgactcataaatttcgtgaaacttncttttgtaaacattttttcatntaannnnnatatatnattccaaataaattaattattaaaaataaa

SEQ ID NO: 10627 - DNA, 382 bp, Homo sapiens
cttagataaactctccctctgtcactcaggctggagtgcaatggcgtgatctcagctcactgcaacctctgcctcccacgtttaggcgaggtctcctgcctcagcctcctgagtagctgggattacaggcgcacaccaccatgcccggctaatttttgtatttttagtatagatgaggtttcaccatgttgaccaggctggtctcaaactcctgacctcacaagatccaccctccttggcctcccggagtgctgggattacaggcatgagccaccgtgcccagcccaaatctatattcttaactcctaagtaatggttttgggtgatatagtataatacatggcaataataaaaccatctccttgtgcaagtatcaaaaaag

SEQ ID NO: 10628 - DNA, 1176 bp, Homo sapiens
  misc_feature (1)...(1176): n = A,T,C or G
ccccacacacagtaaccacacaagggtccgaggagaacgaagcgtgaanccgcggaaacacacctagtacagaaacgcacgcactgctnactactactgcctgtctatggaggtctatctaacaccatgcaatgggatattacaaaatacccggctggcgggtggcaatagacaatattatctcactgcatcaaaaaacggagacgaaaccgctgccatcttgcagcaacgagtggatgaccctgccacgacacttgggctaagcggaaataacgccaaacactggaaccttctcctagattcgatgttccctcccactggtggttccctgagcggggggtgctgaccttacatgcctgaaatggaaacaaccagtttacgataaggtcctccctggactcgcgggatgtctgcgctacacacacgatacttcgcctcaaggggtgtacctcggacacctacgcgacagtatacgcatttgctcaagtcaacgtgtcgaaccctttgtgcttgacaagaaagagaagacgcagcaacgcccggccccgcgctggccccaaccccgcggggagcccctacagacaccatcatcgctctcacaccccggggtacatgactggatccctctccgcactccacccgcccccgccgcgcggcactcacggcttaccgcgcaaccatcatcgagaccaacgcgacgacggctcacacaccacggcgtcaacncaaagcaggggcggagcgctcggtgccgagcccgtggcgtccccccgcgcacgtgcgcgacctccgccccgaggacagcggcacgcaaccacgcgcgcgcgaaccgaccaacgccccgcccgcatgcgagccggctacgaggatcgtcggttggaagaaggagcgcgacaggagcgaacgagccattccgcaacgaccgcttcaagcaccgctggcgcaagtgtcgacggaacggcacgtgctgtcaacgacgtggcgcgataacgcacgacgcctacgcgatgaaacccggcaccgacacgtgacgacgcgccggcgtcatcgaccgtacgccgccgcagatgcgctgtgactcggcgctctggtgcgctgccagacgacgaggctcagcgcgcgaagcaagcaaacactccgaggacgcaacatgccgcgaccggcacgtcgcgagcg

SEQ ID NO: 10629 - DNA, 1575 bp, Homo sapiens
  misc_feature (1)...(1575): n = A,T,C or G
ctgcccactccccaagacgacaacttaccacgcccacgatgacacggaanngtccacgggtncaaacannanctcgcggaacaancctttcatctggtgacgtaaccgtcgctctccnatngcagctcttatctcaacacccatcgacatcgcgactcctacgcaagagatactgcgccgcaacactatcgtcaatagcgattactcatctgcaggccataacacaaaactactggcaaacctctcgctcattttagccacccatcgcatcggcatagtaaccgtagcctctgaccacctcgtcccctatgacccgaccctcacagcgcgcncccacctcgcacgcactccctactnagcactacgaccgcttccctcaccccacctgatctgttttccccctgacgcccgacctccccccacacttccccatacgtcgagcatngaacgacacccaccggcgcccccgccccctctccggccncgaccacacccccccctctcataccctgacgcacccactcncnntccttacacctccacacgacctcgtcnctgcgcttcagcgtctgccgcacccatcacacgcctcttcggatatgcagactcccacccaccctacgcacncctccacacttcacagacacacaaccacacaaagcgcacaccacacacgctgcgcactgnacgctccacggcgccctcgacgtatnccccctcccccccccccctgccnctcctcgnnntttataatttncacacaannnanaacgcgcgcgnntaccaatcnatcgcgccccacccctcccctactatctnatatctcagtcagtgctcatgatcgatnatccagcgaacgcagtgagcgagcgcgcgtgtccacgntcatatcgccactagactgacnnacactaccatgcacctccacgtctcgccntactcccacgcatctccatgtctgccgccncccgcgcacacganccctcacgtcncnacccnancgcactagccacgtctctgaagtcgcgctcgcagcacgaccncgcnncccnnacacgcgcagcancatcctctgctcctctgacgagatacgtagngagtcgtcctgatgagagacgacantcnntnactctatcgcncacntcaacagacgcgnangatactcgctgcacgancactctggctnccnnnnnncggcgcgncnnnnnnnnnnntnnnnncnnnnncctnacaccnnacctactagagccactntccgctcgcgtctctcnagcgcgtcgcgctatctatcaacgtcactctccacctcacgttactcgctctacagtacccatctccgncgtccnnctcttccccccnctactaactcnccactcgcgagcncccctcacacccagcgnnnnnnnnnatgctgtgtgtgtntattacgctccccannctcnctacccccnncntctantctaccnatnatntaaaactgagcagtngctnacattagtacnancncgatgatgatgatagctatatagatcnnntacgcgatngngncgacgccatgcacaccacgacggcagc

SEQ ID NO: 10630 - DNA, 1410 bp, Homo sapiens
  misc_feature (1)...(1410): n = A,T,C or G
catcgaggacgcgcgagtgataacatgtagtgatgtcgaattacccgtatagcataagnagcgcgacggtgagcgagcgacgtcaatagatcgcgtgatgtacatagtgagatangacgtgtaagagtgtggataacaggtagggcgacatgtngacatacntgagagtgagaagcatacngtatcgcgctgaacgatgtacgtggatgtctagcgggtcgcgctcagagacntataacgctcgtgaatcagatctacaccgagtagaattagtatacntacatgnggactatctactgctcgtgngacactgatcgananctgtgactacggcgtatacgtagcnggagctctcagactacgtgcgtaccgngcatcttatacacatatatctatgacatgtcgacagtgcgatatacgacacngtntatgntanatgagaagcatggtcanacaactcgangctgcgtggatgcgctacagctgngngacagcgtgcgcgctatgcatntacgacgtcttagatcctcgttactatagactctctcagcgctacgtgacaggtgcgctgcgcagtccacatgacgatactaactcgagcgcggtcgtgtacattcggatctgactgatacggcgtgcatcggactatggagcgcgtgagcggatggatgtcatatgttcgtattcatctgtcgtgtagttctgcgtgtcgtcaatcgtagtacgtgttangatataccacattcgtgggtatgctaatactgcgccaagcgatgtcatatgttgagctgctattatcataatcatctgatatagacaagccgcgtagatcgtgngcggtacggatggatctgtgagagttagacacagtgagcgtaatccactgctatgttcatacaggcagtaaactctcgccgaacgcttctggtacctagtgaganagcaccactatagatcataacacgcactgtatgttgggtggctaatgtcacggctacgcaacgtgagcacatggagacgggtagtgcggctgtctctggaatatgaagacatcaaggcttgaatatgaagacacttggtagatataatcagggtgagtcggatagtgcggtgcgtacccatcgcgtactggctcggcgctgtgctgttcagaattattaaagtatctgttgagtgtgcaccaacgccgacagactcgcgggagcttagcgaaagaggcgtttataacacagagacttattattatgatnaggtcgattgcgtactcattgtctccattatcgtgttgtttttgtcattctgaagtctcccgtgagatcgaatatgttcggcgctggtatgtctcaccgaaatatagtcctgcacataatgaaagatgtgtgtgttgggaagtaacgctgatgaaagaca

SEQ ID NO: 10631 - DNA, 790 bp, Homo sapiens
  misc_feature (1)...(790): n = A,T,C or G
cctctgcctgtttcagctggtctgtggagaagcccactggagaggaacagagggaggcctctggccaacagcttctgaggaactgaggtctgtcaacaactacatgagcctttcaattcctgaaataacaagaagagatgtgtagctgtgaagggaggttcaacctctcctggtcttgaatcccttactcaacttccccaggccctgggtatatggtttctccttagggcagacctataagaaagtcaaaatgggtatttcctgcattgtctctccccacaccttcttctcgggaagatctttagaacacaccaatgcgtactcccatttatttagaattcaaatacaatgtccttccagttcaatcatgtgtaaaatggaggtttcctgactgctttcatcggtgagcaacaacaacaccaacaggaagaacagcagaggccacatcagccacaagccaccctgtcatctaatgaatgccaattaagcgcccaacactaccctaggcattntataaacattaatctgacaaatttctcacaatgatcctatggaatangcattagtactctcatttgttggatgagagatccaagtctgacaaagaaaacaggcagcaacacagctgttctgttttctgaatttatcttttaacttgattctcttatcatctatatggatttgaaagcttcttgagaacttattctattttggactgctccatagtacctagcacagaaattatttgggggttttctttacttaatattttatttggacataaaacctt

SEQ ID NO: 10632 - DNA, 120 bp, Homo sapiens
cttagatttaccagcattcacagtcaaggaccgtcacggaccgtcatgatgtcattatttcctggcccctagagaaggatctgtgctaattaaacacatttaatgggaaaaaaaaaaaaa

SEQ ID NO: 10633 - DNA, 1580 bp, Homo sapiens
  misc_feature (1)...(1580): n = A,T,C or G
gagaacggcaagcggcagaggagtacaagaacttctgatagtgtcgcgggtagcgctacgaacatacgatctttcacntagagtcaaagtatcgtcagataaaatattcaactagctggagttaactcacgtacgatagtatacgacacatattcattgcctatnagatgggatacacgtcttcatacatcatagactatggtatacatcctcgcagacgtccactaaagtatntcgtcttctagcgacagatatgaactgtctataagtncgcatgatgcgctaatccgcgacgctactntagcactgaatacgacgtacagtagacatcggacgcactagtcacatgtatgatactacgctactgaagtccacctcgtacgcaatgcttggcagggtgtttatatcagaactaaagtgtcttagatgatatgcgtagtacatctatcgtnagactctatctgacataagatgtaccacgtcttgagtgagagagtgagtttgtagcagaggccattagtgcgcaacttagacgccgatatgcacgtgacatcgagtacgacgtnagatcacgattagggctataagaacatcagcntgcacaagaacgaccggtgtatctcgtgtacatctccngacactaccattcaggatggcgcgtngttctgattagtactgagtgaaagacggtgagatatgacagatggagtcgtgagtgatacagctgcgtatgggaaagactaatatgagaggattcaagaganatgtgtactagtagaggtgagtcntaagngcgcatattcgatcagtagntgtatgagactctatatactgtatcatcangattcagcacaagatatgtatntnatcatagantntgntgncgtcgtntagtacgcgcgagcagtgcgaatatacanatctgtatgantnatatctattatgtcatgagacgtgatgcatacactntgtattacatgctctatacgaagtagtaagatgtagaatatatatcgtaatcatcgtagatgcgtctacacgtccaatcaaanttacaaagtatancgancntanactactatcgnaggncgtatgtatagagagaatcatgcaataatggtgtacagcgatgtcaccgttatatgatctactgattatatcgcgagncaggtgtgtcagtatatattctcantgcgtatacgactggatagtttatagagtcgcgcgtgttcgatatatcgcattgtctggtcgaatgtatatgagtcgtgcataagatctctagtcgacggcgcgatacagtagagcagagttcaagaataatgataacatagaatgaggataccagttagtcgagaacagagtaaattagtattaagcacaggcgcatcgtggagagtcgtntatgatctagtcatcacctacataaatacgctctgtacatacgtaacgttatgtatattattgaatataactagtacattntctgactgcacatactaagatggcatcatcgagcgncgcgagccgcgctctacagtgtaataatcgacgaaataaaatttagtatgatgtattat

SEQ ID NO: 10634 - DNA, 1304 bp, Homo sapiens
  misc_feature (1)...(1304): n = A,T,C or G
gtactgagatctatttcatattnaacatatgggaaatcacagnggcaacatcactgantaacgtaacacttttagaactatgtactactactttgtnacacctatgnncaaattgcggctatgtggatgcgtgacttccggtgggtggcatacatatgagtgattggtggtatgctctaatcaggaattcgatgcgctatctgcgtaaacttagcatgatctctnaatctaactcggaacaagaggactcggacaacgcaatgcggagacgtgattgacgtacacgacgnactcgtgacgatgagtggagcgcgaggcgtgagatacaaaagagnatcgatatggatatgtatagtgagatgaagtaaaagcatacatatagagtaaggcgtgaaacttctggtaatacttanaactagtagacacacaggggnnactcatagcaagactgcacagaactaaacaaagattcaacatagaagatgatagggnagctgacggagtagtagtcntgaagagtagtnnaatctgctncagcatcgcacgtactacgctggcggagggccggtggagcagtcggtgngtggcgtcgtagtgtacagtggtgtggtgacgtggtgtaatgtgagaacatgtcttataatagtangattagcagttaacgacgcggtcantcatgngcactgtacggaatagacgctatgtcctcgcaacagtcagtnacactatncaccatcagataactcatgacaaagtggaggtactgtggaatgaacactgcacacganggatcggacctgcaagtaganacctgaaacacaaatgatatttnaatgtaaaatgtaaccatcatcagtatnnctctctaatgttgaaatagaaaataactgaagaaccataggatagatctcattatgnagctcaatgtgcnctcttnacatactacacaagattactctctacactgtactcacacgnacattgttacactccatcgtgaaatagcagaaggaacgagatgtctaattncacctaatcaatnncctctcttntaactatatttcnctttnctattctacaatataataattactatnactctactattcattatttataatcataanaacannntaacatggcgtctctcctgnnnnaccnaacacggactgggtgcntnnnccttttctcacactcagaataccnnnnnacatancacatcaatattnaatttatnaactattaanannnnanaaaaantnnnatntaaaataaaacatatatttncattataacatataata

SEQ ID NO: 10635 - DNA, 351 bp, Homo sapiens
  misc_feature (1)...(351): n = A,T,C or G
atacaatcttactcttnttgcccctgcgggagtgngatgggcccatctctgctcactgcagcctctgcctcccnanttcaggggtggggggngggtanctaaccaaananctnnnactacanncgcccnccactacgcccgggtaatttttgggttttcgggaaagacaggggtttnctatgttgggcagggcagggctcnaattcctgagcttctgggacctngcctcttcanccttggggggggggnganattacangggggannctnccaaaaacaaccctaattcaatatttntgtggggacattcaaatgggaataaaaggtctacaaggcttaaaaaaaaaaaaa

SEQ ID NO: 10636 - DNA, 1748 bp, Homo sapiens
  misc_feature (1)...(1748): n = A,T,C or G
gccgcgagaggcgtacacgagaaggtnagcagccgacagtttggnctgtgagcaggcctgagcgcaggaangaannngttccttantgatggtnnnnaactnngnacaccgcgcngcnccgccttttnacngnnaggngnnnnntaaccnanacnngngnncgnnancncgnaggcncacnnnagcggccccnggggggnggacagcgatctttcgnanaggaganaggcagagagagcagagaacgcctcgagcnagcacanccgnacaaggacacacgacganagcagacgcncaaggacgacagagcacacacacgnacacanacnagagcncgcgacacacgagnagagacgcacgcgcgcagggcgcgagcgaagcagaggcggcgaacgcaagccaccacgacgcattccnagcgncncgagcgcgggcgcgcnggcgccgcgcncaagagacacgaaagcagaagangcaccaccncgagaacgcacagaagcagggcagcacaggagcagaggtgttttgcctcnctntntntcagcgnagcngaanangagaagacaccagcagaagagacgagaccaacgaaacacgcacanacgcagcgggacgaagcgcgcacaacaaaggcaagcgcanacagaaccgacacaacagagcgacgacgcgagagacgggcgnangcacaccgaaaccacagcaaacgaccggcgcacgcgagncgggnnccncnngagacggacgccggcgagccgaggncgccgcggagagcacanacgagcgnaaggcacngagcggcacnagcgcgcagcacgaacacagagacagcnncnncnaccagagncacncgcacanccagcacgcgagggnagacgaacgangacacncgacgcgngcgcacgaccaacgcncnacacgagnaacacaccacaganagccangncgagcaggcaagaagcgcagtagacgccaagcgcngncngcagcagcgcagaggagnaggccngcgcagnagancacacacannngcagaccagcccngcgcccgcaccacangnacgcgcgcacgacagacnacangcgaacagcgccgacncagcgcgcnagcaacggcacgacangacgacgnnaacacanagnacanacancaanancncngcagacgcagacnacangnagagcgcacacggcaagcgaggnangngaggaaggcacacnanaacgcagncacacacacgcaccgccagncgagnagaacagacacagngacggacgaccggcgcacacacgagcgacgcacgcacgngnaccgaacacaaacacngagcaagacggagcgagagncggacgngncnncaccacnagacggcagcagggcacgagacgaagacgccngaganagcacccacaggacgacngcacngcgcacgangngncgagagaagacacgcagcgacgcacnacnacgcacagnaagcgagnnacacaacgcgcggcananannaccccaccagngnancacacaacnacacagacgncaaagcagccnacacanacngcgcacacgcacgancaccgcgagacgagcagcacccgaccgncgaacgagcacacagcgacacgagncagcacggagacggccggacgccngccgncggcgcgcncgccacngcgcgcgcgcacgcgncccgcgcgcagaccgcgcacgcgccgcgcgcgcgcgcgcgcggcacgcncngacggna

SEQ ID NO: 10637 - DNA, 1628 bp, Homo sapiens
  misc_feature (1)...(1628): n = A,T,C or G
actgtgcccatcgacgcgcgcgcacgcgctcagcgcgcatctccagcgccactcacgcgccgcttctgncgcatacgcgggccacgcatcccgctgagggtgtctcgagcgcgccctccatactatctaactgantgcggactcggcgtgtgtctcgaggatgactccatgacactcgcctatgcgtcttgctgtagnactaggtgcgcagcggcgcgttacagggagtatagtcgtgtgttcagctcnacgcgctgctcgnggatcgcagctagctccctncacgctctntagcgcgcaacctntgtcactacgtctcgncgtgactcantccgcatcgcgcgacactacacgacgtacgatcgagngaccacactcgtcacttcacacgctctactncgtcgtatcatcctacncggccngctggcagcgctcgtttctgcagcagtcactnaccgtagaggnngacgagacggcgactcgcgtgtngcagtcatgtangagtgcggactgtgtgactgcgtgcagagtgtgcgacgacgnatgacgaccgcgagntcgcgcgcgcgacgtccgcgcgcgtcggcgtnacgactngagtacgctcgtgctccncggtgtcgtctctgcgaggatctcacgatctatancgcgcgacgagggacgcctcgccgctcggacggcggcgnacattcgcanccattcgctngctcctcacgtggtgcgtacgtacgtcgctatntctanncgcgatgctcnggtgngnacacgtctgaggagagctgagggtgttgtgtggctgaggagggaggcgctcgctaatgtgnactagcggtcggagtggggcctgcgtcnttcttccgctgctgcgnggctcactgcgntcgcacgcgaccccctcccgcgctcgcgcgcgccggccnnccctcggtcctcgctggacnccgtcgcctccgcgtgcctcgcacgtcgactccttcnctgtctccacctccgtgangcgcccgctcaccctcgctcgtgnacgcgtcgnggactgncgtgtncgccacctgtgtcaggtcgtatntttcttctatctctctatcttgtttgtataataaaatactcttactaccacgtgctntaatatacaactcataacancgaataactatcaccataatctatnctcgaaatcaaacaaacacaacgtctcatcactctactccttcttcaccncccgcacatccttganctgaaaccctccgtctaataangtgtacgtttgccctctctcgcgatatgtccacaattcaggtccgcgccagcgcctcttgtgtnactctctcctgtctttctttgttttcctcttctctcttctcattttcttccnacncctcgcttacctccctctaactatctaaaccacnntttaatatnctccactacccttctactccttntnnctncacctntcctccccnctctatcctattntttcgtggtttctctattctctttaaccttnnttttttnnttcgggtttnnccccntnaaaaggtttattatattttttcttcatctttttcttactctcttctcctcccctnnnnntnttctnnnntccncnnnnncntccccccttt

SEQ ID NO: 10638 - DNA, 500 bp, Homo sapiens
cctggggctacgctctgtcgtcctaatggaatgcaatggtgcaaacatggctcactgcagctttgacctcctaggctcaagcagtcctccttaccaagcatcagcctaccaagcagctgggaccacaggtggtgctaaaatgcaaagcgacggcaatctgcaacacataaataaaaccatcttctgactttctgaagaaacaggactgggaggataccatctttcgactgttatctatcaatcaccatgtataccaaaatttcatttaaggttaagaattttgccccagtgaacagaaacataacaaagaacacacacttcatgtaaatatgcaacataacaactagttttcagcatttttaacattgttaagacagaataccaaatatgcaaagtgagaatgcattttcatttactacttgagacatgaggtttacttcaaattgcttatcatatgttcagtctcataataaaaatttatctctataaaaaaaaaaaaa

SEQ ID NO: 10639 - DNA, 2288 bp, Homo sapiens
  misc_feature (1)...(2288): n = A,T,C or G
attgaganaggagtagtcatggtaaggtnctattannggtatagtctgagtgattcnncganatnagcnanattatnctnnttgtagcatnntnngantncnggatagctgtgattacaggagantanatgacagtcagttcnatgagtgatngctgacgtntaccgtacatcagcacgncngcangcgtagtangtangcgtaacgtacngngtagtcgtcgtaccggntntactagtactgacatgactgctttacntagactcatcttagntcgntcngcngcagactacngaagtganntctcggatganaggtngggatcgtactgctgcntcntnatcgncatcanagcntacctgcgacgacgntgaacannaaagattacgatatgntgaactgatgcatcngangtacnnttctactcaacgatgtacgcatgctgatagtacgantatcgtaagcantnangtagatgactagtgatcatcnacgtgagcatcatagcacgantactngcactgtgatgtcattgantgatcagacgcntgtcgtncgacgtgaccgtgatcattgctntgcgatgagctctagcgatttantngacanacgcgtancagcgatncatcantantgtaacnacctccatactatcanatactacntctgcatcactncttcccacttcncatcgtntagtcntatgtatntacatgattangtnacacngacagaactgcantacgctgcgatgatcatgtactagctaatataactacgtcngtctanataatgagntgagtacagtcgcaatacagcntcnacantngcagtcagtagtnagcagtagctgttgagantttggagantagttgactanatcgcacgcatctcgatacgctgtcgntncacgacntgatttntcncnncgcgtccgngtcgtactgngtcgtcgcagctnccacacactcancanactcggacatcactncantnagtatacttgatactgncgtcgatgnantagtgcatcgtcatgtcgctgtgagangactngacgtgcatncaacgtctcaccgtagtgcgctgagtcatataagacgacactcagatagacagnatatacgtcagaatgatgagatcatatattacatgtatatgtagcatatgtgcgtntgagtgacgcagttgnctantactacgtgtgctgcgtagacgagctcgatcgatacgatgcacatactcgacactataccgcgcgacgtctatcagacgagaccgacgtcatatactctcgcgtactcgtatgtataagagacggtgtgtcagatgcgggcgtagtatagacagacgcgtgagcagatgagagcgagtgatagaatctgagtacgatcatgatgtcgactgatctatgattacanagacatcnatccgaaagcacacgcagctatcccncacagcntactcntcacngagcgacgcagatcntatgacgcatgtgcagaacacactcaacatgagtacgtcggttgcgngtgatgganacatcataccgatncngacgtcgcgcggctctgctcaggcngctagngtcganggtgtatatctgacgtgatngtangtagtatatgacgtgcagngntatgccntactagtctnttattatgctgtgtctctatacacacgcatncntcatacatctcgnctgtactttcantgagattcgtcgntancncatatcgtccagcttgttagtgacgatgatnaacattgagnattattagcgcttgtagtgagtgacgcgncgagcntaggcatcncgagtgnaacatgtcgtgacgcttnctcagcgagtggcgatagctagtcgcttnggtctgactactgatnctagnagagtntcacacacgagctctacttactacttgcagtctatacatgatgtgttgtcgtgcgtgtcgtgtacctgtcttcgtgctatcgantcgagagtcatntagcgacctgtccgantgcgcgatantgactgttcagcgtgaatcncacgtcagcacacancagcgctgcgttcctacgtgctctagtacgctgtgtgcatgtagataacgaccacagatctatctgtctcatctgccgctgcggcagcgataacagctgtnttgctctgctctgcacgataatcagagctacagcngagctgctcctcacgacttagatagctgnanctgcagcatgtagctgaggatgagtgtcgattggtatacgtaagagcattgaactgatctacc

SEQ ID NO: 10640 - DNA, 1177 bp, Homo sapiens
  misc_feature (1)...(1177): n = A,T,C or G
cgtcgtcggttctgtgtgtcgtcttgcttcctctctgtgggtctgtgctctgtgggtgtctgtgtgcgtgcgcgcgggcgcccggctctgngtccggcgtttgccgtttgtgtgtgctgtgggcgggtccttttcgtgttgtggtggggtctttttctgcttcttttgttccttcctgcgtcttcgtctgtcttgtccggtctgtctcntctctggggtgtctggcgcggtcctcgtccgctggtgtgctgtcttgttggggtgtggcgcgtggctcctcgtntttgttggctttgttcgtcgctcgcctctccgcgctcctctactcgttcgtctcgtcgctgccgtgttttgtgtcctcgtgctggcgggcgcgcgtcttgttctgctccgctcgtccgcgtcgtcggctcgcgggtggtctctgtcgtttttcgtcggtgcgcgtcctcgtgctccgcgccgttggggtgggtgttgtactccggtgctgcgtctgcgtgtggcgtgtcgcgcgtatggcttctgtgctcgttggcgctcctgttggctttgtggcttctgctgtggtgtctggtgggtgtgcggggtttgttgtttgtctgggtcgtgcttgttgcgggtttttgtggggcgtgggtggtcttcctcttttcgtcgtgtctatgttgtgtgggggggctgtgtgtcggtttcggttgtgccgtgtgtttctcgtttgtgttggtgtgcgggtgttgtgtggttttggggggcgcgcgtcttcgttgctggctgctgggtttcgtctgcggctggcgtcgcggcggtggcgtcctgcgtctgtcctctttcttttgtgggggcgtctctttcctctgtcgtgtgttggtcgcgcgttctgcgcgtcttgcttggctgcttggtgggcgggcgcggttgtttgtccgctctgtcctgccctcctgtgcggtggggtgttggttcttctctttcttgtctttgttcctgcgtgttgcgggttctcgcgttttgcgtgtctttcgttcttcttttcggcgtcgtcttcttgcggcttgggtccttgctcgcgcttacaagcgggtggttgcttgtttccccccccgagggcttttttccttcggtcgtcgtgttctctgtgttgggcgccgtctggttcttgtttcgtggctgtgcg

SEQ ID NO: 10641 - DNA, 194 bp, Homo sapiens
gttttgtggagactccagaagctacctgacacgcggtaacattccgattgaatgcggaaggagatatgacaacctcaacgtcctctattaagccatacattaaaaggacttgtaagatgtaaaataatgcccttcttttcactgaattcttttgtcttgaaaaaatataattatttcctataaaaaaaaaaaaa

SEQ ID NO: 10642 - DNA, 254 bp, Homo sapiens
ccctgataaaacatctcaagctttgtatttggggatgaccaccctcagtttttgatactcatctataattcaaccaagttggagaaaaaatttcccagaacacaagtatctgtcctaagtttgatgcaaattatcagtaaagtataacggagtctaccattgtattgggtacatgagaaacaaataaatcttttattttactcatgagaaaaagatgaaaataaactttacagcaccttgcaaaaaaaaaaaaa

SEQ ID NO: 10643 - DNA, 445 bp, Homo sapiens
cctagcttcctgtctactgtgcatgtgtggttttgatttcaactgaagaagtgacattctgacttggaattccaccagatgaagggaaagcattgtgagaaaattcagagaaaatcaaaccagcgctggattcagacacaactggctgtgaattctggctctgccacgtcatagttgtatagccctagatagatttactaaatcacttcgagttacaaattcctcatcagtaaaatttcagtaaaaatacttaccttgagtgttcttatgaggattagagttaatatatgcaaagcaccgtgcatcagctctctatcaagggtggtataaatcacttgatgtttaaagaatctctgaaagtaaaagcttctgaatgtggaacagattcaaataacaagtgaaaataaaagcagccagcatcaggcccagcccaaaaaaaaaaaaa

SEQ ID NO: 10644 - DNA, 124 bp, Homo sapiens
tcttctggggtcctcatttgggaacaaactgatcaaaagcgttccctgggtttggcatgactggactgagcttgcgcacataaagatcatcctttacaatgttaaaaaaacaaaaaaaaaaaaa

SEQ ID NO: 10645 - DNA, 154 bp, Homo sapiens
cctagtgggaaccctctaacataactctgagctggaacctcagaagtaggaagaaagaaaaagatgtcttctctcttatcctgcacactcacgttctacttcaaagtgaaaagggaatgcagagcacaaggttccatcttgaaaaaaaaaaaaa

SEQ ID NO: 10646 - DNA, 311 bp, Homo sapiens
cctagatttgaacccctccaggtaatttctacaaaatgggaaagcaaaaagcagaagaaaaatcttaagtccacaacagctccattcacatgtggcaaatcctgctggctcctgatttcacaggaagatcaaacaccatttttcatgcataagagacagactgaaaattccccacagcaagaaattcagatgctaagctgatgcgtggttgaaccaattgcacaaggaaattttattatgtcaacatgtccagtcaaaaataatgtgctagaaggtaataaataaagtttacaaggtcaaaaaaaaaaaaa

SEQ ID NO: 10647 - DNA, 243 bp, Homo sapiens
  misc_feature (1)...(243): n = A,T,C or G
tggagccgcccgcccaccatcctcttggaggagtgaagggaggctttgtagcgacnccaccccacctcgagtgcgaaccgccaggggaagacaggcccagggaagaaacaaaacaacaaaaaccaccggacgacccccacagaagaaggcnccgacncccccaggaacacccccaccaccgcaaagaaagaaaacgccagcgggggcaagaaccaccccccacaacccagaaaaaaaaaaaaa

SEQ ID NO: 10648 - DNA, 2257 bp, Homo sapiens
  misc_feature (1)...(2257): n = A,T,C or G
ctgatactctgcatcgtgatncgancncagangtcagacgcgaagacntcggtactcgagccgactgtcacgttagngatcgagacgtgantaggncagtagcatantnanacgtgctggatcgcgagcgtancngagancgacagcgtcgtgctatcaatgctcagtgcactctgangttgcgagagcacacatagactgagcagctctcgcagcagagcagcgcatgagtgcgngtcatgcgtacgcgccctcgtannaagttgtgatagtctgagactcncnacatacgactggagccagtctncgntgncatatctgtagtacgatananntnangancgacgctcgcgctatgcgactatcgagagacgtgacngcgtgatactgctacgcaccagntcggacacatagactcgcatcgacactacgactagnagatgatacgagcagngcagtcacgcagnagcgacgcacgatgacganngngtctatcgatnagagagagntgngctncncgtgcgtgtcacacgatctgctgtcantactctatgncgtgatgcngncgacgtcgagcgcgctngcaggcgntgtagacgtcgtgcgagntgagnananngtagtgtagcgngncgatcgcgtcgtagatgcgtgatcggaagtacgctacgtgancacgtagagtcgaagtgacgactgncgtcanatactagtagtatcttaacgcatcatgatagngtgngtcgcagcagcgtcgcgcagtngcggcnatcgtgtcagcgtngcntcgatnngctgncttanggcactangntagncatacgngtgatgtcgatacgaaaggtgcgctgacgggcatcatntgcnggcagtgtagtanagcngtagnatcgtagagacatcgtnagtcngcnggtanggatnggagcngcgngcntgnatcgtagancgtncagcagctagcactgcagctacagacagncgncgctgcgaacggcgagnctactngctcagcgacanacgcngacgatgcgtcagcgcgtacgtgnctnanngcagncgaccgcntgtgtcgtagcnacntcggnggctgtcgngtgacgtcatcgtcagcatggcngtnngtnngntgngtacgacgtagagcagcgtactgtcnngcgtaggtactgcngtctgctngtctnntngntcggctacnactgtcnatcagctngtcgcntcgtgtncngctnnccnccntcngcntgntactcgcactactggcgtctcctgntcctcggtactcatgcncngtnagngcnantcgtacgcgagtnacagtcacgctngcancgcgtcggtncatcncgcngctgtctatcgantacntatgactcgtcntgctgaagngcatgtacggagntactcacacntancnctanncagcaccgtccgcnctnactnacngactancctatctacactactnntcnccacatcnantcacacanctanctcatncncatcntnataactantatactnatactacttcacnacaaaactacctnncccactacctacnctcatcacannccatactatctaataatatactatannnnnatcantnatncgatgcttanctncaatagtctactgtgnctgtactgcatntctacctatcatngctncaanntgatnactacnaantacgtgactcatnatanncagttatnatactacnacaacttatactatcantntnctnanacaatncganntgatacngtnatcatatacnancattatnncnaactnatctaactacattcattcntacattntacctcactnntcntacacnnctcnncntcacacaatccattannntncatcaatcatcattcnctcatctcatnncntactnctnncactnctcactactctnttntanncttcntatcatatnnntnnccctcttcnctccatcactattntnnacccacttancntntncttntntntttcacntnncntcgcncagctgctgnntnttctcnnntcntacaaaaactnnnttnccttnnctnnnctcnnacntnnntggtnnncntnatctcntnnnctaaaggnntnnnnctntnnnanntnnntnntntcntnnctntcntcntctntccnntnntnacctttcctccttctttctcatntntnntnnntnncncttnctnntnnnncnctnnnnnncnnncccnncccccctccctttttt

SEQ ID NO: 10649 - DNA, 119 bp, Homo sapiens
tgttgggtgtgtttcaagagagtctattaactaagagagttattcagattgtggaaatagaatgcccaatataaatacataaaagtctcttataagttcatgacttaaaaaaaaaaaaa

SEQ ID NO: 10650 - DNA, 289 bp, Homo sapiens
cttagtattacacccaatgatgtcatcagagacccagttctttccatttctcagtttggacatgcccatggttgccttcatcttcaagcagaaagtgaggtggttacaacagtttccaaaatcgaactgacaccaattaataccctgaagaagaatgaagctgtcttcttttccccgctaaaaaacagtcaaggctctcctcccatgtcatttgtcctaactggctaacatttgtcattccctgagtcaatcatagacaaataaaatggagataccaaaaaaaaaaaaa

SEQ ID NO: 10651 - DNA, 271 bp, Homo sapiens
cttagagcacacctccaagaaagtttgcttgctttcaaaattccaagagacgtctgcccctcaacacccctcattctaccatcagagaaggtgaagccagactcatgtcatcactcacccgatgtcatgctgacaacagacccaagccaggacacgcccactgtcacctacaaaagttgagccagcacacctacacacatggcttcatctcacccaactttttctttttaataaaatagaattgatgcaaaatgtttcaaaaaaaaaaaaa

SEQ ID NO: 10652 - DNA, 1580 bp, Homo sapiens
  misc_feature (1)...(1580): n = A,T,C or G
aaaaaaaaangggannngnanntnnnnnnnnnnnnannnnnnnnaaaggnngnaaanggaagtattaannagaaggagannaagagatgatnannnnnaaaagaannttttctttanangannnaaatnatannnnanaaaataaaagttgtaantacgaatagtnacnataaataaaaaaataagaancangtgncaanaacaaataagagagaatgatataagagaaaanataataantancggtnacgntganagngagtaggacataagaganccacaggnaagcacaccagacgaagaggtacgtcccgtgcgagtacgcctactccgcgcggnagcgtagtgacccgccacgtcgccacaacccgacacgacgcagccaccgcaacaacgccgcacccgcgaccgacgagccgacaccgcgcacatcgaccacagcgccgacacgacgcactacagtatgaggaatagtgtatgggcagcgagtaaaggaancaagtagagaggtaaaccntcgaagataaggttagtagagtaataaatataaataaaaatgagacatagttgcggcagcgggacatgagacggtacgcgcagcgcggatgagccagcgatgcggcgaccggcattaagaagcacgacgaanagaaaaacaccacgagaccgacaactaaataccaatcancgagacggtaaaatacgagaagctatacattnccacgttcaccgcgcccatcgcccccactctatcgcacaccgctgcacccacgcacaccacgcgccgaccgtcacccgcggatcagatgctaccagtgcgattcttacactctatacagttattcaccgcatgtattaagatacgccatcgcacagtcgtagtcgacgtgggcaacggatgacaggacgtcgtaccgagaagccgacctgatatacagaagagaggcatgcgtaagacgcatcgctaccacgagaatagaccaactagaggagatagggagagtatcaagagggcaggatagagcgagcaggcagcagagagagataggattatgagctatgtagtgagntgtgaagaactatcagacatgagagggaaggagtgagcatagatgacagagagagatataatcaaaaatagaaacactaatatcacatccaacatgcacatgcaaccctgtcgacaggtagcagcgcgacgtgctagccgncaccacagnatcgangtcatgngacagagcgagtagcgncngatcgtcgcgtacatagtgaagaggaagatgagatanagagtgcgaccgacacgaccgcgatcagcaagactcaacacagcagatncgtcaatctcacacgtcgacgaatntacagcgacagatcgctcacgtatcacgtaacgtgacgtgaagagacacagagagtaatacgacaccacacggcgcccgaccgcgggaggcgtacgtcgaagctctctatacagcagcgtctggtggatgcagctcaagtaagactacgcgcactcagagacacagaacacgcaagatcatcccgactctcagcaacgccgatggaagtgagtcacg

SEQ ID NO: 10653 - DNA, 257 bp, Homo sapiens
  misc_feature (1)...(257): n = A,T,C or G
tctttcgttacgnaggtcctgacctctgtgccctaacgcactccagcctgggcaacagaagaagaccctgtataaaaagcaaaaaaaaaaaacccattgaggtccagctaagtgtatggatatcaaagcaaaaataattgatttcaaacagctgcccttacctgttaacccattgtgttattcaagtcttcttcaagcctctgcttttacagcaattgtggccaatgttacctgaatttaggctaaaaaaaaaaaaa

SEQ ID NO: 10654 - DNA, 741 bp, Homo sapiens
  misc_feature (1)...(741): n = A,T,C or G
ttagacggagtcttgctctgttgtccagcactggactgcaatggcacggtctcggctcactgcaacctccgcctcccggattggagcaattctcctgcctcagcctccggagtagctgggattacaggcgcccaccacgtttggctaatttttgtatttatagtagagacagggtttcaccatgttggtcaggctggtctcgaactcctgacctcgtgatactcccacctcagcctctcgaagtgctgggattacaggcatgagccaccacacccagccagcttttcttttaatgtacacttttttttttaatagactttattttttaaagcagtttttgggttcacagtaatatttagaggaggaagcccatatacctcctgtccccaaacatgcatagactccccagttatcaaggtctcccacaagagtgatacatttgttacaactgataaatgtacactcacacatcaatatcacttaaagtccatagtttaatatttaaatcattaaatgtgtacattanactttaaaggtgtacattaaagcttagggtacacatttcttttcctgcatacccaactgggaattctatttctcagcatctagtaagtttgtgaagaaagttgtgtccatgggtttatttaaatgaaacactgcactgatgtcacttagataaatgacaatacttggcctatttgggtgtcttcataaacaactactttaccaaaaaaaaaaaaa

SEQ ID NO: 10655 - DNA, 743 bp, Homo sapiens
agggctgtgctgtgcatgtgggacatttagcagcacccctgtctctattcaccagatgtattagcaccccctattcctaattatgacaaacaaatatgtctccagacattgccaaatatgccctggggggataaactgcccctggttgagaccatcccaacccaaagcctgagcccctaataaacaaggacaggcattagttttcaacacttcacaagggcctattgtaggctgaactatgtctctctaaaattcgcatattgaagccctaaacctcagtggttcagaatgggaatgtttatagaggtaggatctttatgtaggctgaactatgtctccctaaaattcacatattgaagccctaaccctcagtggctcagaatgggaatgtatacagagatagactctttaaagaggtgagttaaaattagctcattagggtgagctgtattccaacctgactggtgtccctataagaagaggaaattcagacacacaaagagataccagggttgcatacacccagaggaaagcctacgtgaggacacagcgagaagacagacagctgcaagctgaggaaagaggcctcagaagaaaccagctctgctgacaccttgacattgggcttccagcttgcagaactgtgagaaaagtcctgtcgttgaagccacaagtctgtgatattttattatgatctccctagcaaactaatacaagtccccgaaagccaaaaaaaaaaaaaa

SEQ ID NO: 10656 - DNA, 996 bp, Homo sapiens
  misc_feature (1)...(996): n = A,T,C or G
tcctgttaaaaataaaaaaaancaaactttagaggactcttgctctgtttcccagcactggactgcaatggcacggtctcggctcactgcaacctccgcctcccggatgtgaagcaattctcctgcctcagcctccggagtagctgggattacaggcgcccaccacgtttggctaatttttgtatttatagtagagacagggtttcaccatgttggtcaggctggtctcgaactcctgacctcgtgatactcccacctcatcctctcgaagtgctgggattacaggcatgagccaccacacccagccagcttttcttttaatgtacacttttttttttaatagactttattttttaaagcagttttttgggttcccagtaatatttacaggaggaagcccatatacctcctgtgcccaacatgcatagactccccatatttcaaggacttccacataagtgattcattcggttacaactggtaaatggtcacttaaaactctaatatccactcacgagctcatagtgtgattatgtcaaggaatcagatgtgttcgctcgaacctttatagtgagatgattaagagggtacgggtgcaattcttcttccctgtgtacacaacctggcaattccttacgcccaatcgataattaggttctgcgaacgaatcggtgatcactgggtgtaaataagagtgaaaccgtcgccttgacactcgacttagatcaaaatacaattcgtatgcctcatcagtggtccgcgtctgtacggcctctagcttgtctcaagatatagattaattatggacttattgtctttaacagatgaacgtccttgaccctattacttgtgtgaagggatagggagtagatccgctctatagactcagtgacctcgcgccgcaccattgatcgtccgtatagatccactcatagttgagtcttgtcttgattattacttggtctcttctgagtttctgtggtatactgatgcgct

SEQ ID NO: 10657 - DNA, 1312 bp, Homo sapiens
  misc_feature (1)...(1312): n = A,T,C or G
atgtgatgtgatangttatagacgatctacgctngttatatgaacnancatacgaccgtcagatccctgtngcaccacgcgacgcgtgctctctagangnccggcgcttgaggcagtgcagatgagaccctatccggnagcgctcatgggagcgactggggagcgagatgttagaaagccagaacgcgcctccgctcctcctacaccgaccatccgtggtgnatcacattacatatngacattcgcttgccgctctatgatatacaaggggacagtgttggtnacctcagggcgcggcaccctcgctgacgaagatctgagaaacagggagatacatcggtgaaacactgctactgncgtctactagcccaccgcctactctacaaccccggaccactacaggaacactcccaggagcttctagtgagcgatgtataaggagatacggtgagaggaaacgtctactccactgtgggggtacataaagaaacacgatgggtaccgacacttccttccactccaccgtcactcggtcccgctcgcacaaaccttcatancacctagagccccgccactacgcctgacctccctcggcactcagcgaagacatataactacagggtagagacgctcgaagtctgactaatcatgtgatgcggtcgttcactcaagcgagatacagtgcaggccccttggcgatctcgccgtgtagtacagcacgctctcgggccttcgagagacacgcgatgcgcaatggagttctgaacaccgagatcgactcgactcagcggaagaccagtaacataattatagacgcagcgaggtgggcactacaccgcgacgctcggcgcgccgctcacgccgggagatacggaacagcagagagatatgcgacgtggcagtgatgaatagtgtgtgnagtaaattgataggactataaggagtacgacgtcgggagattgtgtaggtgtctgcgacgggcacgagtcttgctctctagactccgagcggctgtggtccgcgtcgacgggtgatagatcacgttatggctccggagacgatcacacgcgacaggacatcgtataactccgcacgacacgtgcagcacacactgagactcgagaaccacacgggagagcgcgggtgacgatcagctgactgagggcgcgcagacggactgctgcatcgccgctaccacacacatagaacctgggtcgtgaatcacgaagagcgcggacgatgagggtgaggcgacgacaccggagattccggggcgtgggcagcagggcgcatgtaataagtgtgtggattg

SEQ ID NO: 10658 - DNA, 1853 bp, Homo sapiens
  misc_feature (1)...(1853): n = A,T,C or G
ctgcnctgctcgcttattgacgtctctatgcaactatctgtgntatctatcnactgtgcatggtctcacagatcgtatactngacgatacactgtgctcagtccacatgaatatncntgctcatagtatngatgccatcagatccgnagtatctactgatgantatanacngtntnatcgnaggtagtgtgngtcactgcgactgtcgcgtacatctcgacgcagtgtgangnactactgngntagttctacgtagacacgatatgaccantagtangtntcactttatgatcatcactgcccacntgcttacttatgagcanantgacanctgtatacggtcgtgtatctnncgtccgctcacgcnatctctatatnagtgtacgatgatctatctacgctcgnggcgctccgcgcgccgcgtcgtgctatacgtcanatatatcgatcgatntgctgcntgctcaccgccggcctcctctgtnctnactcagacatcntangnatantctctgtcaatnctcacgtccacggcgtcacnattatacncattcgcgtcggcggcggcggtcgagtactacgntctgcgtcgtcgccgtctgatctctatatcactcatctcngcgcgacgtacgtcgtataatagtattgatctccgctcagtgtgctcacgcagactctgcatacacatgttgcgtcgctcttcaaactctccgcgccagtggtgatncgtctgtaacatcattactgcgccgagcgctatctatagcatgcgtacctgcgccgaatatcgactaatcatcatatactcgcgtgtcaactcgaggtgttgaactctacaancgttgtgttacgcagcttggcnacgtcatataacganagccactgcagtcggtaggctcgtcagcgctcgcgtggtggatgtggcaggactagagattggagcattcggtcagcacctagtaactgcntccggtgtatgtaattgcatattgcactctaaggattagtccgtgttagcctantggcgagatctgaatggtntacgagtgcgctggtccgccgatcgtcagtggctgcgcgtacgcacggtcgtagatgcgtgtaactgcggtacnagtcttcactggtgcgcacacgcgtgctcgtatgtatcactatacctcatgtacgcataatgtanactacgcgtgnctntcgtcggtgcgngtcactatctcgatgatactcatgacactcanancgncgaccttagtcgatcgtgctataggctgtggtccgtngtgtgagnanaaatctaagcagatagctgatcatagctcgtgtgagttggttagtctataggaattaatgcagactacgttcgntgcagcgtaacatcagatactacaccgttctnaagctggtctctctcgcgtatgatngangagactgcgtanagtcactgcgtgacagcgtcactctncagtctacgtcgcgactccgcnattacgtgcntntcgactggctcntatgccgtcgtcncgcatcaaatnttangtacgtacctcagnatctntatcgagctttgtagtcagcgacgtatagnatatgagagacgaacagtacactatcagtangatatgatctgtcgggcctacttgtctngtgctcgttngncntataaaacgaacgnntctgtcgtctgcnggcatngnntnantgctttgtccacgtctctgctgtngaagnggcgtcgtcatcattatgctnctgctgncnngtcgctgcgtncagtcatgncntctgtcgcagcagcagncgactcctgactgctcgacgtcaccggtcatgatacgtgactgcgtctcgat

SEQ ID NO: 10659 - DNA, 1052 bp, Homo sapiens
  misc_feature (1)...(1052): n = A,T,C or G
caccatttacatcctacccaaacnactgcttgggtaacaccccccggaccttacaggggatactatctgcgnatcngcccttctccttgggatactatttataaagaaagtgatcattgtctacgttgaaagcatctgccgtatagaaacgttatccatgaccggaaagattctgtttcatctctcagattacttcattgttcagtggccggctctgaaagaaaagtatcccaaatcggtgtaccttgggcgaattgtttttcaaatggcaactgacctctttagaacgttgcagctaacagtgagatgtcctcaaatgggggggaaaaaaaccctccatgtttcttgtaaaggccgttcgacagcccgtgggaattctctgcccggcaagggacaaaaccctgtccacaccgactcaggtgaaagaactcgaggcctttttttatgaaaccaacacattgatcacacgcccaccccttaaacggttagcgcttgctgagagccacacttactttgtctgagaaaaacaaaaccacctccacccccttgccaaaacacaaaaaaaagtgcgcctctactgcgctctatacgggtgaagcgttcggcggagccatctccacctcgtgcggcgggcaaactgtctcgctccctcagcccatcgacttcgcctgccgcccgcaacggacccggatangtgcgcgccacgcatcccacgcaccctaagcaccggacaatcccggcaactcccacatgtccacgcgcacaacgccccgatactatatggtgatcaacacgagcctgtctcatgtgcccgcgccctcaccgccgaccgagcgactgagtgcttcatcgctangctcccgtcacccgtgcggcacctccaatgcgcacgcccccgactgagcggacgcgcgaaacagccgccactgttaaacccctacgagctgctcactggagcgaacctcacaccatacttctacacaccgcgcgcctccggcacgcgaccccgtttccccttcagaccgagacgatacatacaacacacttgagat

SEQ ID NO: 10660 - DNA, 1757 bp, Homo sapiens
  misc_feature (1)...(1757): n = A,T,C or G
aaatgagagatgagtgcgcagcgtatgtctaagcgcgctcgcgatgctnggganctcatcgtatgttgcagtntcgactcntatcgtcgacgtccaactacccatcacgaggcnagccgatagcacgagcganctaactcgccgcacgtgactgtncgcatcatgcatcgaggctacgcccgtcgctatcttnngncgctgatctcggagtaactccntgtcngtgtagcagtatcagctctcgatnagatagacatgatgtgtngcanatagatcgtcgtgcgagtgctgagtgtgagtcgcgtgtgcagagtatgagcgctacgcaactactgtgacacncagcagcacacttcacagcngcatgtcgctncgcctcnggctgctgcgcgagnngtgacacagtgcgtgcagggtgtgcgatgttgganctcgatgcgtggcgcngcacacgtcgcctgagtggcgcacgcggtgtattctctatctctcgtcacgtgctctgtggtgcttgtgtcgntgtatnttatatgtatcttgctgctcgctcgcnnnnncnataccagtccacncnctctcgcgttntncgcctccacncgcggcagactcgcggttgagacagacatacgcagagatcgacgacggcgtntagaacattcgctctagcancgtctctctcccgagtntctctcctctatntatangcacgagagcgcgggagcgagatgtgtgtacgatgtcctcagtagtagtcgaaagtgnggctgcgcgtcgtcgctgcagactacgacggnagactctacanacangagcaacgatggcatgatgcggcgctcgactcgtgagcgcagcgtcggtgcggntgcctagcagangctctttctgtgggagacgtgtcgacctcgtccacnacatcatcacgcgctcacactggtatatacagtttcgcacacatacgatattgtagatacagcntcttagatgcgatacagctnccactcgcgccgcgacaactacgtgtctactgacactccactatgtcnccatgtagagatagctgatacgagagncgtatgtggtaccagcgcggcgcagcgtaaggtggcgctacgtacgtagtncgntacagcgctatgtganttcatcctgcacancacgcntgctctggcgtccatntnaacagncgccccatgctcgacgcgctcgacgttanncagactatctctacgcagcgcgcgaacatcgctgcacagacaccgtgtacactcacacttagtacgctcatgtagaagagtgtcctcatctagtagtataatccgtcactctacttcatatncacaacctggtctcgcctcatacatgcaatctcaatgantacccacacttgtgctctatgaacctgatacacttgcacgacactggtcacttgcgcttcggtccgttgcgcaggtcttcagtccgcactggatgggcgcacgagtagccagcactgtggacatactganagcgactcgtgcaccctcacgtggtgctcaaacgagtggcagatgctcgtcatacctctgtactctgtagatgccatctcggcgcttcacctctcttntacgacttantatacatatctctccttcgtggagtgtgcntacatactgcgacgatacgtgcgcgaggcgcaggggcgaggngcgcaacgtcgagcaccgcggcccagnccgaggcggcgcggtgcagagtgcgacagcgtcgctagacgcgta

SEQ ID NO: 10661 - DNA, 1145 bp, Homo sapiens
cttcttcgtttcgtttcattccgctctattttgcggtgttccgctgttcttgctccggtctccttgttggtggtccgtgtcctagtcgcttgtgccgtccggcgtcgccggtccgcgctctttcctgtcctctgggcgttatctctctttattcttcgtgtcttccgtttcgttctctcgtcgcgatcttgcccgcttctccttcttccctgcggcgccccctcgccttccttgtttcgtgtcccggccgcgcccgcctctcttgtcctacgcccccctcttctcggaccttcgctctggccgcggtttccggctgccggttcgcccgctccgcctgttctctctcggcgcgcgccccttcctgctcctcttccccgctcttctgcggtctgccgggtgtttctgtactcgttctccgtcgcgatgttgtcttctccgccccggctcgtcctccgcggtcctgttgcctcagctctctgtctcgggcggcggtctcttgtccctcttgccggccctcactcctcccggccctatgcccttctttcgctctccttttcgtatgcgtgcggtcttcgcggggggtcttgcgggcgcgcgtcggggcgtggctgggttgccgcatcccgtggtgcggtgtcgcttctgtctccctcgcgttctctccgttccctgctcacgcgccccggctttctttcgctgccctatggctcgcatgcgcccttctccttggtcctccgctcgcgttccctccccgcatctctcgccgctctcgtctcctccacccttcccgtgcatggctctcgcgtcccggtccgcgtgcgcgcgtcgtctgtcccggtctctgttcgcttggcgtcctgtcgctctctggtcggtcctcggcgagggtagcctgcactgtggggtcgcgtggccgtttctcgcgcctgtcctcgcgctgtgtgtgtgtttcttttctctttttaatcggttttgttgtttgtcggttcctcgtgggctggcttctcttttgttgctcctttcttcgtatggccttcctgcggtcgtcgtccctctccaacctcgtcccccgtggttttccgctaaagttcttcctccggtgtctcgtccgttggctgtcgcctcctgtgctttcccgcatcttg

SEQ ID NO: 10662 - DNA, 1367 bp, Homo sapiens
  misc_feature (1)...(1367): n = A,T,C or G
atagctgctaggcgtgcgatagtccggcgtctcntcgatcgtgtcctccancggcgtcggcgcttgcgctcgtcgggatctgctgctccgcgctcggngcgcggcgggctcgcgcggttgctgtccgctcgctgctgaggcgcgtggtgcngngcgctggtggtttggtgcagtgcgcgttgtgtcgctgctcgcgcggcgcgtggtcgtgncggtgcgtgtgtcgcgtngcgcgtaangcatgtacatgcgctgcggtctgtggtcggtgggcgtgcgtggggtgcgcggtntcngcgggtgtgtcgcgttctgtgtactgaggcgctcgcgcctcgctcgcnntctgtcgcgtngagtgtgccgctgagcgcgcggntgcgggcggcggtgtgtggcgtcggtacggcgttggcgctgcggctggggcggagccgtcgtgttggtgatgcgtcgtttgccggcgcttgcgtgttcgccgtcggctgctcctgcgggcgtccgcgtgcctgtggcgcgcgcgtgcggccgcgagcggcgcgctcgcggcggctgcgcgcgctcgccgtcctgtgccgcggcctcccgtctttcgctgcgctgacgtcctgcgccgggcctatgctctgcgcggggcgcggtctcggcgcgcggcggcgctgccgtcgctcngggcggtgcggaccgggccgcggncgccgtggggcggcgccggggtgtggcgccgccggcggcccgcccgtcgccgctggggcgcgtgcgggcggtntcgccttgtggctcctccccggcgctctcgctcggggggcggcggctcggtgctgcggcgtgtctcccgcgtctgcccgcccgcgcccccccctccctcgccccgccgcgcgtgcgggtagccgccgggggcctcgggtgggtcccgccgcctctgaccctctgccgctgccnntcccctcttccctctcttctcaaacgtttcttttctcccncccttcctccccttctccctccctccgccccccctcccctgcctcttctcccgcctcttnnccctccgtcccttcctccgctcgtttnctcttcttctcctccctttcgccncttttccgctcccccttctccttccctctctccctctccttctctctctccctctttttcttttctctccctctccctccctcccctctcncctctcctccaaaccttccctctcctnccccctctctcttccctcccctctcntctgttcttccccccctngaggttttcttttnttcttgtttccccnaaaagggnnctctttttctctctctcccctctcccccnctcctanncttncccncctcctttccctctctctccttccctcc

SEQ ID NO: 10663 - DNA, 941 bp, Homo sapiens
ttagaggaactcttgctctgttgtcccacactggactgcatggcacggactcggatcactgcatcctgcagcctcccggattggagcaattctcctgcctcagcctccggagtagttgggattacaggcgcccaccacgtttggctaatttttgtatttatagtagagacagggtttcaccatgttggtcaggctggtctcgaactcctgacctcgtgatactcccacctcatcctctcgaagtgctgggattacaggcatgagccaccacacccagccagcttttcttttaatgtacacttttgttttcaatagactatattttttaaagcagttcttgggttcacagtaatatttataggaggaagcccatatacctcctgtccccaaacatgcatagactccccagttgtcacgggctcccacaagagcgatacatggcgtacgactgataaatgtgccctcgcacatcagtatcacttaaagcccatagtctattatttaatccttaaatgggtacatcaaacttacaagcggccatcaaagcttaacggccacaatttttcccttgcatccccaactgcaattctatttctcagaactaagaaagttcgaaataaaactgggttgcatgtggtaacttaagtaagcgcctggtcctggtgtacacctagaaccaatacaaaattcgtgtggttattttggggggtcttcatcaaacaacatacttaccaagacagaaaaaaaacgagccctccgttgactaacagtgggagatttgagtacatccactttaggagagttataggtcaccccttactcaagattcagtgcctggcatctagtctgtgaggcgcgacccttctcctcgcgcgttgacgagctccacaaaaaggcgattttaggtcaccatgggcgattgccgtaatgcgctaaccgaa

SEQ ID NO: 10664 - DNA, 1384 bp, Homo sapiens
  misc_feature (1)...(1384): n = A,T,C or G
atctgcgagtggtggtgtcgtgagtctctcgtatgtggaggtcgtcgagcgtgagngctcgtcncgcttcagtgtctcattgncngcgacgcgctggacgcctccttgngtagtngagctgcgctctggtgcctgtctgttggtagccacgtctgtgggggctgtcgtgagtgatttggggtggaggcgtctgatgangtcttgtctctactcttctgtctttcatcttttgcgggccatctccgcgtttnaccctctgcgtacgagggctctcgcgtcggctgttgtctatggatcgtctccgttctctgtatnacgtgatactgatggcgcgctctaggtgtcgatggggcgaggtgttgtgggtgctcgtcgtggtattcttaggtgntttctgtgtgcgctctttccatgntgccgtggtgttggcggtgtgcgtggccggccttcagcgtcgtgtggcgtgccatcaacgcggctcttgctccggctgcctcttgtgttcggctttcgtcngtcttcttttcaactctctctagcgccgttgctgcgagacgctcaatactcatggaggtgtctctctcgtctacgttggtcatgtagtcgctattgtaccttcactctctagcgcggctggaggcgcggcgtgactggtggtgtctggttggtgagtcgtatctgtctgtattagtccgttccggaagtgggtcggccgacgtgcgagcgccctgctactggacgcgctgccttgtgactctctgggcacgtgtcggcgtcgccgtatggnccgctagtgcgcgcctggaganactttgacgcccagatgggtacgatggcacgcacgcatggagtctgtttagttagttgtctttgtgtgtctctgctgtctcgcgtgtggtcgcttcttgaggcctctgtcggcggcttctggtgtcgtctacttcacttatcggagttttttcgtgtgtgccttgtgccggctcgtgactttcttggggtactatcgtaccgcattctgtgtcttacagtgactgtttcgtggcgtgtttgtttctctctcgagtctcctcgggtgcgtgtgagttgcttggtgcctgatgtgcgtgaggcctggtgggctgattggtgcatcggcttgtgtgcggtcgcgggngcgtgtggggctggcggtatgcgctctgtgtacttactgtggtcgctctgtggggctttgtcgaattcgtccagtcgtgtctgctgtgtggggttgtacttgttgttattctactagccgacggctggggctgtgtataatgcgtggtcgtggacgtcgtgtgtgtgcgttggtattcgggggtgctctcgccgtcgtggtgcggtgcgctggtgggtattatgagtgttt

SEQ ID NO: 10665 - DNA, 1204 bp, Homo sapiens
  misc_feature (1)...(1204): n = A,T,C or G
atgtcgccttgcgtcctaatctcgatactttcatgtagttacctcgtcgtcatactcattaaacctaaccggtatgtggggagtttcttatgtttatttcttgcgcgccgctcggtgggtcagctctctgaagtgtggctttagagactttgtaataccacctgtcctgcgatcttcgcatcacaagttcgtctcctgttccttcctacctntgcgttctgttgcctgtgtatgggcggcgcggggtagggacgttcgtcttcttactattcgtctcgcgctttcttnaactgtccgtaatccttcaagcgtttggattgctatattcttcgccgaggtcgttagttacaggtctgagttatatacttttctttgttcctttcacattcgtctctgtttcgcgtttagccggatgtgtttgaggagtctctcgagcttgagatatctatcaggttgctcgctgttcttcgagtggcactctatatgtatacgttctaacaataatgtccacacgtccatactaattttactaattttattatccgtataagggtgttctgtcgtgatactatacggatcgttattcgggatggcgcacatattcaagaaacgatgtggagcgggcgaggacatgaagaggtggcgacaacgaggtctttgcttagtgtagagagaatcagttgcgaggatagtatgtgtatctctctgcaatattgattgatagatctgtggatgacgacgcttgtaaacgtgtatgatgtgtgtctgcgggcgcttgttagatatcaccgttgctagtcgtctcgctgtaatcgcgagcgggaatctgcgtttgtttatttcgaggcgaatgcgtatgtacacaggatttcgtagtatactcggacacgcatgtgtgcttgctcgattgtcgtattcattgtagctagatggttgtgcgccgcctagttctgctggtatggtcgcaatgttacgcatctaaaatggtcacattctactcgtgttctgtcagtttgtgttttgccggtccaatgacaagactcatcgattgctcttagcctaacaataataataagaaatnaatatgcgctcttcgttggcnttcaaagctggtggagtcttgttgcgccctcgaggcttttttttctgtttgcatggttttgaggtattggtgtcaactgactaatactgaatgcgtacctgc

SEQ ID NO: 10666 - DNA, 963 bp, Homo sapiens
actcacatcacacaaccaaaaaagccgacggcctcgatgagggactaagactacccagcctcgtactcagggaacgtgcccaggaagaaacagggagacagccattgcatgaggcctgcacaggccatcctgaccacaatactctgcctttccacgataccctccctccattgcccacgaaggcggccagagagagctagcgctggattaagacgggcttaaggtgatatgaaggctaatagcctgccgcgtcacacctaggtcgctctctcttgcttacagccgaacccgggggtcatgaagcgcctcgaccatcaccgctggtaaacaggccgcatcaacacccaggatcgtcggcctagcttaacagcggcccggaacatcggacggacatcagtgtaggattcccagaccacgtatcctgttccaactatctatagaataacgcagaaattacgccgccacgtcaccacagacgcccggctatcaacgcgccgccccgcattgctctgatgccccccctccagaacgccgggccgcccacgaatcccgaaatcccctgcacagcgcccgacaaccgaccgcccccggagtccccccgacgcatcaagcaaagcacttccacacggcccccacaccaccgataagccgaactcagacacagacaccacgcccaatacacatgaagggagggaagaaccgagcgccacccccgtaggacttcgtcacccaaacacaacaagcccggctccagctcgctgagacaacagcatccgacgctctgaaagcagcacaccatacccagacaacataccgcagacctcaagcagacgaattcacgggacgtgcacggcgaaagaacggcactgactatctgagcaccgtatacacacgcccgcacccggcacgtatgtgaaactagtgcgaacacatcctgagcgagagtacggctagcttctgaat

SEQ ID NO: 10667 - DNA, 1336 bp, Homo sapiens
  misc_feature (1)...(1336): n = A,T,C or G
cttatggtcggcgtgtgagaagcgtgatgtgngcgcgtgtggagatatccactatactcgtgagctgggtgtcgcgatgtcctntgtcgcgctacggttcgngntgcgtgtgtgtagctttgttctatggcgnacaccgaggagagtatgtagtgtgcgccattcgcgcgngagatatgagtangatgagtatgagtgcgatagcggaaacaggtgtgagnggcttgtgagaataactaaatcgctcggtggaacaatgagcgngnacacgtngntgcgatacagctgtatngcggaggcgaggtgggatggcactctgatctagggagtatctgcatccaaacttgtganacatatagtcttatctatgtgtgcacgctttcttctccgcttaanncattctgtagtgccctgtgtaagtctattatggctagcgatgggaatcaactgtgggaaggcgcgacaagactcgcataactctatatcgagccatccactgtgagcagggaggngcatgtgactgatgcgaccggcgcgcgagatgaggcagcagcgtgtcgtgtctctggagtgacgctgtattatggatgtcagtggagaaactatgggtgggtgtcggttgtgggatgcgttctcttcgtctattgtatgttgtatgccttatgcgcaatatatcactgtgaacctatgtagttgattatgtgaacgattgatctagggatgcagcgatgagcactagcattnacatgtctangttccatattagcttcgcaatatgtcttcctctctatntgtcttctgttgcgtttatacatattcatgatgcggagcggcggcgtaccactgggatgctgggcgaggagctagtaggcgttattgataatatgtgtgtttctggtgaaaatgatagtgaatcaggcagtactgaagtataatcgaaggcactgcttatctcactgcgattctaatcttggcagacggacaatcatcatagaacacctgcactgtacgtctcagggtngcgcgtactcatcgctagtngctacgtggatgttgatgatattgtagatcgcttgagtcgcgacgtgtggtgcgagggtcgcttagatttagctatcgtataccgtcatcatatagataatctcgagacattgtagtctctagatgtgacaataggaacgatctggtgacataattaatattctcttcatacacaatatacatgcgtggggtangtgtacgttgctatgtgtgacgactatgtggcgagtaccgagggcgtgaactgaacatgcgggctcgcgtagtgaccagagagatagcgagttaatatata

SEQ ID NO: 10668 - DNA, 1446 bp, Homo sapiens
  misc_feature (1)...(1446): n = A,T,C or G
cgtcggcgcgtgtgttgtgtgtngggcgcggcttgcgccgtgctgtcgtctgtctcttcgctgatggtccgttctggttgtgcgtctgcgtgtgcttcgtgtctgtctcttctcgtcttgtcggtctctcgtgtcctctcgacggcggtgcggcgctgcctgctcctgtcgcggcggtcggcgggctgtgtcgtgtgtntgctttgtggttgctctgcgcgtcggcgttccctctacggtgtcttctgccgtctcttctgcgacggcgcgcggtgcggtgctgcgtacgccgtggtnggtctctcgtgtgcggcgcgtgcgggcgcgcggcgactcgctcctctggtcgtctctctctctcctggcgcgtnggaggcgcgtcctcgtcgtcctccgcttcttctctactcgccctcatctctcgccttgtctctcgcgcgtgtgtcgcggctggtggtcgacgtctgcgccgcgtgcatcgttgtcatgctgctgctcggttgtgtgcggcgttgccactctgncgtctgcttgcgctcgctctcgctcgcgngtctcactccgctgcgtcgcggtcagtcgtgttccggcgctgtcggtggtctcnatggtctgcgccttgttgtgcgctctgcnccttcttcgtatcgccgcgtgtgtggtgttctgggtctgtggagggtctctctctattcttccgtctgcgtggtgtgcgttcctgtgtgnctgcttgtcgcgggtgtgtgcgcgcctctttgttgcgggtcgtgtgttgtcggtgcggcgcgtcttcgcgtgcgctgtngcgctcggngtgccgcgctcgcttcngttctgcgttcgacctgccgtttgagttgctgtgctggcgcgcgcgtccgagcgagcgtgcgagctgcgcctccgtgcgcttgtcggcgtcggcgacgctgcgcgtgtgcgtctgttgatctcgtgtctcgcgcgtctctcggcgcgtccctgtggcgtctgtcggcggctcgctctcgggtgtgaggggcgccggtcggttgngctcggggtgcctcgtcgctgttctgtngtctctccgtcgcgccgtgtcgcgttgcgctgtgtcgcgggtcgctctctgccgcggctgtttcttccgctgtcgtgggtctgtctggcgntgttcttcttgctgtcgtgtgtgtgtcggcgctgctntggtggcgtcgtgtcctcgcttttcgtttgttcgctctcctttcgttcggtgcgtcggtggctgcccgctggtggtgtcggtcgtgctcgggtgtcctcttgtctttttcgtcgtgtggtgtgcgtttctgtcgcgtcgctaaaanncngggtgtctcgttntgtctccgccctgctgacggtgttctgtgcgttcgttcctatctcccctggggtggtgtgcgcttgttgtccgtgctgcgtgctgcgtcctct

SEQ ID NO: 10669 - DNA, 1502 bp, Homo sapiens
  misc_feature (1)...(1502): n = A,T,C or G
attgttgttgctggggtgcttgtggtgcggtgcgtcatctgcgcctccgctcggtgcgtggtcggtcgtcgtgtgcttcgtcttgccgcgtccgtgcgggtgttctcgtctggctatggtctcatacgcaccggcgtgtgcgtttcctctgacgctcctccgtgtcggtcttgtgcgcgcgctgcctcgtctttntcttccttttcggtgcctgctctcgtcgncctcggcggccgtgtgttgggtgtctacgtctgctctctgngtcgcgctgtccctgtcgtctcgcgcgtccgcttcgtcgcttcggtctcgcgtgtctgctagctgtctgctcgttgccggactncgtatcgctcgctgtngcttctctgtctncncgctcgcgctcctgttgctcgtgctctgtgtttgctcgcgtatgtcgtgtctctcgttgtgtctgtcggacctgcgtgccaccgtacgttgactacgtctcgtctcgtgcntgngtggctggcccgcgcgctcgtgctgnggtctgtgtnccgtggcgctgccggttccgntngtgctctccgctctcntcctccttcttctgnctctctctctcggnttctgtgccgtgctgccgcgtcctcctcctcggntcgttctgcgcgtcgcgctgtgctggtgcacgctttcgtgcgacggcgcgcggnctcgcggcagctgaggcgggtctgtggtgngcgnttctctgtnttgtgtgagtcgtctctcttgtgcgacgtctgtgcgtntgtcntcatctcgcgtggcgtgtcgccgtcgcgtcgtgagtggcgcgtcggcgcgcgctcagctcgccgtcgcgctgacgcctgcgcacaggcgcgcgcgcacttcgtctgttggtcggggctcttcgcggttcgttctcctacagtcgctctgttatcgtctcgcgtgtcgtcgcgatgtctctcgttgtgcgcgcggcttcgtgtgcgtgcctttgttttgtcctctnttctttgtgtgttcttgttagtctcgtcgtttgtggtattagttgtgtggtttgcttggtgctttctgttcttcctctctcacgnttctctcccgcttccctgctgctgtaggcctctctccgccgcgctccctcntcttcgtctcgttcggtctccttgcgtttgtctgtgtgttcgcttcttgtgcgttcgcttccttcgtgtggccttcgttcttttgctggtcgctctttgccggtcttttttcttgttntctctctctttccctcctccttctcttccttcttttttccttctcttnntttctttanccccttcnnncttttcnctnccttnctcnccctgctcttttnttctttggttttcctttcncttttgaggnntttcttttttttnntgttttctcttttaagaggntnttnttntttntctctttctcttctctctcttcctcncctctcctnttttnnctttcttttnnttnttttcnttctttcctttttt

SEQ ID NO: 10670 - DNA, 1517 bp, Homo sapiens
  misc_feature (1)...(1517): n = A,T,C or G
gtctcctagtaactcacctcagacccaccaaccaacagagagaccaacagntcaccccttcatagtgatcgtgcacctngnnacncgctatngagngagtcttgttagnnagtngatngaatntcccacacacgtngcaatcatctacgaccaatgntaccaatgaactgcacgcgctagtcagcgtcgcacacatctatccaagagacgtaatgcaatcaccctcgcagctaacgcacgccgttattgtactctgtctcacacactcccatcgaaatcttcgtcacaccatcagtgagcgtgcactnacgcattacgctcgcnctcctctcacactacacatataccacacgcgtacgacgcgcatctcgtctcactctctatataccaaacacatatatgganatatatatcgatctcacacagagancgacacactcatagagtctancncncactctatatacnagagacgnctacacacattagatatgtcantcccagtatacgcacctgactcacgtctaaccactctgagtntgtcacgcgacgcgctcgatcgctgcgccaccgtactccnctccacttacctacgactacatcacacgcgtagctcgctatataccgtcgcactctatgcatcacctgactacactccgccatccgcccacgaccatctctctactacacatcctntcccncacagcggcggcgtcntacnacctctcctccgcgtagtatcgcgtcacctctaccctctgcttgtctctatatctcgtccgtcacccactgcgatccactctctctcacaccctacctctcgcatactttccgcgtccacaccttcgtcttctatcctatctctctcccncacttcattcctacctcccacactcctcacctcactccctcacccactcaccatcccncgcttacctcgactctccctcaccgctgcaccctcacaccgcgcgcatattctccactctccacctctcaccgctctccatgctcacacactcctacccantactactcccacacctcctcacccactcctaaccccacacccgcatacatatatatcacaccgcacccacgcaccgctatcctcctcacgttatccactcantctcttgtccatgtaccctacgcacacctccgcccctcttatgctcctctgcctccgctcgtcttcgtcactttgccaccccccgtcattccccacaatactactctcctctcacaccctcttccccctcccccatcacgctaatccccaccaactccccgcttctcgcatctcaacctcttccacaccttccacgccacacctcctctggctccctcgccaccataccaattaccctccaccctcatctccctatcactactacccactacatctcctactaaccataacctcacagcccaccgccccatccatctacccccgcccaccctacctaatacctcctctctccttacatcccacactcctagcacccctatccact

SEQ ID NO: 10671 - DNA, 878 bp, Homo sapiens
agactcttgctcggcctctctccgcttccgcctccccagtatagcttgctgcgctgggcgcgcgacggacccggcttgcgtgcttccgctccgtgtgctggcccgtgttctcgccttccggcgcgtcgggctatagtgcggtcgctggtacgcattgcgtcgatcacggcgctcctcgtaccaccactcccgctctcgttcaacccggggcagatcttgctctatatctgttggcgttcggtgttttcgttgtgtggtttggtcgctgtgccgtttccccctctcgttgagtgtcccggtatgtgctgtgcgtggcctagtgtcttcgccttagttctaccgcgccgcctggtgcgcggcggttctttattttttgcctgttcgagatccgtgtccttgcggtccgtcgccggggtggttgtgtgcggtctggtgcctggtgcgggcgggtctcctggtctgtatgcgccataccggcctcgtgcggcgctccgcgtagtattgtttgttcggcggctccagcggcggggacgcggcggtgcggggttcgggctctggatactctctcgcgcaaccgtctaccgtctgtctgcctcatgggtgcttttgcgcctctggggtgcgcggatcacgttcggggggcgagtttgcggtccgctgcggtgggtgaccgcggtgtgctctttgtgctgcgcttggtcgtttcccttgtcgggagcccggcgccccagaaaaaaaacggttcccgggcctgttgtcgcgtgaggggggcttggaccgtgcccttccgcttgactccgtacgccttaggcgttctgcgggtttcggttatatctggtttagagtgttcaattcacctctgcgtcgatatacgaatc

SEQ ID NO: 10672 - DNA, 1112 bp, Homo sapiens
  misc_feature (1)...(1112): n = A,T,C or G
cttgtgcttctttttctttgcgttgggtgttgtgttggttctgcggcgctgcgcgtcgttcccgcctcctcctgcgctccgcccgtcgcgccttccgtctgttgccccccgtgccgtctccttgttctctcctgggcctggcccgctcgcgcttcncctttgtgggtcnctcctntcccttccctcctcctgtcgttcttctgtgttctccgtccccgcccgcccgccggcgtttttcgcgcgttgctgtgccgcccccggctgtgcgggcgncgttgccgtctcgctcttcgcccgtcttccgctccncccctcctcttgcctccttgcgcggcgctccttccttttcccgctggggcgctgtcccgcctcgcttcgccctctctctcttcgcggcgcggtctcccgtctcgcggtggtccggcctcccgttccttcgctgtgctcgtccgtctcgcgggcgcttcgcgtgcgcttgcttccgtctgttcgtctgtcctgctcgctggttcgcgcgccgtctccccctcgttcgcgtgcgcctctgtgtttgtgtcccgctctctcggcgcttttcttcntcttgtgcgtcctgtgcggtttcgttggggcgcccgcttcttgtcccgccggcgctccgcccggctcctcgcgttttgcctgtcttgtttgttcttttttttgtggngcggttttccgtggttcgtgtccgccccgctgctctccgcgttcccttctcctcctctcgcgtctggtgccgtctggcgacgatgccgcctcgtggccgtcctcctcggctctctctttctcggcccggtcggtgtggcctcgtgcgccgcgtttgtccttgtcgttggtgctggcggccgcttgctcgttgtttgtgttgtctccttcgtggtgtgggcgctcgtggggttctctgggcgtgttcgctnccgccgctgcgcggtcgcgccctcgtctgcgcggcgtgctgtgcccttgcgttgcggttgttggggtttgtgtgggggttttcgtcccccctaacctcggtgggtctcgtgctctctgaccntgtttcgttttgtgggtgtccgtgcgctcgtggctgcgtcgctgtccctcct

SEQ ID NO: 10673 - DNA, 1389 bp, Homo sapiens
  misc_feature (1)...(1389): n = A,T,C or G
gtggaggggnaagaagaaggagnnggggnnggngnnnngnanggaaanaagaagaagaagaanngnnnggggnnggnttttgtatacagcacagnnnntttgctacagtagcatacgagctattgcgcnngtntnnnnnggcaccgnnctctttccatctcgtgctcctcgttcataagaaccatantatctcctgccancaagccagtccaacgaacagatagagagcttttttggagagacgcgcacagagcaccaaaccacaangagaanagtaagagngcgaggngcgcnnnttgaatttgacgtctctcagtctagggtggtcgacggatgatactagcantattgacataactcaaggtactattactaaacctacaacttagattatactatattggttctccctacctnctctctttctataccttcgtattgatattttctctacattncctacttccatctgactgtccattgatttatacatcacatctccataagactccaacactgcagctcaaataagtggagagtaagatgaatgggntncgtgtgatttgattctgtcgccgctccttctctggcnccgtncgagcccgcgccgcccgccgctgcgctggtggtttgagtgctgtccggagacgcgcagcatgctctgctcatgcactgtcgttgtcggtatctcggagcatgtggtggattgctgaagtagatgttggtaaanatagcgtttctgtgctgtctacttagtgggtggctgcgtagctatgattgtgccatgtncatttagtcgcnactcacacgtatactattttgtgcnctatgtctcatncatcttgtctaccgtacctctnatgattcgcgtcagatagtgtcngcttcgagattctgcttctctgcgcgcacacattctgtgcgtcactatcgctcgaccgcgcttcccngataccgcgtatatttcgtgtacagtcgcctcttgatagatcgtcattttgcactatagttgtgtgcgtagtccagctgcgcattcgcgtgccgcgttccacgctagagtcacatcagctcgagcacctgcgtannacatacacacgaacatgttgtacactgtcggtnttctcctcttcgtctcatgcgctcgtcnagcgtcacatntgtgataggtcgcgtctgttctcnantacatcgtagtgaacgtagtagatgtgagtacacttgagtgcgctgatgtgcgctgaggatccctctagacgatatatagtagtanactatgatatgatagtggcgcacgtcttcnctacattatcatactatagctacgaacctcgctacaatctcgtccgcagtcgtggttgtgtgtctttcgtctcatctcgtcctctagcg

SEQ ID NO: 10674 - DNA, 967 bp, Homo sapiens
  misc_feature (1)...(967): n = A,T,C or G
ttcgttggtaactacaagattaatggtgaaaaattcatcatcatatgggttataatatgataaacattgtgaaactatctacaatgtgggtaggggggttaaactattaaaataaaaaaaaactgaatttttaataacgctcctgccacctaatatatttagaaaagaaaatacattgccaggttcgcgttttctgaaggattcagtgacttggtttctgtaaattatatgggttattatttttttagacaaggggcagccaatagagatcattgttaagaataatgaggttctaatatactttcttttagttctgggagccgacaggatttattacgagcactttccctttaaaggaaacagaagtgtataccttattctttttactagccatagtgtagctctattggctgtactacctcatatgttactttgctggatgataccataatggtttacgggagcttcctatggtaccagatttagaatgggtacctgtatagaactacaaaggttatgcggctcagctgacatatattatgaagaccgccaggcacagtacaatacgtcaggggcgtgtcgatttgaggaaagaaagctaaaattgtgttgagaacgaatccagtgatgaactgaaaaacatccgacagtattagttatcggtgagtataacgtctacagcttttgttgagcattcgttctcctctccgcgtaaacatcaatacagtagcggccctgtgtgggacacgtctactagctgagagcattgactacatttctatttgtgtggggaacgtacctacggtttgagaacggagcaacggaggacgcgcctatgngaccattatcggacggcgcgacctgtatagatccttaagaacagcctattgttatgtcgcgaagctctgcacgtttaaaaaacataataaaagcgcctgttggcccaaaagagtcttgancctgagcg

SEQ ID NO: 10675 - DNA, 1865 bp, Homo sapiens
  misc_feature (1)...(1865): n = A,T,C or G
aataggtagatcgtcgcgatgagagagggagcgatcacggacgtcgacgtctcgtagagcggcgtnagactggcgggctgcgcgctggcgactatcgtcgcgatncgttctngactagtgtntngtcntgtgcantgcgactantannnngcacngtcntcaacngntgntacagtcagcatacatatantacncncatcagacgctgngangtgactcgatcgangtatgactcgtgcgtgtnacgntatagcatgatacgacananntaaatctgatcagatangntacaaactacatantgatagcatatgcaganatgnngnngaagaggtcgntgngnangttgacagtnaacacgctgcaaggangacgtcgtgacgatancngagcgctcgggcctgtgcgtgtcaagcatcgangcgatgcttacataggtangtngaggacgcatcangacgcgagngatcatgatactcacagtgngcgcgatngacntctantncgctatcctatactagtgcagcacgtcgtcagagtgnacagcactgcgcacgagngnagagcacactgtatcgtatgtgngactcgacgacgatngngangnagngaccgacganganggngcagcggtcgnggagagngtacgnagtacgtggctggnnngngagtggtagtgnagntgncnctctacagtgaganggatancagcatgtactactagacgncgaaatcgactaacacagatctatgtgangtgtgagcacactcacgatacaagatcagcgtagttatgtgacgagtagcagagctnacgntggcgtgctgtnacgcactacanagctagtngctcgtcgctgattctagctacatgcctaacgtnataantacacgctgctntatgactcatactagacagnancanaaataactcgcgtgctnggagcgacgcaggagagagggctgcgngnatctggatggcgngagcgtagtatggtgactatagtgatgcgtctactgacgcgctgcgcgcgtcagtgtgatgnangtgcgatgatggatcgtagcatggagacatacatctcagacggcagcatctgtcgtgcgcgtcgcgcaagngcgcggttcgcggagctcgtccgtgctctagtgngctgtgatagtagtcgacacgtcacgtgtggtcgacgtgcgtgcggacgcgtgncgtantcgccacagcgtagtngcctcgtacatctgtgtctacactttatcggttgccggggtggagcgaccatcgagtcgtcatacactggcgaggacggtgtgncgtattagaggcgttcgtgggtnagtatacgacgcacgcgcatcgtcgattcgtacatggccgctacgatagcgagtcgacaacgcgagagatagtgcgcgatgaggggtgacaaggaatcgagcaagtgggcacatacgtatntatctatcgcatcanctcgactcctagcgcaaccgagcgagtagatgacgcggcattactgcggtgacagtacagagngtcatcacgagtagattgcaagcagtagcggnggcgtgcgatagcgccggtggcggagacaccgatagtagacntcattgatgacgtctattatatgcgcacacacgcgcgagcgcatctcgctgtgctgattgtcgcgcctctggtagtggtcacgtagcgcgtctcagccagcacgcctcnatcagcacagcagcgctggaggcgggtagtaatactaggcttctctgcgttgggcattagatgtagggatgactatatagtagnatcacactcccgcactctgtgtggagaggtnagaatgctatagatgttcgtcagttctgctctc

SEQ ID NO: 10676 - DNA, 1311 bp, Homo sapiens
  misc_feature (1)...(1311): n = A,T,C or G
tctctgtgcgtctattgtctcgtcctcgccgcctcctgcctgtcgtttcgttctgcgtgtgttcggcgcctctgctctgtcgcgtgtctccgcgctggttcgctcctcgctgccgtctctctctcctgctctgttttcaccgttgcgggtctgttgtgcgcttgtggtgtcgtggcggtgcggtgtgcgttgcttgtccttctctcccggctcgtcgcgtgtggcgcgtcctccttcgtcggccgcttcgtcgcgtgcgcgcgccgctcgtnctgcttcggtggtctgttctgcgccgtggtgtgtccncgtggttctttcgttctnctttctcctcgnctcgttctcctgctccgttcgtcctctctccctcctcgcgttctcttctctcgtgtgctcgtccgctcgcgctccggtgtgcccgtgcgcgcgtctggccgcccggcttcgggctgtggccgttgcctctcgccctgtgtcccgttgcggctcgtctgtttcgcggtgcgccgtcgttcgcgttcttcgcgcggtcgtcgctcttcgccgtggtttgttgggttcgtgtgtggtcggttcgtgcgtggcgccgcgcgctctgttttgcgcgctgtccgcgttcttgtcctcttttcccgcgtccccgctgttcgcttcttctctggcgctgtgtgtcnttcggtcgtgtgtccggtcgcggcgcggcgtgtgtgctctctccntcgcgcggtcttcggcgtggtcttgtttctttgttcgccgtgtcgcggcgtctgtcttttgggtcccgtctgtctcctcgtctggtcggcggcggtgtggttgggcgcgggcgcgcgtggctggggtgtggtctcctgtcttcggttgtcttcctctcgtttctctctcctccgggtctcggtcccgcgtcgggcgtgtgcgcgggcgggtcgtgctcgtggctcctttgtcggnctgcttctcgtctcgctcgcttgctctcgttcgtcgtctgtccggccgtcggcgcgtgccccgcctctcgtccgcggcctgctccgcgttggctcggctcgctgtgtcttcgcttgccgtgccttggtccctgcgttgntctctctgtgtgcggtgtccccggtgtctcgcgctctcgccggccgctctgggtggcggtcggctctctcgccgtgtgttgtgctccttgtgtggtgttgcgttttcgcccgcgncccaaggctcggtgggttgnttgttttccctccctgcacctgttttttgtgtggtgggcgggcggctcggcggccggctggctcggctcccgtctgccgc

SEQ ID NO: 10677 - DNA, 975 bp, Homo sapiens
  misc_feature (1)...(975): n = A,T,C or G
ggctgcgcggtggtcgtggcgggttcggtgcgggcgctgtgtcgcgtctgattcgctgcgtctgggcgggggcgccgagctttaccggggaggccaggcgcggcgtggatactcggagtcgccgggtggcgtcgggcggggcggcggagtgcggtgagggcgggtgtaggggcgagggggacgcggtggccgcgntcctgcggctgaggtcccgacgccccgcggaccggccgtagcgtgaccggcgtgcggcggcgccctcgggcgcgcgcgatcctggtcgcgagcgtgatggtacgcatgcggcgttacgcgtcgcgggctggtcgcgggacgtggtccgcggcgcgcgcgggccggcgcgtcgccggtggcacgcctatgcgcgtcggttcctcacgtctcggtggtctcgcggcggtggggtcgcgcgccggtgcgggcggcgcgcgggctggtcgtcctgtcgtgcctaccctcgtcgccgggacccgcggcgcgccggaggggatgtctcggtgggcgggtgtgcaggtgtataggtggggcgtgttctcggtctctcgcttccgttgctagcgttttcagccgacgtggagattatgtatgtgtcatcgcctcttcgcgcggtttagcggtgagcgtcgtccggttgttggagaggtggggcgcggagtgcggcccaccgccaccttagttctttctttctctatctctattctttctttactatatattatcttttcttttctttatatttatgtttctccacaactactttcgcctccacctccccgagtgtattctctttgctattttcttatatgtcattctggacataggatttctgattctttttattatttatatctatccttctcccctttcctccnctttttntctttcttctttttctttctaaatctttcttgttttctcnncnncccttttnttttctggtttcntcttgttaaa

SEQ ID NO: 10678 - DNA, 477 bp, Homo sapiens
ttccctcgctgtacgtttacctcaatagagccccagaatcacttctgatttgaagctgcccaattcatgaatcgctgtttgtgcaaataaactctaaaatcttatgcctcagtttaccttaacacacataattttccataccaaaaaatcacttcccaaatacgtaagcattcaactcactatctctatctaccaaaggccaacctcaactccacagagataggagtggactccctctgaaagtaaagacggagctgtcacaggcctactcgttgtccctgtggccactgaagaggtgatggtaccaccgggataatgataccacccaataccaatacaactcttcttccagatactgacttaaataggacttttgggggaaaagtagctttcctgggaatagaaacatcattatggcaggacatatgaaacatggtctagtggcaataaaagaggggaaactcaaaaaaaaaaaaa

SEQ ID NO: 10679 - DNA, 1897 bp, Homo sapiens
  misc_feature (1)...(1897): n = A,T,C or G
aaagacggtagtgcgtagtcacagaggtagatatagtcgatgcacatgcccgcgctctacannattacacnatactacnccgcatcactagacaacgtcatcancgtatctcacatacctatgagtanttgcagnacatcgtacganatgcnnacatcgctcgcnacagcgaggcgcgctcntgaagctgcgntagtcaggtgngagcgcagctgtagtagtgnacgacggagacangagnagagagnagtcaaagagctcgtcgagggcaccagcgacgcgcgtgactcgccgagatggcagtggcagctntgacgtgcgtctcgtgngncgcgctcgcgcgcgctngnactcatactgataggtacagtctagtgtcgtgtcagtcgtagtgntgggtgnttnggtacgnnctgagccgacgcttatacacaggcgcgcaancgtgtcgatgacnctnctatcatgcgatatcctcataagcagctcgtcgtgtagtanggtgngcgntacacgcgagtctgatgtacntattgagcgaanngcgatcagacgagtaggaacgcgcnagagagaggtantcatctcgcatgggtcgtgcagcacgagancgtcgacggatgtcagaacatactagctgagangagctcatttaacgatagctgctgtttgactgcgtgcgcagtcgacgtctactcgccacgcagagtngtgagtgcatctgananacacgagcatgcgtcaccaaacgcgacactgagtcgtagtgctgtcacatgtagcgtctactcgtcactagctatnagatacaccacgcacgatcgtggtctacactactacctacnngcacataacgttcagaggcgtctctgtcgtcagacananatgatattaganatgagatctgtatcagtctgtctgacgtgtcagagtgagtgngacttgcgcagtgtccatgaggccacgcagcacgactcgctagcccagcatcacgngngctcacctgcacgtctncngacnacatgcatgccctgtcgtatgtgcgctaccgtagtcggtggtactcagcgaggacgctacatgtgacanacataacgtgacacaagattcngtcactacgcgtgcagccagatacgtagttacctcacgtcgcgtnccgcagagcataatcgatgccatcaattagtacagctgcaagngtgcgtcatatgaatacctgntgcccatcattatgcagcgcgtactccgcgcgagctcatcanctcactactatcgcgnaaggcgacgcgatccgangnacanaagcagtgatcatataatngatgagngtgctacacaccatgngcgcggctcagcangagaccatcgctctggagtgagcactagtgatgtanacatagcggccgagggacgatagacagatgaactgcaagcatagagacacaggagcgtgaagtcgacagagatgatacgttatgatgacgtcacgcatgatgctgtactagcagatcgcgcgagcaagagacacacagatgcnggatcatgcatcgagacgcagtgtacgcgtagagtgaagcatgtaagcacagagatagcgactgatctgtagcatctattgaggtngctcctatccgtgatngtactctcacgcngactcaacgcgacngcgctaccgcgtacagcacagcgcggcgtcatcattgtacgcccgacgacatacacactcatccacaangcacacgnctgtgctgctggtatataatgtgctgtgcgctgcatggtcntgtattgtagctgtagctcgcatgacagctctctaactatgctacactaagtaagctgtcctgngtcgncagctactcgcgccgntgacnacgtcatgctccgctcagctgct

SEQ ID NO: 10680 - DNA, 1210 bp, Homo sapiens
  misc_feature (1)...(1210): n = A,T,C or G
atctctcgttctcgttcgtccctctctttgtttcgtctgtttctggctgtttgcgttctttcttctcgcttgtgcgccgtgtcgcgttgctgtctctgctcggtttgttgtcgcgcggcgtgctcgtctcggctcgcgctcggcctctcttctctttcctggcgtgcttttgtcttctctgctctgcgtnctcnancgtctgcctctcttctttttccctaccaggggtgtgcctgtttcgtttcctctatcgtcggcgcggtcggctcccgcgtgccttctctcnccctctcgtcccctctccgccttctctacgcctcctgtcctgccgcgtcctctctctccttctttcctcttccgctcctcctcctcgcgtgcggcgcgctctgccggctatctcctgtgctctccctgtgctcgttgntgtgcgtcttgctgtctttctcgcgttgctcgcgttcgctcggcggcttgccccgtcgttcgcctccgcctctcccgggccgcccctccgtctctcgctgctgtgttggccggtctgccgtgttggtctgttggctcgggctccgcgtccttttgtcggtcctgtttcacgtcgtccttgggttcgtgcttgtcgcctggcttgtgttggtctcggcggcttccccgtcggcctgcctgtcccctccttgcttgttgtggttgcgtggcgggcgttctctccttcggtttcgttgctttttttgtcgtggtggcgtgcggcgggtccgtggctgttcccgcacttgttttcctggtccttgtcctccccgtgcctcggtgtctctctcttccgctcttctctggcggcggcgtcgggtggtgcgttccttgggttgccgtcgtcgcttgccctctccctccttctttttttccgccgtcccttcgcgcttggtttcgtgcggtgcctttccgtgtgttccctnctctcntcttcccgtctcgtgcggtggctgtctcttctctcccttctgtctttctctcgtcctcgtgcctcgctctctcggcgtgtcgtctatgcgtcggctctcttgcgggtccgccccgtcctggtgcgtnnttgtgtgtctctgcgcccgtgtcccaccatctgcgtggtctgttctgttctctccgcctcgaccctttttgttgtttgtgctctccccccctggctcttcgtgtcccctgcttgtcgctccgttctgtc

SEQ ID NO: 10681 - DNA, 239 bp, Homo sapiens
ctccgagtaacattctgttgcccatgctggagtgaactggcgcgatctcggcccactgcaaccttcacctcccgagttcgagcgattcttgtgcctcagcccccggagtagttgggacaaaaatctttaactgtgattaaaaacacatataaaatttaccatgttaatgaattttaagtatacagttcagtagtgttaagcattaatatattccttattgttgtgcaaaaaaaaaaaaa

SEQ ID NO: 10682 - DNA, 357 bp, Homo sapiens
ccccggctaaccgaagggagaaactttctcatgctgctgatgctgactgcttttggataactctttcatactgaactggactgctgcgttcttgaaaaaccaggaagaagaaaatcaccctctaaaactgaaatttccagagacttgcctcaacccattggctctctacatgctgccctcctattaggaaatagatttgttacttacattcccccctccactcaccctccactaccagacaaagctagatgggctcaggggaaataagtaactgtgatgttcctcagagatctgttatgtaccaatgataaatggaaaatgaaaattactaacatttatgattgaaaaaaaaaaaaa

SEQ ID NO: 10683 - DNA, 1603 bp, Homo sapiens
  misc_feature (1)...(1603): n = A,T,C or G
actgcaggtgtgaggtggcgtgcggcaccanacgctgacagcgtcatacacacattgtgacgaccgcntagcgtgcgtgacgacactctgantcgctcgccagaaggcgcgcctacgcgccgacgcacggcgtgtcgcatcactgtgtgctaggaccagcactgagagaggagantcgtcanccgcagtngaangagtcgcgagtcgctcgcgactcgacacgtccggagtacgctcggacgaagancagaccacagagatcgagtacgacctgtcgcaccgcacgcaccgcgcgangnggcgagcgtatctagacagacanntactcgtcactcgcacgcgatgagagcacgnagatgagacncgcgagtaatgcgncggcgtnctctgtggcgcgcgtgcgcggtnaggacgcgcagaagctatatgttgnnatgtatcgaccgcangtcgacacgtgcgtgcgacgacgacacgngnggcnttggcgcngngagtcctagtatgatgtgagtagcacgtgtcgtctaggatacgtgcacgcgngtngagacgcgagtacgtacgnggcgcgcgcgagagggggctgtgatagatgngncgctgtgctgatatgagtcgtcaatctagagaagacatagtgtgttagtgncgacgatatacatangctcgcatctacgtgtcgctaccacctacanaggacgcataggcgagggagatcacgcgagcgaagacgcctcgtgacacggtgcgcgtggcgcatgcggctcgacgacgtcacagcgtanccgtcgtcagttatatntgatgttgaggtagaggactgagcgcgtgcgatgagcaggttgcgcgctatgtcatcgatcntgcgtgctcnatgagaggatgagctgcactacgtgaggtgtgcagagtgcgcggcgtgatttgagttcttcctctcttctaggagagcgactcaagcaagagggacaccacgagaacagagaatgcgacacacgatcagcatatcactctgatcatataggctattcatgttccagggtcgtcagcggcaggacctaggtagcgacactcgcgatgatcccgtggaggtgatttacgcgaggcgggcgtgcggatgaatcaacgttgcgactggtcggancaccatcgnancgagaacgatccttctgcgttctctaccaattactacatcgacacatgatatgggcctgaacagacgacgcccactgcgagcgactaactggcctactgatcgctgaactcgaggatgccaacacgagtacctcagacagcgcacacgcctcggaggcctacggaacatccgccgccgcgccttcctggatacttctggtctcagaccctcaccgtgtccatgcgtaatcttagcgaggagcggaggcagacgaggcgggacagcgcaggagaggggacgagggagggcaagactgaagcgagnggcatggggaggtgggcggcgcggcacgatgggttaaacataatcaccgagcgggagatatacgacgtcctgcagccagagagagaagattcggtgggcacaagcacgcacgaggcgcgagcggctaagtatggtggctag

SEQ ID NO: 10684 - DNA, 1512 bp, Homo sapiens
  misc_feature (1)...(1512): n = A,T,C or G
cacctcccgtacatcgatacttgctcgcagctctactatacccaagtctcngctcgcatccgtgcactgactccttgctcgctccggcgcagccgtcgcgacgtggcgtcatcacgtacatncgtcgaccgacgcatcgatgttaataatctcatacgatgtcgcgcttttccatgaggtgtatcatgcttatctcactatactctcgtcgtccatataggtattacgattcatcgcagcacgtaaatgcgtgcagcagtgcgcagacaactaccttcacctatgcttattctctcgngccttgcgtgcgcacaccagcacctcctctacgcagtaatgatagtgtcgctcattacacagcggaatcgcattacngcgcggagtgcaattcctcgaccctctcccgntctattgtagagtcgtgatgctgtgtaacactatcgactagatgtcgtactctaatcttatctctgcgcactgacggcgctcatatctaatcgctctatcctctatcgagcggncncagccgcacttgcgcagagtatactgcagatgcgtacacgcgggcacagaacgacatgatgtcgcatatctatcgttgagtgacgcacgcgcaaactanatcaagatgtaggatgggcgtcagcatagtacgttgagtgtcggtccatancgcatggancggancgncatatcatcagcgaaganatgttataatcactactctcatgcacatctgatgcgtcgactcgacgatggngcctgntacgaacngtcgcctagagttcgatgtacactcgtgttgcggtcgacgtgcgtgccatagcttgacatgcagtgagtcactctntcacgcgcaagtatcggtctccgttcgtgctacgcccgcttaggcctatacgtcggcttaatgcgtcgtcttacagagactgcgcgtgcaataatcggtaggttcgctgattcgcctccgtccgcttgtcagngtaccgtgagatccagttattactactcgctgcacgtcatcgcntgtgaggcagcagctgctcataccgnggcgcgtcgcactactgccgcgtcggcttagtagcgagcacgtcgagcgcgacaangcgctgtcgatgtctagtgtgtcagatatctccgcgcgngtggtgnagtcngtacgaagtcgctccagctctgtacagcgctgcgcgcgtacttaacaccacgcacatatantaantgaaatgactgcacgctatcatgacgcatcttgctcactcgcgcgagactaccgcagcacgtaggactcgctcagcagcacgctctcacatcgacctagnatttatggacgatncttcagagacgnctgcgtggctgcncgctcnctctctcgtcgaagctttccgtcctgtctcgcggctaggtttctcccgccacncgcacgctcgatcaagcgtcgcgctcnttgagcggccgtcgcgcgtcgctggcgctcgatctctgatgaagtcgcgctgtacgtgcacc

SEQ ID NO: 10685 - DNA, 873 bp, Homo sapiens
  misc_feature (1)...(873): n = A,T,C or G
cattctaattacctcgtaccacaaacaacgntttaaaaaaatacaaccccttcgggtctacacgagtatccgagctgaagtcagggtgtgagatatcagatgattgcgacttctagtgcttagtggagctcaagcagtcctattgcctcagcctatcaagtacacggaactgactacaggcatgaaccaccacacctggctaattttttttgaatttttagcagaaaagacagtgtcttcatgatgtacagaactacttctcaaatcactattcacatactggtagaaggcaagcactgaagatggcacagaagcacatcccaaatactatgataccataaagtatactgcagcaatgcattggcacacacttgtttgaacatttgtttcagaagattttgacagaagataaaactgtgtggtttttatttcactggattaaagaaaattcattataactgcctctatgcctcaggcccatgactgaattaagagtcataatacttcacttccccacccgtgaacttcattaacactgctgcagacctgttattccaaacactgacgtctgtttacacacgcctcccatgatttgatccgcacttcttctcgttccaatctcaattccataccttggcgctatcagttagtgcaaacttacaccttactaccgcgcatacgtttccttccgcgtctctcataagttccccctgttcgaattactagcgttatatacttctctatcccttaagcacacaaatctgttcattcactgctgtaatttacatatccacgcgttcctatataattgtccgctattgtccatatttacccactatcccattccccccatgcccttcattttcgtcggtg

SEQ ID NO: 10686 - DNA, 1651 bp, Homo sapiens
  misc_feature (1)...(1651): n = A,T,C or G
aggaagaggnaagggaagaggaagnaaganagaagnnnnnnnnnaaaanaannaanaaanaagggannnnaanggaaagaggnnanaagagagggnnannngnnnnaanagaggaaggnaannaaanaannaaagggnnaaaagaaggnaggggntggnnnatttatganggaatagtgaaaaagggnnaaatagtaggnaanacgagagaggnnnnancagaagagaganagaggtgtagggagtatgnaggatttgttatagtggtggcgtgtgaagtactgccgtgcgnntcagtgtgagtgtgtgtggntatatgctgcccacagaacaccaacagtagagataaanagcgcgtgcgagcgcgcnnntatcacattcaccacgagncgcatgntgtaagactgcgtacggcacggcgnccagctcacaataatcttctatgtgtaagagtccgagtgtaattgtctctggcngtncactggcctgtccagcgtcatctntctggtgttgctgcatgtcgagatgtntaccttnatacatttactcgttctcgctcgtctcgtattatatcagacatctcctcctcactcgcctctcnccaccagcgcgcngccctcnggcgcgtcagtagcgctcgcagtgagatcacagcgagcnncgaagatgtcgattacgctcgcctacgcgncncctcgtcgtcgcgcgcgcncncgctgcgcggcattcgtgctccctctcttctntctctccactcatcgcgctttcttaacgtactanancctattgattacctccgcgtacgttcgcncgttgcgtccgtngncnaccgtagtggtgtcacgctgtngtgtcgcgttcttgactatcgcaggcgnnaagcgagtgtgacatnngaatagagggcggagagacgagtcgaagtatnctgcgtacgaggaggcnccacacgcgtaggagacttgcgntangcgcgcntctccgancactcccagtcgnnatcgcagattcgtntactcgcgctgcgtgcggatcatctgctcnatatatgtgcacttcttactagatggtatagtgagtatggncccgacgtagtgtgtgnctgcgtctcgtcgtnctcgcgtcnagcgtcggacgccgcgactagtgttcacgtcgcgacgtgactgccgatgatgacacacagagttagccnctgagacgcgcgcatcgcgcnagagtgaggtctcatcatcgttcgcgatgtgtccagcgtanggctcttaggttgtgtgtcttncctagcgcgcgtgtaggccgcattccgtcgcccagccggaccgtgtatgctcaagagagagatgacgctcnanactatacatatagctcactcggtccatgagacgngacacacttagttcagantactanccagcgacgatgtatgcgtgtggcggtgactgtgctgattgctgagatgcgcgcgtggtagatgcagtccnacgagagattatacgccgagaggcgcctagtgagctctgatccatctgcctaacgagtactgtctncacatgtatcacagtctgntgatgttaagncaggtggtgatagtaggagtgtgttntcatcagacgagtagtgcagcgtagagcgtgcgtcgcgtcgtgcgtgg

SEQ ID NO: 10687 - DNA, 1217 bp, Homo sapiens
  misc_feature (1)...(1217): n = A,T,C or G
atatattganggntccttattatgttagtgagtgggaatctatagcagaagtcattgttatgtanggtggagagagaatatagaatggaagaatattaatcgattgtgagatataaaatggtggtgtgtattgctcgagagggattgatgatgaanttaataatgtanaagagtatgatttagtggaatgattcatgttnagagttcggtcgaggatctgcttattgatgtggacgatgatagaatagaggatctctaagttaatattgagaataatagggtggacaagttgcgatgtgcgggtgtgtatgtgcgagtaatntnnaatatatttatataaactgtatataaactattttagatatatattatatatcattgatgtgtattctgttgtatatatatgtaatctcttaatctnattatgtgcatcattttcgattatatctatttatgtatgtatacatacttttataactatttatataaataatatttattattataaattataagcaatcaaataaatattgttagaaaattaaatatagattgtaagagaacatgtagtattctgtgtgtatagtatgtgtatgattatgtgtttgtgcatattttctttgtatttttatgttagatctgatttgtaaataattataatatggtatatattattaattttaatatactatttggataaatttattatatttgattgtgttaataaaagtctttgattcgatacatatttttatttgtaatatacattaataataataataaataaataagnaactttttacaaatcaataaaaatatatatcntaaataataatttnagttattattgattttattttatttatatttataatcagttttagttatattgaaagtagagacaaatggttaagtcatgaggtaatataaaatatgagacaaagacctgatataagataatgatagtacgtnaanactatttatantnatataatatatgctttctnntnaattttaaaaagtttagtctaattatcattaattcgttatttatctcaacttataccgcaagtgttaatagtaataatgtaaaaattccactattattnttatttgttatatctatatataaactttttcttatatnntnatttgataatattaataatataatatatataaaattatatntnattattttnnnnttnnntatcatc

SEQ ID NO: 10688 - DNA, 862 bp, Homo sapiens
  misc_feature (1)...(862): n = A,T,C or G
ggtcagtggcactcaagcacactagtttgcagggaagactctggagcacacagctgagcagcaccacaggagcagagtgcaccctgagactgctttgtaccgatgcatgtcggcgggctgggctgccagaagaacctgttctgaatcttcacacagctgatctctggcacttccctgcagcgcgtaccagggtcacactggaacactgggagcccggcttccaactgttcctcncccactgccattctgcgggatcccagggtcattgcaggacgttgctgtggacactggggcaaggaaatagaagagagggtaaggtcgactgggtgtctgccactcaggaggctccacagtcatcaccctcactgattgccatcatccgtgcattgccacaaccaccagaaccttcccatcatcatcatcagctgtagccacagngccactattctcactcccgatactatcactgcctacaccaccaattgtgatcacacttgacactctcactgatatcaccactaccattcttccagtgccttcaccattactgtcatctgcctgtgatgagatgctatgaggtaagcatgattatactggtataagtatagaattggaatcagcttaagaatacaagcattggtccataaacaagcattgcacttctgtgtatggcaactacatgacccgaaggaggaagcgacacaaatccaacctaacttcctgctgncaggtttgggggccaccccttacttccagccttgnggaaggcacgcgaggaagtccttgaggcaggaactggaaccccctggaaccaggcagcctgcctcacaaaataaaaaatgacggcgggggagaagcctat

SEQ ID NO: 10689 - DNA, 941 bp, Homo sapiens
agcgggcgaagatgcaaagtatacttgtgggttcatcggagtgtacgcgatgtttgcgcgataaaaaaccacaacacaactcccgtgaccactcgtgatgaatgtagatagcaagggagggtgtggtggcaggtgaatgctacctaatatgtgcgggacgggacggaggagagcacggagaggaaggcgtgctcgttggtgagtcgtctgcaggatctctctaggctcatcaatcggaacgtgaccagcgcgctgaatatgcgccgaacacacccaagcatccctaaactatatcgatataacactgcactcactccaaaattcttcttccacgttacctatctggtcttactattttatcctcctaactactatctatattcatatatataactcaatcattcacaccatgaatatctgtcaacaatcttatcacacactctacaaacacacactatcagctaacgcattagctagtctgtcgtaactatataataagtagaaatgagagatactgtaaaggtagtgatgacggctttgggtgtgagcgtggagtgatatcatcgtattgtgtggattactgtataatgacatagtaacggggctatcttttaatcatcaagagtgtaatcgtattgcggcaatatttataaaattaaataaatagaatattattatattatatactatttatagccactgcgattattaaaacaagtgttattttttctcgagtattcttcctctcctttctttaatattgtgttatctggagggttatagggggcgccggcgggggagggtacactgcgacaagaggggcacggccacggagtacaaccctgcctatgtgtgttacacctccggcagtcagttttgactgacaaattcctcagacagatacagcctagattctcacatttatttctatttcctcactc

SEQ ID NO: 10690 - DNA, 358 bp, Homo sapiens
gctgggtcttcggagactaatatgttaggatgaaggatgggctttaatccagtgactggtgacttcatgagagaaaagaatgggaaatttagacagagagacccgggccatgtgaagacaaaggcagagattggagtgatgctgccacaagccaaggaacagcaagcactgccagcagtcactggaggtgggaagaggcaatgaaggattcagccctaccggccccttgattccagacttctaatctccagagctgtgacagaatacatttctgttgttttatgacacccagtttgtggtcacctgttatggcacccccggcaaatgaatacactgggttttcagaaaaaaaaaaaaa

SEQ ID NO: 10691 - DNA, 1065 bp, Homo sapiens
  misc_feature (1)...(1065): n = A,T,C or G
tttcagggatacacctcacagatagctcgacaggatggacagccccaccggagcgatgtgagagcgatggcgattgactcagaacctctctcgacacgtcatagtcgccatatttattctatcactcctactgtcacatttactgccgaatctacagtgattgattcttctcgtttggctgcagactcaacttgataagatcctgggacagattgactttagtgctaatacctaggatagttctttgattttcagtagctgcagactctggagaaagtccattaggcnaatacacaagtaattgacctacttgagcttgacgatagaattcgcccagaagagtaatcggacgttctgtaattttctataaannctgggaggaaactgtcctccaggtgcgattgtacgtttgtttctcgctttatgttcgcgaactcagaccttgctaagtgtcatgcattgaaggggcgttttgcaatataactttaatagcctctagtgacttacgtagaaggtcagttcatttgccttgcatattcaggtatggagggggcaattatgtcttggatatttttttcacagaaaagattaaatagtctcgattagggggtaatgccttggctggcatataaccttattctcattttccccacttcttcctgagggagaaaatttccaagtttcttctaatcttgggattgttacgggaactggagaagggggcctttgcgacttcttcctggtgactctcttccttctccttgggccgcatggcccaggttctattgatccttgcccttctctttcagcacgtggtgttatcgtcttgggagtgtggccgcctctcatcttttcttcgagtgttagctcccctcttttaccagatgctggcaggagggatcctccggggatggtctcactgccggggattggtatgttcatgcggcatattgggtgatagttgatgtagctctgcacgcgtgcccgccttatccacggcctcttcgcctccacgctgcgtcaacgcatccccttgctgacgcgccctctccgttgcctgttcta

SEQ ID NO: 10692 - DNA, 1556 bp, Homo sapiens
  misc_feature (1)...(1556): n = A,T,C or G
gcgggccgtccagatctggtctaagtctcagaacagaacgtacaccaagaatccgtcgcccccactgtcgcgtctcanaatataggtatcaaactatcataaacgtatatcatatagtacgacggtcagacccacacgagacacgtctcgtaaaccgaaccgactacacgtaggcgtgcgcacgattaagcagagtctaatagagtcaccagatcacanccgccgccggccgcgacacgagtgcctagagtacgcacatagcacgtaagaaatagttcataaatataatacatgccggacctctgcgtgggtataacagcactcgcaatgataccatctacggcacgcgtatagtgcgaacgctgagtcggttaagtacagacagtacagtaccgcctgatggtgaggttgggcgtactacgcatcagacgactcgaagaccgcagcatcgtcgtcagctaaagatacacgaatcctatttggtaactcaccgcaattcaaagccatcgatgcatttctctacagagatatatcgctcacttgccgctcgtcagaccgcatcgcacgtagtagcctgcgctcggtgcgcgacacggagacaccgaccgaggagcgatgatctcgcccgccgggtggtgatggtgagatctggccgacgcggcacagagataggttcgctcgacatcgccgttgtccacacacgtcgtgtatagttcagcaaagntcgtggtccgtctcacttgacgccttagcgctattctagaatatcctcgactgctcacgtccaccgcgcgacganacgcatcatccgtggntagngtgcgcgcagcgagatcgttatagtcgtgacggtggcgngactcgcgcacgcgcagagacgctatgtcgatctcgtcgcgtgtcagctcgtctcgttacacacgtcactatgctaatagcgttcacatatagtatatatatgacattgtcgtgatatagatacgccatgtcatcagacatcntaatcgccgcagcacgacacacataatcagtcagtacgcgacatactggatgcagttgatactcagatgttacgcgctgtatcgccactcgacgacagcatgcggatgtacagatcgtacatgatatntcacgctgtctgcgactagntactgtcgatatgatatatatatcacacacacactccgctacgcctctgtgagacagtcgtaatactgaatgcgtgatgaaagcgtcgcntcccgctcacgcgcgatcatgactgatatcncagcgcgcatcactgagtcgcgaccgcgantgactatggctgcgtacgcgctagaccagtctagagatcacagacgaatcagcagttctagcggagagttacactatgcaggctacacgcgccgcgttatgtcgcagcgacgcantcattgactttcagcatacaacgaccatgacagtgcggcgtaacgattcacgcccgcccctctcggactttcgggatcgccgacggaccgcgcgtagaaacgcagatactttgcattccgtacctcaatacaaccatatgg

SEQ ID NO: 10693 - DNA, 401 bp, Homo sapiens
ctacacgccccttctctcgtttccagccggaaggggctgttagaaacaattccaatgttatctcaagttatcatgtgaatattgaaaaacgaaccctaaagtttatatgcgagagccaaaaaaatgcaaaagagccagcacatattgaaagagaagaacaaagtcagaagattgacactacctgacttcaagacttatgataaggcttcagtaataaagacagtgtggtatggacaaactaatagaaatacagatcaatggtacagaacagagaacccagaaatagattcacataaatatattgtcaactgacctttgacaaataagaaaaagcaatacagtagggcaaaaatagccttttcactaaacaaatgaacatccacattcgaaaaaaaaaaaaa

SEQ ID NO: 10694 - DNA, 746 bp, Homo sapiens
ctataaaaggggaactcttcagaaacacgcccgggggttttttttggggaagaattgggggccttttaataaccttagccgggaattcccccgggggggggggtttttcccaaaccccctaaaggggcgtttaaagggagttccccaaaaaaagtccttcccccactttttgtcttgaaaaaaaaatttcctgtttcccacccaccggaatcaggggctgtggggcccaagggagggcaattttatttttctggggggggggcaaaaaaaaagtttaagctcccccctttcccagttattccccctcaattacccctttaggtgccctttaaagggccccgcccccgtagcaactgtttttcaaaaacccccccttttaagtgaaatgtacaaagcttcccctgccgggtgatcccttccaaaagaagaatttgaaaaactttgcccccaatttaaaatccctttaaaattttttttccaaaacttaggggaccctgttttcccaaagggtttacctttaaaaagatccttcccccctcataagggtttttaaagtcggcctgccctttttaaggggatttaaagggttactggcccttttccaaaagtttttttttttttgggggggaaaatcataaaaatggcccttttccaccttttaaaaaaaaaaaaaaaaaaaaaaaaaaaaaaaaaaaaaaaaaaaaaaaaaaaaaaaaaaaaaagaaaaaagaaaaaaaaaaaaaaaa

SEQ ID NO: 10695 - DNA, 1602 bp, Homo sapiens
  misc_feature (1)...(1602): n = A,T,C or G
gcgagctccgtnaccgacagatgttcgacagtctacacgcggctagatgtactnagngtgttgcactccggacgtgggtaagatagcgctagatatgtctgatatcagccacgtgatgtctgntgtgactagtagatctgtatcggccacgcntatgagtatatgcagtgtgtacaagtggcctgttgaccttacgatggtcgggtgtggcccagatgatacaatgatctcactgcgctctttgtgcagctattcggtagacaatcgcagcacggtgcgcgccgtaagcactgacttacgttgcgcacgacatctgctcgtccgtgacgtcgcctctccgttgttacctagagtccgttgagcacctcagctcaacaaacgtttcggtgtccgtggtgagtgacagccagttcgagcatgattcttcgtcgcgcacgtgacagtgtattntgactatcnttatcgactcgcgtcaaccatactcttcgtctatctatgacgcaatgatgagtagtatagtgncttctctgcgtaacagaatacgacctattttctctgttactcactgtaatctnctactctggctcacntatcgtnctatgcgtatcgatagcgaacgtaatagattcgtatgacacgcgattaatatgtcacaggtcacatacgacgtatcgtattatnagatattaaccacgangatntgttttatnanctacgagatatacatcgaacncgagatgctcgcantatactctagcatntcatatttatgtgctactctcatctctgttatattatatccgcntgatctctgtgtcgagctantacattgttctagtctgcacttacgtctgtcgngtgtcgtctgcgtngttagtagagcacacatcagctgtgtagcgctgtggagtgttgagttcgatgcgcattcacacgtcgatcacgcgcaccgtcactcgccgacttnagtatcgctacacggcatatgacgcatactcatatccaggatcgacgtgttgcacaccgtttctatatnctatatattacanagtaattncgactgctcatatctatttatncgcncgcactatcncaatcgtcatagtatatattcatatctaactttttnatctcactccgtacgctcacaccgtaatgctcgctaacattgtatatttcaatatcaatactatactcgagtcactatgatgantatatttcactgagcatgccgcgccctcgncgcttagagtatcatgttncttatagcgcacgctcactagcgtccgcgtcagtagtgagagtatcatccgttgtgtgntgtcgacgtatgctcgatcgagcgttaagcatatcatcagcgtctatacgcgcattgcgagccgtatgcantcagctcgacacgttacttnacnacagatatgtgtgagatttnatccgccgcntggtttgtgcatcngtgttaccgtggcagaagccgatagtgtcantgtgcgcctgccgcacgtatatgtgtatgactctatacgcgtgataagccgacgaggtntgaatcagcctgtagtctaatgctgcgttntatcatatatatcgaacttagcg

SEQ ID NO: 10696 - DNA, 1738 bp, Homo sapiens
  misc_feature (1)...(1738): n = A,T,C or G
ggggtctcttatgacagagttatgattttctatccgagacgacgacaagcggagatccgacgattgactcgcancacaagagcacgctgacacgagcatcagactatcatactancatatcantagaaacataccagtacgcatctatcatcaaactcataatccctganctgangaatcataacctgctaggatgattcctatcagtacgcacataatacaatgtgatnatttagcgacgaatcgcacacagatatacgcatatgtgtcatagcgnagatagattcgcaggccatcgagagctatgtggatacctagntagttganagcgcacgccgcactgcatgatgtagacggtactatgaagtagttgactgagcggaggtcacgatacgtacgtcgattgttccttcgagcaatatgaacgcactcgtatcagcgctacctctacttctccttacgtgtgcgtcnccgagacgcaactacttcagcatcgacacatatcgaagctccatatccgactcagcgtctcatatgctcgatgacgtgcacgccgnctacagtcacgcgccgtagttgttcgggtaccatagactgattgacagatacccatcgatgatatcgagcgataactcttcgcacgattacgaaaccacagataaactcgcgcgcacgcagcagctgtcgatggtantcgagcagctattcgagcgcagacgcgagtgcgtcgcgactgcgcgcacgccgtgcagttatttacgtcgcttactcccagtcgtgctgtacacacacgngaactacactgaacaccaatctgttgctcagtcatgataacatatattattaacacgaactcttagtatattacacgagatcgtatgcgacgcgacatcatgttcgtacatgctctgtcgatctagattctntgcgcacgcgatgccgtacgcgtcgcagagtgtacactgtgttctttatacgagtaagagactgtcgataatactgtagtcgaacgtccactctacatataagaatgaataatgttacgcganactctgtatcgcatatgaccagtgtgtgacgtaatcgcgactcgtcgttatactcgactaatagtcgtgtgacgtagnccgatgtcatcttatgagacacgcgccgcgagcnactatgacgagacgagccgagttgcatcgtnacagatgatatgtccggagcgccactgtcacctgattgcgtactcgcggcaatagatatntatgctatgaagtacacggntagacgtagcttaggatgtctctatgtgagctatcgtcgcgctctcgtcgcgctcatccgtctcgtncgntgtntnattcgcgtatgtgagtgttggagagtacggcgctggcgatcgcagattgnctaagtacanactacgtgtctcgattcntcatgctcacacgatacgcgacgancccgatatatcactgccagataagacactacgagtgcgactctcacgtcttatgagtgcaccaagctagcgtcactacancgttncggtatcgccgtgtatgccgcgcgnatggagccattactgagagatcgcgcgtacgcactcgtgcgtgctgantacaattcgcgcgcagcgcgtcttttcgatatattattccatgtatcacgcatgacatcgcgcgcgtgtgcgatctcggcgtcgatatacgangactccactatcacgcacagagcgcagccatancac

SEQ ID NO: 10697 - DNA, 551 bp, Homo sapiens
gttgagacactgaagacttcttcccaccaaagaccactgatgggaccagccccagtgaaactaaggtaaagcccagaaagccaacagcctgtaatgatcatcactaccacgggcacacattgctgggagatttaaaaaaagaaaaaaggacagacctacactgagttaagaagtaattccagaatgaactaatcaaaagcctaaatgaattcacacagaagacctggctttctgcctgccttttcaaataaaatcaaagttcaatgtcatcttttagttccggaaataaaagtaaatatagtcaaatcctctagaaattttcactcaaaggagcaaaattttcaaaatgtgacagaactacttcttgtcaattttactatccaaaaactcaataactattttaaactaagaagttattaaatgagagaagacaaaaacagtaatattaataaaccgttttgtggcaatgaaataagtttttatagattttataaacatgttgaatatttggtactaaataaagtattttaaacattttaaaaaaaaaaaaa

SEQ ID NO: 10698 - DNA, 748 bp, Homo sapiens
tacttccaaattccttcttctacaacagttagaatgacattttaatagggtgattttgatcacatcacattttgtaccaatcttctattttttttttaaatatccaaaatctgtaggcggctctactatgtcccgaagaaaactatcttgccacaccatcctcctttactcccagaataacaatcatgccagagtgtcattttttttccttaaaatttttcatagtcccatttggcttatggctttttcacatgatttttttcctccctgaaactctgttaaaaaaacattttatttgcccaagagctacttgatttccctcagtttaaatgctatttcctccaaaaaggctttgatcctcacttcagtgactatatgaaagcatgaatatttcttcaaaaccatttcagttttcttgtatttggggcacatggtgagattatagtattctgtcttaaagagtataggcatcatcatgaagcttactgagattttagacttttacttcttacctggaattattatttaattttattcagtttcacaagcaaagatttgatcaccactagattcacctccctaataagttttactatcatattatggcacaataatttttattatggcatgataatttttacttattgggtaattgcttgtgatatttgcagaatgctgatgtccaaaatcatcatgttttgcagagtccaataaaatatggtagattgggaaaaaaaaaaaaaaaaaa

SEQ ID NO: 10699 - DNA, 791 bp, Homo sapiens
  misc_feature (1)...(791): n = A,T,C or G
tagggaagaggaagataattttgtcttcacccctggccaacacagacatacatgtagagaaagaagcacaagggccatgaccttcaatcctgcctgaggaattgatctgagacctgggaagttctgcaagaaaaatggccatttcaaagactgcgtattcctaatgatgcagtttcaaaatcatttttgaaggcagaaagtacttcttttttggaaaatacaggtgaaagggtcttgaatcagattaagctaaagaaaaatacaaaatggcagggttcaggacaataaggagattatattcccctgaatattaatgcaacatggttattttatttgaggaatttttaaagaatgtttttagctttccttgtgtctgagataacaatttattaaaggaatcttgaagcagattaaagaagctattagagaaattatcagctatctcttgatacctaataaagcagtttcaatacagaaagccaaggctaagggggaaataaaactccctggttaagaattctttgttccagactttggaaacagtattatgtgatatatgaagttatttgttctgccattctgtaattacttttacctccatcccatcttctacttttaacaattaaagaattatgatggtgatatggtttggctgtgtccacacncaaatctcatcttgaatttccatgtggtgtgggagggacccagagggaggtaactgaatcatggaggcaagtctttcctgtgctgttctcatgatagngaatgagactcacaggatctactggnta

SEQ ID NO: 10700 - DNA, 1241 bp, Homo sapiens
  misc_feature (1)...(1241): n = A,T,C or G
ctgtactatcagtcgctcatactagccgcggtcgacacgttaccacttacggattctagttcgatgggcacgtgcgtctngatactcaatgtattgcgaccgcacatccgacatgctgtccactactataatagcacgcgtgtagatcgctgctttgttctgacttctctgactgcttanancatgggtatagtattgtactctgctggagcttgaccgtcgatcacgcctcgatgtctaacgcggtgtcgttgtgtgcgtgtgatatatgctncgcctgatcttagccgctgtcctacgctctgctctggcgcagctgcgtcgtcgatggctccgtacgcgcgacgtgcacgtagcgcgccatgtcgcagtctgcgtgcagtgtgtcacgatatagtgtgactgtatttgtactggtgtaatatatgacactgctccctctcancctatctctattattcaggcttctatctgagtctcctagttcgcacattagtactaaatacgcgcggatatcgcaacgagggatcgcagctgaggacgtgtcgacgtgcgtactgtggtgcactatatgagcgggcatttcgacactctcgcgcggctgtcaatggtatgcacactagctctggtatcgtctgtggtggcggttgtacggcgcgtgtcggcgcgccgtgcgaaggtcgatgnttgttatctatgtatcactctcgtcactgagacgtgggtcacagtttatacgtagtgcagttcagagcgtgtgcgggccttggaccgtcccgggtcatgagtacggtgtcttctattgtattgggcaagtcctcgctcgcgatcagtctagcacaagtgcgctagaaacgtagtagtgatagtacgttgtctcctgcttctcttaaaaaaaaataaaactccgtcgttggttttgttgtcttctcgatacgatatgtcaaaggtctgcgatcgaactccgacttctgcgacctcggtctactggcagcgcttgggaggcgatatgtgtttatggtagagtgacgctcatgaatancgatggcgcacgtcgacttctcaccttcgtactgtattgtcgcatatagggcgtgtcttcttcggtccctaaattcctctcttcagccagaattcaaagntgacgggatgntgttttgttccgcnctcacgctggtggggttcnagtcgcccacgaggtatgtctcccccnttgccggtcgtaaatagtgaactcaact

SEQ ID NO: 10701 - DNA, 1165 bp, Homo sapiens
  misc_feature (1)...(1165): n = A,T,C or G
ccgcctggcttcgcccaggcgccgcctctcactagctcgattgtgggcgcggcgccccgtgagagcgcaggggcgcgcgcgcgggcgccggacgtctggcgccgctcgcacgcttgcgccatactttctgtgatgtctgttgctccttaggccgccgccccttcggcggtccgtgtgtcctcggcaccctctttctcctctattatctcgtcctgccgtctttgtccgctgtttggtgttagatgcgtgggggtggtgcgaggagtgcgtacaaggtgttgtgttgcctgataccagcctgccttgcactttagtgctctgatttttttcttgtggttcgttgttcttttgtgttgcgggggtccggcncgggtcggccggtcgtgtgcgcccggncggccgccgccttccngcgtgtggtccgtgttgcgcggccgcctgctnccgcctgcccggtgctgccttcctcccgctgtccttcggcgcctgggcctcgccctctgccttcgcgccccggggggctcgtctgccgggcggttggttttgtgtgggttggcgtgttgcttttttctgtcccctcgcctctgntcgcttgtgtctcgtccggcgggttgtttttgtaggtgtgcggccctgggggcggccttccgtgggcgtccggcttgcttgcgctttgtgcgggctgtggtgtgtctcgggccgtccgttctcggctctcccgtcgctgggcgtggcgcgcgtgtgcggcgcgccggcgtcgggcccgtgaaaaaagggctctgtgtgccgctgcttgtgtctcccttgtggtcgcctggtgctgctctgcctgtgttctcctcgcgtcgtttttgtcgttgcgccgcctgccgctccttcgcccgttgcgcggccgcgccggcgcggcccgcccgtctggcggncggccgtcggtgccgctcgcctgctcccgtcgcgctgcggctgcccctgcttccgtcgtgctgctcgccctcccccggcgcttctgcgctgctcgtctggcggcgccttcntcttcctgttgctttccggtggtttttgtcccctgcgtaaccgcgcggcggtgctcgtngctcntcggcaaccgtcgtcccttgcctctcgagcgttggggttgtgtcgatcctccgctcctggcgttccg

SEQ ID NO: 10702 - DNA, 832 bp, Homo sapiens
cctacacacaccacccccacataccccgccgattaaaaaattcctagggaggacgacttgtcgttgaatacagcaactcaaagcgtctgcaggctgccaaactcacagatgcacggggaccctctgaggctgtcgaggccaacaacaagattccctgccgggcttttacatcactcaccctgaggaaataataactcactaccttctgcatgttcttatgatagagttctccattcgagcacacaagagccctcttatcacaggacactctagcccttctctgggtccacgtaactaccattatcagaccatactaacccatatttatcgccaaccacgcccccagactgataacaacacaggattccatacatgggaaaagacacaaatgacaaaacgatctcacacctgaccacttcaacacacaacacctaccctgcgaactcactaccctattatcccgcaacgaccacagacaaccccccccgcctcccgcttccccaccgatcacgcctccccccccgcctcaccggaccaccaataaccacccacagaatccccccccaaaaaacaaaccacacaccgacttctccgctctccccaacgcacccctccccaaccatcaactcaagcaaggattacaagctgatccccacccacccccctgccagacagtccaaccccccccccccctcaacccaccccctttcccatcccacactaccacaccgcactcccccacatccccccctcccccccactaactacctcccaacctagccccctaacgacccccccccccacaccccccccaccgccatcacccacatac

SEQ ID NO: 10703 - DNA, 1651 bp, Homo sapiens
  misc_feature (1)...(1651): n = A,T,C or G
cactctctagtacgatacactctcagtatnctncntcnaactacacngtgatnatctgtcatatacgacactcatcatnagttgcgacctgtaggtgcggtcatagtcagatgtgctgtagtacaacactcctctctgnancgcntgtacgcgcgtcnccatctatgatcgcctcgtgctacatattgntatngtgctgcgacgtcactcacgctgcttttcatctgctctacatagcgtctgtgtgctgatcatcactcngacgagtgagtanaatcatntctcattaatcctctnctgtgcgancgtgctcgtcgtacgacgagatcgatgacgagtctactatattgatagtagtntntantcgactgcagcagtatagcacgcgacagtacagtntacanagtacgtntcgagctgtatatacattcgcgcgcgtactctcgacgactgcatagtcactcgagcatgctgcgcctcgccgagancnctgtcgtcacggtatctatacactagtgtcacgtgtcttctgtatagctncgatgcgaacacatctgctacttcgatatgctgtaattcantcagtcgagcacgtgatgctcttagcgcctagttcagccgactctcgtgcgcaatcagctcagantttcacgtacatacttatatatctntgcgacgtgcctgcgcggctagtcatgtcgatagcatctataacaactcaacgantttattgacgtgcgtacctcttctcctgngtangggctctgcgttttgcgtggaatacagctctcacacagtcntacgagttctagtgtgactactatatntgagcgcttgcattgtcgttacttctatctactgcgtacgcgttatgcaggtacgtagtgtagatacctccgcgcctgtgtctgaccatnttcatatggcgatgagtgtccgctcatgatgcgaacgatgagggctgtctgcccttgttgtgtgatatcgtattcaagctatcacacgctatgtgattccacagacgcgacctctaactatcancacacaatcttactcacttagaggttcaccagactgataagccattcaccactatcactcaagcatctcgcctggagtgtcaactcnttctagtcatcagtgtcttcccgccaagtataatcaaaacgatcatggagcgtgctgtagccttcatagcgatctctctcctgcgctagtgcgcgcacacagangccggagtacgacgaagagtgatagagtagaagcacttgtgtctgtcagactgccacgacatctatacatcactaggatacaaccgangtctgtgcatattgtcgaagacaacttacgtagtgcgcatgatccaatctttgtgtaaccgaatcttcgtagggcttaattatttctcatcagcaatacgttgtttctctgcgacatgggtcttacacccgtgctatcgagagttgcgctgctactgcggtgggtgtaatgtataccaatccataagactaattacatctgtgtatatataataacaagaataaactactatgnggtctctgttccgcnctgacgcagagtggttgttctcgtnttgcccntcagtgatgtttctctcttgctttctttacctaatttgtaaagtcgctat

SEQ ID NO: 10704 - DNA, 1872 bp, Homo sapiens
  misc_feature (1)...(1872): n = A,T,C or G
cgcgcgtgacgcgtctgtggcgtcgtgacnccttcgcgtctgtcgtnacgcgcgtgtgctatccgcgctgttgcgtnggcgtcgcgctctatgcatcttcttccgtgcgcgcgtcttctcgcgcgtctgcggttcgtcgcgtgtntcttggtcgtgtccgtntgttagtgcgtgcgntcggcggcgcttctgctctgtctgcggcgncctgcggcgctggctcgcctgtcgctcgctcgtgtctcttccgctcgtggatcnttgcgtgcgntcacgctgcctacgcgtgttncccgctcgtgctgtactcttctntgtgagcgtctgtcggctcctcggcgagcgtcatggtgtgtnggaccgtcgctctctgtngtgcgcgccgcccccgtcgctgtctctcgctcgaccccgtcgttctcgatgtctcacttccnctcggccgtgagtggtcntctgtgcgtcggctgccntcgcatgctgctctcgtcgtcgcgcttgctctctcctgcgcgcgcgcgtcgtgtcgctcgcgcgtggtgtgtgctactctcgtctcttccgctcggtgcgcatgcgtgcggtcatctcgctgcgttgtcggcgcgcgcgcgtgttgtgttcgctctgctgcgagcgctccgacgcgcgtaccctcttacgcgtgcggggtcgcgcccgcttcgtgccgtgcgtcttcggntgctgtccgctgctcgcgcttgtcttctcgtacgtgctccgngtgtcctcctcgtctcctcgtctngtcgctctgtcggtgctcttcggctttccttctcttctgcgtgtncttgcgcctcgtttcgtgctcgctcctcggtcgttgtcgtgccgcttctggtcgtcgtgcgtgtgcgggtggggtgcgtgctgtcttctgtcttctccgcgtctctcgcgcgcgtgctggcgtngtgtggntngcgccgtcgcgtgctgcgctgtctctctgctnctcgtctcgctcnctgctctccntcgttgcgctgtctctcgctctcgttgtctgcttctcngctgctctctgctgctgtgcntgntnttgtccgctgtgtntcgtgtctcgtcgcgtngcgcgccggcgccgctgtgtccggcgctngntgtgcgtngtcgtctntgcnggcncgttgtgtcgcgtcnctgcgncctacgcgcgctctctcgttcgtgtctgtcgtgctgcnctgcgcgtgcgtntccgtctgcgctctgctcgctgtctnttgcgcgntctgctcgcgtgtgtcgctgtcttctgctgtcgtcgttgctgctgctgtcgtgcgttcgtntctntcnctgtgtcgcgctcttcgtgtgcgcgcgcctggcgtgctntntnccgctcgctgtgctcgctcgtgcggctggcggtgngcgcgcgtgtctctctngnctctcgnctgcgtctcggtgcnggcngcngtgcgcgncttggcgctgctgttgcngcgcgggtcgtctcttgtgcgtctgncgctgcncgctgctgccgtcgtcggtcgcgtngntgcngcgtngctggctgtcgcgtnctncgctgcgtcgctcngctcntctgtgtgtgctgtcgcgtctgctggtcgctcgcttgtctntctcggcgcgtctgngctcttgtngtctctcgtcgcgcggtctttgctgcgtctcgcgcgcgcnctcgncacgcgccgccgggccttcgctgtgtgnngtntggttcggtctgcctctccnggtgccaaccccgcgctgtgtgtntgcncgcgtgcgctgggtcgcnctgcgtngtcgnccggtcgcatngtgctgcgcgcgtgctcgcagcctcgngctgtctctgcgcgctcntgctcgtgcgga

SEQ ID NO: 10705 - DNA, 934 bp, Homo sapiens
  misc_feature (1)...(934): n = A,T,C or G
cttatgttttctattcgtcgttcgcggagtcgcggcacacccggcgaatgacgtggtttcggtccggcgagcggaggcggggtgctggtgtaaggaggcggagtagaaacgtcagcgcaacgtgaacatgctactctcggctgcagtacctacgtgtgtgtatgaatccgccggtcgagcaatggaactcagtcatcgcgcgcacgccgcccgccccgacgcgtctgccgaggcgcgggccatgcagccgggcataccagggacgagagggcgggcgacagggagacaccaagacgcggcgtgggtgagggctggggggcgcggcgcgggggcgcggggcacggtgcgcgcgcggcgccggcgcgngggcgcactgtccgcgcggcgcggcggcggggcgtggcggggtgggcggggggcggcgcgggcgggcgcgcgcccgcggccnctcgccccgcgggccggcgcgcgggccggcgcgttgcggcggacgcgcgcgcgcccccgggggtgtgcggtgcgggctcgccggccgcccgcgcgcggcctcccgcgcggcgcccggcgcccccgcgggcgccccggctgncccgcgccccggcgcgggcccccgcgccgcccgcccccgccctccccccgcgccgcccccctcccaaaaaaaaatcttttcttttttttcttttttttccnnncctctcttccccccncccccccngcccncncccgcccccccccctgcccgcccgcgcgcccccccttncccccctgcccctccctgccntcggccccgccccccccnccccccnnnnnccctctntcgccctcccccngccccaaaccctctctctctttccccccctgccgccncttttgtntcnccgnaaaagcgtcagngtcgtncncgtccagttttttttttttttttttttttttt

SEQ ID NO: 10706 - DNA, 1425 bp, Homo sapiens
  misc_feature (1)...(1425): n = A,T,C or G
ctccgttgttccgtcgtgtgtgttcnctgcgcgcgngtgcgctcgtgtgctcgttggttcgttgtcgcgtncggcgtctcgtggtcttctttccggcntntngtgcgcgctctcgtgttcgtgtctcgtgtgtgtgtgtgtgtcntntgtccgtctcgccttctgcggcggcgcgccgtcctctcggctcccgtcctcccgcgtggccgcggcggccgttcgcgctggcgccggtgcgnctgctcggctgttgtcctgcgttcctctctcgctcgtcgtgcgcgtcgctggttnttctctctctctcttccttcgtctccgcgtcgtgtctcgctcgctctctgtgctccctgcctcgggtctcttctcctcgcttgttctttttcgtccttgtttctgctgtgcggtggcgttgcgccttgtctgngtcgtggctctgtcggcgtgttcctctcgtcttctgttctcgcgccctcgtgttctctcttctcgcgtcgcgtggtgggtgctgctcggcgctcttgtgtcttctcttctgtgcggtntcgcggccgcggtcggtcgttgcggctgcgntctctgtctctctctccggtggcgcggtgctctccgtgcggttgctcctgccgtgtgtntgctctgttctcctcgntctcgtgcctctgtgttcgtcgtcctntgtgtgtcggtgctggtgtntgggtcgttggtgtgcgcttcgtggcgtgtgctctcttnttcgctctcgtctttgtctcctgcttgcttgtgcgcctgcgcgtcgcgtgcctgccctctgcctgcgctccgtgtcttgtcgccggggcgttgggcgcgtcgcgcgcggtgtcgctgnccttctccgtggcgcgggtctgctttccgtcttgcnctcgctccgtcgcctggcgggcgtcggtngctgtgcgcggcccgtcgtccggctcgtcgtcgtctgcgcctngnttggtctgcggcgcgccctctttgctttttaacaacaaacacattntctgctntttccttntcgctgctctctcgctcntctgcgctcgtgctctcctggtgttgcgtcctgtcgncttgtcgtccctgtcttctncgtcttcttgcccgttcnctcgcctttctcggtcctgctgtgggtgttttcttggtcgtggcgccgtgcccgttggtccgcggtgccctgcccgtgctctctcctgcgcggcgctctcgggtcgngcgcnntccggcggttttctcctctttcctccttctcgcaacantgtttgttctntctctctcctnccccgccnnnntcntngggngngttgtnnggttncnttcccnnntnaaaaggngnggtggggtgttgcgttggaaacaaaaaacggagtgtntttctcccgtgtgcctctgctgttttctgctgcctccctc

SEQ ID NO: 10707 - DNA, 1796 bp, Homo sapiens
  misc_feature (1)...(1796): n = A,T,C or G
cctactctgtactgatctcgatngnngnggagtctgncctctacctccagtgcttactagaggtgcgacactcgtactctantcgcgctgctcgngctgtgtgtgcaggactagatgngttcagctctatgtgnacatgtgcgattcgcgcgcgagcagtgctcngcgtccatgacantgcagctctncgtctgtcgggaggttatagctgcgtantattgantctaggcctctcgcgtcgttgcgcgtcntgatgtcggtcatccgctatngcngtgnnctgctcgctangctatatcacantgcatcacgtgataccgntctcnacgtacttagacgacgtgggacactcgacatcgncccgtcnacgatcancactgcgcacgactctattcgnacatcgntcgcgagtatcattcggcatggactgcgacgtcgactgncnttcagctgcgaggcatngnttctgatctatcgtcctnacgatcgacncncatctgtgcgtctcctacgtcttacgagctgcttactccagtgccacatncctatatacatcattgccgctgacactgcgtgatgcctctcagtgantcgtgcgtctatactgtttcgnctctacacgcgcttantctctccgaacacgaccgttagtacgctgtcgctangacagtcgtagttacgatatcgtcctgtctcatgcgtggctctgtagctcgacgatcacntatgtctgatatactnacatatctacgttagctatctgacancgtatantgtgacgcgatacttctcagtcanagtctcgtgatctccacgcgtccgtatgcgtacgagtcgttgcacanctcgtgcatcatggacactgcgtcgtagtatcgccnacgtcagtcacttcatcctcttgttnnctgtagttgcgtgtgtntcctctatgttgtcatgtccgtctgttagcttgctgcgaggcgagaactacactctctccntcctcgtctcatgttttctctctcttcccgctcgtccgatgctcgtgcaggtcgcgcgtatatagtcctctgcatcgtcatactctgcatgcncgtggctcgcgacgtcgtccgagcgtggcagcaggtcacactgacggaggtcatcacacgtcctgtgtcgtacactcacattcgacctgcacacagggttatacccacgagagcatatcacgtcaccacagcgctatagcatgccctcagaccgatcgngcngcggcagcgctatgcgtatcagatatacatgcgctgtcgcgactgctactgtgctgtcgtatgtatcactagtatcatctacgtgtactnagtcatacacagattatntgacagcgagtgcagtgacatcgtacgtagtacgcgctccgcgcacgacgcagcttcactcacgtatctatcngagcgccgctcgttgtgcgtgtagtgactgtctctcatcancgccacgacaggatgttaagcgcgtggcgcgtacgttacactgagcactcttcgcatatgcgctatcgtccgcatctgncgtacatgtgcgcgtctttcccagagangtgtattctncntcctataaacatcntctctctagtgctcatactcaccgctacacatatatatacgcgtaggntngctattgtagcggtttcgngttcgctccttctngacgngtctgngtngngctgntntnngcgttgctagcgcntctccgaacnggttgagtgtctcngcgcctctcccctcctctcgctgacgatcagctctgagagacctatgctccgg

SEQ ID NO: 10708 - DNA, 1472 bp, Homo sapiens
  misc_feature (1)...(1472): n = A,T,C or G
gtcgtggcgcgcctgcggctcctccgtctcgtctctctccggttctctctcttgtcgtggctcgcgccttcacagtgccgtntggtcttttcgctctccacttgcccgtcggcgtctctcgttgtccgcggccggtcgcggcgctcgttctcgcggtggctcttctcgcgtttcgttgtgctttcgccggcgcctggctgcgcggcgtgcgcctgcgccgctctattcgcgtctctatctcttcntcagtgcgcgtgcgcggcgcgcgtgctcgccgctccgtgcgcctcggccggcggcgcgctctcgcgcgctccgccttctcgctgcgcgctcagcgcggncgccgcgtccggcctntctgtgttcggcgtcgccggcgtgctngctcgtcgttgtcgtctgttcctttccttgcttgtcgcgtgcgctccatctgtgcgctcctcgtcgccgcgtctcgcngtgccgcgggcttgagctgtgtgcatctctctntggctctgttcgctcgcgccggttcggtgcgcctgcgctctgcgtgcctttcgcttcctgcgcgctgttcgctatctctgccgtctnctggtcgcggccgttgccgtctcttgcttacatcttgcgctgctgtgccgcgtatcggctcttctgcggtcgtctgtgtnctgccctgtttcgcttctgtgtcgctcctgctcttgttgtcttnggtcgtcgctcggcgtctgcctcgtngccgctggcgcgcgtggtgcgctgtctgcggtgcgcgtcgctgtgtgtgtcgggctntgcgcgcgtgtgcgttcgcggcgggtcgttctgttcgtgcctcgcctctctcgttcgctcctcgttctcgctgccgtcgtcttccccggtcttctgcgcttcctctcgccggcgctttgcgctcgctcgtttcgtcgtctcgcctcgcctcgtcccctccccggcgttcgcgtcctgntgtctccgcttctgtctacttgtnttctgtccgtctcgtgctgggtggtggtcgccgcttgttgttcgtcgtcggctgcgcctctcctccgtcgcgcctcgccgcgcgccctgtcgcggttgctgcggcgccgctgtcgtcgcctctgctgcctcgttcgttctctccgtcgtgtgtttgncgcgcgcgccgtcgcgtgtcgctggctgtgtggcgcggtctcgcctncgctcgcgtctccttctccgttctgttctcgtctcccgcgcgtcggcgcgcgtcgcgctcgtgttcgctgctgtctgcgtggtgggctgccgcctcgcggcgttctcgctctcctcgctngttccggcnctgcgcgcgcgtctcgccgtcggctcgccgaaccacgcggtgcgtcgcgctctgttggtcgccgggtgacccttgcgctgccgcgcgcgcgctctctcctgtgttgcctgctggtcgcgcttgctagccgcgcgcaccgtcctcc

SEQ ID NO: 10709 - DNA, 1648 bp, Homo sapiens
  misc_feature (1)...(1648): n = A,T,C or G
acgaggacgagaggacggggtcgtcgcagacgatctagagagatatatgatctgcatactacaacgtacatctgcctatacatgtgatcatgcgatatcacaagcgtgaaatcgagatagcgacagcgcgtgacgacgctgtagatngtacaccgtaatgagtgcgntcatatcgagacactagcgacgcatgcagnagtngcgtgtgagcgatcagcgtgcatcactacacactatcacatatcgactcaatgcacagtcgtgcgagtagtctcgatagaaggtggctagtagtgtgtgcaangagttatgatagtgcgtgctcgggacgtagcgcaagcgtcgagacagagaggtatagagacagngagagaagtgngngaaattctctacgagagcanaacagcgcatgtgtgcngngatgatgtgtgacagtggagatacgcagtagatgtatcgaagtgatgatacgagcgatcaatagcatacaagagacgggatgnggtcgtaggagagcgcattcggaccaagatgnagtagcgcgcgatatcgctctgtcgganantcgtctccatacatntntctcgctntgtggacacactctcgatactgtancgcncctccagacannagacagatagacacgcgcgatgcacaacgcaacaccgacatccaccacacncacacgaaggcgagccgcactacaatatatacacactgtactatcaacnacacactantcttctactccacctcactacacaactcgtaacntctctacatantctggnatatcacatgagtctcttccatcacgacangtatgctntaacgttcgcatacntcaatacaaacaactacgtaagtgtangatcgcatcagacggagagatagtcagtctggtgagctagagaagttagtagacctaacatagtattagtatatacagagacaaagatacagtcacganactagatggatatgacgacgcgatgaagatcactcggagtgacacagaagacatatataaccaaacactcgctctctcttggatgatcttctctgagccacgagaggagcgtcacatgtaaacataacataacaanacacgcagcgaggtaggtaataaccaggatagtcaggcgtgtactgacgtgatgtctcattttagcatgctgtnnagctcatcggggcgtctgttcctagacccaatcgctaacacaatgcgccattatagtaagtcggtattgtcaatgtgaggccagccgggccgaagcgaggatgccactaacataatacggcaccacagtataaacttcactccgatactcagttggtcgcgagacctgggagagaagtgatagcaggcgagcgaagcgcggcggcgactgtggtgtacctgtacagtatcatagagaatgtatacgtgaccgcgcgtgtccgtgagttgcgctcaagtctcggaagacttggtgcacggcaaagcgacacactaacgacacttatcaaataaataataagagaggtggcgcgccatattatccacacacgtcgtccgcgcgaggttacgaatctctatacgtgttctagtgtcagactacgatcgctgcgtgcctcctgccgactcacaagactatcgcctgctccc

SEQ ID NO: 10710 - DNA, 2273 bp, Homo sapiens
  misc_feature (1)...(2273): n = A,T,C or G
cgcgctctgcccgcgtctcgctctgtgcagtgtacgtctgcgatgctcgcgcgcctgtccgggtttcgccgctgcgcttatctcgcgctccgattgtgggtgtcctcggtntgatgtgctgtggcggtggatgattctccctcggcgttgcgtcgtgtcgtgcgtcctgctcgtctggatggttggtctcgctgccctgttctctttcgttcttctactgctgtttgcgncgcgtcgtacttcgctgtgtctcgctgctcgtactgttgtgttcgtgggcgcgcgtgcgccgctcgtcccgtgtccgtgcggtatcttcgtgctgcgcgcgcgtgcgctggtgcccncgtntcctcgtatagtattctcctagtctcgtattgtcgctctacctgngcgcctcgtgtccgtgctcgcntggcgtcgcttcgcgctcgtccgntatcgtctgttcttgcttctcttcntctgcgcgctgtcgggtgcgcgtgcgctgtctgntgctagtgcgtcgtctcgtattcgtgtngcgtgtntgtcctgtactngtgtgtcgcagnctcgtcatcngtactcntcntcgcngacgctgttagtgctatncgcncacagcgtcgtcgtngcgcacgtctcgccttgctcgtctcatcgatcgcatatcgtatacttgacgtgtgctacgtntagtgcactgacgcgtcgtctgnatgtgcgtgtgctcggtggtcagngatgtgctgcgcgcgcgtaggcngtgcgntctgtgctgccgtcgctgcgtntctatgcagtgtcgctgagccgactncgcctcnctgctgctctncgcggctcgtcnccgctcantgctgctgcgtatgtcgtnctatctcgtactctgttcgtgctgctgattactgntactgtctgactgtttgcacgcagcgtatcgcgctgnttcgncngngtggatcgcgacttcttcgtagtacgtcgtgtcgtcgncatncgcgtcggcangtgcgtcgctgccggtcgcggctcgctngtcntcctctgctgcatacgctgcgtcacgcngntgtctgtngtgcgtctctacggcgctgtgcggtccggtgttcgngctgtnngcgagtttcggtgctgtgttatgtcgtcgtgtcntgtnntcgtntcgctctgtanctgtgtcnctgtncntgctcntgtngtctcggtcgttgtgtctcgntggctcagtcggatctcggangctntgcctcaccgttccgttgctgcgtgncngtgcnganctgtgatgggactttcntcgctgctgctaggctctnctgctctgtanntgtgcgtcgatcgagtctctctcagtgtgtccgntccggtcggtcgtctgcgcgtgcgtttgcgtctctgcgttgcggcgtctcgctgctgcgtcgtgccgtgtgctgttgntggtgccctgcgtgtcgtgtcgttgtcggcntgncgggctctctctgcgtcngcngctggcntcngctgctcngttctgcgngttcntgtnntttggcgtgtgctgcngtngtctnctccgtntcnttctnccgcgntncngttgcctcgctggtcgctntgtccttctgcntcgcttgcggtctgcgcgtcngtntcgtcgtctcngcctctgtnntttgcttgcgtctgctgctccgtcgtttgtcgctntnccgctcggtttcgttgtcgnctngttgcncgngtctctgtcngntncgtgngtctggtcggctcgngtngtgtnccgctcgtcgtncngtntncgnctcgtgctngtctcngctcctgcttcctcgctgtgctgcncgcgctgnccgtcngccgnngtcgttgtccgcgttcatgntcngcccntntcgtttggtcngctngtncctgctggtcgtctcgntngctncgnncnngggcngcngtcgtccggtcgtcnctntctgctcgtcgtcngtntcngtctggtnngcgtcgtttcgtctncgtgctgctncggtcngnctncngnttacaaaancagcgtnnctgctggcttnggcgctcgngcngncctcnnnntggttttgtngccngccccgtncnctctcgngaaaacccncnctactcgttatgctgctnntctgctgctgtcgtctctgcacgcgttcgtctntntcgcnttgctgctgtcgcagctccgnctgactcgtcgactgctccagcatcgctgccttgactcagctcgacntacntccgtctgacgtcgcagtctngctgctgctggc

SEQ ID NO: 10711 - DNA, 187 bp, Homo sapiens
  misc_feature (1)...(187): n = A,T,C or G
cgggaaggggagaagagagggcagagaggaagagagagagggagaagaagagagaggagagagagaacgcgagagggacaggaaggagctttctgtcttgaggcgtggagacgaaaaacacaanacaacgcgcggaggcacgcccgagcgcgagagcaaaagatcgaaacagagagacagaacaagt

SEQ ID NO: 10712 - DNA, 1573 bp, Homo sapiens
  misc_feature (1)...(1573): n = A,T,C or G
cctgacgncgcatgtcgaacgtgtgcgctgtcgcngnnangatctgacgangaggtgctgcgtactagcaatgnaccatacagacggantacgcgtcgcgnccgctgccggacacgcgtgtcagcncggcacactataacntacagtcgnacntngacgtgnatcatcgctggtanagtncgactcgctggagtgtggagtatatgtgatcggcacatgtcnaatgaancatgaccancgtngcgatcagcaacatgtgacgagtactgatacagcgtcagactacgtggcgtcgctancgcgtactactcgcaagttcatatcagctagctgacatgcaggtanagtctacgacgcnacgtcgangangancncgatgcgntcgtnancnacagcccgagtgatcgtgtctacgtacnaggtgagagtatgcaggatcacagtgtgtccgaactacacgacgccgcgacatcgacgctcgcgtgccctgcgtgtcgcgagtcagcgcgcatcgtatcgatgtctgcatcgctacnccaacgcgcagttctcagtctattgtagtcgtgtgccatggtcgcgcgtgcgacgctttcagcagtgcttataacgcatatatggtgtcagtnctcatgcgtgtcggcgaattcgtacagcacgcgcgcgcacggcatancatgattgccagngcacgggttgtgtggtgtntctcgagacgacgagtcgagggcacacgatatactgcgcgcagactgcatcgattgtgacagcgtgtgatggcgacgtcgttatcctgcacgatgctgcgatgtacacgacaagagtacagatcntcttgctatacttgtgtgtatcgatcactcctgaggcgcgcgtctccctcgcgtatatagttgttgtagagctggatcaaagtccgctcatccgacgcacagcagactctgcttctntctctgtagcagatcgtaatatgcgtgtgtcgcagcacaggtacgcacgccggcgcacancttagcgcacagcgatcagcatgattctgtgtgtccgtcgcgccagcgcgtctgtctcgcgtctccatcccggcaacgagtaggtcgtangtgacgcgcgctcacggcgcgcgcgcggcgtctagtctgatcggtcctatatgggtgtgcctgacagtacacaacgatacgtgcagtcttcccgcgcaccgccacgcagacacacgcaagactactgttgcgttctgccctgatatcgtcggataccctctgttggtccgaaattccgttgctgcgcggcggatcaccatattaggtgtggcagaatcgcagtacgcgtcgcggtatcttcttgttcaacggcgaggtactgagagaggggcacggccaactattgtgtgtcgattgttgtatgatgtgtgggcgtgagccaatctgctttcagaagagctcgaccattacttgataatgaaaaaacaataaacatgatcgcttcgttgcgcctgcaaacgtgtggcagntgntgtttgccaccgaaggtagggctcgtctcgctgctcggggctaaaccgggagagcgcgcg

SEQ ID NO: 10713 - DNA, 1215 bp, Homo sapiens
  misc_feature (1)...(1215): n = A,T,C or G
ggacgccactcanccgttcgatcgcgccggacgtncacgagagctcgcacggcgcggggcgcagaggtcctgtgtngccgctcgcctggctgccccgatataagcctttcactcctctcgtgcggctagcactccatcggagtctggtggagaatgatgtatattctactttcactcgtactcgatatgtgtgtnctttactcatcaccagctggacttatgcgggatctgtgcgtacacgcgactcttcaggagccgcgcctgccggcgttcctcccagccacatgtcttgcgggtacgaagagagtaattggtttcatacctcacgtcattttatcttgctaatactagttatattaaccgagtgggggcgaacgggtgggaatttgtccatatctcgggtgttgcctctactgcttgaggctcgtgggtgacagtggtgaatttgtgtgtcgggtcctcatatgcggtatggtattagtgagatttgagcctgctcgggttgtgtttcaaccagtcagcggaaatacttataacgagtggtaagttggaaggtctctcctccatgcacgtatcaaatgttcttaattgaatgatgacgtgctcgctctgttcgtcggtattctatatgaaggtcgtggcaccgcgagccaatatcagcttctgtagcactcacagtgcgtgtatacccggcgatacagagtagtctggtctattcgctcaaggtaatttagccggcactggatttggcaatatccgcagactcctgtcacaaaatgacatgaattgtccttatcggcttagaacggcgaaattcgctgtttgttcgacaatgcaccatcgtgtgctagcaatcattctttagattgtgagctcttaatcaagaatacagagttcttttaagaaggcacttatagcacttattgtgtgtacacgttatatgtatcaactgtagtgatagtacttcttagacgtgccacacgtctacantatatatagaccaacgtcgtgtcttgtggctgatgtcatttggatagataagacacaatatagaatatatanatgtgtcttctgctgtctgcgnctntcacaactccgggtgtgctagnntagtttgcccgctgctctgaccnctgtgttgtgtgtatcggtcgtgggtcgtagctgcgagtcgcgctggcgtatcgctgaggccgacgcgtcgccagtcttgta

SEQ ID NO: 10714 - DNA, 1712 bp, Homo sapiens
  misc_feature (1)...(1712): n = A,T,C or G
ccggcgctgcccgcagtacagagtttgcgtattatctccctcgcatagcgcacagcttgtcgggtgtatgagcggagtcacggngtgagcgaaagacacttgacgaatcagnatacgtangacagtaatgttgtagagaggctagcggtagacgttgtcgcgancgcgtcgctgtgtctagtcgattctccagcnagcgcgcgcctccatacgctgaccatctgcactacaccgcacntcgcctcgcagcgttgttgagatagactgttgtttaaggatgtgagcaataggantttcatcgccgcgctgctatntacgtgttcgatgcgtgagcgaagaggtctcctagtctattagagatcatgtcgcacagcttgtcacggcgcgtcgatgganantgaaatacaactgcacaatactcctagtagacagttcacggtggtatgatgcgatccacgcagctntccaacgcttcaccagagaacacaggatccgcgtaacactgctcctcagggctcgttagtcccgctcagtgacgcacatgcgtccatcttatcggtctacgattgcacgattgtacttatctgacatatcgactatntgatgttnctatctaacataacaccntacattgctgataaatagaagtcgcgctatgtcttacgtcgtcgtntcgcgtctcgtgcactgactgtctcactcgatgcgtagaggcgtcgctacccacgcgttctttatctagttattatatatgtatagagtgtagttcactcgttagatctgatttgtgtgtcgtacagcgacattgtgttgcgcgcagaggagatgacaggtgttctcgtctatangacgacgcacgctgngaatgtggtatcacgagtgtagtnantagaccgtcgagtagcgacacacgtacatnctngatacatgtctntgagcatctntcatggtatctcgctnaactgaagtagtagcaagaccgctgcaacgctcagctcgtagtgtntgtctatcnatagagtcgtcatcgacgctggcgagatgcgtatacgtggtgaggtacctagtcgtgctgtgtagcgttgtgtatcacctaagtcantacatataatagtcgatgnctccgactgatagcacacgcatgccactgcaagtacacacactcagatgnagacctcgatntagcacactctcacaganctactcgccgacgcgggcacgctcagtagacagcagntcgtgtgctnctcgtgtgcgtcgaggcgtcatcccttacgagcgcgatcatgcacaagacagccgcatacagcagcgacnactgcgcatgagtgctacatggacgaacacgangagagcgactactcgctcacatcatctntacgtgagtctctcacacttctctncagnccactacgcaatntgtcgnacctctagcactccgcggangcctctcangcntaagtactgctgtatacgtgctantgcgagctgagtcgtcccgtagtatatcgtcatantgnagcatctatactgatgacacactcgcattcgtccttctcatcgtgctcgtacgagtcactacgcatcttcttcgaagacgacactctcacgagctctccnntatcgagtctntcagtacgtgatctntctctagttntcgtgctatgactacgtgatgtgatntcgtctgcgtgcggcangcctacctgacg

SEQ ID NO: 10715 - DNA, 420 bp, Homo sapiens
tggatactggtcttgtcgtacgccgcacgagagagccctattagaaacaatgccatgttaactcagttatcttgtgaatattgaaaaacgaaccctaaagtttatattggagagccgaaaaatgcaaaagagccagcacatattgaaagagaagaacaaagtcagatgattgacactacctgacttcaagacttatgataaagcttcagtaataaagacagtgtggtctggacaaactaatagaactacagatcaatggaacagaacagagaacccagaaatagatccacataaatatattgccaactgacctttgacaaataagacaaagcaatacaggtagagcaaaaatagccttttcactaaacaaatgaacatccacattcaaaaaaaacaaaaaaattggcctctttggcctca

SEQ ID NO: 10716 - DNA, 859 bp, Homo sapiens
ggcgggacgctccccggtcggggcgcggacgcgagggcccctcaaagggacctggctctgttttcagctggaactcagtggcatgatcttggctcacttcaacctccacctcttgggtgggaaatgattctcctgcctcaacctcctgagtagctgggactacaggaacacacaaccaggcctggctaattattgtatttttagtagcgacggggttttgctgcgttggccaggattgtctgcgaactccagatctgaggtgatctgcccacctcgggctgccaaagcgtcgggattacaggcatgagcgacagggcccaagctgaggttaacgtaattggggaatactcatatgggcacagcgacaggcgactgagtattattatggacgatcaaccgacgagcacgctatcatggcgggcaccaggacctcgggattgggttacctctgatagctcgcatcaggggccatgacgcgcagggcgggggtgggtacgggtgaggtacgcggagcctccgactagcgactgcgcttctcgtcggacgcagcaacgcactccccgccagcctgcgacaccgcggcgagccaacgggatgcgctggcttccaacaacggcgcgacgcccgaaccccggcacgccccagctgttacccccctcggctctcaccccatacgcggccacgtgccctcgggggcgcggtgtcagctctagcccctactaccggggaggttgcctttagctaacgcgcggtggaaggcctgtggcctaccagtgaaggggctgcaggacagtgttttagcgccattccccgggggggggccgcgtcctggatgcacgtgtcccgcgatgtggggtcg

SEQ ID NO: 10717 - DNA, 995 bp, Homo sapiens
  misc_feature (1)...(995): n = A,T,C or G
atattgttttctgttattttgatgatgtgatggggggaagtgaggtagtataaatgcgcgacacacgccgcggtgggcgggccgcaactatcagagagagactgacgagaggaacctgcacaagacgacgacggatggcgcggcggcgccgataagtgacgagcatatgtgtgcctgaagcggaggatgagatgcgtnagacaggcgagtcggtcggatgaggggagcacgtgtgggacgcttatggagctgaggagaaggcgcaagcacgccagcgacggatgacgacggtgggcgaggaagaaagagggggacgcgaggcgccggagcaggagtggacggagggtgaggggggcgaggcggtcgaggtgagactgaggtagggaggtggaatagagacaaacgcaggggcacgggctagcgtgcgggtcgtggcgaaacagcggacggggtgaagagagagaaggggaagagagatgtagaggacgagcggangggtgcgtgggcgcgccgcgcgcccggcggcggcggccggggcgccgcgggctgcgggggcgcgccgtgtgcgcgggggcggcgcgggcggcggcgggcgcgccttgaggcccgccgcggggccgcgggcgcccgcgccggcgtgggggggggtgggtccgtggcgggcgggtggtgcgggcggtgggggcaaaaaaaaattctttttttcttttttttgttcncttgggcggtccgcccgcgcnccgcccccctgcccccccccggccgcccgcccgggccgcccggcccccggccgcgccgggccgcgcgcgccccgcccccgcccccgcccgcggnnnccccgcccccgccctcnccccccccncaaagtttttgcctcgcccccccncgtctcgcgcccntgtttccgcgccgaagcgcngggccntgctnctnnttaggncttccacttttatttttttttttcctcacccccncnccccaccacccttttcttc

SEQ ID NO: 10718 - DNA, 914 bp, Homo sapiens
cttacacgagtgcaataaccattacatcgactgatgtgattgacatgattgggagcgtcatggcgggatgggggtggctatgtggggagctagggacgaattgatatacgacacgcaatgcaacaaaggcgcgcctcagctctactggatcaaggcctcctggatcacgtggcgatgatagtggttcggtacgccagaactcctgctacttcagtgtggtgcgtccccacatactatcctgcccgcgctggcgtctgcatgtgattatcgagctacttttacctacattatgttcatatgggagttagaacaaagtcgtggcgctaaaggaatagactatgtggtgatacgtaaacacatatgagcattgttggaagaggaatagaaatggtcgaaggatgggccgtgactgataaccgggcatccgcttaaggtctaccaaaggcggagctaagaacctgatcgcgctgatcaagcgactcttggcggcgaatggggaaggcccactgactttcgggagcgtcttagtatggacataagtacagcgggaacgtgacgactaaatacaagatatgggaataggcggacggggagaattaggaagacagaataaaaagacgcgcggggtgaaaaggattattggggtgagtgcggatatgaggtcgtgtccttgtcggggggtattgtcctctagtgccgatctcactacatatcgtcccacattcttgcgtgacaggatgtatgggcattctttgtctctgtggctttcctctacccgacgttgtgatatgacattacgaatacatccactgacagagcgcatggtgacgggtcctcgccgagaatacaaaatcccgggcgttgatcaggttgtggggggctttcaaagcgggatgcgtggagtaacgattatt

SEQ ID NO: 10719 - DNA, 1500 bp, Homo sapiens
  misc_feature (1)...(1500): n = A,T,C or G
cagttngatgatggagcattcnaatctctcgtctcnatctaccgctatcatcatggtcatctcagacgacatcgctgcggcgctcaaacgtccactagtatattantctgccgagtggtgtcgacacttacgtacgattantngacacgctcgtgcatgacgctcggcgatatctatcatgggtaaccatcacgaatacgcgtcacaacgattgtgcgtgcccagttatagcatgagagtgcagatcgtgatggtgaaagaatatagactgtagtcgacgtgaatcagtgcgctcacattagcgtcatcgtagcgccataacttatctcaacgtaatctaattgtctcactcacaccccacatcgatcgatcacaactgacagtganagtgcagagggaacactatagtccacgtcctcgagtgggtgcgcgactcatcatctctaccaacaacgcactcaccacgctctctacatcgcgcctacaaggagacggaattagagctgagaccggtgcggtctcgtgtcagttgtgtgtgagacgacatggtgcgtctatctaatatcgactcagaagtgcggtgtcatcgcgcgcagagcgcgcacgcgtgaacaatgcagagacgccgacactgaggccatgatagctcgactatactcacatctcatcatgcggcgtatccggatagctgagctatcgagacggctgtattgctacgtcgacactgacatcgacgtatcggtcgtctatgcgactgacacgacgcgtgccggcgcgtggcgtgactcgccgaggtgatcgctcttcgtgcctgatatgcgcatngatgacattgaatataaaggtgtaagtaagtgtgagagctgatagtcgataggctagcggcagaaaatatgtagagcacgcaagagtnatacgaagacagtcagtgntttcgacacataggagaatggagaggatacaccgcatataagatacgctgcgcggggggacacantagccgacgcgcggaccgaccgtccggcgcgcgacacgctagtgatacgcgtaagctacagtgtcacagcggtagtgcgatgttttcggctgtgtgttgtgcagcagagcgtggagcaggcgacgatagagatatattgagctggagatgattatgagcgcatggttagtgacttttattcctattctgccatgtgcttactcaccgtcagacgtcggcgcctacgcgaatacggaacggtgagtggttggggtcacacagcggtcggagcggcggtaggtatcggctaagagagaatngattacgagcgcacaaacgcgtacatcgatctctactccgtgctcacggtcgtgagttcggctgcgcgtcaactgcaaacgatatcaaatttcggagctagccgggcgtgaataatgatcagcgaccgcgaagacggccgagtcgcgctctagatagtgataatgaaggagggagtgggcctgtaaggacagtcggaaccatct

SEQ ID NO: 10720 - DNA, 1367 bp, Homo sapiens
  misc_feature (1)...(1367): n = A,T,C or G
aaaatgtggcggagaggaagntaagagctcagtggtcgtggatctcgtgtactcagtacncgcagctaccgagtgagcgcgatcatagcgcgatgtgagagctgagagaggctagatcnacagagcagaggccgtcgtagatngcgatgtgtganctgcggtcggcgtgcgagcgtcnagtgcggtgctagcacaaggtgagtggtgtcagacgtttgagacaaatacctcacacatactcagtatattgatcgtgaggtcagctgtggtgacgagatagaggagggtagccgctagcanggtagccgaaagtgagagaaagtggtatgacatcaggagcgcacgtcgtaggctgtagcgatngtagatagacgtagctctacgaacactgaacgcacattattggcgtatcggcgagtcgtagagcaggtcatatggtatgagcgttcatggaacgaagacctcgtgtcgggtgtctgaatatatcggcgtgatggtactggagaacgttggtgtgtcgcgccttgcacatgtcttgcgcgtcgntggtgttgggtgctttgagctcttgcgagggcgcgtggcgcgctatcgcttcagcgttcatcgtacgacttgtgcatcgtaggatggcgacgatattgtaagtcaacgtagcaccgacatcgatacgcnagacgcgcgtccagaccacggagtacaccgtgggccgtagaacgaggcgagacgatacagcgctattcggatagtctagtggtcgcggtggatcttgggagggcgagcgagcagctgcggggtggacgagggagtaccgtatccaccgcgtcgaagctgcggcatcgaatactcgggcgataagacgagcgaactttagataatataattatcggaagttggaggataactaggaggaagtagagcgggggagcggggagagacataagagataggtgaaggtgcgtggacacacacccacaatggtagtatactaggcgacgtgcagcatatacgtatctggtgcgtcgatacgtcacctagacganaacacggatcaacacgtagagacatacaggtaggagatagtgtcgtatgctcgttaatgtgtgagtgctcggcgtccgattagtatatcctttggtgacgcactctcgtaccttatagcagaaatccggatacaaggaggatagacggagatcagcggggggacgctgcactgatcaggagagggtaaggggacgggcgtgacatgtaggcacattactacaaaacgagcggtggtagataatagagaaagtttagttcgcgtggacgcgcgcttagcaagatacagcaggcagcgataagaacggatgctgtcagttgcgcgg

SEQ ID NO: 10721 - DNA, 325 bp, Homo sapiens
cgagattggaaatttacaaagaaattcccgtcaatgtgacatattcttatctccgcaatattctgactaggggtggggctgtgaaacaataccatccccttttctcttcagctctgcaaaaggacagtcaatgacaaactgctagcacctaagaaagctggtgaagtgcagtcaaatggaagatgattaaaaacacagcttgtcaacataatctgcacagcatcatatgcgggggatcttatactgtgtatcaagattaaaccttctctgatgatactcttttgtaagtaataaaattctgtacccacagttaaaaaaaaaaaaa

SEQ ID NO: 10722 - DNA, 1706 bp, Homo sapiens
  misc_feature (1)...(1706): n = A,T,C or G
atcgtaccatcatancgtaagtacnanagtacnagtcacgnaanacgacgtccgagcgacgtaactnagcaccagagatagtacganacgacgtnatcgtgctgctntctacatctnacgtgcgtactatcgacctcagacgacacacatgcgagttactgatcatgcaactccgttnnagtcaccgagcgatctcactntganganacgntngagactntagtggtnagtnccgtgagtgaatctacatgctncngcgtcgtctgacgtacggcgcanctnacgacaccacgcgangatcgtcagatgtgctcncacatatgctgagtgantatangggatgaagtagactagctatgatnactcagagtgctattacgtcgggtatctcatgntcncgttgcagncagtngancatcgnccgtacggatacactgtcacagcactagatacatgtacgaccatacagctcagagatatgatancngatctactatgcagctcgtcgagtagatctanatgtcgacgtgtcgcgtcactagtcntcgtcgtcgctnataantcacgacgaanngngnacncnngnacgcgcatagcacagacacataacgcactgcacntcacggtctatgtcccgcaggccgtaacgcagctacatgatcgtagagagctcgcactccgtttctanggcctgtctcctgcctnatatgcncctctatctgctcatcatngcgcgcactctcangagcatcngaacacagccgcagtngcccgtcactctcnccagacgcgacgcgcacgctctancgcctcatgcagtcgttactcgacgcgtcactgtcgtcatgactcgctgctccgtgctaatgtatacncgatgactcggcngatcgctgatgctatatacacattcanatactctgatgtcgacgtcatctcagcatatctcaccgactgattagacgctcagatacagactatgtgatacgcgtcgccgactagcgcacagtgcgacttcgctacactcactactatgcacgtacagancaatagaagagcttatanancagcaaatctcgatccgntatgtggatgatacactntcgtagatcgctcgcgcgcgagtctcgtgtgantgcatggttgtacggaaagtagatcctgangtnagattcacatatatcagttatacgccacgtgcggatggatcatacaactgactaataacgtangcagcgactagtagtatactgttantacttacgtgcagactccatcaccagtctagttactaaatgaagagagcgctactaactcccgtctcactctgcacccgccctctggtacatcgtatacgagtctgtgtctgcgtcgcctgttgtgngctaggtacgcgcacgacagtcgatccacgacactctgtctcacaacgatgtcactacagtcatagatatcgaanatcatagtgctctgcgagacgatacgttgtgcggggtgcatacaggagtcgcgagaggttattagggaatatcaacacgtaacgtagctcgagtcaacaaatatagtctctcgtctcgtcgcgtcactatatcatcaactagattggcgccgcgatacaggtgagctcgagtacagaactgacaccggcggcgcgcatacaatctcacgcgcgacgcgcgacggcggacggacttggtctgcactca

SEQ ID NO: 10723 - DNA, 907 bp, Homo sapiens
tcccgccccatcccctcacccacacctcgcccaagcagaagagcttattgggaacagctgcctagttttaaagaggcaacggcacacgcgtcatcgcaggggtacctcctgattcccaaaacctgggaatgaaccctatgctgctactgactggacctacctggaagggagctatccttggtggctttaaaagtaaagaatgtgtgccaaaacttgcggctgattctatggctaagaagctctcattggatgcattactaacccatgttttaccttctgaagaggagtaaatgaaggattagacctgctccactcgtgaaaaaacgatccaagacgattcccgaggtcaccagacaatgccagatggttagcacttgaggcgcccattgaagcctccccttaccccacattcaccgcgtaccaccctctggcgaacgcccatcactccgcgcccgattataaaatcgcctgcatgagcacacctttcgggtattattgtacatgtaggcgcccatgttgttggcgttcgtacctcggcgcaattgatatccagccgcagtcacgactgaatgagaattgtactcactagcaccccccacacgtacagcccactaatttttggttactagccacacaatcaatgacaagagcagcgctcgacacaacaaaaaaagcaagccgcccgccgcgactcccgcccccccagctgcaccgactcctcccacgcccgcctctgcctgagcctaatccacccccccccaagttaggcagccatgagtgcctgaaaccggtctcagacgctacgatcagaatccacacgattcccgcccgcataacgcggcaccacccttcccaagacaaaagcacccacccacacacgacctatgatgcaaagaacaccccgccg

SEQ ID NO: 10724 - DNA, 2246 bp, Homo sapiens
  misc_feature (1)...(2246): n = A,T,C or G
tattgtacagtgcgcgagtaatcatgcgtactanctctactatagccactcantancgctagctnctgctcgacgctgtcnggactncaagtacnattcgtcatcatgnctagcanactanctntactcgtactcatatncggtgcnctagtctcgtanctcaatncantggtcanatctgctcgacagtacgctctatgatagtaatgagcatangtcgnagantctctcgatnacagngtcatcatntactngtnctcgacgacgttcagctngactgtcnatanaactcacatcatcantaactccgtaatagtagtntctgtangctantcagcagtcatagtctcgaacactntcgtatgctcanttagcgntagtctgtacatcagatacacatntgcagacgcgctacctgcacatgcaatctacgntggtnancaagtattatctcagttgntantagataggtcgcgaanatcggctnaatagactatcancgcgctacancactctgaaatgatntcggatcatactntacgtctcctaccagtgatgtcactcgtntccatcgcnngtganagagtagancagatngtnatagagtanngagattagtgtgaattantangntcatgctactgatcagtgtntcatatanntaccangatacgatactactanangtgcaagangagcaacgtgcgttagtagtactgtgtagantgtcaaggtagatgnagctcatatctaacgtcatngcgatgatcgcgcttatagtagtntatgatgtctgangatgtcaagtngatatgtacgngtnatcanatctgagcgaggatatgacgcgtgcgtgtgctacgngtntagtacgtctacatcatctacntagcntcgcgctcacgactactagcacagatcnagagacatgctntctacagatcactgtntcgtcgtagatatattacctntgancangttgatagtgtctgtcggtcactcancctcttcatcgccgcacaggcgcgcntgtgtgcngtcgactgatgtgagtatatgcaatcatataggtnagtgtnacgtctctacgtcagtancttctaacngacgtaacgtaatacacgtagagacgtcactatacatttanatgatnctagantacagtcatcatgctcgtcagatcgacgtgcatgancgctnacgcgagagtaggctgacgtcnatatgagactgcgtcnttcgagtcacncacacatactgtgctccanangacttntagttagtacgcacagantcatacatgacgcttgcacgacgcgctgagngtgagtcgntactncatnagatgtntatnantctttgagttctgaagtgtagagaagttagcactnagcaganattgatgntgactggcagtgcgtcggtgagnggagtntcgtactactgacgcgacanacgncntncanctcacccctgctcacganactgactcantnatcatatagacnancactactctccgctnacntntatccatctangcatcgtatcgctacantacagtgatgacgagtcantctatgatctgatcgcgcgcatcgagtgtaatcntaacantcactcgttatgctgcagagtagctctcacactnttaacagtctcgaggcgatcgatactaagtagcacattatgtatacatgtggttacgtgagtcgtacgagngatcacaggagagatctgcangnatcgngngntcaaggtcgagcggcgagngtgtgtangtagtagtatctgagatacggcatgagatnagcagttgangcacatnatctgctagactgctacctnacgctagncntcactcactcgtctcgtcagnacgcacctcgtgcgcctcgctggatggtcgacngcagagatgactagttgcncantgttcagnatgtagtcgcacatcagtgcgctgcgcatcactncgcttncngtcgagctggtngctggcaggagnctgctcgtcgcattgacatacgtgctgnctatacatatcatancagtctgaactgcgangcgataggcgtcgtagctgcagngttcaaatcaagagagatgtattagantcacgtnccagtgcgtcgctcgtgcctttggctcctgtcgtctacngtgcgcacgctactagcagctcctcatcgaccgagcagtcngacgagctgatgcagatnactgcgtgttttatgtatctgctg

SEQ ID NO: 10725 - DNA, 1325 bp, Homo sapiens
  misc_feature (1)...(1325): n = A,T,C or G
ctgtncgtntttctctctttctccctgcgctgtcttgtcttgttcgctgcgtctncgtcgtcgcgtctgctgtttgtcattatgctctgcgtagttctgctctccgcttctctgtcgcgcttttgtgttcttcgngtctctcttgtctctagcgtgtgccgtgtgttacgtcggcgatctccgcgtgctctctcctcgtgcggctcgctncgctcgcggcgctcgctcgcctctctcgtctctcctgcgtgccgcgtgngcctgtccgtctctcntttctttnttgtcctctatgtcgtccgtctgccctcggttctcttcttgctgtccctcttcacttctcccgcgttgcgccgcctcgtcgagctctgccgtgtctgtcgattgngcgttgtgtgtcggctgcgtctctccgncagtccgtctcgcggtccgcgcgcgtcctcgcgtctcccccgatctctggtgtgcgcctcctttgcgtctccctttgcgctttcttcgctgcgctcgtcgacgtcgtgtgcgtccgtgccgtctgcgccgtgctggtcgctcctgtcggcccgccgttcttncttctcctgtgcggttgtgggtcgtgtcacgtcgtctgcgtgctgtcgtgtggtctgggccgttttctcttccctcctttcttctgtgtggtgggtcggcgtcgctcggcggtcgcttttgctcttgtggtggggtttgcgcggggctcgncctcgctttctgttcgcgttccgcgtgccctcgggttgttttttcgtgtttttggcgtcgcgtgcttttcctcgttttctgtctccttgtttgtcttcgtccgccgctgtgtgtgctctcgcttctgctccgccctccgcgccgtgcgtttgggtggcgcgtgngcctggcgccgccgctcctgttccgcctctgtgtgtggtcctcgcctcgctcgctgtcgctcgcctcctcgtgcgcgtcggccgtgcgtccttttccttcccnctctgccgtcgcgtctcggtcgctttgtcgggcctgttgggtccttttgctctcgctttgtgcctcgtgcgtgcgctcggccgcgccgcgctgtctcgttttctgcgcctgcgctgggcgttccgtgggccgtgcctgtctcttttcctgctgttggttgtttcgttgctctgcgtccgtctgttctctgccttcccttctttcttgtcttctctgccttcttgtgtttttgcccctctctacgctcgttgtgttgtccgtctcccctccgagggttctttcctgcgtgctttggttgtccgtcctgttctctcttctcgcttcgcccg

SEQ ID NO: 10726 - DNA, 898 bp, Homo sapiens
cacgccactcggacaactactgtcccgaccaaccaagaagcttagggtaaacaaaacacatgtttaaccaaactcccggctgattttatggctaacaagttatcattggatgcattaatagggcatgggttaccttttgaaaaaataaatgaaggatatgacctgcttcactctgggaaaagatccagtaccattctagatgttaagagacaatgcagatgttttccattgtggcgagattaaggctggtgtaccgtacctgatactgcaccagaagatgggggaatataataaccgtgtgatcagtaagacgattttcatccacaaatgaacatcggaggccctccccccacgccttagacaatgataaaatgaagattaatcaaccacatggtccccccttcaaggtatgaacttgtacgtagtgtgtgacatcagacggagaggattagtatgccggctatcgcttagctgttaggcgtgataaagattaaaaaactgcccgactatcacaacccctcagcttcacgagcctgataaaccctcaccctccacacacagtggatatgattgatgccgatgcgcctgcaaggaaacacgtcaaagaaagcgtgagaagagcaacaaagctagatgtgattgaagaccgcgatcaacggtatctagtcgcatcatgtggatgtacctccacccagacggcccaaagcccgaaccgagctctcatctcagcgatcgttaatcagaaccccagtatagtttcagtactagaggcaaatatccgcttccatagaatgattataataccatgaaaacgcacccccacttagacatcatctcacgttttattgtcctatgagcatccccccccgccagcgcattctagtatacgattcacaca

SEQ ID NO: 10727 - DNA, 1774 bp, Homo sapiens
  misc_feature (1)...(1774): n = A,T,C or G
attacgtcggagtagtgggctgagagcgcgatagctgtatagngacgtgtgagtgntgntgcgcgagattggtgtctacgtcgccgancgcgtcgcagacgttgtgcgtctctcatcatagcagcagagagcagcagtcgtggtgtcctctatatagcacgancacctaaaagactatatgagtgactancggacgtacgcgtctcgatatagatgtcgtagagatagtagacataaccntnatcgctatatgagtgatggtatgnagtctgtgnagacgagacagagtcgctacgnctagtanccgatgtgtatgncnatttatatctgtagagnacgttacatagtgtncggctagaggntagtagcagtagacgatgccgctagctcctgacgtcgtctgtgtcgcgactacacgnaggtngcagatcgtgtgtantcgcgtgtgtgtngggtactttgagntacgnactgcatacaactatgcaggaggtagacgagcangagcgaggcacgcanctcgcantncnccgcatcctntggcgtatgtcggcgcatgtacctgtgcgctgttcacacactnctcncntttagctcacangtgcntctttgactctcgcgnatncntatacgaaatagtagcacacgtcatatcttagagtaccgtatgatcacngcgcancactctacgcntcatggagagnacggtgtagnagntnatgctngtctcgctgtctatatcgntcattcagcntcacgcactctctgcgtgcagctncctgtgtccctntctgtnttgtctgtcgncgacgagcgtgtatatacgnatgtatacatcatcgagtngnntacatcantatatntgtntgattaacggtgatgtcgcgttgagttatatattgcntgtagatcatcgtcgngtacgatacgatgtctctgacgagtatgacgagagangcaagantagagacgcactcaacgagcnacaccacctaagagcacaacacagagagagctataacgtctcgcgcgtatttgccgtcgcgttcagcatcgtgcctcgaggctgcgtgacgttcgtgtacgctctttcgcggcgcgtgtgcactgcgtcgctagagacggagacagcgctcagtcgtggcagacacgttacgactacagttactataagatgtacgtgtggaggacacaactacgcggcgatactcatgtgggtctgtcgagtggatatactgttacatagttgaagacgcatcaaaatatagactgctgatctcgcatcctnacgtcgacacttacgccgcggtcgctgtcgtcgcgtaactcagttgcgatggtctctgtcagtgtcgataatggcggaaccagacgattgatcacgatcctttcacatatgctgatgtatcagaacacgaatactgaggtgcatattgacggtgctgtcgctgagcagacatcacgcgctgcgaacttttgatcctacgcacgtcaatgacttgtataccaccaagcgacactccaccattgatgtatactgcggtctacttatgtgagcacacatatgccgccgccgctctccaccactatcatggatcgtggtagatgctatgagcattataatggacacacgcaccaacataatctaagtcactcgcgcggccgtgcgatctgtcgagatcacgtacgttgactgcgtacagtggtgtatatttgtatataagacaacgagttatcttgatgcgctcacgaagtagtaggatcggagtatggt

SEQ ID NO: 10728 - DNA, 1517 bp, Homo sapiens
  misc_feature (1)...(1517): n = A,T,C or G
ccgngttgttcttctcgtatcgctgttcgcgtctgctagnccggtcgctagcgcctgcttgttgtgtgtgtcgtgtgtgctcctggctnttggctcggccgctcgcntcggcatgccgctctcgtggcgtcgctgtcttcttcgcgcggcgtggcgtggtctctgctcgtgtcctgtntgttccgtttctcgttgtatcgttgntttgtcccctgtgtcgcgtgctgtctgctcctccagtgcgcaggtgctctgtttgttctncgcgcacctcccgtcctcgtgtcgtcttattcgcctcgcgtgtcgcttgctgctgctcggtccttctgtctgtcgnggcattgcgtgcctgcttcctgtctctctttcctccttctgcgtgtggtcgcctgctctgcggcgcggtgtcctgcgtgtcttcgttgtgcttgtcctcctgtctngtcggtggtgcgcgtgtgctctgtggtgtccctggccgnggttcgttgtcgctcctcctcntgtgcgccgctgttcgtccgcttctcttcggtgtcgctgtcgcgcgctggtncgtgtgtgtgtctcggtctctcttcgcctctggtgcgcgtgtnggtctgcctctccgtgctctcgcggctttgcgggtgcggtgtgtctcgtgtccgtgtgttttgtcttctcttgcntccgttccgcggcgcgcgcgtcctcgcctcggttcgtcgtgtgtcggtgtcggtcgctgctgtcggtcgntctgtggtcctcttgtgctggtcctgctttctcggttgtngtccctgtcgcgtcttcgcttttcctttctgttgtgtcctgtggtggtcgttcctttgctcctcgctccgccgcgtcttggtcttttctcctctgctgcgtcgggccgtgtgtttgtgctctgcctctcctgcgccgctctcctctctctnctctcggcttcggngcgcgcccttctgnccggtcgtcgtgtgctnccttcgtgttcggtngtgctcttcctttggtctcccctcttctcggntcgtctncttgttcctccgctgtccctctgctcccttctcncgtcgcgcctnccttcctcgncgtgcntgctgtgcgcgtctccgcttccgtctgtgtcctgccttgccgtgttgtgcggntgctgttgctctgttcgtcgccctctgccgtgcgtctntggctctctgtcttgttgtgtcgtcgcttgtgtcgccgngctcgtnccgtgtcgtccggcgtggggcgtgtgtgtgtgtcgcgtntcgtctctcgcccctgtcctcttttctctgttctctncccctttctgtctctcttcctcttctntctntnnttgttgtgggtctctgcggctncgtgtncnctaaccgngnctgngtngcgngtgtntcggttcnctntctntcnctncacgcgcgtnttccttctctgcttgtnctcgtctngttgcctttgcctcttcgtcttcatcttcgnctcactgctggctcgattgttcgcatcgt

SEQ ID NO: 10729 - DNA, 1090 bp, Homo sapiens
  misc_feature (1)...(1090): n = A,T,C or G
ctctcttgttttggagatgcgagtttctttttgtgatactgttgtgtctctttgcttgtatgtatatgggtgcatcggtgtttgtatcgtgtcgcttcgacgagatgctgttttctctggcgtgtggtgtgttgcgtgttcgtggtggttgtggtcttttcggatgtgtatgttcgccggtgtgtgtcgtctttaccttagctgccaggcggtttgctnggagngcgggccggtttctgctgtccgtcctgggcttgtgattatgggattgtgtgtgcatgtatttacgctccgctataccaacgcggcacacaacgggtgtttaaccntcgacatatatttcatgttattgtcgtgcgcgtgtgcacccttaacacctgactcgcggctaactacattcgcactcatccttaacatcactcgtcgatctactctngcgacgcgctgttctcgtcggtaccgacgtcttcctgtacctctgtatcggactatacgagcgacgtgctgtgttgtgcggtattcttgtcgcggggcgggacgacgccggcgaggccgaggcgaacgcagagcgagagacgcacatgaccgtgtatctgcatggttttgctcacttctagtacgacaacgagcgngttgctgcttttcgttagtctcttcatgatgttccctcattgccgtagttcgtcttctcatgttctcgatttgtttctgtttataactancttaaaaaaaatatttctatttttatattatttcttatattttaattcattttattattttccttcatttctcattatcttgctatcttccacttctctcttcccttctccctctctgctcccgcttcttcttctctctcctcctttcttctccgctccttctcttcttccttctctattcttctaacagcgatattttcattttatttttcataaacatttcatatttctttcttctttttctctattcatntcganncggttaanttcctcgngagcacattncttttcttgttatccttntaggtttttttttttatttttctttttttatttttctacttttcttcatttttttccttctctat

SEQ ID NO: 10730 - DNA, 259 bp, Homo sapiens
ccccgcccgcccgcaccctgccgcaccccccagagccccagccgaactcattgctgacgtgttgactggatcacctgtggagctttagtcctgtgataccacctggaaccacaagtgaggacacagcaagaagatgatcatctgcaagccaagaagaggggtctcaccagaatcctataatgctggcaccctgatattttactttccaccttccataaatgtgagaaataaatgcctaggccacccaaaaaaaaaaaaa

SEQ ID NO: 10731 - DNA, 929 bp, Homo sapiens
gctcctgtccgttcggcgtcccgccgccgcaggcagcgcagcgtccctcaggtgtacctcgacatccattttgacccactctccaggatgacctgtgtctgagcatagagtttcagagaccaggccatgggcttggcacagttaccaagaatggtcttttggagtttttcagaatggttggagtttctcagagatacgttctcattgtttgattttcttacataatatgtactcccttgagacactgtcttgctatgttacccaggctggagtgcagtggctattgggggttatgatcatactgcaccatggcctcaaatttctggattaaacccatcctcccaccttagttaccaggactacacgcttacaccacaagagctggcggactctgtttactcctgtttttaccctactaggcgttaaactgctgtcaaggccaggatttagggccgtgccccactgtcgtaacatatgcgcctccctcagtgccctgccccctggccgcacgctgtatttatgtgaccgcaacgttcgatgttgtttttgtttattataccgcgatataacgcatcgggtctgacaccgcctctataatctctctgacgggtctagggccgccgcttccgctctggttcgaggggtcttattccctccaccgcccccctcacccttcctttcgttccccctctccgtccgttcgcgcttctccccgacgcggtgctcccgcttcgttcagtcgccccgtcctgcccggcctctcgctcgtctccttattgggattaccctcatgcgccaatctctgctccgacaagatgacctccgtttatgtgtttcgaccccctgcaaccgtcgtcgccgctcacactctctcttcttcgcgtctctcctgccctcccgagccgttctcctggaattgttggggacgg

SEQ ID NO: 10732 - DNA, 1277 bp, Homo sapiens
  misc_feature (1)...(1277): n = A,T,C or G
tttactactccgtcgatcagagcacctcgtttctctgcgcactgtctctgctctgcgtgcagtagctaggcgtgaggcgtacgtgcagtggcagtgaggctggcatacagtatccgatgtttaactggatactctgaagcattgacagagattagtgcatcctcgtcgcgacagcgtcacacttcctacacagagcagttaaattgcgcaatcaccgccacacataattatggttgccgtaccaacgtgctcgcgtacatcggcgtcggtgagacaatatatagatacagatagatacctctgctaccggtcaagcctgacgatacggaatcgcaccgcagacacgtcgagaatcagcctccaactgagacgcacatgtcgtgcgtcctcctacatacacagccacgcgacagccggcggaggagtgacatatcacctgcgtacagtcgctctangcaggagtataggctgaaggccaattgaatatttcttatttcgccgccatcacccagcgcgccgagggggatcttgagatgatacctcacgggaggtgtgtgntgcgtgtctcttcgcgcgatcgcggctaggaaagtcacatgtcatgacacactgacagtcaactcgcggacagctttcctctaggcgcgtgaccggcggggcggatagaacgaggggagagcggcgtgcgcgcgaggggcagccgagccacactatacacaccgattacggaaccaaatgatatgtatgtgataacacgaagcgatgtatcatagtgatataccatagagcgtacgacgtgacataagggagtggcaataggcgatttgtagacacaaagagagcggggggagaaaagaataagaaggagtgcgtagcgcagcacaggagcgctgatgactgagaccttgggtgtgtggagtgtagcacgctggacgcaggtggaatcctctttccacgaggtgcgtgccttgatttagggttacaacatagcttcactctgcgctgtaaatccacatcatctttgtgctgagttcgtctatacctctctagacaccatagtagcaaacagggggcagagtaagttgacagaagcaagatacacgatagcgggcaccagggcgctgctaccagcacacccgccgaggtcgcaggccgctcctactataaacatcaatactcccacgaggaggggtaaacggagtctatatgatgagaagaggagggcactgcgatcatacagtgtagcgtggccactctctcgctaacttgatgcgtct

SEQ ID NO: 10733 - DNA, 1450 bp, Homo sapiens
  misc_feature (1)...(1450): n = A,T,C or G
gtcttgcgtgtcactgccgtgcgctagatcgtatgatgtatgggcgatgttggcataactgtaccatactactacacacgtnagcgacgccatantcgctagcttattgtctcacantgaggntagtattactattgtctagagcgtctatatacaatatatatgtaagtttgccagcactctgnctcacctagctatcacgcctagcagcgcatcttctcctctcgttccgtgtcacgtagatgatgctttgtactcacacgacgagtaatcataatatgcctatgcggctctatcacttcgaagatgatctatgtgtccacgtgactagtcgcgaatactctactatgcgtcacatcacgcatgattaactcagcagaattcnaagctaattacgattaatgtcctaatcacgcatatgtcttatcatactccatatacancacgtgatctatccctcataattntcataagnagacgtgtacttctgtcgtgttgtctctgtctcctgtatacgcgttttaagctaagctgctctggtctgttggcgcgtgtatgtatatatacttgagtcgcacactgatcatcatttgacatacgctgatgtccgtcgttgactagtacgcgcggtcatcgtcattcttgctctttctactcattatctgtcgtcgcggattgtccgcgtgcatatcttacttatccctgctagccgcctgctgtcgtgcacgttgtggtcggtcccgcaatcttgatccnccgctcgatacgccgaccacctaataataattcgattggtgcgcgagagtcggcgtcgtatgtngagtcacgtgatntcgtcgctgatctcgttgtgatttccgtagcgcgatgttatcgtgtgactattatatctttcgtagtgtcgtttgatataagctctgatcgagtcgcccaggtctgtctagattatctcccatacgcactctaaccatgaattcacttttctncatctgatgcgaacatctctctccacgtcatagatattctatgtgtgccatcatattgnctcatcgcncggcacggcgtggtgtgtaattgacgatcttccacttccctaaagccgccatatgcgcatgtttcaggtccgcttngcgtgtctactcanctctcgtgttgcgcagttatacagtcacattacggattctatcgctagctgcgtggcacgctagtgatgacaatgtagtagtgtctatgactctactatgtactacgtatctacataattcatattacctccctcgtatacatactataatattacatgaatgatatcatgtgtctctgtgcttgtgtcttaaccagctgtgtgtgcagtctggttaccgtctcatngagcgtcctctttcctccgtcttgttcgtctcgctttctggtatctccttagctgtgctggtgatcagagtgccgagtg

SEQ ID NO: 10734 - DNA, 1455 bp, Homo sapiens
  misc_feature (1)...(1455): n = A,T,C or G
agtcgtgactgatgtgtattgtgaatcgangtgggagtgtattgcgcgagagtcatagagtatattgtagtatgtagaggagaatggacgtcgagtcggggtaggaggagtgtgcaggatggagtgtggagtntaagtggagggcgaggagagtactactggtcgtgtgcaggtcatctaagagcgtgaggtgtaggcgagtggtgcgtggagtgggaatagagtgtgcgtgacgttacatatatgtggctactggatatatgtcgttgattcgacagcatgctgtcactggtgtgantgtgtgagctcgctgctcgctacgcatgcgntgcntntctgtgcttgtcgtgntgtgtgtgatggatgagntgtatgggagagtagtgtgtatgagtggatgagatangngtgcgaggtgatggcacggacgatgcgttacaagtcggggtagnaatgggagaataaggagtagttgtcgcgtgggtctgcggtgtgtgtgtgcgtggtggtgtgcactgtntacgctgtagctcgagtcgatcgtagatatganaagtcagtaattcatgcatgatgtgtgtgtgcgatgangcgggacagcgtgctcgtgggactcgatgcgggtggtggcgttggtnaggcattggactgatgtgcgtggtgaacagnagaggggagagagtggagaggtcgngctgtagaggggtgaggctgtggacggtggtggtgacggtgggccgttgtgaaggtgcgcggtntgcggttgtgtgcgtgagcggtgatggggttaatgtagcgtgttggtggggcgcgagggcgcgacgagcgagtggcgacgcgtgagaagtttacgcggatgtgagggagttgtagatcgcgtgaatagtgagtgattggagggtcttggattgtgggtgagtgtgggctgtcgtgtagttcgataagatttattatgatttgagaagagaaaatatatctaattatcatattctttagtcgtgtatcacagactcaagttacaagttcttctcaccatagatcaacgctgtccacttcttagattgtagaggatatatgcgtcgctacagcgagagtgtatgcgatgcagtgagtagtctctagagactatgtccattcgcgttgtcgcgacttgcggtagagagatacaccgtacgcgagacacatgtaacgccattttacgtttggggtcanagcgtggtagctctacacgtgcacatagtgctcatagagtactacatgcanaagctgactcatgactccnaagnagcgacgcagngtgcnatccggggtgcagcacgtgngtgaaacgctttgctgcgtattgtnacgactatcanccnctagcgccncatttctatattactttttataactcatcctccacccctcctacntnnntnncntctntttctnttctctttctccctccccccc

SEQ ID NO: 10735 - DNA, 359 bp, Homo sapiens
ccaccttcaacgttccgcctcccagcacccgcgagccgaaaagcttagaagaatcgtcttgctatgttacccaggctggactgcagtggctattctcaattatgatcatagtgcaccataggcctgggggtgggggggctaaagccatcctcccacctcagctccaaggactacaggctcacaccacaacacctggtcctctgtttacttctctttttcccctactaggttataaactcctccaaggcaaggatttagtcctgctcacagttgtaacataacacgggggggcagtgcctgcacatagcaaatgttcaatcattaaactaaaatttatttctctcataaaaaaaaaaaaa

SEQ ID NO: 10736 - DNA, 743 bp, Homo sapiens
gcatcattcctttgcaggagaagcaccccaaaaggggtggccttcggggcttgtgcctaaatgggctttcttggtgtttatcacgccacttctggtcttttcggtgactatggagcttcctagcattacgaagtacacgacacttgcccatcctgccagtgccaagggcctgagcgaaagagagacttttaaactttctagaaattatttattcattaagagcacattgtgtttcggatgattctgaagtggataaaacaccttaccgtagaaatactttaatgctaatagaattatcatccactcttgaatttgggtcttattttattttatattgccaacctgtttatgaacaatattaagagtgacttatatagggctacatgatgacaattgttcacccattataggatgtctatgggtaattaaatatctagagtttaatttgaacgtggattctgtttataatatttgtttgtattattgcaggtggagagatttataaaacaattttctgagttctcttactttgccacatagattttgctaaggctctgcaatttttgtggaatgcactactgttgcattttctgttaaaaagtactttgaatagttttcaggaagttattgtaaggaaaaagttaggccaatatttttaccttttgtaatcttcaaactagcattaaaatagactgcttctacaaaaatataatatagagaaaaaatgaaaaaaaaaaaaaaaa

SEQ ID NO: 10737 - DNA, 380 bp, Homo sapiens
ctttgaagttcggttcctcaggtatcagacattgagatggagtttagcacacaggacacttattaaggcatcctcttgtggtcaatgtctgtggaatgaaggaaaacaatgcaagaatacccagttgagggagaagttgagctgtgatgcagacccaaatcctgctttagctgacccctaaggaggcctctgagcccaagccaagccatcgcaccccctgtgacttgcacgtatatgcccagatggcctgaagtaactgaagaatcacaaaagaagtgaaaatgcccagccccgccttaactgatgacattccaccacaaaagaagtgtaaatggccagtccttgccttaactgatgacattccaccaaaaaaaaaaaaa

SEQ ID NO: 10738 - DNA, 140 bp, Homo sapiens
ctagcgttacctatctgttttttttttatgaagcttcttctggttggaaacttgtcaaatttcatcagattcatccattcctcatttaacaagcttgcttcataaaatcatacattattccaaacataaaaaaaaaaaaa

SEQ ID NO: 10739 - DNA, 1159 bp, Homo sapiens
  misc_feature (1)...(1159): n = A,T,C or G
ccctcccggctcgttcctcccctcgcgcgctgcgtctctcctctttcctcgcttcgcgtggggctccgcgtctgtcttcgctccgctctctcttcctccggttccccgtgtgtcgtgtcccggtctcggttctggcgtccctgctggtcgtcgtcgcctttgttggacgctcctccgttcctttgcctccgttcgttgcgtttcgtctctgcctgggccgttgcgtcgctgtcgcttcccgtctcgctgtcgggtgcgcttggcgctttcgcgtcggcctgtggcgttgtgtcctgtttcttagcctcctcccttgttcgtcgccgtctcgcgcggccggcgcgcgcgcgcttccccttccttcgttctcgttttgcggtccgcgcttttcttcgtctctgccgcggctccgcccgcgttttgtcctgtttcccggtgtgttccggtctctctctgtggcctccttgtccttccgctcgcgcctcgttctcatgtgtccctgctctcgttctcgcggcttcgtcggtgtccgtgtctctctcttcgcgcgttcgttgtcggcgttgattcccgatggtgccagcnctgcgcggccgtccggcgcgcttcctgctgacggtcttctgncgcgggccgcttctggtgcccggtgccggttcgccttggtttgtgtgtcgtggtggtgcggctgctcccctttcttctgcgctgcgtttcgctgccgtggtgcgcggtggcttcgcggtccgtttgttctcgccttctgtcggccgtcctccccttccgcgttcgtgtggctgcgcggcgcttgtggtacatcgctccggcgggtgtcggtcattcttcggtgtcgtgttgtttctcgttcggtcggctcgggtgtgcgcgttctcgtcctgtcgctcgccccggccttcctggtgggtttgccggtctctgtgcggtttctcgcggtggcgcccgcccctgtgttccctcgccgtggtccgcgtcgtgcgcgcggttctctcttctntgctccncacaagcatcttcttccgccgctctgggtggcgcggccgcgtggtttgcggtttgggcgcgcttcaggccgcggtnttctcggttcgccccggaagggctgtctctttctgtttgggctgcttccttgcggcgcccg

SEQ ID NO: 10740 - DNA, 1724 bp, Homo sapiens
  misc_feature (1)...(1724): n = A,T,C or G
cgcgcnactgcncgtctccgncnaacacacactatcactcgacttacctcacanggaccatgcacaatacctcactacgtagcgacgcgcccancctcacgcacgcgtcgatgtcggtgcgatacgcgaggatgtcgttgagctcntgcgtggtgatgctgtactatatagacgcgcgcgantgactcatcctcgttgccgtcgnctcacgcgtactatgcgagacatctacgctagatctgtacgattcgatctaacgtantaacgtccgctagcgtacgccacgagcgcgtaggcgtgnttatcgtctgcttgncatcagcactgcancnaacgtatgctcgnttcgtctacgcgtggtagtgttgtagcatacgccacgcatcacagncgcngtactacatctcacatanatagtaggttcgaaggaatacgagcagcagagcacgatacccatcagtgagncgtgagcgcatntcacggcactggtggcgtcacgtctaaggtcgacagtagntgatactgctgcaatacggtccagcagtcagctcatctagatcatcgctatctacaccacgctgngcatcgtgatgcgtgtgcagcaccncattcttgngcacgcgtgtgtccagctccgcgtgtgtagcatatcatctaacaactcacgtgtcggcgctctcgtagtacgttctccgcgagtaccgnggcgtcgcgtgtgctgtcggctcagacgaacgaccatgtnagtaacgactaatctngatcattacgtgagacgcgagcgcagagtgtgatgcgancncctcgcacccgttagcgtgcgacgagcggtcacacactgtcntgagctcgactatgtgttcgacactctanctcatgcggtcgcctgcggcgtcgcgctgtgcgtcagtatgtataatnacatctaacatncgccgcgtcagccgacggagagtcgtctgatatccgtgncgtcgagcgcgtgcacgtgtatgtcgcgctgcgtacgcgtgatgcctctctgcganctctcttcgttncgcgctctgcctcanttanatctgcgtcacgatacgtnngcatgcctgcgcgatcctctacatcgcntgtgtacgcntgcatcatgagcncactgcagtcgcntcnctcgcatgcgtgagctctccatgcatgcgactctcgactacactcacactcactcgcgcgatgcacngccgcagactgccactctntcatcctcganctggctcgcgcgcgcgnctgtgtcncntnccatacagatacattgtacgtctatcaccactacgataccctagttcctatntgtcaggtagttatcaccacatacgtgcaccacganggtacatcacagncacgagacgcgtatgcngantgagtgagntgttatccagcgcagggtcaggtatcggtgactgcatgcttagccataattagtcgagtactgaccgnatctgacttcgtgctcgcctatgccatagcgtatcctcagngtgcctatggaatctgttgttcanctgtgctatgttcagtgacaggctcctcgcggtctctgagtgacggccacagtaacacagctcggtgctcgcgatgtgnggtttntaccgtacgtggcacgcactgttccgccctctctgatctgctcgtcatacctcctggtcgtcccgcttcgttgagacngagtntgtggtaggcgtcgaggtccg

SEQ ID NO: 10741 - DNA, 2090 bp, Homo sapiens
  misc_feature (1)...(2090): n = A,T,C or G
ggtagggtgttaantatctgatnttgttaatnttgccaccgcacgaccacacaccagcgcgaccttacatgggggcataacaatagacacccgagagacagattttctcacctgtgggaccagataatacgtaaacgccgaggatacacacaacaccgaccacacagtgagncgcgagttactcgctcgtcgcgagttgtattatantgtccccgtgggcctctcgtagacagagacctcatctcgctgctatgatcttatagagtaggcggcgacggtcgaccagatggtcgccgnagcagactgannataccagcncacatgatggtcgggnttgtgcgtggtgcactcttcatcagtctcactatctgcgtcggcgcgacagtctctctagatatcgaagagatgtcgctgtaggtgtaccgnggcacatatattgatgagtncctactgtactctgttgtgnccncttctacttgtgagcattgtaggttngcatatgcagtgtacgcgcgacagtgaatcccntatactctattcacgcgcagcgtgcgtgcgtcgtgtcgaatcacatgtgagctgggtgcgtgcagatagagctaacatagatatgtcantttntcacanagtagagatgcaggcaagtatctcntgntcatacatgacgcggcgagttagtattgcgactgctgtgtacatcacagacgtgcgntngnatacgacgtgagcgtacatatcatcacttattgctnttgagacttatatgatctcgtcacngctgcagcattcgacgtctgctgatcgatgtaggacgatgatngtgncgtgtcgagtcagtgtctacntcttgcttgatntctcgntcctgtganggcgtcgtaacgctccgacacagaaaggacgtacattatgcatgtgtctgcgtntgtcgcgangagtgactgcacgcgttcgatgtatncntctgcgctctactccgnacgntacgccncagacacaagaccgaagacgngagatggactatgcatcacgtcagtcgctacgtccctccgtncgcatatagagtgagttgctcatatcagcatagactgcgcgatcntgagagctagttgctgacgcgcancgtatctctgagacggactatatcagtctaatagtacatacgacatctcancgacgtgtctctacttgacacgtcttcgactacatactcaatnaccactacgatcctaccacanatntctanaatctactacttctnctatntnctacatcacantcntcananantaatctatatacntacgagagacgtatagatgatnannagatcatactataacggcaccgcgccnacgncngtgaccatacatgactacatcgacagtcntctcctcactcacgtctcacgtgatagatacgacgacgngacgtangaatgcgctacgtcagtgcgtcgtgtcgtnagctgcatcgctgtgcgactcggtagcacatgtagngcatcantgctgctgacgctgttngtcgagnagatntatagnagnctnantcacgagacgtgncntntcgtgtatcgcgctctgttactgatgcagctgcgnatagtgatccnntatgtcatacagatcgacagcccncagcccanacgacgatcgtacgcngancgtagtgatgcgcgtcatcgcgtcatcgatcataccgactnnatgagcggatanatgatgaacagcttacancatgtgtcagnagatncgatagtgtnctgctgtgntntcatcgcngagtgatagtatcgtgnacngtcnncagcngttcgnatactactgtatgtgntatatgcatgcngtactgcgagatatgtnttcactgtctctgagacacgactgcctgngctactatctacctactcatctcgtcgtcgtcaagtagtgacttctnntagcagcgcgnacgactagtngtgagcatcgatgtgctacatntactatgtcacgcagatagaacacntcancaacaanagtatagcaaacgggcggcgcgagacagncagtgatctanccgagngncactactcgacggcgacatcg

SEQ ID NO: 10742 - DNA, 176 bp, Homo sapiens
cttagatgatcctcgaatcctgagagttctaagtcctccccactctgtcattcactttgggtctgcccttttgctaaagcctaacaatatctctatgcttcacatactcttacgctgttcattttatttctacttgtgtctaaatagattagatgaaaggcacaaaaaaaaaaaaa

SEQ ID NO: 10743 - DNA, 879 bp, Homo sapiens
tcgccgttctacggagcaccgaccccggtgtggaaacacgagcccctcactaggaacaacatgatcagctttggtgaggcgaccagcccgagacgagatcgtagggcaacactacgatctccaagacctctcagtgaaccctgacgcatgctactggactggacacacctacaacggagctaatgacagacaggctgaaaaaggatggactgcgccctaaaacttgaggctgagctgatgacctagaatgctccattgacagaatctataacccacgctgcacttctttacatagcagatgaacgattcgatgtgatgaactataggaaacatctgcggacgctgggagaagaacaaacacaatggacacgttggccttagcggcagagcttagcctcctctatcctacatgacggggaaaaacaagaggcaaattccctgaatccttgccattagcgaagttatcaccaaaaaaccgtatgcggcttctccaaggaggtacccacccgccgcccaccaatcccccaggcacaccccaaaaatcccatcagcacctacgccacccgacgcccctcactctggaaaaggcaccgctagctacaccgtcccggttaacgagcgacaccccatggattcacctgtcctagataacggtaatcacacgagccgccgccccctagcccgacgctcaacgtatgcacgcgagctcatccccgccaatcacgccacgacttattcctgccaccgagcgcgaacaactggcctccaagcgcgtcacgcatggttccttcatcgaccccagagagatccagtacgcaccgtgcagcgccctactctgccctgcgcggcctcggccaccgccgtcttcttccacccccc

SEQ ID NO: 10744 - DNA, 1470 bp, Homo sapiens
  misc_feature (1)...(1470): n = A,T,C or G
cgtgcttctcttcgtctctcgcgcgcctcgcgccatgcgcagctctcctctgatcgcctcctcggtcactgcgccactcgtcctaactgcttagtgccaccgtctctcgatggtagtgtagtgtcgttgtattggtttgttgtctggctgcgccgcgcgatctgnctgctggctagtctctctcttgtgcgcttgtacgcgttctcttctctggtctgattctggctcgccgttcgtatggtttctgctccttgtccactactctactgattcgcagttccctcgagacgtgttactctgntatccgcgcgtcgccctgacttccgctcttcctttgcggtaggtactcagctgcgggcggcgccttgtgtcttcgccggctactgattgtttcgcttcttgggtggcgccttcgggggtgtctctcttggcttcgtgcgctatgatgatcgcgtcgcgggtctctattcgtatattagtgtaggtttattgacttgtacgcgtgctgcttgcatgcatattccgcatctgtcgcgcgtgctgcgtgtcgtatgatacggctacatgcgactcattcctcgctcgctcgtcgtattcgttagctcttttgaagttctaactgtgctcgccgttgtgagatgtgttctgcgcgggtggggcggcgcggcgcggcgcacgcgctcgtctactgctgtcctcncntcttatctgtcgtatcatgcagtggtggtngtgcgcggtgacgtcgtgtcatgcggcgcgtctcgcggtagtcgctantctcgctatgtcgctccctgtcgatcgtccttgtctntntattngtcgtgcgggtgctgcagttcgtgtgttcgatctgtgtgtgttgtcgcgcgtgcggtccctcgtccgtatatcctatgtcgccgcgcacgtgctggtctcatgtcgtctagtagcttgtctcttgtgtcggccacaggctgctcgctatcgaacacagctacctctctcgtgtctcgatgtgcatcgctctcgtctctcngtcgcagctactgtgtntntgtcggtcgctcgagtgcgctatctcatatctgctgcgcgngcgcatatcctcctacttgtgcatatgctggccacancctgcagcgngtgtgcgtctgatttctacgtacggcttggctacgccgcgtgtgtgagatctnccggtgggacccttctcctcctgctcaccctcttatccgtcgtgaaggtctgcttgcctgcgcgctcccgcgtgttgtgtgtcatcatttcgcatctcttcacacaagtctcgacctcgtgcactctgtgtttacaagtatgagcgactactggagtaatagtgtgggtctgcgtctgcgctcttnncagngcggtgtgcgtanggtctntgttctncctcactggaaggggggtgtccgtctgtctntcgcgcgtggcgtcgtcatccgtggtgcagcagctatt

SEQ ID NO: 10745 - DNA, 1530 bp, Homo sapiens
  misc_feature (1)...(1530): n = A,T,C or G
cggcgcgctcgtgctggcgcgtggcggtggacgctcgtgtgtccttcgcacggtcgtgctgctatcgcgctgccctcgacgcctgttcgcgtcgtggggcgctgctcgtgcctantagtgcgcgtcgcgcgtgctntctcgctgntatcccgcgctcgtgtatatctagctgntatcgtatgaccgntaggtcgttggatactctgtacgngtggttcgttgttgtcatgtcgtgttgttctacgctctgtgtcgcgantagcgcgttcgnggttgtcntgtgtctacgatctgctctcgtcaggtggtctgtgtacagtctcttgcagcaggatcgcggcgttgcatctactcagctgngtcngtgagtcctcgtgggcggtacgtccgtgncgcgnagcgccacgntgtcctcgtcntcgtggagtctcttgcgcatcgcggcgcgccgtctatgctcgcgtctactcgctcgcgctcgcgcgtaccgacacacgcgcgtcgtgtcctctgcgtcagccttcgcacgtgctgagcttctgtcagtgcgcgcgagtgcgctgtcgccgcgtccgacggctgtcatcgtgcgcgtcctgccgctctgctgcgctcgccgtcgcgctacgncgtatgctctcatggcgctcgaggtatgcgctgtctcgtncgagttgcgtggcgcgtccggtcgcgggtgcggtcggatgcgctggtcgtctcttgctgtgtatccgtgtgcgtgagtcgtgctntngcgcgtctggcgcgtgtcgtgtcgcttctgagcatatcagctgcgcatggtctcgcgtggcggcgcggcgctcgcgtcggtgcgtcatgacgtngcgtgcgtcgtcatacgtgtcgttggtctgcgcggccgcgcggtcgggtctcagtggttgctcgtcttcgagcgctgcgtcctcgtgcgcgctcgtctcgcgcggtggttcctcgtgcttcgctgctgggcgcgtcggcgtgtctcgccctctgcgttgttgcggtgtgtgatctntctgcgttggncgtcgctcncgtctcgttcgcgtcggcttacaaaggcttgtcgtgcgtgtgtggctgttcagtgtgtgcgttcgtcngtccgctgcctcgctgccttgcctntgcctcttgtcaagagccacacggtgctgngtgggtggtccggtgttcggtcgctggcgcggtcgttctgcttgcgcgcgtcncgctcgttcgccgcgttctcgtccctcgctccgctcgtcgtcttctntctcgcgcctccgtcgctgcccgttcgctccttcctccctgccgcgttcctggtgcgcggcgcgctgtggtgcgcgcgctccgtcttgcgcgtgcctgctccgccgtgttctactgcgtttgctgcggcgtcgcgttgcgtctcgaaaactcgtntgctgtgttgtgttgtcccctcctgaaaacggcgttcctgcgttcgctactgctgtcttgctctatgttttctgcggtggcgtctcgggtggtggtgcgcctcgt

SEQ ID NO: 10746 - DNA, 1431 bp, Homo sapiens
  misc_feature (1)...(1431): n = A,T,C or G
tcctctgcatcactagacagtcacacaccctcattatctatatagcagacaaagcgaggaagtcgccctcaggatgggggaccanaancgatgaangcctgnacatcgacggaaaaccagacgcacaagacgccccatccctcacgcggttacactccctcgacttccccagcaacacttggtcaatgtacactcttatgcctcgcctacctgtacttggtacagatacactcggcaagggacgaccctcatatctctcgcgcagcgctccttacattacgctaacagtaatgtgttgtccacataacacactctcgtcgcgactcgacngttatatagtgattaaccgaacgtctccatcatataggcactcgcatgtaacataacatccacccgttctctatctctttatagacaaacagataacacacacagagactctnatacactcgcatatcacaatactacaggtacacaccgcaattccagctacacactatgattcaacagactgtcacagcacaatataacagctatcaatanttcgcgctgtcgctaggctcgtcgctaacatgagcacttacttctcacccgctcacccgaggagcccctcggcacgcgtaagaccagaccgtgtgcacaagtctcggtagactctaacatctcctccgcattcaatccacacacacagcacccactccatttatccgctccatcactccacgcggctgcgacgatcacagatcaacaacaactcctcgcgcacacacacccggctcgtcacgcagttgtcatacgacgtcccgctgngcncctaccctcgttctcctatcattcgtcatctcagtattnacacggcacaccagagcatgtaacatcgacgcgcgactctaacacagttagaatgactcgaccgggagatnagagcgctcancnacacacgtcaagcgcacctgtgctcttgtctctgctagntctcacanctctactaactaatanagcaacgatcatgtcgtcccctgagatctgtgcagctaacactactcgcaccggcgacaccatacatagacacgctaganaactgcacacctcgtcgatggagtancacgggcgtacatctaccacaccgatgctctcgagccacganagcctcggcgctctnttctgtgtcngcgcctctcaccactaccgcaccacagcatcactctcacacagtcgactcggcaacttcgcgctaacatnccctgtataattgctgtgctcaatagtaagagcacgtcnatcncncatcaatcaacacgcnatagtagatgacactanctcgcgatcgctatagtnacagaccgtaactnattatctacctgaatggcgcgcacgcacacntcnagagcacgacacgcacagtgagatatgtaatctgcaccnctacag

SEQ ID NO: 10747 - DNA, 1480 bp, Homo sapiens
  misc_feature (1)...(1480): n = A,T,C or G
tcgagngntcgtgcgtgggtaatgtgtagagtgttaacatgagtgagtggatgaggaagctgtagagcagatgctacgtgtgtggatnggagttcgaggtcgggcggtatgcagtcgttccgtcgacgagcgtctgcgcttacgattgcggtgtgcagtcgtanatatgtagcagctatgtacatagccgactgctgtgtatgttacattgatactcgtcgtgagagtgacgtcgtgagngcggtctgcggcgaagagctgtgtacgtacgacatctctgtgtgcgtacttcgacacagcgatgcttgagacacgtgcgctagctggctagtgaagtgcactgtatacgtccggcgcacatctctctattatctctcatcaaactccacaatangtctctgtagcgtntacanantactgcgatatgtgaaggggtcgttccggcacacactacacgcgatacgtgcgtattgttctctactatccgacgacggtgggatagctattgtgtgttgccatcgaaattaattaatattagagtgtatatgtcctactaacttacaactgttagggagcttggaagcacctggcctctagcattcaagcgacgctcgtgctcggctcagtccggtgatggagacatctggcacttatcatcgacttgaatgtgaatcagggacagaattgatgagatactctgcagctgtgcgtcgcaccgagccgggagcgatctagtagacacgatgtatataatgaccacacattggtgactctgtcatgcgcatgcgcgcgcatgtgtaagtaatgttagattcgactgttatcgtgtttgtctttatgcacagatgttatttatgggtgtgtgttattggatccgtagaattggtgcgctagaaattatatagtttgttagggggttgggtataaatatgacggtgggagataatgcgatggaggctcgacggatgaggtgtgcgtacctaggatcaatgacgcagcgccatgacgttagtcacttcgtgtngtaccgtgtgtactacgccgtctcgtcactgcgcacgacgcaacctatatgcgagcgcgtcatatatcagtagatcgagatacatggtgttccgtactatancgtaattatttctatacgtgtgtatctacatcgcagaatctggtcaacacaatatgcgattgctgtggaagagtgtgttgctagtacacggcgcgtacagatggatcacgaagagaagacggattaagtagcggtagaggcctaggctcgagtcgtctnctgagtcttgtagcagatggtgtgtaatggaaacacaacntactccaacctcataaatacgcgccgtgcgtgtgcagaaatcattgatatatgtgttgtagatatgttgctgatttctgtacgctactacaatctactacactataggctgacagcgacagacacatgtctagaaagcaatagtagatagcgacg

SEQ ID NO: 10748 - DNA, 1440 bp, Homo sapiens
  misc_feature (1)...(1440): n = A,T,C or G
ctaatccgcgctctcgcgtgctcgctgcttcgcgctcgtggctcgctgtggtgcgctccgtgtgcgttcgcttgccgctcttctgctctgtcctgctcgtcncgccgcttctccgtcgtntctctctgcctcctccgcgccttgtcatctncgctcgtctcgtntctctcgtggctcgtcgctgtgcgtgctgttgttgcntctcggttcgctcttgtgcgtcacgtcgcctcgttctctactatcctctctctcgcgtcngcttctgctattacgncctctctctcactcctccgtgtgccgtctcgctcctctgatcgtcgcggtgtcctgcgcctccgcgtcgctccctcctcacacatgtgngctgcgtgtcgttctacgcttcgggctcgacctggcgctgctctgctggtgatctctcttgcgcctctcttccgtcgcgcacgcctccgctcatcccgttctgtctgtcgtccctctnaggtcgtgctgttatcgcgtgtcttctgtcgcntcttgtncagcctcttngcngtgtgctcgcactccgtgccnccgtcctcgctgcgcttctcgtgcgcgccgtctcgcgcgntctccgcgtgtgcggtcgcacgtgtctctctcttgtcgtgcttgctctcgtgcgtgttttcgtcgctgctntgtntgtccgtccttctactntatgctggctggtcgggcgtgncntgcttcgcttcgngtcgtcgtntctctantgctgtggtctttcntctctctgtaccgcgtcgcgcgcgcgtcgctgacagcncttgctcgcgtcgtctcgccggcgccgtccgctgcgcagtcctctgtgtctgtcctgtcttcgcttcatctcctcggcgctgtcgctgcgctgtgcgtgtgctcctgccgcagngtggctcgcgctcctcgtgtcgtcgtcttcgtccgcccgcgtgcgtgcgcttgcgtcgctctgtgtcctgtcgcgggcgtgcgtctgtgtgctgtgtgcggtgtgtttctgnctcggccgggcgtctgtcgctcgcgcctngctgcgcgtncgttttctgntctctgtctctttccgcctcgttgtcttgttctnttttccgtcccgcttncttcgggcggctttgtcgggcttctctttctctctcgcggntggggcggtccgtttgttggctgtcgtttcgctttgggctcggtccgtgcgctgtcgcggcggggccggcgcgcgtctcggctttctcggcgtgctcgcgcgcgtgcctgtcggtggcggcgcctggctgtctcggttggtcgctcccgtccctgctgtcgttgtgctcttccgcgttgggtttttccgcccttaatctttgtgggctgtttccccccgagcctcttttcttgtctcttctttgctgtttttttgctttctcgggtgcgctgtcttcg

SEQ ID NO: 10749 - DNA, 2052 bp, Homo sapiens
  misc_feature (1)...(2052): n = A,T,C or G
cgttgcatatctatatagtgnngcanantagacatggtagaagagaactctgnngggatacgacatagacgagatgggagatatgtgtgcgtgaattgntcagtgtgaggtgtcgtatgnagtggataagaatgatctgtgtngntctgngacgcgtgacgcgtggcgagcgtnaatcacgagtgtgaggctgtatgatggcagtagaggactangtnacgatatgcacataatcgctgtgtgtatgcatgatatagagtgcgtagtgnattgttagatangaagacgtntgtctgatncgnaacgctacacngggtnnanacactactgatgcaactgtacgctgtgtgngncgtctaatatgctagtgacaataagntgcgttatggananagcagncatgtgactagtgactgtctatatacgagatgatagnnaaacgcgcagtgcgcgcagagtagtcgagcagtagcgatcnncgnnnactagactgatgaggtgnggnagctanatgtcagggacgctagngattagcgtgcgttgtgantcgcgcgcgcangggatngcggaggnngaagagtgagagctgtctgtgagtacagcggancgtatgngagatcgntgcgcgctgggacgcagatgcgagcnggggatcgtgtagcgagtgatctgactgagagagatatgnganntanacatacataanancacattacgtgtcgtngngatgaatatcagcagtagtgtgngagtnntnangtgtgagtcganggagatatagatncgcacggcgaagtgtgtggtngagcaacacgcngtagctacgttgngtcnggtctnggaggcagngnactagcatgcacgcangnggagatacgatagtgtggaggacgctacgtgcgggagagagacngatagtagatcngtgcaacgcatcgatgagtanacactgatgantggnaanngacggcantcgactatcatccgtnnnngncactcgcagcgtgtgatactgatcaatgctctatnacganngacatgactgagtcagtatatngagcataaagtactctgcatgtacactgtatcacntngtcgntanaactnngtgatatnagtacgacatcatcatatctcgtatangnacgaatatgtatattnnatgactgctctactgtctctgacctatgtntgtatgctntanngnnnnnntnantgcgannacgcgtcgctctgccccgntacantnactcgtnatntaactatcntnagntnagctatgctgatatctcntacngnnntnannnntttctatcatctnnnacatattgtgctntatcttcncttntccttttntnattnnatacatctctntnntntcatcanantaatctctctctttactctatatatnnnnnatctatncctcttctatatctatntacntnnannacacttttttatcatatcnctntcacntntnnnnnnnntccttctatcatntcttcnnnnnccactcactcctctcactctacnctatctatctttaccntnaccattaataacattnttngnnnaacttaatntnaacacatacatcttnnnncaccttttcattactntctcnctnacaccacnctcnacaagatcgtaacaattacancaccataatcactcnnactnncatttacntntcctactctctttnncactcattattttctcttctnncntnnnacaatcctatatcactctacatnttcatctctctntttnnctatnattatcttcctctcntctcatcattctcaatcttncnncacatatcctctctctactatatacacaatcatcctncnaatctncncancactctnctaannnncatctcttnnnnccaaaacacattnnnnnnnnnnnnnnnncatnnnnnnnnnnnncactntcnnncnctcnctcntnntnnnntncnncnnnnntcctcnctctntctnnnnnnnnnnnnncttnnnnnnnnnnnnnntnttnnnnnnnnnnnnccntttttttttt

SEQ ID NO: 10750 - DNA, 233 bp, Homo sapiens
gtttaaatatataggtgacctgttcccaggaagggggagagagcttgtgtgccaactccagcatatcttttgagttagaactctcgccttgatttcttctggtctatgacagtttctgtctttccccagattttctgtctttccccagatattctgtctttctcaagccatgaccttgagttttgaggagtactagtgaagtattttgtgaatgtccctcaaaaaaaaaaaaa

SEQ ID NO: 10751 - DNA, 778 bp, Homo sapiens
  misc_feature (1)...(778): n = A,T,C or G
cagacttgtgagacccagcattcatggagccaacctggaagcagagagcagccctcaccagacaccaaacctgccgatgccttgattgtggactttccagcctccagaactacggagtctcgctttgtcgcccagactggagtgcagtggcgcgatctctgctcactgcaagctctgcctcccgggttctcgccattctcctgcctcagcctcccgagtggctgggactacaggcgcccacgaccacgcccggctaatttgttgtatttttagtggagacgggatttcaccgtgttggccaggatggtctcgatctcctgacctcgtgatccgcccaccccggcctcccaaggtgctgggattacaggcgtgagccaccgtgcctggcctctaataattaattcttaaaaagaagactgtcagtttaaagaaaaaatagtctattgctgagttgaaagtatacataataaaatgcaaggtataggaatgtaaatggaattaaaaagtgttatgttatggaggtggatgggaagatgttgatcaaagggcttgaaattttagacaggaggaatcagtttccaagatctatcatccagcttggtggccatagntaataataatgtattctatatttcaaaattgctgaaagagtagattttaaatgttcccactacataaacactgggatgtgaggggttggatatgttcattaacttgaatgactccttccacatgtataataaatcaaaacatccatagtcccccctgaatattatac

SEQ ID NO: 10752 - DNA, 504 bp, Homo sapiens
cctagtgatactaaggagccaaggtcatgcttcacaccggcaggacgtccccttgctctccagctgtctgtgcacgtgcatgggcgcctgtgcgtctcctctgcagatggagagatggacagtggctcgtggtgctgtgtcatccccacgcctgtctctgtgcacacttgttctttccaagatggttctcttgtgaacacttgactggtaagagaaaaatgcctcaagcgatcacttgtacaacgggaggaaacacactgtgcatgtggccccttcccaagagctggcagccactgcacagcaaacagcccaccccaagggaagaatcggggagaagggatgcaagaccccggaagcatgccggcctataaaatccccacgtcaaaggtcaaactgggcacttgatctctcaaggtgccacctggtcctcttccaggggaccttacttttgttcctgctctaaatggtggaataaatgttcattctggtctaaaaaaaaaaaaa

SEQ ID NO: 10753 - DNA, 786 bp, Homo sapiens
  misc_feature (1)...(786): n = A,T,C or G
caatgatggacttaaagttttgaaatttacctatgggtgtcatttaaacagaaaanaatcattaccggataataagtcagactgttttcttatctgccttgatcaagaaaagttagatgttgccagtgtctttgaaagttctgctaggaagcaagatattcccagcagtttacttgagcaaatggcttccgtttagcctaacggtttcttaggtttcacttttaaatcctgtgtaaacagaacaagtcactgtcattcaaacttttcccaagctgtatggggctctattgctgttgtttaacgaaattcagaggctagtgtaattagaccgcagggaaggtaggtcaggcagtgctgttaacttggctggcaaagttgatgggtcaaaaatgttttatgtttttcttcttttttcgcactaaataaactcggtgtaaaaatgttttgcttatagtgctcttctattcatttaacataaacatttgtgtattttaattctgtctgttctaaaattctaatttcttctataaattaatcaaatatgaaatctaagccagcaaagtatgttagaggaacagagagtcaagttttataaaaattaggcaggtatggaacagagctttaaaactgtatgatatttggagggaatggagtaagaaacagaaaccagttttctgaagggtatttattgttattattattattaaataaacacattattgcgagttccaaaaagaaaaaaaaaatggcctcgttggcatcagtcggtggagatgctctggccag

SEQ ID NO: 10754 - DNA, 932 bp, Homo sapiens
  misc_feature (1)...(932): n = A,T,C or G
caacctctggctccacggacggagggcaancaggcccgttgagaggcgctcctgaaatttttcgcatgtgtctcatatcatacctaggggaaaaacaagatatttcctagcttcccttgatgctggatatggtgtgggcaactgagtactgaccaacagaatgtgaaggaaagtgacaagcacgcctgccaggactcatcttaaaagagagaggacaaacgcctatgttctgctcccctactcagtcccactggccggaacaagaagatgctgagatttcttggaccctgggggggagaaccgaccccaggtccatattattgatgtgaccggcccagtccccccttctaatgacactatgctccttgcccacgttccccaacggaaacggggcagcaggccccccgggacgaaacggcctctgaaacgccgaccggctggcctcatccctccgatacgagtggcacctcaatacccctccgcggtcccctatggcgccgttgcgggcaagcgcggcctcgctgcgccggtcgctgcccccacctagacgtactgcgccccgcctccacgtctcgagatcggccccacaccctccgcacgtcctctcctcttcgctcgcgcctcacactagagcctcgccgcgtttcatccctcgccttagcgcgggtacaactcgatgcggcgggcgcgcggtcgtgtcgcgtccagtgtccacggacagtcgtcctcctcaccaggcctccgcacgctcgcacatgtgttatgaattgtacccgtacccctactgccacgcccggaccggacctgcaggcggtccaactcgacgaagagctgagtaaccgtgcctcatcaccactcgcatcccccacacgcctccgccgctctgccttcctcacgctcagtgcagaccgccgccatctgcgctaacagtt

SEQ ID NO: 10755 - DNA, 344 bp, Homo sapiens
cctagcgttacactgggggaactttcccttcccgacttggtgtgattagggtggagctgtcaaccacagaattcgaccctggtgacaaggtggtctttggacccaagctcactaaccagactctctcctaaaaatttgtgtcttgaatggagacaactgggttctatgcatggctgaaacagaagctcccatgaaggtatcttcaaagagaatgtcctgctgcccagagccatgtctgcttcttgccttcccatggcctgattttccaggttttcttttgagtctgtgaacttccaagtatcctcctaataaattcctctttgcctaagctaaaaaaaaaaaaa

SEQ ID NO: 10756 - DNA, 324 bp, Homo sapiens
  misc_feature (1)...(324): n = A,T,C or G
ctcgtgtagctactagaaggagncagctttgaggaggaaactgactttcttagcaaaaccagttcctttgctttcctagtgggtggcctcagccttgtcttttaagttaagtgatggggctaaaaaaactaatgagccccaggaagacctggggtccagtccctgatctgccacttcattgcctcacaaccttggggaagtcatttatcctctctgagcctcagtttcctcatcgtgatatttcagataaccatccttctgtaactgacagggttgttgttagactatcaaaacaacaaaaaaaatggcctctttggcctcacg

SEQ ID NO: 10757 - DNA, 258 bp, Homo sapiens
cttcatgagcgtccatgtagctggacttatacagcaagtagcctcttcagattggcttctttaacttagtaatattcatgtaacattgctccatgtgttttcgtggcttaataggtcattccttttcattactgatcattttattctgtgcatgtaccacaatttgttcgtctactactgaatgatgtcttgattgtttcggttgttggtgattatgaataaacttgctatattcaattaaagagaaaaaaaaaaaaa

SEQ ID NO: 10758 - DNA, 2277 bp, Homo sapiens
  misc_feature (1)...(2277): n = A,T,C or G
cttcatcagatttcagccacgcaactcgtcaancgagagactaacgacngccgacgcntacncaggacgatancacagcatgacacgacgtcngaacgtananacgatccgcgcattcctgantcacttcgactgaacagtcagtataatnagtnctgcagacgnatagcatcctacatgacgcgttaccatttacattatcagtcanctctcgagatcgcggtcacgtacaacagcantgttcgcagttggtcacgatcgctctccgtangtgtacgntangctgtactgagnagctacggtcaatagatnancctcntcntnaccgacgagtcgntgctacgagcagcgccgnctcgcagtncantgntnttcgcgcanctantaatagtaatcgtganctatgtaggtgangtaggtcagatcagncgctgcgaccgngnactgtcagncacgacgtagctgcagantcgnncttgtctcanngngacacgacgctgaatcaacgncgcagcgtgtacnacgantctcatcgcaccatgttacgcgactnacgacgcgcagtcatagtccgaagcagtncanctatnattagatcagactctgtanacgtcgccantactgtctgcgtactagctatgctnacgtctgncagactacgacntcgtcgngtgtgcgtcnacaatcgacgcagnatngagagatgnggnatnacgactgngatnggatcgacctgagcngtatcgtcnattacagcgtcangntactggtgcagcgctctgtcagttgataccaactntgaatcatntnacnggtcgatactgcacactgatgctactgtcgcgantngtattatgatgcgtatcgtcggtcatcgccgcgcgnacgcacatcaggnatcatcatnntcgcgtcncgactgangtgcagatgngatgatcgncgtctgcagtacgtncacnacatgncgacgcntcatcgangcacgtncgtgatacgtcgtgctcgacntacttttatngatgcagtgtcgcatcagcanancancacgcactncnantgacacgntgtcatcaatcnantcgnagacgacgatcgtacgcaatgtacganatctggtgcagtgatntctacatatgatntncagacctatgtcatgagctagtcgatcgccatcgtcaattaccggcgacgtgtcgtgcgcaacgcgatgttctcgcacacatgattatcagcaaggactcacgagtatgtgatactgtagtngancngtcgangtacgagactgcgatctcanagcgttctgtgntcggtngcacgtacgncnangcgcgcgctgcttgtagcgagnctgagtagctcgtgagtagacgcatacggacacgaacgagtgtgcgtgcatggcggtanatcgtgacgtgcacggcgtcagagctgcgagagagtctgtgagatcgtgagtgcacgctatgtgttagtcagctcgttgcgcgtgacactatatcataatacaatgctgcgcgtangtcgatgctngtcggtgatcgagcatactganagacacgcactatagatgcgtgcagcgtcattatgntgtgactatatatagatgctgatcgatacagtcgatantactncgntacgacgcngcgacgtatgcgcgacgtatctgctacgcagcggancgtgcgagatcgagnacgagcagattatgatgtancctcatgantatgtgactgnatnatctcgcganaacacanagataccacctgcnagcacgacacncncacggatcacgactcggtcgctcgataaattaatcactctaacntcgtacgtcactacanaganatantgatcngncaggcagactacgcagactgctatgtgtctgatgcgtgtctagtgtacagtgtcacacnatctcgctcgcacgtggagtagctcggaggctgctaggangcagnggagcgcggtcgcgtacgcntacgcgactacagactgtccgcnaaaccacctacactcagctgacgacagtggcnccgcgctcgatcatgcgtgtanctagagcgttgnagactacacaagacagatatctgctgattgntgcngtgcgcgctagtatngttgtgaggcagacagcgactagagcgctgacagtatatagtcgtgcgatgactgctatgcagataatgtctgcgatgtgtagcacgncctgagcgcacgaggcngacgacgcagacgtagtctacatcctcagtcacgcttttgcatacg

SEQ ID NO: 10759 - DNA, 1285 bp, Homo sapiens
  misc_feature (1)...(1285): n = A,T,C or G
cttacttacttggtgtttgtctctcctggcaattctgccatctctcgcttcttgactatggagatgtgtactggcgagtcttaagtggattcttcttttggtaccggatgtgtcgtgggggcggtcgggccgttcgatcttaaaactaatgcgtcgatttgcgctgcagtncactggatctatgcgcctatttgcccataattatacatactggaaatgtgggatgacgctgttcgctacgggagacgaccgcattctgtatcctcggtcgcctctggnatctggcggcctataggcnnaccctgaaatgggaagctgtctcttataatantagtgaagaagtataactaagagtctgaatattctntattctagtgaacgtntcgctagcgcgcgcgtacacatactactacctgatacacactttctcatcatagacatcattcatataacancaagtagnttattctcgtaactttgtatctccagaccctgtatacactgttactacgtagcgttgattttttcttgtacttgatattggttgttcttctatatcttgntatagtcgactagatgctagaggaagggaatcatacagataatatatgagtacatcataaannacaacatatatcactatannnaatctggcganacctctctcgcttacgctatctgtactggtcatggacatattattcttctattataataagattaaanacactaacacactacgtacctaaaatctcaaaagaacatatcttatactatatttcattcatgacacctcccgtccttatgttataaatataataaaaattttgtcaacatcnnnnacaattantcttatatatcaatctaacaaaatattaatattcttcattaacctaataaaatctacaccatcactnaatctacttaactcacatnnnccttctctnttaacaatactcaacacaatacctattaaacactaattaaatnacacatactaatactcaanaaaatatctatccccctatccccaccttnnccattacatttattttttaattanaacactttnataaccactaccctactacactttcaattttatataaatatattncaaattaacttaatntactctcttcatacgatcctctcctccttncaaaccacctacncctcttcacggcacttcnccctaacaannncnnncctnncnnnncccanncttcancccnnnntanncatatctccnnnnnnnnnnnnnnnnnnnnnnnnnnnnnntttt

SEQ ID NO: 10760 - DNA, 178 bp, Homo sapiens
ctcaggagtgctgtaaagatgaaaatcccatgaggaacacagcaggaatgtggctgtctgcaagccaggaagagagccctagccggaaactgaagttgccagaacattgactatggacgtctagcctccagaactgagagaaaataaatgtctgttgtttaagccaaaaaaaaaaaaa

SEQ ID NO: 10761 - DNA, 940 bp, Homo sapiens
ctcaggaacaccttgactggtaagattaaaatgcctacagcgagcacgtgtacaactccaggaaacacactgttcatgtggccccttcccaagagctggcagccactgcacagcagacagcccaccccaagggaagaatcggggagaagggatgcaagaccccggaagcatgccggcctataaaattcccacgtcaaacgtcaaactgggcacttgatcgcccaagttgccctcctgggcctcttacaaggtacctttctttgagtcctgctctacaatgccctaacacacgctcaacgtctgtccctaattcatagcacttatgccccctttcgctctgtacctctcgattctcggcgcactaactccctcctctcataggtccacaccatcaggccttcatctcccctttctcgtcactccgcccgccacccccccccccctcctcctctctctcccatcccatcatcccttcttctctcaatcccctcgcacctattctcccacacttttcctacacacctctcctttcccaccctttctcgccgtttctccctccccctactctcccctaacctgttccgctgctacgccccatcaccacttatcacactctccctatcacctctctttccctcgactttacgtgcctctcgcccagaccattcgcaccgcatcacctctctctttattccgatcccccttccctcctcccccctccccccactcccgtttgttccctcccccccccgttctcctacttcacccccactcatctccatcccactccttcttcttatctcaccttaatatctattcttagcgccagtattcgcttcctccattactcctgtcacctttccctctacctccacctcacacgccccgtttatcgctccctatccacattcttcatcactccactttcttctctatattt

SEQ ID NO: 10762 - DNA, 384 bp, Homo sapiens
  misc_feature (1)...(384): n = A,T,C or G
gagaattgtttaaggcatgaagaatgcatttcttcagactggagcagagccttgagaagatgctggcttggctaatggggaaggagagagagaaaactaattccagaggatgtgtcatatctcaggcaacacaggccaggatgagggcaatgattagagaaatgagtgcaggaagaggtggggggaacatagtgtcantatataatttgtcacccaactatatttctcccttttccactcagttcctgtccttgaatgtgtattctctaacaagntaataaaangattttattacagtaagtaagagagcaaagttgcctttttaaacacatcattttaaataaagggcgaggggnctttccaaaaggnttttcaaagggngtt

SEQ ID NO: 10763 - DNA, 1849 bp, Homo sapiens
  misc_feature (1)...(1849): n = A,T,C or G
ccaatacacgactagatgacntcacacgcaacataacgcagacanacanagcacacacacacgagccttgcantgtngcggtaccgaccagacnancgcaaacatngcacnacncttgagacnatagcgagcnaacatagacccgcgacanatngngcnncnagnactctcatgagatatagagccacnctatcnatgctnactcagcattgtttagggagcgcgacgngcgatagtaagagcaccacacgaatgcacatgagtgcacacgagctggcgctncggcatctacncgactgacatcgtactagactactgcgctacangcaacttccttangccctaatgttggactaaccaacgtgtacttacgcgtatgcgatatagtgcccaagcggagatgcaacacgtcgctgcagctctaggtatcacacgcgcagcgaganagcacgtaggggntcgctaaagatacactctcgacacactctcctaccgcagtacanangagatcctgtcacgcaatccctcgacttcgtcattttatattatacatancacacacacagcacacacaccggcgcgctccanctcgctctcaagcgccnctgccaaccnaccgnacagtggtacgcactncgctagtgagagcacnccgacacacatccntatgtgatagcatatggatgcgacatatacaagcacgcgacgtagncatcacactgncngactnaccacgcatcacactatctcgccttcacacgaattcngatacccgacancatctcacntattgcgccagcttagacaancagcgtctatctatagacagactctcacatgcatgatgacacgtacgtcgacgtnctcttacgctcagatacacgtcagntacacgacagactataccaaacagncacacgtactaaacacgtgagcgacacacgatcatattcactcatntactagcgtgacgacagtccagacacgacatagtacgcacactacaaccgcntncactagtgctactcaaagtcagtgacaggacacgctgcccagangtgtnagtgtatnagtntggcatcnacacncntatgactgacnatcagcgcgcagcgcacgcacgaccgtcctcagtcgacacgacagcgcatcgaccagaccatcagtactccattgtctatctgcgtgaatngcncatgactcgacgcgcngcacactgacaacacaaccatacnacgacgctacgtatgacagcgatcatagagtgcacgngacctgcgtaccacctcgcantgcgcacgcacatatataactatactatctagctctcaatggtgagatataatgtctatcgcacactngcatcanattnagcgactgacagatggacgnctccaccaccatagcatcacatcacacatgtgcgntacgtcggagatcgcacgcagagcgtcgcccactagcgtaccgacactatcggcgataccacgactgcgtctagacagncacgcagatcgacgcaancaagcatgctacactcgcacgcgcagaagacccgtgctgagctcacgcatctagtatacatcgacgtgcgaatacagatnaccagactacacatctcatacgaatccagtgagtacagcacctanatataatgtcgagaggagccntgacgtgcgatgagcaccacgacctncacgatagttagatatatgaagatagcaagcacacatatatcatcanatactatcacgtacacatcntctatctacnacgaagcagtgctgacacatcatctcntgatcgaacagcgcacacgacntatacatgtgctcgcgcgtacgacctc

SEQ ID NO: 10764 - DNA, 565 bp, Homo sapiens
caatgtgaataagctggttttttgcttatatatgtgctcttgtatatcagggaatgtactcagacagaatactgtacgcataggaataaatgaggtaaatcaaaaattgaatttatcatggaaatatagcaacagttataagagtgcataatcgagaagatattagatcctatattgctgggaacaggtcggattaatttacacatatctcgaaactaggagactagattttattacttggagtgtacggattattattattagtcggataaggttttattatggctgtattaaactgctcgaatagttattaaggggattaaaaatagagattgtcgtggcgtacgatagtttataaaaaggtaggcaggtgagagtgagcgttaaaatgttagcgttgaaggaagtggtatactcaagcgtggtatatgcggggattttttggccatagaggtttttttaaaactgtcattgagctactaacgtattctcacactaggtacgaggagaagttaattgacaacagtttatgacagtaggtgccggtaacgacgaagccgagagt

SEQ ID NO: 10765 - DNA, 828 bp, Homo sapiens
gccgctcccgctccgcgacaccgtggggtggtaaacgccaacttaccccttcagtccagccgacactgcgcttaaaatcatacccgcctaaacttgttgcctccatcatcttcaatgtagttgtgttcactgatcagtagggtcgtcgatactgatccagaccgtttgtcaaggcgttctataaccctgtcacgcattcgctgcacaagccaacccatagaggtgaaccggaggcggacaggagaggaagtgggtgcttgacggacatgaatgcgaaatgccttcgagcgaagggagagtatacgaacacgttcggtttgagtggggccctgtcactcactttatggatcgtcatcgcgctccctgtggatgagaaagctagataatacctcctgcgtaacgaagaactgttaagcgcgcgatggtcgcccgtttcaatatctaatcctgtgacgacaataatcctatgggatgactgagaatcgatctcccaagggcgtcagggctctctagttttcctttgagattgcgcttagtacgtgtggtggggacaaaccccactagtctgtagtgcgactgttaggtcaacttaagtgtaggcggcggagtggacgattcacgatgcaaaacgctggtagtgcacagtgcgcctaaaatctgtaagtcctctccttgcccctcctgaacaggtggactgatgaattcgtgaaagaattgcgtctttctaacaaaaaaaaagaaatggcctggatggctaaagcggtggagtcgttccccctaactcttctcccgtggtgttaacctctatggtgtggcgggtgccgcggc

SEQ ID NO: 10766 - DNA, 850 bp, Homo sapiens
  misc_feature (1)...(850): n = A,T,C or G
cggagcgggggcgagcgagtaggtgactggattaaggtaggggatagtgggttattgttggtggcgcgtagtagtcttgggtgtgaggggtggtagatgttatatgaggtgagaatgaggtggtgagcgggtttgtggaagggtggtgggttgttatggtcgggaggagggngagatggagtagtggaggtgaagggggtagggatgacggtgtagatttgtattgaggtgtggtgtgggatgtggggtggggttgcgggagagataggtggcgggtagggttgtgagttgtaatgaggaagtggggggaagggggtggggagtgggtgagatagaggcaaggcagtgaagaggtggaggaggtgggggtggagagagcgtggggcgagggaagggcgtgaggggagtgggtatggggggatgaggatagggggtgtggngggtgggagggtgtgggggaggatagtattgggtaggtgtctttatggatcggatagtataggggtagggggggggagggggggggggggttgttagtgatggctggttggggggtttgggttggtgggggcgtgtggggttaggggacgattggggggaggtggggnaataaaaaagtaaatgagaatttagtgcaattattatataataatattatggaagaatgagtagagaangatgggtgggtgtggtggtggtgtgcttcggggggcgtcggtgaggggattagattattggcaactccaccaccttcccttcttttgtcctcaccctcaccattcagtatactgtagtccttcctaatccaccattgcacatctcagaagattgcagncaggtgctcctcagg

SEQ ID NO: 10767 - DNA, 1033 bp, Homo sapiens
  misc_feature (1)...(1033): n = A,T,C or G
cgtaacgacacaaccgcccagaaaacgctccaggcagcattatctggggtctcatgtgacatttctgccttgaatctgcctttcctgacacattcaagtgtttgatgaagctattcgcagcccaccatgaagctctttgcagcccactatcatcagcctccaaacacctttagtctgacaccctaagattcagaaatagtctttctaatgaactctactgcactttatgtaaatacaattatattgcatacagacatatcaaaaaaggcaacccaagagacatccgaggaaagaacctacccggtattcggagcacaaaggaccctctacatcactcacttaccatcctgcgcaagcagaaaatcgctcgcagtctcccgtcgatctcactgaaactgcatcaatgcctctcctgccgcctccacagacactcaccccactcccagcacatacgcacgccgccaaccagatgcagttgttaacagccggggccccatacgaccgcgcgatctgttattagcccccgcgtgaaacattcaccgcgggacttcgcccggcggcggcgccccctgcgcgagccgacgtactataccacaccgtacggtacagttagcgcattaagcgcattctagcccacaccggcgctcgcgacctgtcccgcgcagcagccgcttcgcccgggagagatgttggaacagctgctcccacctccttcccctcgccgcgcccaccggccactgtgcctcccggcacacgggccacgagaagctgcctccgcacatgcagcgtgttccgtggtcggcgcgcggacgggcgtcgtgcgcctcgaggtatccaggctcgacagactacctgctacgggagcccgaccgtttcgacctaccgtgagaagtgactcgtcanccaccatgcaccagaagagtagcggcgcgccgcagactcgccacggcgctncgtcggctcgcggcgacncacacgccaggtgactcatgtgacatcaccgccacagcacaatgtcaatcgccccacacgg

SEQ ID NO: 10768 - DNA, 1660 bp, Homo sapiens
  misc_feature (1)...(1660): n = A,T,C or G
atgtanacactgtcgcgtgtcatgatcagcgcgactcggtctgtcgatgtcgtgcatacgtatagtagatacagtcgtcgctttgcaatgtgtgtagtagcactctgagctgntcagtantgcgangncaggantgtgcgaggtgtcangcgcaatgataatgcctcgatcatcagactgtatcacaatcgngatnactatgtgatgtacatgatatgnatgcgctctcatctagcctcgctgtacgcagttgaatatacacaagaggcagagcatgtaacatgcagatacagtcgagcaagatacgagcagcgcgcagaggtaatgatgagagcggatgagtgtcgagtgatgtaatatctaaactatcgagcgtntcgcagtgtacagagatggcacaggagcgatngagatgtnagtcgtgtcgctgcgagataatactcacgtcgtacggagtctgcagtatgatcgatgcgtgcgcagtgatggtatagatagacgatgnatagtaggatatgacagatcagcgcagttcgcgtaggatataatcgttatgtgtaactcagtatgtangtaggcgttagcttcttnctatcgattatgtaggacgctcaagcacacacacgagcgcatgctgtgagacgtatctgcgggtgacagctagcggctgtagaagtgctgcgccctagtctcaactacatatcgtggaaagaagagtataaagtnacagagtgtgatactatatgagtatgtagagtatcgaganatgcatattagttacagtgtgagttagtcagatacgttaagcagatgagtgtgtnggttatagagacggttagagagatngtaggtagcagattaggtgctctacctcatgcnatactgttagtatcatattgtcatctcgtagtctcttcacgtcaggagaatatacgtacgtcaatgagaaacgagagcacgtcatgcgattcatatcataggtgacacacatgaaatcgaanagatagaatctcacgatgngtgatggaggaatatcaatatacgcgaagtgtgtcatcgagcggaacggcgntgtgtatgntgtgtgagtgttaanctgagacatgactgcatagatagttcataaggcatagctagcanttagatgaaggagtaataagatcacatcatggattgtcgtcagtatacgatagctccataccgtctacgtcaaagtgatatatcagtggacagaacgtaactcgcacgtacgatatcggctggctgatattgatgctaatcgtgtgcagcgaataactancaggattcttacgacgagatgtaatgacatctaagcacactcacttntgtcaccaagaacgatataatgatactcatgttaccacttacagtgtgatatctgcgatgcggtgacttatcgtgatacgatatganaagatgtggttagcgtggttggtgtggctgtacggtcgtcgggtctcaatgatatagtgnacgaactagcactggcggacggagagaatatattatgnacntgtaactctgtacgtagtgttagatgagtgtgtgctctangngctagataatgagatatagatcaacagagacttagaggcatagtatagtcgcatgtacacgatacagatataagacacagtgg

SEQ ID NO: 10769 - DNA, 1295 bp, Homo sapiens
  misc_feature (1)...(1295): n = A,T,C or G
cantcagcgtcacatgtttacgagtacctgtcgcacaggcgctcgcgagatcacgtctaccagtgtatcntaacattgagatacgtaggggtgtgcgatgccgtcctgtgcgttcgatgtactataacactgcagccgatcgcgtcaactgctgtgtnancaagtacactttgtatggtggtagtgtctatgctcgcatcttactatgtctccacgattcactcgttgtgtgcgatacgacttagcantgtatcatctagatctttatatctgtctcggagcgccttcttcggtctgtaacatgtcggcagctatatcgacattatatgcagctatcncgccctggtcctttccacgtcactataccgccttgagcctattagcagcgtaatagagttcaggccaagctagacctgctggtgtcatgtcgttgaatagactaattctgcatagtgctacatgctgcgaacagtgtatggctcgttaaacactatctcgcgttgtcctggctctcactttcacacataacagtttgtatatcttgtatgattgtgatatatcgttagatgctttcttgcgcgtgacacagcgctgattaagtatcgatatgtgcctacactgtcttccgctngtcgagatgctagcgtgcatacagcgactgcttttgttagaatcctgcgtcgcgacgattaatataagcgcaggtctatgttgatactgggtgcagattctcngtgcatcgagagatgtgccttccagccggctctgtgttgtgacgcactacgcgctcctcttnggacagcgcgctataaggcgcgtgtcagtatgatcttacccctgtcagagtgcaatgatacgtctcgttaggtgcaccacgcgctggcgtccgtctacgaatgagttgttactgcctcgcngtccatctntgcttctaagagaggtcactctatcttatctagtctctacgnactgtcacgtgcgctgcgcgctggcgcttgtatcatgctccgangcttcacctgctggtgcacgtgctcgagtcgcgaggctagtagatgcgcgtttgtaacccctgtgtgaggtcaggtagtgttagctagtagaaactcgtagattctgctgctcatctgcatctccttagtaagagcatagttactgctgctatccaaaagaacaaacaacaaaatatggtcctcgttgcgcctaaaacgcggtggagtctgttccgccactaagcttcttttttctcgcgtcgtgcctatcttatctttttgcatcgcatcgcgctccgccct

SEQ ID NO: 10770 - DNA, 730 bp, Homo sapiens
accagtttcaaagccactgaccacataaggacccagagatgagaagaggaaaaaagcctccgtccttcccccgtcagtgagcccagcacaggcctgctgagtgagaccttcacagcgggagcccaggagcctgtactcaagagtctaccccagggctgggctctcagagctggccccaaagagcacatcttccaggaagtcccctctccccttctcctcaggccctgcctggcaaaacctgtcaaattacatctccctaaaaacagatgtgaacattcactacaagaatgtaaaaatcacaaccttgcctaagattagttagctaaacggtggaatagtcataggagggcattccacatagtcattgaaaatgacactgtgggccaggcacagtggctcatgcctgtaatcccagcaccttgggaggccaaggctggtggatcacgaagtcaggagttcaagaccagcctaaccaacatggtgaaaccccatctctactaaaaatacgaaagttatccaagcgtggtggcatgcgcctgtaatcccagctactcgggaggctgaagcaggagtatggcttgaaaccaggaggcggaagctgcagtgagccaagatcatgccactgcactccagcctgggagacagagccagactccatctcaaaaaataaataaataaaataaaataacactgtgaaaggtgtttactgacaaataaaaaaaaaaaaaaa

SEQ ID NO: 10771 - DNA, 652 bp, Homo sapiens
  misc_feature (1)...(652): n = A,T,C or G
ctagtttcttaaggtacttgattgggggagagctgcagtcttctcattgccacaactgccacctgaagatgtagcaagaaaaaggatgcctttctcctcttctgccttctgaggatggaaggaaagttaattaatacagctcttggggctgcattggaatgagactgccatcagaaagcctgaacctactgcagttttgattcctgacatcggaacttgttactctacagtctttattgtgctggcaaaaggagattaattcacaggatgaaaagaaaccatattaatgaaagggacaatataaatttgtattcagcaaggcaaatcagcagtgctctgcaactacaggagcaggaggcaaagaatggcatgttaaattactcctgtcttgggctgtcaatttaaaacaccttttgtgcattcttttctttgaccgaatacatgtgcatttcacacacagtgtgaaggcaatacatgctaacctgcagcaccagcccctcccccaatataaagagttcagtagcaaaggcttgtaagtttaactagagaaatcgcttttattggaagcatttttcatgtataaatgtaaggtagttattaatgtnnaaaananannngannnnnnnnnnnnnnnatggcctcgttggcctca

SEQ ID NO: 10772 - DNA, 181 bp, Homo sapiens
caacgtaaaacgacaagcaaaaacgccttgagtacacttccaaaggattttcgacaaactggctggcctgatacaagatacagatgaaggagaacatgatgatgtaaaaaaaagcattaaacacaagaaaaacattatctttcatttcataataaaatactaaaaagcaaaaaaaaaaaaa

SEQ ID NO: 10773 - DNA, 1925 bp, Homo sapiens
  misc_feature (1)...(1925): n = A,T,C or G
cttatacagagtatgttgtacacgtacacaactcagatcttacttagtacggtatcacgntagacaatagatcataaccgtatcaatacatatctactctgcacgagctgccactcgtctacggtaggtgtgagagacatctatcacccaatccagacaaagcagaccgcgtgacattactcttgacatatcgntgatcttatatatgactnaatcacagactgttctccacttctccgcgtacctacacaacgaccacacacgccaatccacagctaatcaaacagtagtcacgtacactaagagagngagagcgaacgtacgtctgactgtcacagtatntnttcatcacagagagacacactgcaagatcaatagaaataccactctatcgcgagtagtgcgctacataagatgatcaacgctcaccgctaggtacatatgtcatgtgatcgaatatagatgtgagagagatacatattacgatactacactcatgaacgtacgtgcgacaagccgcgattagcntggttgcagccggcggtcgtgncgagatacgtnggtnagtgtgattgcgattcagngtcgaaaccacgacacgatgcgagtatggaatgctnggatcgacgctcactgacatcacgtgcctcctgcacagtccgagcgatcgcgtcngcctgnacctgcacccatatcactngcgagcgatgataggtntcagganggtgaagcagcgtctcgcgtgagtantagtctatacactgctacgtattgaagcgtgagatgtgtgttagacttacgtaatgagtgantcgtgcaattgcagtaacgttgagtgtgcgtgagtgcacgtgttagagatgtgtggatatgagcctanagcacggacncattatacagtagacagcatagatctgttattactatgcgtgtaagtagtgcagaatctatcatgctagtatgtcagatntatatatatatagagtatgtatatgtgaatatacaaggtcgcgacacgttactgcactactagatcanattcgactgtatagaatagaganagttcagtcacnacaacctacntagcggctggtgggcgcgngcactancnatctagccgcgcatacagtnagcgtnagcngatcacgctctgtgctcatagttagtcagtacgcatcatgtcgtagtactcgatgtgaaatntcgcagnttgttgctaggtatatgtgntcagtgcangtcctgtcntcgcgccgtgtcgtacacatgcacactctcatgtgctagacacgtctcacactgcgatactctcactatcgtctacnattagtcaattcgataagtagtattnttatgatcgcntggtgcagctcacgtgctaganttgtcgcgcgagtcntagctagatacttcgatatatatgctcttgtaacnccacctatatacacagagacgtacntgacanctcantngtgcgtgcacatctacgctagcgnactcgctnttgcntcgcgcgcgacgctncgtctatngatcgtctctacatatatgatctcatcgtacatgactcaganctagntanctntnatctgtcgcatagctagtagtnctaactatagtctancattcanaccatctatgcacgctgtgcgngctncgtacaagtantcatatcatctgtacatagctcacaanattatatagagcatatacactctctatctcgccggacggncgacactatcanatgaaacactanagatcaatatcgatctatcagagtctgagantctgagcgngtngtctctagacntngatctcancaaccgatncacactactgcggtcagtagagctggcgagcgtgctgcgtngtcaatgagtngantgatatcgcttagcnntatgatngntcgatgtcgtatc

SEQ ID NO: 10774 - DNA, 1129 bp, Homo sapiens
  misc_feature (1)...(1129): n = A,T,C or G
ctcgctaattaatacaatatagatacacatagtacacgtcaacactaggaacatgctagcgcgatgacgcaccaatgagatgactgcgagcatattggtcatccagtctacaacggatgaagtaaagatataatcgccacgcacacatttcaccgatcatagtatagcgagcgaacagatgtatctgctnaacataactcgagagtaagagaatagatagatgagcgcgtgtgtgcggtcattaaatagtcataatggtacataatacgacatatagagagacgaatggagacataggcctatactccgtgcttgccaataatcaagtgcaagaaggaggggcaaggaaatacacacagaacgcgaatcgaaggcggatagatacaacgcgcatatcaagagtgcggatggcatgtcatcgagtctttgctgcgtgaataaggaagagtagagtcgggtataggttgtcggagcatgctaancaagagtatttacagataactaatcatgcgccgctgctacatactggatacaatgatacacacgaggtatgcacgagcgcagaatattatacaacacatacatcggagtaagccagagtcatcagccgtgcacgcgcaaggcgcgctacagacgagtcatgaagactgtatctanagtgctgactgcagagagatgcagtnttatactgactctatgagctcggacgcgctatgacttacttatcatagggatgtgttcagcaagatgatatagaggagctcgagggatgttgcgctctcctaaagtgatagtacaagaatcttcattgacaaacgacaagtagatatttgacgtatgagcatacatattagatccgactagaattaaattagagtgtctatcttacacaaaagtgtgctcgtgtatatataaacatcattcattctaatcgcctatagacataacaacgtagtagaatatacagcgatcagaaagtatttatctatattaccatagaagacaggccgacttaaatctcctaaacatatttgctgtagtctaactttactagtgcatttgtcagagatttgttattgctaatagcaacacatacaacagagtgcacactttaaaaaaaaaaaaaaaa

SEQ ID NO: 10775 - DNA, 1504 bp, Homo sapiens
  misc_feature (1)...(1504): n = A,T,C or G
atctccggatacgtcntgatctaccatcgcgtatcgtgtcgtgcgcaccgtctgtgtcgttacttactgcaactagtcgttcacgtgctggtcatcgcgctgcgtgatgtgtcgacgtctaagtgtgagtatccgctagtcggcgctgcatgcgtcgcacgagtcctagcgtcagtgagacggtaacgtgcagacgantgctgcatcttactatgtaattactgtagcactatcgatanatcacgatgtacgaggtctacatcagcgacgcgcntgtgacgcagccagcctcgagaatagtgcagncatctagattgtaagaacgagagtatgtgttcngcggaggagatgtgtcgtgtntgcagatagtctcgctcgtcgtccgtctagcctcagtctctcttccgcatcagatctagacgcgtcgcacancattgccgcgcgcgacggtcggtcacgtgtcgatgcgtggtgtaaactagtaacagtgtgatgaganagcagccgacgtcatatactcaactactgaggctcatnggtgcgactcgtaagnagcaggaggacgtcgcattcatgcgtttcgccttgatatgtgctattacgagcgacaaggttaaagaggaggnaagtatggacagctacgtagttcgcagtagcgttcttcgctagtctctgcgtcactcatcgatatactacatctatccgtgcgcatgtncgtagacactgcgtgtacgcatcacggtaactctaatccgtaatgctacacatgcatagcaggttgagaggtatatgaggcgcggcagcaacatctatgagagagcgacgtgcggtcactatgtattgttatgggcgttccggcaatcgctggcgcacacgtcanagagacgatggaagacgcatgatatgataataatgatacgacgcagaccgagtacggcgtctcgctgagataacgcgtctgtcgggttctcacatgtcaatatattctcgtctacacnggcgttgtggaccgacaatacagtcagaagtngagacggacagagggcgtcgagatgtccgccggtacgcagcacgactatgccgtcactctagcgtgtaggacagctactacgcgnagcgaagtggaagtgaggagaggggtgtgtgtacgtagatgcgacgcgagcgtaggactaagataatgaagatacgttctcaactgagcgaacacactgccttcattagcagcagactcatctcaaactcatcgaccgcccgcgcagtgttgtgcgcgtgtggtgtcgtcagtgtgtattgtnagcatgttagtcgcttagtagcgatgacgtatacttactaacgcattacgactatataccgctcagcgcattactcatactcgtatataatatcaacgatacctgcgcnggatgtacgacgacgtagtgggatgcagaccgcggcggtatgcggactgccgcgtcgctgcggagcggcagcggcctgggaggaattgcacgttatc

SEQ ID NO: 10776 - DNA, 747 bp, Homo sapiens
ctggcactacggagtgctccctatgtttctggttctactcccttgtccatgtcagtttataagagttacatattgtgctaaaaatgatagacttaagtgccgacgtctaattgtcgacaatacctatgaaaaactctcgaggcgaggttaatgttactggcagcatatctatgtgcgcaacaataactagaagtatctgacccccatgcatccgcggtcggtcactccgcgtacgcagcgacccggccgaaatcataacggtatagaagcatttccatagataacaaactgcaccaaatgccgcccagtctaagccgcgacggttcatgctgtattgatgctcaatatcttcatagcactctctttctttttaaataatggtagtagttaggccgcataaggtaactggattaattgggattgtagaatacaatttgctttgaaacgttccttcatatggtattaaatgcgagagagaggatccctttggcatcataacgatgcatacagggggtcgtaggctctttaagtatcagttgatgaggtcttgtacctagtggcctgaattcacatcttctttcatcccacccaataaaataagtgctatcctcggcacacttttttcctattccctgtcccagctaaggtaatctcccaaactatttctgtagctcacttctagtcaatgtcaggaccttgatggcaatagaacaataactaagttctgctttgcaaaaaaaaaaaaaa

SEQ ID NO: 10777 - DNA, 978 bp, Homo sapiens
aaacacaaaagccaaaatctactctcctttaaaggatacggctgtttgcaaactattctaatcatctttatcatcataattcagttcagacatttgagattttcacctctccaaaaatgctggtgtacaaactggtgtggggccctggattcaacaagtaaagattataatacataaatgtaaaacatgattatgactttacccaaaaatatcattctctcctatattcttacaagttagcgccccattatttcagctctgataccacctttcggtgatactattgcaaacaatatacaacttacatgcttatcaaccttggtacataaattcacaattcccacatatagacaacctccattatacaggctacagagcagagaattgcctcaccaacagtaactatcctaccaactggtcacattattgaaacccgaaataccaaaacgagagtagccgaaaactgcttgaccctacttaaatacagtcatataataccccggggactcgtaacaactcaacaccattatcaattgagttatcagcaatccttctcacaactcggtccccattccataaaatctttattctttttcctcaagcaccctctataactaccttttgagcccttccatttgaattctttatctcgctaagtactacaccagcagggtgtatcatcttgttatattaccacacctcaccccggcagcgcagaaaccaaatatccgacgccattctgaacgcagtaacgacagcgcgacaactctccgccacatcatcgacaatcagataaagtacagaatagcaaaaacaaaaatattagctccgcactactcgaggggacatgtctcttacctcactccataaagcctccattaacacgtcctctacgcacctactcccacgctagcagcgccacgatctattaaactctagtaactatgggcacacccatcctttctcaactcccaatcg

SEQ ID NO: 10778 - DNA, 760 bp, Homo sapiens
  misc_feature (1)...(760): n = A,T,C or G
ggaggggtggggctggtggaaagcacgggggacaggcgtgtgaggagggggggcgggggggagggggggcgggggggggccggacctgcatcgatggagaggagaaggaggggagcgggggggattggggaggggaaggcgccggcagaagcgaaaagaggggtaaggggggtggggggggggggggtgaggggcggggcgaggtgggcaggggggagggaccgtagtgggttagtagtggctgggagggggggtggtctcgagcagggggaggggggggggggatgcgtgaggtgggggcgggacacagtgacctcgagcgagagaggggctgagggaagagtggggggggcgggggagagagggaaggaaggagatgggcggggggcgcgggggccgcgggctcgcgggcgtctggaggcaggcggcggaggggcgcgtgtggtagcggtcgggacaacggcgaggggtcgcccgtatttcaccacctccaggaggggcagccagcctgccgcaggagaaaaaaaaagaagaggggagagnncactatactgaaaaaacataanaaagaaaacaaaaaatataataaaactactcaacaaaacgacancaaccttttcgttccgtttctgtactttcttgtctctctttctttccttcttataatttacttattttttaataaatatacaaaaactataaaaaaaaaaacctaattaaaaaaaaaatcacatcaaaatcttatataaaataacaaaca

SEQ ID NO: 10779 - DNA, 741 bp, Homo sapiens
cacactgtcccggggcgaaaaacccccggggtgtgtgaaaacccccccacgggggggccgggtggggggggttataaagggaaagagaagagtccggcgggacacccccccgcggcccccttttttgttgggggcggcccccggttttttttatggggggggaaaaacccccgtttttggacccccgcgggggggggaacaggattttttttccaagaagagggggcgctgtttttgggggccccctctttttttaaattttttggggggggggggtcccccccccctttttttttttaattttcgggggttaaccccccccaaaaaaaaggccccccccaatattggccccagggggggggggggtttttaaaaaatagggttttcccccgggtttaaggggggggggatttttttcccggttgtttttccccctttggccccccgagggggaaaaaagggcccccccccttttttttttttaaaaaaatttttttcccccgggggtttgggggggggttttttttttcccccccccccaattttaaattttttacccggggttttttccgggggtttttaaaaaacaggggggttttattttttttttaaaaaataaaaaatttttttttttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10780 - DNA, 1553 bp, Homo sapiens
  misc_feature (1)...(1553): n = A,T,C or G
gagaagtacgcgacgtacacagtactatgcaccgtctcagaccacatgaatgtgagaagagtacagtacgctctgtcgctgtctatgccactagtcaggtttgtcgtattacgtatcatatagttatcttatttctcgttctgcatcttatagaggcattactcaactacgtagcagcgtgaggaattatagacttagattcattcgcccaaatccagattatatctcatttctatatgaatctcttacatcgcgcgttaagcacaatgcactagaagaaggcgtcgagaggcgacgtctagatatgantatagacacatgtggtgtcgtgtntcgtagaagcgagttgcagagagcgcacatacggcgctgactgcgcgcaggctagtaagtgcgttagctcgctgcgtcttgtcgtgtaggacgggcnctgtatacgtgcagcgaangcgtgagagcgtactgtgantgatatttaaggatcttaccctcaacacnctgacctctcgcatatactggactcagtctagaataccatttctgtgcgatgttcaatctagagttaatatattatttccgtctacaatatatatgaatatgtcgtgtgggtgcagcttgcattatataatatcgtatagccggaaatgggtggtcagagagggtagacggcgtcgcgcggtgtttgacagatatcggcgctcgattgtgtggcccagttngacgctcaccgcgcctatcatgtcacatcgagtgcacgattataacacagtgtttgatgtttacgcacatantcgaggcccgtccgagtgacgccagcaggtcntctatattgacgtctgctaactntattacaacgccgtccttcacgtgttaagggttatagantcttttcggacgtcgccactgcgcatggcatagaattacatacgcacagtactcgttcacttccaacgagacttcattataacgttagagcagataaagactatatgtcgcaatctagtcgtagcgcgtcgaggcgttcgggcgcggccgtgaagatcgatgtgttcttgcgcggttgacggtcgtgagcgtgagaggtgattagtgttacacactgcagcaaggcgtctcgagtacattgaccgcgcgctggtcgcgagcagatgtgtcgtgtcattgctcgagttctcgtcgatgcttagcctgtgtccgcgatgtgtaatgtcgacacgcgaatgtggtgcgcgtactgcgtctaccgcgtacagcgcatatagaatcgcnataagacganatatagcntccggtacttcgctcatctatcgcctttgaatctatngatgcgangtgtgtgattcgcgtgtgattgagctcggataggtatgactgtgattagntgtcccctgtgcgtgctcgtgcgtagtgagcgngtgtacgaacgcngctaccgcatacntgtgactatagtacctantgcgcncncttgctctactgngtaccatgtgagacaggatagtattacgttcgctacgtatcagtcgcgcactacataagcacgancgtaagcg

SEQ ID NO: 10781 - DNA, 1003 bp, Homo sapiens
tgtaggtttgagagcgggtcgaacacgcacttaaagataacacggaaattccatggtaatctcaagttattatgtgaatattgaaaaacgaaccctaaagtttatataggagagggggagggtgcaaaagagccagcacatattgaaagagaagaacaatgtcagaagattgacactacctgacttcaagacttatgataaagcttcagtgtataaagacagtgtgggatggactaactaatagaaatacatatcagtggaacagattataaaagcgggggtagatccacataagtatatggtcaactgaccttggacgagtatgaaatatctatacgtggttagcagtagttccctttttactatacaaatgagcatccgcgttcaagaaaatgtgtatcaagttgttctattcggctcaaccaggtgcagctttgattggcgcaaattttgagagaggggttaagtgattgatactcgcgccacatgtcgaagtggtgcttgagtgcggcggctgcgtgactaacggtaattgacgtcgctgagaggtcgtgatgtcatgtatacttcatgaagtccggcgtgtgcggagtgagtgtgttagaggagcgtaagggccgccagattgactgtcgacgcggataatgagccgttttatcgcgtgattagtcataggactagtttcgcctggataggtatgaaactatccgccgtctacagcactatgtaggcgatcgcggtcgtatgctttatatttctgagtattggtccgggggagatctgcgtgtgacgcgtagattgtcgaactcagagttataaacgtaatggtgggagggctgtcttgtatagtgatgtgtgagtatttctttgcctagcgcggacatctgtgtagtgatagagatgatatgtcgtgtgtgctgtcgtggatagcgcggataacagagcacatatggtcatgctacttgacagcagagatgagctgaagacaacttatcacgtagag

SEQ ID NO: 10782 - DNA, 1789 bp, Homo sapiens
  misc_feature (1)...(1789): n = A,T,C or G
tgtcatanggtactgatagcgagtcatgcngagacacgaacgtgagtagtatgatggcatctanagcgccgacactcgcgtagtacgagcagacgcatacatccgtgacgcntctacagtacatcgctcntgcatcgccaatcatcgctagtngagcgtagagcagaggtgcgngtctataatntacanctacgtacgatcgatgacagtatncagagtgancctcatagcagtgagctcgatctgaaggactgctagtgcacctcagctatcgtnacgtatagtcgctgaaccgtgtgatgcgacantcgcncgcagtcntgtcacacgacatgtgtaactgatgacgcgtagcgtcgggaggttggatcgcggcatcgggtctacacacccgctcgagcacctcgtagcgcgcgacgcagaactactntcattcagccgaaatancctgctcggagcgaggcagctacgtgccgaagcgtaagtacgcatgatatgactntaactatcngtccgtatagantctctgcataccagtcgtgcatattgatagtatgtgtntccgcgtgtntatatatggnactgcgtacgtctgctgacagtgatcgagatcntcactctagtgatagagaggagaaanacagatcctatagagtatcagcgctaaagatgcgactacgaagtcgtagagcgagtggcgtatgcgcagtcatgcagagcaatcgcactntgcacatcactctacgaggtcgttgactgcagtancgngcncacttaatatgatcgagacgacgtgcgactacacgtcacacttgtagctatnggaagtagatgagaatgtgcatagccgtagatcgagtcgcgtcgcctaantacacgctcnacacgatagtacatgactatagtanacgatatacaagtagacgatcaacatcaggcgtagccagcgccagagagaggtggtgttagctacagattcatangaaacatnagagcagacangnagtacactctgcgctcgagtagacncaggcgccacagctcantctatagtgatacgagcaatctagactggctgtgatgtgtcactctatagtatactagacaatgngtgtactgtgtactaggtagtgtgtatnagtagaatagagtggtaagtagatgtaggtatgtactaatgaatatagagtgcgtagctcgggatatatacacgacatgcgatacgtacgctcgtagcgtcgcgtcgntactcgaagtgacgccagcggcagaagtgcagtactagagagctcgagagtcgtccgtctgagtctcgacagtcgacgtgcagtagggtgaagaggtgatatagtagagcgcgaggagatgcgtatatgtagaactacgaggctacgcactagtgcacacctatcgtcacctctgttgcgatgtctgcgcctccctgtcctccaccctccactatcgcactatgtctaccatagacgagagagatacacgcaccgcagtcagatctgtgccgctgagatgggcaacgtagtacgattagaagttatcgctgcggctgcgttgttcatccgccgcgtatcgttcagcgtaacgtatagtatatatgtccgtacttcatcacgtcatatgtatactatataacaacgcgcaggtggcggagaataattagagaacagatagtaaagtgctacgaggcgagggctgtagggtggngtgtgtagtgaacgactgactgcagaggcgttgcggcgtactgtgtgtcggatcctcgtcgagtctgcgc

SEQ ID NO: 10783 - DNA, 1513 bp, Homo sapiens
  misc_feature (1)...(1513): n = A,T,C or G
cagctctcgttctctcttgacctgcgaggtgcgattgtgtttacggctgcatggtgatacgtgttcctagatgagtgatttgcggtgtgttgtgcgatagcgtgccgtgttgtctatgaggtgagngtatctatatgtgagggtcgtcgtcgtgtaatgatgtttagcggtattgttgtgacggtggagtactcgaggtatatgcttggtagaacgatcacaattggcggcgtgtggtgtctgtgatgatgtgcgtgtagtgatactttatcatagtggggttgcgcttcgacagtgggttggaatattgtgtgtgtgtgtatagcatcgtgtgggtaacctgattgtgntttagagatagttagtgaatggtgttngcgtggacatatcgcatgtcgatgttcacgatgctctcgtgactccactcatgacgatcgntgaatgcggagagtgttaattaaaggatgtagtagtgatgatagcgatactacgtggcatgcgagatgagcgcgttcgagtgtactgtctcgncgagtgngagcatgtcgtatctatttactctatccgtgnggtatagtgttagaggtgattcaagcagcatctcacgcantatggatgtgtatgtagcgatagtgagcgtatcgtgagtcctcgtgtacatcgtangtaactcgatcgatgntcctcgtgcgtggcgtacatattgcgtgcangtagnggtgtgtgctgtggtgnngtgagtgctggtgtgtgacgagtgtcgctgtcgttcgactcatttacttatcgtggtatagagtgtctgctggangatgtcgcttactaatctnagtttgttagtgaggtgcgtgtgtgtcgtatgcgcgacgacgtgtgtgtggagagatggacgatgatgcagngcgaatgcatggcgcgngttaatagnggtatgtagtacgctgcgtgaccgcgtggaatctctgcttagtgattacgacgtgagtgtagtcgataagtgctattgctgtgggtatcatagagagaggatcacaattctctagaggtgaatcgtttactatgtccgtgtctcagtgatcatgactcgcgcttctgagatacnacnatcgtgcacggcgagtacggacgaggcagcggatgcgctctaggtagtnatctataactgtgctgtcgngtnttatgtacgcgagttcgtaccaacggtggctcgcttgttatgtcgaagcgtgaaggtaggaagtagtctnagtgtgcaaggtgacgcacgcgagacagaagtgaggcgctgtgtgtcgagcgtgagctcgatacatgtaatgcattgccgggcggtgtctagaggaagaagagatatacaataatangtatatgcgtctgtgctgtctgnttcttaaaaagcncgtngcggtnatcntgggtgctctctctgtntgagnnctattggtattcgctgngctgcgtgtcttctgctttgatgtgtgtgtgtgctctgtcatgcggcgtggcgcgtgcc

SEQ ID NO: 10784 - DNA, 1144 bp, Homo sapiens
  misc_feature (1)...(1144): n = A,T,C or G
tctctatattttaaggcagccaaaccgcaactaatgagaaacactcagccgggcgtaatgactcactcctgtgataccagcagtttgaaggccgaggcaggtggctcacctgaggccaggagtttgagaccagtctaaccaacagtggcatgaaaccgtcatactcctacgtacgaataataccaaatatgtagcgctaggctattggtgggtcgcactgcgcttgtaattccacagcatacctctgggtagcgcttgagtgcggcgacgaatactgcttgcaacgctgcggatggcacgattgttgcgagattagcgcgaggatctgcacccattagcaactcgcagtccttggatgcaaacaccagctgtagaccttccattctcgaaatagaaaagtgatgtgatactacaacgtacgcagtgacttttatttacgcagcatataatgtgcgcctctcgctttgacactaaatgcagttgtggagttatcatggtggcaacgttttcactattgagtaagaggcgctcagatctcatgtggtgccatcgattcngcgggaataatcataagaactggggtatagttcaggccgtgctgcgggacaggagtatctataagtgacgttccatagggcagggatctgacggatgatcatcccgagagtcggggtgtgtagcctgcatggatgtagacagtgtcgatgccgagagacggtatnatgatatggcatcgcgaaccgaacgaaagtgacccggaatgtatagtgtgtatttacataagagagacatatacgcacgcaataagccacaccaacactacaacgctcagatatataagtggctaatccccgcctagatccttaaaacaagccgtaggcaaggctgggcgagatttgcgtaaggagctagcggggcatgacatgaggggacgagggggaaggtgcgagttatactctcttacacaggcgtgcgccatttaatgaaatataaaggtggggagggtgatagtggtaggtacaggtgtcgatgggttagtgttatagtctaatcgacgttaatcaggcgtgcgcaacactgtagatctagcagatcacgcacgagatcctgcagacgggcggccacatcgcaattgtattagcca

SEQ ID NO: 10785 - DNA, 733 bp, Homo sapiens
ccatttttattcttaagaataataatccctcaaagaccttttaaaaaactgaatttttatcatggcaacacttttttagttccttttgcgagcttattaagtcaaaagttcaggttctagtctgttgatctgcctttggtttccccaaaatggccaggaattccatttgtttgtagaaaatatgcctggattttcattataaaaagtccatggtagggagtagagactcatatcatggccttttaaatattgtaataaaggcaaatagatatttgcccttagtttactggttaaaagtttgtttccagaacttttctctggtgcttaaatgatgctatgtaaaatgtcatgagtggaaagaatatttgtagtagtaacaagaatttttcattaggaaagatttcttaggttttgaaagaatacattaaaataaaaaacttgcccctcctaggtaagaactttataatgaagacatacattctttttaattttactcttgctcttgttaaagatttgtttgaatatagaagatgcatgatttctggtttttttttttttttttgagacagagtttcgctcttgttgcactccatcctgagccacaagagcaaaactccgtctcaaaaaaaaaaaggaagaaggtggatctccaaccaggccagagaagattctcacagaaggttttgaactctaagaaataaattggtttggtaataaaaaaaaaaaaaaaaaa

SEQ ID NO: 10786 - DNA, 1629 bp, Homo sapiens
  misc_feature (1)...(1629): n = A,T,C or G
ctcgagcgagagctgcgagcgaactcacacaatctctncntcgcgatccgacgtcgcatacgcgacatcgagctgcgaancgcgccagaagagagatctattagatctagcagtaataatatacgtcatngcaatagacgtcgacttacattcatacactatacacagtgaacatcgctcgctcacttacctcatacgtctgcgcttccgcgngacatggtctctcacgantagtgctggcacagacccgccgtgtagcgcagntcgtagcataccaaccacatcacattctagaatgccaacgtagtgctgcgacgcgtatgctatctctggacaccgtcgcgtggagccttgacattctggtatattctcgcgactatgcgacgatcagcgcatgcgatcatcatantagcaagtagtnctnaatgcaatacgtatgtaanantaccacgacacgcctgtcnacatgtgtgtcactacaatacacgcatccagctatcgttctacgtatcactcacgacactacttcactccgtgtctcatatctcacactcctcagtgtgcgagtcacgaggcgagcgcgctcgtgtggatagtgcgtacgcacgtcgcaagagcatcacagaacggngctgtcgagtgatggtnttcagtctgttccgtacatcttcgtcacacctcgaatgctactccccctactacacttttgcatagaataagaaatcatgagataagangcacagccgcgactcgactcacgacatcatgcatcggcagagtctataatcaactgtggatgtacggtgagacgtgngtacatcacatatatcgatacacctaactcgagacaccatcacatcacatcgactgttcattacacatcatgcgcgtgagtatgaagttacgtgagtgccgccgcgtctgancgcggntcacgcactcagcgccacgactgcgcggagtacacaggattgcaaatgtcgtgagtggtgtgcgatgagtggcggaccgttgtaggagcgcggatagacgagatggngtgtgtgaagataagtgacatgtagcggaggcgcggattatatgatagatagaagatgcccgcctggaacgccncatagtatgtaagtggtcgcaggacctgacgacgtgcgggcgcactcgtcgaccagcgcgccactgcgacgtaatgtattcacatatagcaactactacaatctatgacgatgtctacatgagatctaaacacgcccacatcgtacacacatatcacgcggactcagatcgtcagccgcactgcgtatctccatcgctcacccaccatcatgatacataaaccaagangtatgnagtgagtcatctcgtccgcctgctccgagcgtggtggcgtagcacgcgaaccgaccagtcacagttgagccggagcatctatcaagacgagtcaaaggacgacgagaaggatgtagtgtaggcgtagaatcgaacaaacccattaatctacaacacgtgcgccggcgcggacaaaattagcgagcgacctccgacatacgatcatcatgcttaactcttgaaacacataacggactgtgcgctgtggtccgatgccgagctggctactactgcactctcatc

SEQ ID NO: 10787 - DNA, 1355 bp, Homo sapiens
  misc_feature (1)...(1355): n = A,T,C or G
cntctgtacagctccgtgcgtctctcctcgcgcgccctgtcgcntggtcgctgcgtggtcggcctgcgttcgcgttcgtttgctgtgagtcgcgcgggctcgttcggcgggtgcgtcgagcgagttgttgcgttgttctgctctttcggctgcgtgctctcgtcgtatgtgntatgctgtcgtgtggtgcgctcgcgttgtgcttctgcgcgctgtcatctgcgctcacgtctgcgtgtgacgtgcggtgttgtgcggggctgttttgtctttgttgttcactttctgttgcccgcgcgtggttgggatctgtcttctgtcgtggcgtccggctccgctgncgcgttctcgtngcgcgtatcgttcgtcgcgttggtgtgacgcgctgtgcgcgtcgggtgcggttggagcgttcttgtcgtgcgctcgggcgtgcaggctgtcgctgtcggcgtgtggtcgtcgtgcgcacttgtgtgctctcctccgcggccgtgcgcgggcgctgccttttgtggcttgttgtggtcggctctcgctctttggccgtcgctcgcgggtctgtcccttgcctctcgtccggtcgtcctgcgcgctgtgtcgtttgttgtcgctgttctgttgtggtgcgcgngggtcctctctcgcctcttccggtgtgccttgtccgcgcccggcgctcggtgcgtgtttcgtgtgcgtggcgtctgcgcgggtcgccgggtgtcgccgtcgttttgttcgcgcgtgtcgctgtgcgtgctgtctccgcgtttctcggcttgtcgtgtccggtggcntcgtttggcgtgggctgcgtgggtcgcgtgtttcttcctgggttggtgggcccgtgtggccgtgtcgcttccggttgcagggcggcgcgttctggttcgctgtttgcctgcgtccctcgctgtgttcttgtttgctgtggtcntttgtcgtgtgtcggggtgtggttgtggcgggtcggttgcgttctcttgttctctgctttctcggctcgccgccggtctgcgtcgntggtcgtgcttctcctgggtgtctcgtgggtctggcgttctctgcgctgcggctccgctgccggtctcgggctctgttgtttcgtcggtgtctccttntccgtgtccttcntttctggcgtcgcggtcgcgtcngtcctcgctctgtggtctgcgttgtcggtggtctgtgctgctctgtcgctnctcaacgcctcgtcgtcctgtctgtttcgggtcgctgtctccgcctcgacgctgctctctcgcntgctctngtgcttntntttgtctctgtcgtctgttttggttcgtgttattttcgctcgtcggcttgactcgtgtgct

SEQ ID NO: 10788 - DNA, 294 bp, Homo sapiens
gcgattgagtgtcggccgcgggagcgcaagttagagacaacagattgcgaccattaagaaaagacaccaagtgcacgagtacccataaggacaaccatgtgaataggcagtgggaaggggccatctgcaagcccatgagagaagttgccacctgcatgcccaggcgagaagttttggaagaaaccacacctgctgacaccttggactccaacttccagtcccagagtgagaagaagataaatgtctgttattgttaccaaaaaaaaaaaaggggggggcgtgtgtgcctaaaga

SEQ ID NO: 10789 - DNA, 970 bp, Homo sapiens
taaatctgcgctacaatcgtgagaagatagcattaaagttgctgcagctcgtacctatatacgccgggatgctgtgacgagtagactatttttactccggaggaacacaacctatggccgcccgactgatcaccttcagtcgccttcgctgggcctggggggggaactggacccgagattgattgttgttcgggggacagatcgatttgggaggcagggtggcaggggatcgcccggccgtcatcggacggaggattttggactgtgtaggggtggcagcacggagggcgcgcttcttcgcgtactatgccatgttatgaatctttgcttcgttccacctcttgtggggtgggcggtcgaacacttcacttaagggcctacttatgataagagtgacgcacaaataccgtacacgacctcaacacccttaccgggctcccacgcagggcggggccaattggtgttggcttagatcgccccggtgagggtcgcggcttccctgcgtggccggcgcatacatcaccgtacgtcaccttagcatgagtcgattatgatcacattatataccgccggggggataacggcggatattgtggcgcaacgtcatcctgacacggaatgaaaaaaggttagagaaaggaagcgctgcgctaccgccggtgtagtgctgtgcgcagcggccccgtgattgtacacgcgacaccaggctggaaacgcacgacgactacgattacatacgcatgggtgatcgcgtaaatccgaggatagatcaagggtgctgcgtctaatcatccctaatgatcctcgctcctcctcaccccccttcccaacttcccatgtcgcttctccctcttatgctaaataattaagtactcctgcgtcgagtttgagaggcgctcaggtattcgtgggcgcctgcgtctgactccagctacacggcgccgtacagaatcgtattatgcgttgtacc

SEQ ID NO: 10790 - DNA, 1178 bp, Homo sapiens
  misc_feature (1)...(1178): n = A,T,C or G
cggtcggcgttgcttgttgcgttggtctgcgtgtgcggcgtgtgtttctgcttagtcgctgcctgcgtgcgtgctgcctctcgtggttcgtcgctcgtctgcttgttgtgtgtgggtggtgttctgatatcgtgttcttcgctgacgtcgttgctcgcctctctgtgctctgcggcgtcctgtgtcgtgtacgtgggggcgagccgtattgctctgtggtcctgcgctgctgtctttgtggtggtgttgcggtccgtgtggtcgttgttggtcgcgctgtcgtcttgccgcgggtcgtgtccgcttggtctttatcagcccgtgttcgtggtccgcggggtccgttgctcgttgtccgcggcggcggttggtgtgtgtggccggcgcggcgctttgtctcgtcctttctctggctgcgatgtgtgcgcttgcggtgtggtggtgtgttgtttgngtccggtggtgtgtcggcttcgcggtgctgtcctcttgtcggcgctcgtcgccggcgggcgcgcttggctcggtcgtgtggcctttgttctcggcgcattggcgtngcggctcgcggccaccgcgtggcgtcggccgggtgggcgtgtcgggcgcgctcgcgcgcgttcgcggtccatcgggcggctggcccgggtgcggctggtacgtcctctcgcgcgcgccctgcgggtttggtgcggccggcggcttgttcgtcggcgggcggcttctccgtgtgcgttttcgcccttgtgtcccgtggttgggtggtctgcccgttgtccctctgttggtgtccggagtagagtttctgtgcctgtttgtggttttcgcgctagtgtggtcgggtgtttccttctttctctccgcccgcgtggtgggtgnctggtctngctttcttgtgcgtgtgcctcggcgctngtgtgcgtcgttgtgcgtgtctgtcgctgcttccgttgttttttctcgtttcggctgctctcgggcttgccttggtcccgtggaggtgcgggggtgttgtttgccggtttggtgctgtttttgtctgccgcctggttttttgcttcgtctgttggtcgtgcgccgctcntaacnntcgtgggggggtcgttttcccccacgacgcgttctgtttttcgttctttcgttgtgtgtggtggggtggcgggggtggtgggcgggcc

SEQ ID NO: 10791 - DNA, 259 bp, Homo sapiens
cttagattgcgattggctgatggtcgctccacaaagtatgaaatttactcagagttaaaccagaagggtcgacagcacgggcttggaagtcaggtacccctggctaggtagatcagcctggcctctaagcagctgcagaagcctggccgagtcacctgacttcactgtgtgcctctttgtcatttctagcatggataccattatgtctctttactggggtgagaattaaaatgcaaaaattcacccaaaaaaaaaaaaa

SEQ ID NO: 10792 - DNA, 968 bp, Homo sapiens
  misc_feature (1)...(968): n = A,T,C or G
catattagcaccatttagcgcaccccccctgatgtgaactacngnaaaaggttatggccataacggctcctccctagtgaatgggattagatgccctcatgagagggctcgactgagggagtttatcctgcttgcccttctgcattctgccatgtgaggacacaatgattctcccctctgaaggatgcagcaataacgtgccatctcggaagcagagagcaaccctcaccagacaaccaaatctgctattgccttgatttttgtacttcccagcctccagaactgtggtaaaataaatttctgttttttatacattcctcactctgtcacattctgttctagaagcataaatggagcaaagcctcctcttaacatcatttgctagtacatcattaaatgaatacaatgcactctacataagcattcaactcctgtacatgtatgaaacaacttacccttccgccggtattaataatattgcaatatatctcctgaggcatgataaaaaaaaaaaatggccttgttggcctcaactgggaaactctatgcccacctcctttaattgagggctatttcatgatccctcgctaatgaaccacttcacctaggccgttccgtctctggcaaccgtttccagttaactctaaggcctaattccggttatccacaaaatagggggctactccctgttagaatatgtatccaatcgccacatagatgcccaatatataataatgccctattcgctacatatcctcaaaaggttccccacccattacaaccctcaaaaccataccttacagcaagcggggaacaccctactgcacctacatcaccccgcgtcctccacataagaaccccatgctcctaaacggtctagcagaccgttaagagactgttgcatcttattcctagaaaaataataccaccccaacagccctaatggccccccggtttcggctgtcccg

SEQ ID NO: 10793 - DNA, 1391 bp, Homo sapiens
  misc_feature (1)...(1391): n = A,T,C or G
agtcttttctgtgtgtgtgngtctgcgcgtctctctgtgtttctgtatggcgatctgttcntgtgtgcgtgttgtggactggncgctcgcnctctcagctggggcgccgcacgtcgcggctcttctctctgcctctgcggtgcgtatgcgctgttcttctgcccgtcgtgcgcgtcttgtgtgtcgtcgtgtctgttgagtccgtcgagggtggtgggtgntgcgtcgtggcggagaggcgtgtcgtctgcncgtcgtgggtgtctctctctgtggcgtccgtgctactctgcgcggcgtggtgcagctggcgtcggcgtgggttggtatatgtgcgttctntctctgggcgccggtgtggtgcgtgtcgacgtggcttctgctggtgcctcgacgtcttctngtctctctcggcggtgtgtgcgctggggtctctgcgtgtgctctgcgtccgcgtcgtctgttatcgtcgtggttgttgtgtgtgccttgctccagtcgcgtgngcgcgcgcgtcgggcgcgcgcgctcgcgtgtgtcggtagctcgctccntcttgcgtctcggtggttctcgcttgtatctagttctgctctgngngcctgcttcgtgttggtgnttgtgtgtgtcctgtttcgtgcgtgcggcgtgcgcgctggcgtgcgctgctctgcgtgcgtnggcgtgagtcgtgttggtgtgtctggngctgtcgtgtgtgtggcggctgcgcgtcgcgcgcctctccccgatcctcctctccacgggctgtacgtggnggcctccttgagcgtctgatngaacctctctgggangtgttcggttactgggggtctgtgtgctgtacggagtatctgtgcctcgctactcggcttggcgatncncgcttgttttgctacggggctgtgtgtgtgtaaggtcatctttgtcgtctttttttctgcttcgntcctctcgcggtctcttttgttgtgtttctttgctttgtgtgttctcttcctcgctgctcgtnnaccccttcctcnaccactcccttcttcttctcttctctnantctctatctctctctcctctctctctctatctttccctctcctctccctctcgcctcatcctattactctccttctcttcnnnaccctctttccctgcggngtcttcgttttcttcttgtgacccttttctctttcctcgttagacgttctgtatcttggcctanggccctcccttcgcgccgcctcccgctcaccccnccgcgctgcgcttcctttnctnctctatnncttccttccgttctttctctctctttctaacttttctctctctccnnttctncnntcccgtctctctcccncctattctcctnggttctctcttttttctcttaaggc

SEQ ID NO: 10794 - DNA, 1330 bp, Homo sapiens
  misc_feature (1)...(1330): n = A,T,C or G
gaggagagaggaagaggggangggagagaaaaagataaannngannattaaaaatnanaaaaatagaaagaaaagagaaagctttaaaaagaaggaacaaaagaaagaaaagcctcnggngnggaggggaaacggaggcgggngggaggggagnggagacaagaaggngagagggngcgnttttgcnnggcngaggnngnnggaagggnggagaaaaaagaaaaaagcaaggggcaagaggagggcgcggagccgncaacagcgagcgagaggacgcgcacggcagccggccccacccacgccaagcggcacgccgccgccaagccgaaagaacccgacacagggngaaaaannaacgagccgacgacacagcgcaccagcagcaggaacggcgatgccgtacgaagagancaagaaaanggaaggagcagcgagcgaggcgaccangagacagacnaccacgagccgcagggcgcacagcgagagccgggccnggaggaggggcgtaagggggacggaggaaatgagatcnagcaggcacaacaaacgccgacaanaggtcgccgcgntggncttccgcggatctcacggggagcagcgacaggcaagaganaagacggagntgcggagagcgcaagaaagcacacgcggaggacagagagatggagacatatgcacgnagagaagatagagtaagcaagagtgaggacgacaggagaggacaggcaataggacgagcggaccggacagtcacatgacgcgcgctgacactgtgcgcagcgcaggaccgagagagacggagaagaccaacgaacgtacggtnancacgagacagcacgacagccaaagccgcgcggcgagcggagangtcgcgacgagtcacgggatcactacgcgacggcgcacagccagcagcangagataagacacacacgtgcagcaacgcgacgaagcgatcgtanatgagcacactcgcacgcacgcaggtgcagccatccgcaacatccgcgagcacgccacacgcacatcggcacgtacggtgagcaacgaacgacagacgcggcgcgacgatncgacgcgacacacagcctgcgggtgggccgtcgcacgcagaagagcggcgccgaccncacgaccaggcgaaacnaacgccacacaacgaaaaacaggcagcagtgacncagagcagatgacaaacgagcgcgagtcagacagaaacgtgacggaggagcgacgcacgagcgacgcagacgagacagagagcccggcaggagagagagaggacgcgcaccgcgcgacaccagcagaagagcacgcgagcgcagcacag

SEQ ID NO: 10795 - DNA, 260 bp, Homo sapiens
  misc_feature (1)...(260): n = A,T,C or G
atttgtttatttgtattanaaaaagttcagaaaacggtctcatgtgtggcccaggctgctctcaaacttctaggctcaagcaacccttccaccttagcctcccaaagtgctggaattacacgtgtgagccaccatgcccagcttaaaggcttaccctgagagtattttcatcataggacacagatgtatttttgcatagcatcctcaataaaaagagctaagttccaaaaaaaaaaaataaatggcctcgttgttctcaa

SEQ ID NO: 10796 - DNA, 953 bp, Homo sapiens
  misc_feature (1)...(953): n = A,T,C or G
atatttattataattagaatttttattagnacttaaccggatccactggnaccccaaacttattcccattgatacggataccagagcagaatcgtgccaccaggtggcgccaagatgcacccgggatggaaccgatatggctcttgcctacggaccagcgaagggccctcaagtcattcactgacctcacgacaacgtcaccccgtgtttaacgctaactgaaatttttggacctcatgaatggcaagtttatactgtattactttattgtttaaatcctaagtgcaattcatttatacctccttcaaaggatatacactcatcttacctacgtctatacatatagctaattttcgtaataatcgtgcttctcatatcatattaacgaagcagattcccttatccttacacgaaaaactataactatattacaataaacgcggattactacatgatctaacttaatgacttcctcgcactgggaacactgaattaatagagcgaatccatttcactcacactctgcatccagccaccaccaaatcattgcatttcccattaagccactagagcccataaagcctactccgtgccaatgactaccaacgacctactacgccgtctatcttcttattctctccaccttaacatagtctccaccatacacgttcaaatacaagacagcataacacctatcattatatcgatacacgccgacacctctttatcgtccgccacggtacattgaacagatagtatattagactaaatctaaattctaatctacacataatacgccctcgcgcataagcaactcactccctaaataacgtatatgcccattcacaaatatactactaccataaaatcactcacccccaccccaactccatctgtaacaatcaaactgcatgtacatcatatcaacttcacatcacgcctcaaacaacgcg

SEQ ID NO: 10797 - DNA, 801 bp, Homo sapiens
gttggtaggtggatgggagggtgatacgtgggtataggtgggtgagtgagggagcggggtggggtgggtggtagattgggcggggaggtggtggatggtgggggggtaggcgggggagcacgaagttaaggatataggtgaagcgtgaggggtggggctctgggggaatgggagttagggtgggttgtgtggggaggggactcgagtagtggggcatatataggttattttgaagagggggggtgtgggtgataaaggagtgggtgagggagtggggtgggggcggggtgggggagtggggagagggtggaggggattggagttagagagcggggagtggagggaagcgatgagggaggggggtgggggggggtggggtgaggagatgtttgggagggaggggtgctgggggcgtagggatagtgtgggaggggagcggtgtgggtggatgggcgcgggtagggtggcgggggataggtgctggtgtaggagcgcagcccggttggagtgtgaatgtctggtgggttattgtggcgtagggggtgttagagtagcgaggctctataagctacaacggatgtaactcaatataattaaattcaaattcatctagttttattttatacataaaatctcaagacaaaatcagattataggccaaggcaatgttcaaccttagttcctccagttgggcccagcccagtccttgttcgtcctcagctcctcctccgcctcaggtaagtcgcgtcctggtcaggaggacctgcgacagcccacaaagtgtcttaggggtagggtaaa

SEQ ID NO: 10798 - DNA, 823 bp, Homo sapiens
  misc_feature (1)...(823): n = A,T,C or G
ttcccaggttgcttagaaaggctgcgacagtttttaattcgttccaaatgccctttgttctggcctttcatctgtaaagttactttgacaaaaaagtaatagacagagggtcttgtctgaccagtgtgaaattgtctaatgaggaatctgtacactacactttatatgagtaatggaaacagtccttagctcgtgtactataatagtaagggtccttatttaacttttaattatgccgtaactggcaaaattcctttaaacagcttactcaaaaacatttcgtttccggactgaaaaccagtaatggattgctttcaattaaaccctgattctaaataaaagtaataaacgtcctcgatggcctaaacgaataatctcttctggcgcttctctttaatgaaggttaactactccatcctctctcacttactcactcaactctgattttcttttccgttcacccgcattcaccttctctaaggccgcactccgcgtattccctacatcggccatcacccagaatattctttgtgagtcaaatctcacaaaacgccgctcaccctagatagttccctctctcgccgtttttccatcgcttccccccctttccagcatcacaaattcatcctctctctctctacgtcacctactcctatttacaaaaagaccactactatcccctctgatacccnctgtcgccatacacattagacgcgcacagtaactataactgcgcctccgctcccctttatacgcatctcctcatacgacacacctctgccatcgcacgtcaatccttattgcccactccgcctgtacacta

SEQ ID NO: 10799 - DNA, 976 bp, Homo sapiens
agttgtcgtatttagtgagcagagttgttggcgccctttaggtgcaacagaacaaagaaagttcctaccgatacacgcaaacacatggatgaaattcaaaaacatcatgttggcaaaaggggccaggcctaaaaagggtaatcccatctttgtgaagttctacaacgggccaaactaattcatggtgcaagaaatcataacagtggctgccttggggtgcgggatcgccatggcaagagacataacaaactttgttaggcattggaatgatttccctgagcggagcggcgattcctatagcgttggcattccattacaagtattgtccaatctgctaaaatgctatcatctttcactactaagtacccgtcactgttcgtgaactcatgtcgactacacatatactaccggtgcgaatacagacagcggatcctatatttaggtgaccgaccccctccgggcgcagtatcgcgtattgtcgtgcctgaggcaagacagagggacagattaagaagtgttatacagccctctcatcctgtcgccctgggtagcggtgcgctcgctccctacttgtcacttcgttaacgcaggccgaccacaatcccgtctccccgatcatttgcgcgtacacctcccgtcacggtctgcccaaattatcttcggttcgtttgtgtcttcatgccgcgaccccatcaaccatctgcttatatgcccgtatgccgagatatcttcacggcgtgtctactgttatccactacactgagtgtgaacacgctgcattaactactaggagaaattcactaaacctcacaccgtccctgagtcaggctgtcgtctcttctgggcaaccgagtctcgcgactccctttacagcgggtatcagcttcggtgatttgggtcgatgagacgacgattctatgttattacggttccgtgagacgcccctttccagccggaatccaccacatacatagcg

SEQ ID NO: 10800 - DNA, 888 bp, Homo sapiens
  misc_feature (1)...(888): n = A,T,C or G
cgtcttctcgtgaccggtcgccggtggtcggggctcccggggagggtcgagcgcgggggcggccgggggcgggggcttgcggcgccgcgccgtgggcgggaccgcgcactccggctcggcgcggagtgnggcgtggaggcgaggcgcgtcgctcgggcgcgggcctctctggaacgctcagcggggcgggcggcgaggggcagggggggggcctcgggctcgtcgtgcccgtgatcgtgtacacggcggccatcgccganatgcggctctcgcggtctttcccggcgggcaggcggccggggcgagggcggggggtggcgcgtgatcgggctcgatcggcagggggcgggcggcggggggcggccggggggggtcgggcgcgcgggcggggcgtggaggcggggggggcgcagggtggggtgaggggggaggggagggtctggtgccctgcgggggctactcgggcatcgcgcccccggggcgcgcggcggggggcgcgggccgcggcgccggcggtcgctgcggcgcccgggggggcgcctccggctcccggccggcccgggcgcgctcccctcggctccgcgcggtggcgcgtgtggctcgcgcggctggcccggggccgcggggcgtctccctaaaaaatattttggtttattaatgtggcgaccgaatacgtagatatactcgtcagactatcttgcctgtnnccccgtcctngctcgtctcgcccgcctccctgcgcgtgctcgcctgggtggcctcgggtcctcggggctggttctcatgccgccgccggctcnccatatacgctaaatttctctctntcncttcttcctttccntttttgtgtttcccactntcaggnnttnctccntgttatcccataag

SEQ ID NO: 10801 - DNA, 794 bp, Homo sapiens
ttcccaggttgcttagaaaagctgcgacagtttttaattcgttccaaatgccctttgttctggcctttcatctgtaaagttactttgacaaaaaagtaatagacagagggtctgtctggccagtgtgaaattgtctaatgaggaatctgtacactacatttcatatgagtaatggaaacaggccttagtctgtgtactataataggatagctttcttatttcacctttttattatgcgttaactggagaaaatactttaaaatagcttactcaaaacttcttgtttgaggactgtaaatcaagaatgtgatgcaccttaataaaaccctgtatctaccctgattacataattattacttgtggcccaacaatgcctaaaccttggtgaccttaatatataagttctctgatagtttctggagaaaagagggggctctctaagattcagggccatctgttttggccctgcagatgttgggtttgggagacttaaaaaattacccccttttctcacatatggtcctattatcccgttaaaccaaatagctagatgtggaaaattggtcctcatagctcgattgcgagtcaaacaaaactgtgggttctcctcaatatatgagcgacatgaaccattgtcgtaaaaaaaagataaatgacccgaagctccatgtaataggttcgagccctctctcgaagagggatattagatacaatatctgatctccgcgtgtttgtcatcgcggatagggagtttatgaagggtagttgtgcccggttagggagatctgaagttt
